United States Patent 8,709,766 (USE OF ENDOGENOUS PROMOTERS IN GENETIC ENGINEERING OF NANNOCHLOROPSIS GADITANA) - sequence listing, part 2

SEQ ID NO: 2803 - DNA, 703 bp, Nannochloropsis_gaditana
catcttattggttaccaaagggctcgtggatgcctgccttgcttttctttacctccctccctgccttcctcctccccatcttattctttctctccctccctcactgcgtttgctgcaggcatgaaggtctccacgcttgatcaggatacgctagcaaagcacgggatcaaaaaagcggctttccaggtagagagggagagagcaaggggggagaagggggggttacagggtgaaaatcggcaagtaagtgagggagggaaacgcatatgtggaggaagaatgagaaggcaagcttaatttccccctggggctagactcaaaaggtctctgaggcctgaatcgctccctctgtcccttcctcactccctcccccatccccttcctctctccctccctccttgccctctagggtgcggacatgccggtctggctccaaaaatacacggcagaagtcctccgtttcgcagagtttgaacgtcgcatactcccttacaaactgatggagagcttgtcagacggtccgtcccttcctctcctttccctcctttccctccctccttcctcttcctcctttttctcctcgtctttccaccccttcttccctccctccctcattccctccctcccttcctccctccttcccacaggctccccttccatgtacaactattccaccgcggaccaagaggctcggactgtcatg

SEQ ID NO: 2804 - DNA, 703 bp, Nannochloropsis_gaditana
  misc_feature (1)..(279): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaagatgctgccgcaaattgggtctctttttgcctcgggaggtaaaggagggtcgtgcgctgactggtcgctcctggtacaggtgagctttatccggcctggcggtggtgcgagaagcaagacgcgatcgaagatgccttgcaggtgagatcttgccccttttcctctttcctcacttctcttttcctccccttgccccctcatttttccccctctttctctgttctctgttcctcttcttgccccgttgcctgtctgcttttcgcttttctgtcttcctccccttggtgccttgcttttcccctttcctcttccttctctcgtccgtcccgcgctcagacacgcatcttcacaagtcttggcctccctcccttcctccctccctccctccctccctccttgcttcttacctcatgcagacc

SEQ ID NO: 2805 - DNA, 703 bp, Nannochloropsis_gaditana
  misc_feature (416)..(592): n is a, c, g, or t
gaagtgaaactttgacaacgatgacggtgcatcccttacatccgaccgagatgcaagcgagtaggaatcgatgaacatggcaaggacactcggagctgatatctgcccggaaagtgccccgatagacaaattcccaaacgaaaacagacaaccgccactcgccgcctgaaaatcatctacggtataccgtgtgggcagtgatgcggcggggaggagggtgcttgtggtatggttttatcgtatatgggcgagatgggggttgggcctcggagatgtatgaggaaaggagcgccaacgccctagcacaccgcctaaaccctcgtttccccaactaaacacaaatacgggcctcgtccaccgcggttcctcacccctcttctgtcattttccacgtatttgaggccccttacgaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccttatcttctcagcgtggctccttttaagccgccgtgattcacaagcttccgcatttcctttccgttgcccacaggagaggaagagaggggaagacaccatg

SEQ ID NO: 2806 - DNA, 703 bp, Nannochloropsis_gaditana
aggtaaggtcatccacggctttcttcagccaaggaacaccacttccacaacacggtcacgcctcgacccttcccattcagggggctcgggaggcaccttcgaaatggcgggcttcagacggttcttcgggtggccggccctgggcgacaagtccgatccggcctgggtggccaaccagcaaggtaaggggatcgttccttcgtaacggcttgaaaacaaaggttatcgtgagagagagaggagggagggaggactgacacgggtggtaggcctctgagatgaaaggggataagtaacgtttggtgggggggaggaaaggaggaaggacccgatgaggagagaaggaggaggtcaaggagaaggaaatgcacgggagggaggactttgaatggcccgggacagagaggtgtgtgcgttggtaaggtaggtacgagaatgcggcctcggcaccgggcttggtcggggaggagaagagcgtgggcagtgaatacgatggccgagcacgcgtacaggcgactcgtcgagagcctcgatcgctgatagcgacatcgatattgctatcagacgaggagagaagttgctgtcgagagaagccacttgcccgcggtccacatcattgagccactctctccagctagtccgaccttccctctccctgatccctccccgatccttccttcccacaggctggatcaccgccatg

SEQ ID NO: 2807 - DNA, 703 bp, Nannochloropsis_gaditana
acttgctttgcgggagtcgctggggggggaggggggttggaaaagcagccgatggccttgaggtcttcgatttccgacttaaattcagaccatgcatcccgaaagccaggcaaatccttcttttttgtcttgcaggagacttcaaatgtcatgttagattggatctccggttccttgggggaaagcagacatgtggagggtcggaaggcgatagtgaggtcttttggtgtaggtatgctggtgtgacaccacatcacagacatacacacaaacaggccgtgtgttaggagcaggaaactaccttcgtgagcgccgtagcgcacgtggcgtaccctagattatacgcacattaggacatgtgtccattacccttgaggaactgctcgcctcctcgctgcgtgcttcatcaagtcattcggggataatgtgccacttgaacgctttttgccatccatttgtccagggcgtgcggtttgtcaagcgaggacgggagcgttcgtgtctgattgtcaagcaaccgttctttgtattgctccattcaaatggtgtcgtttctccccataactttgatttgtaggaaaacgcctccttcgcgatacaggagagaggaggtacgggcaacacacccggctgcgggtaggaaaaaaggcattttcccactttatcgtgaagcgaataaaagacattttaaaagaagaatatg

SEQ ID NO: 2808 - DNA, 703 bp, Nannochloropsis_gaditana
gaatgtgtccatgaaaatgcaaggaagctttggcgagctcaagaaaacgatggcggcgaagaaaggtgtggacgtggccacggtgcgctttgtgttcgacggggtgaccttgagtgcggagacaactcctgagcaactcgaaatggaggacgaagatacggtggacgtgtacggattgtcatgatgggatatggggggggggcggaaaggaaagaaaggaggaagcctggctggagggaaaaagcgtgtgtacgacgggcgacaaggtgcaaaggacgacagcttgtagatatgtaacacttacaacggtttgatgtattgatggagagacaaatacggcaacgatgcaggagccttggtttgttccagttcccttcttcattttccaatccggagtatatgttacttcttttcccctaacgtcggttccgcaaattgcgctctccaaactacccgcaatttgtttctttctaaattgctttgtcatcgctcgatcaacgatgtatgtattgcctccagcacctcgcattacttcaaaactttcgtgctacatgtcgcatccggagtccactttcaccttacccatccttaccctttttccatgtccactgtctattttctctcaacaaattctctcagtctgtgggatcaatggaataactctcctttccatcaataattgattaaattatctccgtttagt

SEQ ID NO: 2809 - DNA, 703 bp, Nannochloropsis_gaditana
gaggaggacgaggtagcaaaagcggcgggcccgctcgaagacgaagagctagcgcccggccccaagccgctttccaagttcatttgtcccttaacaaaaattgggcgtgtatcctagttgggcaatgctccgacgtgagaggcgaaaattgtcaaaataaaattcgaaagatgatgacgaccgacacgttaggcatcgcggcctgaaatgcaaacatgcaacgtcaacgagcatacctccgcaacactcaaccccctacactggaaaaaaatcccgtgtccgtggaagacggtgagagggggctccaaaatgtggtgagacggtcagtgcgggataatgcgcgccagggttcaaagctggttagtaaacagtgacgtcgctcaaagcgtgctgctttctacttccatttcccccccccgctgggtaataaaggggcactgagatttaatgtgtgcgagcgcatctattctgatttttgctctgcgttcctttgtgtgacgtcggtggggcgtgaagagatagatgtcaggtactgtaattcccatggatatctgggaaaggttcaagttacctcagagcacataccacataaccaccgtgtctccccccgtcacaatacggccagtcgaagcaaccgtgtcgaaccccccttcctggttacgcccgtctcattgctcatcctctgtatcacatcgcaggcatg

SEQ ID NO: 2810 - DNA, 703 bp, Nannochloropsis_gaditana
  misc_feature (316)..(325): n is a, c, g, or t
aactgtggtcataggtatggaatggaaggtggtgaatgtcaggatgaacaacaggagaaggatctggataagcgtgggcggtgcgccgatcattttgtggtcgaggggggaggcggaaagatctgagccgttcctagttcaacgaggtctatatctgttcagttacagatccgaacgcatgccctagaagaaacaacaacccacatgacacaacgcgtccaaaaagaagatgcgtggaggctcgccacgccacatgctgggcgctgactgtggtgatctcaggagttgcagttatgttgccagggggaggatgagnnnnnnnnnntattccatttttttcttttctcccgaggcccggtttccatattaccgaggccgtgacccctgtaaagtgtacctttcgctcccacccacgcgcgagaccctgaccagatcgctcttgcaccgccatatttgtgtgtgtcttttcaatcaagacactatttcttcctgcatgatctcttcataaggggccaaagccctccgcgaaagtagagcaaaaagcctcttcatccaaggctcaggagcattttggactcgagaaaaatggctttttcaatggcaacgacctgtcattccactatcatcatgacaactctaaaactttataatgctaaacattttcagggacagaggtggcatgcagcatgtccacattaccatg

SEQ ID NO: 2811 - DNA, 703 bp, Nannochloropsis_gaditana
caggtaccgcgcgacatgcacgtattcgaaatacatgacacgtgctctacggacacaggatgcactcgtggtaggttactacaacccttgacaccctccgtgtatcgagctcctgtcaaatacactacatgtccatgccacggcaccacttcaatgcacacggctttaaacaacctgcagaatgcgttacatttccattcgacgacctgtaagtgacatcgcggtcctaaagcggcgagttttatggcttcagaatactcgagctgaaggagggcacaaggagcaaccagtgcgtccaaacatgcgcgaggccttacacgcggcatccgcacaagccacgcccaccatccagtcattatccacttacccatgcctttcgtggcataccgtccccactatgtggtgcttaacaccccattggccacatggacgcataggtttagctcggaagatcattccaggctgtgacggcggatttgctttcgcgcaatttttcgggaaagggtcgacctcgaacgccgccataaatggctcttgtgtagggcgtggaaaaaaccgaggacgcgggaattgaaaattgcggcaacatgctgtgagggccccaaaatgtgttttctctcggctgtggagagatgttctccaagtagcgcaccttagcctcttacttttctccttcgactcgtaaccctccacagctccgatg

SEQ ID NO: 2812 - DNA, 703 bp, Nannochloropsis_gaditana
ggtgttgaagacgccgcatctcttcttgcacagcttgccgaaaaagacgagtttgggaacgggcgagcgtgcccgtccagaaaagggacgacgggctgcttaaggtggcgttggtgagggtggaacacacgggttgtggttgtttggggtcacgagcaccactccagtcgggcatgctcatgatcgagaagagtgaggaattcaaaccctcctgtttggtagggttgaaaaaagggaaaaagtgaagacaacccgccgcaaaacttccaccatggtacgaaaagaccttgtggcacgccatgtggacgtggtgggtgccaggttatccggcatgtgcgcttttctcgtgtgtttacgactgtctgaagatagagcgctggcggctctcggggtcctcatcgcgaccgtcactactggcagtcgtttcgagcaaatttatccgcgcattttacaaattccacgagagggttcattcccacacgtgtgtagcaatggcttcacttcgtggcgaatcttgtgcttcagggatgcgtgcgaagtttgcgacaccatggaatcgaaaaagttacagtcgtgcgtagagacgtctccacctcactagcaagtagcttaccgccggtcatcataaaccgatgatgaaaaaagaacagatttctcaccactaaacccttcgttatgacacgcatcacaggctcaccgcatg

SEQ ID NO: 2813 - DNA, 703 bp, Nannochloropsis_gaditana
cgacagatgagaaaagaacccctcggcaatcaatgctagaatataggtggatcaggacgcatatcgttcgttggtatcacaggattcccacggcagcatggtggcacgcgtctcacatcacgtcttcgctcaacctatctgagtcacttggggcgatacgaagcttcccttttgatgctttttatcccgagaaagaggtgttgatgccttcgcagtccagcgaagcatcggatacgcacatttagagttgcgagggatttatggtttcggtgtgcgtgctttatatggggtacacttatcgtttgtgtggaaggcaggtttatcgcagctcgaacgcaactacaggagcaggacccttcctttccaaacttttgtaagggtagcacgtaccaattttggctcacaacagtagtccaccgatatacacgaagaaagtgtcggcgtttgattcaccgtccctctcagcaatatcttgttttttgtgatggactgtgtaaggggtgctctttcctcttaacctcccccccccgcccggagtggaaaataggagtgcttaggtatcaaagacaatatgagtgattagtattatgggttgagaataagcacaacacgcctccgttatttcttcttccttacaaaccagccggacaagcccctgcatccatgaggcaacctggggaatccagcaagcaatggtagcatg

SEQ ID NO: 2814 - DNA, 703 bp, Nannochloropsis_gaditana
ctcgatcatccacaggaaagacagtcacaatggcctgcgtctggagcccatgggcgttccgcccacggcctccgcactggtatgggacggcagtgctaaggttgctgctcctggtcggcttgcttcaggtgcgtggtgactatggtatgacacagcgatgacactatcccgttgcatgatgcgctgatcaagcctcccaacgccccccacaggttccttgtgcggccggagtgcccttcgcgtgcagcaagcccaacatgaatgacggccagacgtacatagtggccgctggcacttacacctgctcgagccccttgctggtgcatggcaactccagtctcatcttccaggaccaggtaaagatatcggtcccgtcagtattagtgagccaggccgaacaaccgaacctgacgtctcgatcccatcgcctgccaaccatctcaggacatcaccctcacgatcccgggcatgatcatcgaggatggcggtgtcgtacagattgggaccgaggcccagccaatatcgacggagcacattacaattaaagtatttggcgcgtggttggacccttgcctttcctccccaaacaacttgtacgccacagactacctcttctgtccaggcagcagcgcctactgctcgtcggcactttcctgtggtaaaactgacaccaattgcaacggcaactatcttgacgtgaatg

SEQ ID NO: 2815 - DNA, 703 bp, Nannochloropsis_gaditana
tatcccgtgacctttacctcccggggcttcagctttaagaacgtcaccaatcggcacttggccctggcgccgtgggcgaagctcgttcgtgtacgtgaaacgtttttatgatagtaatgtctttatgactttacgatgtgatgtggtagtaatataagcgtatatcctccattacaacccacttgctgcccaacctacatatgaaatctaccaggatcttggcgacctgcccttcgtggacattgggcacagcaacttactcaccgtggtgcaagacatcgatggcacgctcaccggtgcgcaggggagcgagggccagcccgtcatctcgaccacgtctacacgctttctgcgtccccctcagtggcgtatcgagtgccgctcgagcgagacctgtggaatcagcagcacggcctacgcatctgcatttctccagccgctgacctcggtatcgctctacaacggtccggcgggtgcgcagcagcaggactctatggggtactgggaccagtacagcagccagaagtaagtgcatgcatgcaagggcgtccccacgcttggctttcgttctatttccatctttcatcacatgcccttttcgcacgccagtgtaaatgttgctctgtatcgactctcactgagccactcttggctttcgttctcttatcatttttcattacatgcccttttgcacaccagtgaa

SEQ ID NO: 2816 - DNA, 703 bp, Nannochloropsis_gaditana
ggggccgacaaaagtctatcacctgcatttcccagatgctgacggctttgtccgctgcctccacagcgcgtgccgccaagatgtcgtcaaggccttcggcaaccaggcttttccgcaattcttcccgatttacgctgttgcctccgccaccagcatgtagacgcggcgcccgaggcggagcaggaaagatcgagacaaacgcaggcacgggtaccatgattgccagaacggccaacagcaggagtctcacatggtttaagggccctcttctcctgactgaccaatgacagggctctgacatctctcgacgtccgatcgaaaaagaaagcagaagcctactgcctgtgtggtttagcggaaaggggggtggggaggtaaactatcgtgtctttgatagctgtccggccaaaacttttacgagagcgaagagtcaaacctgtcgtctcacaacaaaaaacgactatccacgacatgccttggtgcacatactgctcgtccgacgcaccatgcacgggcataggccagcctttcaccggagtatgacgtcgtcggccgtggcgattcatgttccactcgatacagcctcctttcccaaacccggacgcttattccttgctggtgattaccatgacaggcgtaagaaacatgccatgacaaagatgcggcctacctcttgtcttcactcggaaagttgacgtccatg

SEQ ID NO: 2817 - DNA, 703 bp, Nannochloropsis_gaditana
agggagaggcccctgcacgtctagggcccggaggatcgagtccggtgaggactgccggcatatgtcagggtcgcagagaacatgcgtcacgccttgtggaagtgatttgccgacactgtccgccacggctttggccttctgaaacatgggtggtattttcgccctgggaggaataattttgccaccttgtttttccacggccttccgggcagcttcagctatcttgctgctcagccccaaaaaataagcatgaacacctttgagaaacaatggcgattctcccgatgacggtgccattctcatgcacttttctgaatgggtcaggaataatcgtcaacagggatgctggggttcattttcctcctccaaggtggccgcgtggtattaggggagaccgtcgctgttcccccgtcggcgacgctgcaacttggggggtttacatcgatgtagccgcggcaactttcaattatgtcttgtattggatagttcatgattttggagagtcatgatgtgcgccaagtggtcaggtgttagggtccatggaaacgttttgcccgtcgtggaagcagctccgaggctccctcgaaacatgaatccctcgatctttacctattcaagtgtgttcgatttttcaaaagtagggcatgtgatacctgcccttgacatttcccccctacaaccctgtaattcagtgtgacggatg

SEQ ID NO: 2818 - DNA, 703 bp, Nannochloropsis_gaditana
tgaagagcagggggaaacaagacgtggggggaggtgcgacaggcgacacagccggtttcgacatgcccctgggggtgagagtccagcaaagaataaaatgaaccaggaaggttttgccgggctcttacaggcctgacaaccggcacggcgccctgcctgtgtgtcgaatttggttgcgcgttggaattaatccgaaagtgaaggaagggaagcgagcggggggctagaagtaaaagtctgatcgactgtctctttaccgattaaagaaggctgcacacgccaaaaaaggcaaaaatacaacgcgacacacatccatgcaatcctttcaaggtacctcaaattttcaagataaagaatcgacgacgggaagagggtgataggaccgtgccgcacgagcgccgcagagggatgccgggaaggaaggtggatatgggccacggccccaacaacgctttcgcgccatatttgggagccccggacatgcctggggaagtaaaatatgcctccagtccatgaacccaacctttcatgtcgttgaaaggaacgttcctgcggaccatcttgcggtgctgttgcatccgttgtgttccactcgtaagtggccatcgacaaatttgttcttgatctcacgtacagctcatcaccccacctttccacagccttcgttgctgtctactcagcccctccgcgcagatcaatcatg

SEQ ID NO: 2819 - DNA, 703 bp, Nannochloropsis_gaditana
gctctctaagcccttttggggattgctgataagccattccagctgtcgtgagggatctctagttaggcgttgcgctattcctttcgcggcttccgggggatagaatccttgaatatgcacacagcaagtacgatgggcgagcagctgtccagtaattgtgtttgaaaaagcttcatttactatgtatccgtcttgaggaatggctaaaccctggcccgcactacaatgaaagaatatgcgcacatacctcctccaaatgctcccgtttcaaatttgttgccgtgatgataggcttctgtcgtataagatcttgtattcgcccgccgaaatgcttttcgaacaggtggacggcccgcgtcagcatgactaaattggtttatggataacctcctactgtctgcaatcagacccggagtggcttaattttgagacaaatttcgtcctccctgacccgtacgacttcatgggcgtaaaaacagcaacaattttgactgtggccccatatattgccacggatgtccctgttggtacggtgaagattaaatcagaagtcaagcaagggcgttcatccccatcgccgtctgccccgtcccagtgggcggagagggggttccttctgtcgcgaaaagaccaacacaacagtcaacccgcctttccttttccacagcgaacaaatcacagagcttaagaagaagaagagatg

SEQ ID NO: 2820 - DNA, 703 bp, Nannochloropsis_gaditana
aagctgcgtgtcgtagatattttgcggtaggtcgtagttgtacgtatgccaaaatgattccttccacctgccgccctcttcaagagtttctcaaacatgggtctgcaccaagggtgatatctccttgaaaatcccactctcgtagttttatgtttgttatctttcctttttctacccatagccgggcctatctatctatctatctatcgaattacgtatgttcttatgtattttgccattcatctaacctcctccacagagcgcctcgacctttcacatttcccggccgtacttagccaataggatggaaacgaagcatggcctttttcgattgacaccttctgtaaagctaattgtcctccttgtgagcgtgtggcacctttctttcaatttcccctctacgtgtctggcttctgcattctatctccaccctaccctccccaccgccttcatccgctgtccaagcattccatcgttcaacacgtcgcctaggcccaaatgcttccctttcgtactctgtttctcctcgacctcttcatcacctccccctccctccgtcttctcaccccccatcgtcatccccgacgcgcaacccctctaccccttgagcgccttcgccctccctcaccattttctggctgcaggggaactcgaggccgtgctgttgccgtccgggctcatcgaagatcggatcgataagatg

SEQ ID NO: 2821 - DNA, 703 bp, Nannochloropsis_gaditana
cgaatgtcttttgacgcatgaagtagccgccaaaatgcttttcaagccttcattaagaggtatatggaatttacggaggcggttgacgacgtcgccggtgactcaactggcgactgcctcatagtgccgaggcccagcggtcacactttttgtcgcaagcttaatggactcagtgatgaagcacggcacatatctatagtacgctaattatatcctagtagacatcattgagaaggagacctttttcgcagtgcggagggtgtgaagcaatttgctgatagattctcggccagagtgctatatgcaacccattccctatgatcagtcatttttggggcgcaccagcgcaaacactcccgcaaaaatagtcccctgtgcaattatggtatgcatatgtatatctcacacgcttgtcaatctaaatcaagaaaacacagggaggtagtgtcaaaaatatgcacgatgtggacgatcacgacgaactgacaggtgagtgtttctgccggtaaggtacaaagcatgtatttaaaagtattctgtgattgtgaaggcatggaagggaattgaaagcgagaatataaacatttttagagcgttaccggtcgctttttacgaaattcttgtttatgtgtatgtctttgaaggagctacgggcctgccgcgccagttgaaagtattggactgtaaacttcgcgttttaatg

SEQ ID NO: 2822 - DNA, 703 bp, Nannochloropsis_gaditana
cttttccttctactttttagccccgtcacttctttcttacttcttcccggcggctctccagggagaccttactcttcgagcaacattccgcacactcgtgctctttccgcgcccttgcgcgtcgtgcgcttcggtcagcagcatcaggacggagcgggtgacatgaaaggttgagtctcgcaccaccatgaccggggggaaataaaaatgataactgtttaacctcctggatgctgtctgctctgctttatgcttgacttttcgcaaccacttggccccggcacatgccggtaaattcaagcgcgctcattttcccttactttgtctcttctttttgatttaatttactgggttgcgcgtcggtggggaatgcagaggcctccggggggaagaagggcgcaatgggtggaggaggcagtagcacgggcagcgggggcggaggcaggcgacggcctttggtgattggagtcacagggggaagtgagtcgggaaagagggaggaaagagggaggggggaaagaaagagggagggagggagggaaggagggacggtaatcgaggaagctatgttgaaaagtaagcagaggggcccgcgcgcgtgctgggggcaagatcgtcgcggatgaccgcccccgagaatcggatgacatggcgctcaccatcacttctttctctttacccagttgcctccgggaagagcatg

SEQ ID NO: 2823 - DNA, 703 bp, Nannochloropsis_gaditana
caagtaacattcctgttttccctccccgcctcacaccctaaatgaacgtcctgttcttgtcaccatgcccataccattgatgtatggctgttggggtacgtgggaactaataccacgtgtctggtggcatgcgtgtgccttgtattggttggaaagtctccgatctcccgcatcgcaagaggtgatgtcttatcccatgtcgattttttcctcacccctcaaaactccttctatcattgccccacctgcctaccactaggccatgtcggaatcgtatcgaagagcagtaggaggacgcctcaagatcggtgggaaagaggtggatgtgtaagtaaagactgggggaatgtggggtggggcaagggcgggagctgacataggtgagacgtcgcagacatcatggtatggcggtcagcacgcgacacaaagaatgagacagtcctgctcatttcgtgaatcatggcgaaggttccggtgctcattttcaaggggaagagggaggccgtcgccgatgtattgaacatcaagtcgcaagcacgagtcttccttctgcctctgattatatctgtcctcgagtacccgcaaagtgcatgtctcaattcttctgtgacataagagagcgttagctagccctgtactgtatcttacatgttccttttcctctccgcctcccttcttgggggttctccctccttctcaaatg

SEQ ID NO: 2824 - DNA, 703 bp, Nannochloropsis_gaditana
acttgaagctcttcttatccaccatattccgtgtactcgttgtgggacgcagacaggcaatatctgcattcgaagatctgtggacgtgtaaatgtaatgagttgccgcgtctttcaagtattttatttgtcttcaggcagggcaagcttcctctgtccttcaagtatatgatctcgcctcgcaagtgctccactctctttaaccagagcagtgttccgccattccttgtgttctgtaccctgtctaacgaccccacaccttccgatgcaatacatacaggccattagggatgcaactcgtgctatggtattttttgtggtagatagaggcagatgaagggcagaggcgcgaggacggggccctaccaccacgtaccagtactactagaagtagccgcatttgcgttcttgcttcagactctccacatgtcttctcaaactctggccgcccgatgtagtctttccaagaccactgctcctacagcctcacggtcgtgctctcatttggctgccttgccgcagcatcgaagcctcatgcttcctctcctatggagggtactttcactcgccccccttttatctcgcgtccattacttctcgaccgcggcactgtccagcgcttgtgggggatagagccagagggcattacttacattccaccaactgtttgggagactgaagcagagaggcacaaggcgcagatg

SEQ ID NO: 2825 - DNA, 703 bp, Nannochloropsis_gaditana
atctttctattttttgggcggtatatttgccgtgtgacgagctttcaaattaacgaaggttggattccattcctgacacgggcttcgacgtacgacatttgacacattgaaacgtactaaatgtgtaatcagacttccgaattcattctacgacaaaatatcacaaatattagaggtgtgacgctgttgatcctcgtgattgtatctctaactcagtaaaattatatcttactgaatcacgagacataatccaaatatatcgaatccacctatacagatagataccgtcctagaacagcgtcaccatggttagatattctacgccggcatacagagatagcgaggatgatcatcaaggtggtcatcagctcaaaatactgtcgcctttgccccgtgtcccctgggaccttccgccactcccatcgggtgctggcgcgggtgtcagccccccctcagtccgccaatgtcaccgcgatcctcaagatgtccgtcacgaggctgcgacttgtcgtcccacccgcagccagaaacgtcgcagcgtcgccgatgccaaggagtatacccaacggccagtcgaagaggagagggaacggagcctgtcctcgtcccaggggagccgtccaccacgtctgtcggtctcccggcacgaggctccaccttaccttgttggaaacccctttatattgtccggatatcgacgatg

SEQ ID NO: 2826 - DNA, 703 bp, Nannochloropsis_gaditana
agcacgagaaaggagtgttagggtcgaggcgagggccgtaggggacagccttgatgccttcatccttatgctgcacaccgattcgtctctgagaaatgacacgtaattatatcggcaaagttgaaggggaagggaatgcttggctgcgggcctcgggtcatctccctggctaggcctacctcatgtgggaagccatggccctttcttttgcaccaaacacattccgtgacgtccttctcctgtccaatcgataagaatcttacgcacactgtacgcctatcatcacacaggcgtgtttacaaccgtgctcattccggcccggtaaatactccagcgaaggtacggaaaggaagaatggccagccatcacggcaagcctaagaaggacgtgaatattttaagtgatgaaacgataagggcatgtgtgctacatcaagctatgcctacatgaatgctcttctttccgtgtgaaggcttcatcgagggcaatgtgggctctggagatgctgatttgcctttcatgaggggccgtggaaatgggttgatcgaaagccttcgggctctcctttctgctatcgtgtctccgcccccacacactaaaattttgcgcgttttcgggcgtacggggtttctttgtactgtagaagttgttccccacgtctgacgagcttcttctgtcttcatcattccacgcaactcagatg

SEQ ID NO: 2827 - DNA, 703 bp, Nannochloropsis_gaditana
cctctcgcacagacaggccctaccagcccttcatccccgcggagcccctgccgtcagatatgtcacatgcttttaaaaatcatgcatcaggagtgaaatcaggagagtttcctcgcaccacgcaactccactgcgcgtgggacatgccggggggtggttcgaaatcgaccatgcagggcgaatggcgagactaggaggacggaggcgatgggctgggagcacgccacactctgtgtcggcgcttgacaccaagatcacaagctcgagcaagggaacgtgcacggcgtcaagatgcgatcgatcttgagctttgaccaaagacatggttacatgttcccttgcttcgcatgtttgcagtgttttgtggaggcctctttgtcctgtgtgcccgagcccgagtgccttggctcttgggaattttggcagtcttgggtggcatgtgggataggttttccgagttcaatttcatccccggcgagtcggcccacaatcccaacaacatgtcaacaatatacaaggaaaacggttcacatgtgcgtactcattgtactcattgtttcattgttcacgtctttctacagcgtcgcaagtctcagaagctaacgggaggttagcgcagccaatgtagggccgcaaacttatctttcatcagagctgcacaaacgtgaccgaaatttctttaccttttgtcaactcgagcatg

SEQ ID NO: 2828 - DNA, 703 bp, Nannochloropsis_gaditana
cctcccccccccgcctcgtagttctgtaacaattacaggcatattcactttgtcatgctgctataaatactatactgggcatttctgagcctagggtcggcagcgtgtcgaaatcgatgattgcgggcacgtactgaaccccgtttcttccacagtcatgtactttttctcttcccgaggcccaggatcaaggcgtgtcgttgaacacgtcctcaaggtaagcgagacagtctggcgaggatctaaggacgtgaggtgcatctgtgtcggagactttccaaatgaacatttatgtccgctcttcggtgtaggtctcgattgaggccacgcatttgtctttttttcccctcctcgcttttccctccggggcccctcatgtccctcacgtaacgcccggcccggcccttcccttgaacaggccagtgcctgtataaccgcagccgcgggtgtcatggcgctgaccacgccttactattcggcggagaacggaaagcgagggaccccgggttcctccttttatttttcctctccgtgccgtggccccgcccgggcgcaaggtcatcctgcttgggtgcactcgtccgaggaggaggaggaaagagggacgaccaatgatgacgagaaacaccgtcgcttctataggccgccgtacaaccggtcaggggacaagggggaaaggggaggggggggaggcaagcggatg

SEQ ID NO: 2829 - DNA, 703 bp, Nannochloropsis_gaditana
tcagaaggtaccgcgaagggagcttcagaaggcgccgcgaagggagcgtctgaaggtaccgcgaagggagcttcagatggttgcatggttggcgccatagtcggggctccattcgatttcgttgtaggcgccacggtcggagctcctgtcgaatgcatcgtaggtgtcacggtcggagctcctgtcgaatgcatcgtaggtgtcacggtcggagcgcctgtcgaatgcatcgtaggcgccgaggtcggagtttccgttggctgcatcgtaggcgccgaggtcggagtttccgttggctgcaacgtaggcgccacggtcggagtttccgttggctgcctcgtaggcgccacggtcggagcttctgtcgaatgcatcgtaggtgccacggtcggagctcctgtcggctgtattgtcaaatctggtgtacgagggacttgtgttggtgaaatcgaaggcgcgtcggtggttgctactattccgagggcaaagggactgaatgatgtcactctaccacacaagagctcagattctgaatccacttctgtggtcacatcgtcccacgtgtcgttgataaaatgaaagagccgaggctccgtgccccttggaaaagtagatttagagtagggcaggcacagatcaatatccccgtcaaaaatagcagtagtgctgatgaaaatataaactggcggattcccaagcgaga

SEQ ID NO: 2830 - DNA, 703 bp, Nannochloropsis_gaditana
acgtggacagtacggtcagggcactcttcctttgtcctttcgggtcctccatgacagtggcaatgtacaacgacaactcatggttgtttgggttaaattcttgttgtgtccttgagacaaggacctgctttatttttgtcaggaggaaatcattcgatcgtagtgggcgagcaccacttgacttcgcctgctcccctgcagtgctctggtgcacagggtttgtggcgtctgaatgcgccttggacctataaaaatggcatgaattaaaaccgagtacatatttcttgttccgaagatgcccctcaagagtctgacgttgggtgctctggattatttcatgtttgcaaggtataggcgcaggcacaggacaacctcctccctcagtctgctatctctcgaaaaggaaaacttgaaatttgtaaagtctggaggtatcgcggtaatagcactcacaccgtgaaaatggcgacaactaaatgcatcatgctcaatctgactaatgttgatcaggactcggacactacgcatgaatttatcccgtcccagggttgcacaggtcctccgacctcccacttgtgctcgatttaaaaccttttcgcccatcgtacccacgttttatcacagaattccacgtataatcttccaagagaggcacaacttgcagcagctttgacagaggtgacttgtcccaacctcaattatg

SEQ ID NO: 2831 - DNA, 703 bp, Nannochloropsis_gaditana
caagacgagtgcatatgcgcatttaaatcttcatgtggtatggctgtggctttgggggcattttggggcaagcaatgtagacccatgcgagcctcgccgactgccccgagagagcacggaacatctcacaacttggtgagggcagtctaagtatacaacctcctgtatctacacgaatgaagacgggagctcttccgtagtatcgttatgaaatgtgacacggctgctggagttacatcgcgtcgggctgggaaaggagaggtcgtcttttacacgcgccgaggatttagcgggggatcgttgtccggcgtcaaaaaaaaaatgctcgatgcgggcttcccttaatcttctcacaaattccccttttcaacaaggcacccacgcgccttaataaggtcgaccagttcgcaagtagtggaggctttggcttaatttgactttgtcgatgatttcactcgtgactggcctgcctcatgtgtccacaggcttgtatttcaccggaacgacgcgtcttgataaggcatcgatagggacgtcatgtccatgtctgcatctgggccatccgcgatcgcctccggctttgcaaacaaattacaagcgaccatcatcagaagtgggatgctgaagacgaacgcaggcgttttgccccgcccctctccttcgcttttctatttcccaggaatcacgtcgaagcccgtgcatg

SEQ ID NO: 2832 - DNA, 703 bp, Nannochloropsis_gaditana
  misc_feature (691)..(700): n is a, c, g, or t
accgttcccattctttgaagccatactcatagtatttcttgccccgatacgacgattcgctcgcagttttcccgttcaaatgctcaatcgggaacacgtcgatgacgctgcagacgctttcaacaggatatccacaaacttcatgtaggtactggcaccagcaagcgtctggcccccaaccactcacagcatctgcatctatcatctcccagtagcaggcgtaggcctggtccaaagaaattagagaagttagggggaagggtagcgataaggataagaagataaaaatgcaagagtgaactcgctcgctgatggttacaggcattgtttgcgtcgaatggtttttttcccttcttcttcccttcctacctcctgcgagaccgagtagagcggcccattttccaccacgctggtgacacgatagagcgtgtcgttgtgctctcggcagacatcgtggtcgctggagcgcccagcctgtcgagtgaaaaggaatacgagaagcgaaaatcgggaatactgagcagggcggcttcttctctatcccctttcatgttcaaggtccctcctcgtatccacgctccacatagaatagaaaaggaccaatacatggatcggtgcctttccgagtccctcctttccacgttgctcttcctcgaccccaagtaccttaattatggcaggttgagctatnnnnnnnnnntcc

SEQ ID NO: 2833 - DNA, 703 bp, Nannochloropsis_gaditana
ccttccaagaccacatctcgtccacaaaaacgcgtcgcccaggttcgcaaaccaccgaatcacagcaacaataattttgtgcgcaagtcaattggcgggttggggggccgcaaccacggtaattggtccccggaagcgtggagcatcattttttaaaaggcgttccgagcttgctggggctatggcctgcctgagaaatatgagccgtcggggtggtccacaagatgtggaaataaaaagacgtagagaccaggtggacgtgcaccaggcagggcatacagacgtagttggaatatggacctgttgtgcgtgtttccctgatgcgcgagggtgagcccggcctcggatttaggggttgctttgctttcttttgcattcctgaaccctcacggactgatatacgcgagccaccgggttcatgtgtatgttgaggcgccccgaacttgacgttgcgcgacgtcctgcccgtgcccttcaggagcatgacgacgcactagacagtgtgtatgtgtatctgtcctccattctttgcgtgggaatttcattattttgtgcgggcgggcttgttaaccaccaccaccccctccgacgggccttgccacaacgtgtcttcctgggcctccccccctaaaagatgacaagcaccgcgaccacattggcaacttgcgctcatcaaccacccacatcctacactccagtcacg

SEQ ID NO: 2834 - DNA, 703 bp, Nannochloropsis_gaditana
gctctcgccctgcgcggagggtaagctggttgcaaggatgtctggggagagggaagagcgaagcaggccgagtaggtggcctcgcgcacgggtgcgaagggcgtgcaatgaggaggaggacgaggaagctcccagccctagcccatccaaaaaaacgagttctgcgccgtgcaggaaggcctcggcgacagtcaggcatggaagcctctccatgctgccactcgcttcgcgatgccgtgtcctttggtcagtcgtcgtcgtcacaaagctcgcccaggtcaggaggtctctgagcgaaatagccggcacggccaaggacgacgctcgccccttatctgcccctttttctcccccctctcgcaaccagtcgacaaagtcaagcatcgggtccacaagggctttcaactccaaagaaacggggagggatggaggaagggagggagggagggagggaggggccagaaccgagagaaccacggatgaaacgtctgctctcgcccgcaaaggagggacccaaatttcggtgaagcgagagcgcagcgcaggtgagagttccctctttccgtagtccccccctggattcatcgtcgccaataagcgaaatccaggagccgcaactacatgactgtcatcttctccctccctccctccctctgagcctccccccttctcggccaaggtcagggaacgcccaggctccaag

SEQ ID NO: 2835 - DNA, 703 bp, Nannochloropsis_gaditana
  misc_feature (1)..(652): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggagggcgggcggaaaggtacgcccacggcttattcgcaggcagggatg

SEQ ID NO: 2836 - DNA, 703 bp, Nannochloropsis_gaditana
tgcgactgaaggatgcgggagtgtgatgtcatgtcttgcatgtttttagcggcctttcgaaatgaagaagccaaacgcgttcttggcgaggaccacgtattcgttaatttgcacttgctgtcgaccaggcgacaaggcagctttagaagatggctcgaggcccgacactgtcgtttccgccctgacatacccgtccaaaggatgcatgcgtacgcccagaggcgtgatgctgttgctgatccgaaattcttgatgcctctgtggctccaatccttctcacgatgatagatctcaagaggcaacttcgccgtgcttcaataaccacctgtcccgtcccattgacacatttaatagggccgtacaacatgcgacgcacagtcacgccagcagcgtcgtcattatcatcgtcctctccagcttcattgtccttttggggtttttctagctaccatggagctacagcaatattggttattgccgttactgccgctggggcggccctacattacgtgtatcaacatcacgacttatcaccccagaaacgacaatctcgtgcatatattgacgctttgcatcaaatagcgcgttctgcgggtgcagttcgacaaatttctgcgctgacaccaagtgaggcggaagatgacgagagccgatacgctcgtcgtcatgctttttttacgcatttttttacccatgttctcgg

SEQ ID NO: 2837 - DNA, 703 bp, Nannochloropsis_gaditana
ctagcatacgcgttcacaagcagagcattggcagcttgtctaatattgcagcctacgaccaaacggcgagaggccagaagcgctgataccatggttatacccctgtcattttgtgggttgatagttttgacgtccatatcagattttgtggggcacaaggtttgcgacagggacaggaatagtatctcgtgctagggtagagtagaaggcaagagaagagggtaggaatgtgccacgcctgtctcatggaccgaaagagagtacgatcactcgcaacactgatatttttgcccgagaatcaattctttgaagagtgttgcaggctaccaaaggctgactgagtgggctgcgctcttaccactgtcgtgccgtatgttgttgacgatagaggaggtctgtgcggctagagatgcacgcgagcaagcgtggatggcaggcaacttctgccgagaaagaagggacgttaaggggtgcaccacgcggacgtctcgctattcccctttgatttctcgtgtgagtggcaagtcgggtgtgatggtacgcatgaagcgcgtgaatttgtcgtgaacattgtgcgatcgatcacggccattcgcctcctccggttctctctgcttctccgtctcctccgtcccttctatccagccactcacgttcacggtacaatgttttttcctcaacacgcgtcttcacagcaatcatg

SEQ ID NO: 2838 - DNA, 703 bp, Nannochloropsis_gaditana
tgccacgctgtacgtccaatcccaggcacatgctacgggccgcatctttgccgtcctcatgaagcgggccgtgggggagaaggagaggacagagcaagccctggagggcccagagcagctcaagatcgcgagtgatcgagcctccctccgggtccacaaaggtcccgcccatcccatccctctcgcgggaccgcaaagccaatgcgggtaaggactctgcggcatgaaagaaggcaaacgatgcttttcctcgacccactttcagcaaccgtgcccagaaagggttgggaaagccaacatccgccccagatagaggaagggagagcagacccgcgtacgcccgcgcgtacccctccctaagagcagcctctcgatcgagtccttgctccatgaggcaaccaaccaggcccccccaccgcaccaaggcgccttgcaatcgccatagccccggggactcccccctccgtacatcagaagggaggctacttaccccgttctcccccgccaggctgcttccttttttccctcctttgcgttcggcgagctccatcagcactgcatgcatttcgaccatgcccgcagccaggtccagggtgcccgccttccccaacatctgggccacagccagggtcaagggcccgcctagagccatccgcgccgtccctcccccttccaccctgccctcctccgtgcccccctcggc

SEQ ID NO: 2839 - DNA, 703 bp, Nannochloropsis_gaditana
ccctctcgcgggaccgcaaagccaatgcgggtaaggactctgcggcatgaaagaaggcaaacgatgcttttcctcgacccactttcagcaaccgtgcccagaaagggttgggaaagccaacatccgccccagatagaggaagggagagcagacccgcgtacgcccgcgcgtacccctccctaagagcagcctctcgatcgagtccttgctccatgaggcaaccaaccaggcccccccaccgcaccaaggcgccttgcaatcgccatagccccggggactcccccctccgtacatcagaagggaggctacttaccccgttctcccccgccaggctgcttccttttttccctcctttgcgttcggcgagctccatcagcactgcatgcatttcgaccatgcccgcagccaggtccagggtgcccgccttccccaacatctgggccacagccagggtcaagggcccgcctagagccatccgcgccgtccctcccccttccaccctgccctcctccgtgcccccctcggcgtcttcatcgccttccagcaccgccacttccagacagcggtttcgcatggctcgagacacctcccccacggaggggtccatggtcaggaacaagcggaagctcgggtgcggtcgcaaaatgcgaggggcgggggctgcattccgagaggaggatggggaggtccctgcctccgtcaa

SEQ ID NO: 2840 - DNA, 703 bp, Nannochloropsis_gaditana
atacaaagaggagaatcttgcccacttagctacccaatgtcttccattttctctcttatgccatgagcgtcgtccgtagaagccctacgaaagtggttgatagagtgcgcgtgccaaacgcctccccctcaccctcctccttcccgatccctcacgcgtgtgccccctgatttccatgctcatgatgcagcgatgtacccatgaaacaactcattaagcacctcgaccctgggaaccgtgccatcattcaagatctagacgagacacacctcttcgtggacgccaatgccggtaggtcctaacctcccccctccctccccttccccgtccatttcctccctccctcccccccccttcctcccgattcccagcctcaaaaccaatcgctcggcctttcatcgatacagtgagcacaatcaaacgggagatcgaaagcttcgtggacaagcacgtatacgcccctacgcctgacgagcaggctcggagtggcaagccgggcagatagaacgctcctactccccgccctccctcctactctccgccctccctgccaaagcctctggcatccgggcatgtggagacaggagggcgcgtgcttgaagacgtggcggagggaagacagcctgagggtgggaggtagaggaggagtgcttcccacacgggacatgaagggggcacattccgtcgtggtggcgcgggcatg

SEQ ID NO: 2841 - DNA, 703 bp, Nannochloropsis_gaditana
gccaaataccggtcctttgtcccccgattctcctgtgccgccccatcttcttcgacttcatcctgctcctcccataggacagccatcaggggcccgtcctccccccgccatttgccctcttcatgcgtcgagatcgatagagccgtcgtcgcctcaaccaaggctcggatggtgcttccatgctccgatttcagcgcctggacaaagtgctcgtctacactgtcaatgccggcaaagttgtaattgctgatttttttttgtaggcatagttgctgctgaaagagcagacacagggccaagtcacgtagactggcatggcattcatccgccgagagggttgaaggctcaggcggcggttttcgggcaagatcttgccttatgtgctccatcgtgagtacaggggcagccattgtttctgatgtgtgcctggagggagggtgggttgagcacctgctccgttagattgttttttgcgagcttgttacagagggcccgttgcggggggaagccaggcgcttggcgagtcaacgtcccgtacgtgcttcaactcaccctccctcgaaactctacccatctggacaaaggaaacctcggaaacggaactagcacatcagttgggcctaagaggcgtccgtaagctgtgcctgcggcttctcagcacgtggctggcgggaagacgctgagaagcgcgtggggattgatg

SEQ ID NO: 2842 - DNA, 703 bp, Nannochloropsis_gaditana; identical to SEQ ID NO: 2066

SEQ ID NO: 2843 - DNA, 703 bp, Nannochloropsis_gaditana; identical to SEQ ID NO: 2067

SEQ ID NO: 2844 - DNA, 703 bp, Nannochloropsis_gaditana
cggtctctccctgaaatggccagtagacctgaccaatccgcttcctcaacggccatcaagcaatacaaaggatgaatatattgatcagccgttgaattgtcgaaatcgttcccgcctgaggccattctagtaggattccggacattatttccccttttagtatacgctggcgatgctgcaacctcaccattcccccatcggtggatgtggcaatgcgtgtcgacaaggatcatgtgctgtcgttgccgaaagcattgtgagttttgaaaacctcgatatatcagctgggaccgaatgccaggctgaactcccctcgcgtacctttcctgcgggtcggggccaggaagaactcgccttgggtgccacggcaagatacccgtcgccgcacgcattcgtcccgcttgccctgcaaaactaccaacgatggatgcctcccgttcctgacgcaagaacttctttcaattttgaaagtgtgcaatatagaaaactctgcagcggtgcggtcggcaggccgggggcgggaagtgtttacccactcgtctgcgcttcacgcgcctcctcccatcacaagcaggacttactcccgaagacaagaagtgagtgcacggtgcaggctttttcttagtctctcacacaccctctccgactcctcagccttacagttgcacatagaagtgacattgtctgcacgtggggcagtatg

SEQ ID NO: 2845 - DNA, 703 bp, Nannochloropsis_gaditana
accacgttcctcatagtaaacatgcatgaatgacgcgaggatggctttatattttgggtcggtgcttggcgaatattatcccccgttgtccgtctctgtccgtttaagacatggactctgtctcagtgcgctacccccgcttatttcgagttcattgtggaaaaagaaaaatttcacttgaaaaagactgtaacttgatctctacaaattatttccttgctaaaataaagacgggaaatatgctttttcgaaagacgtaatccgtggtaccccgtaggtttgtcgagaaaagtgatttttctgtgagcgtataccagctttcttcgtcaatttatattcaagtcaagaagaagaccttaaccgaaacaaactagtttccaccacgccgcctacgcagctaccaagtcgggctccaagtcgggctcctgagagctcgagctcgctgaccgcgaagggctttcttgaagcaatgcactcgcagcggtctcgcaatgcactgaacttgtcgagtgcgcgcggcgttgtgcctcctcatggtacgggaatctgtattttttcacctgatcaaacggcatggcacatgctcataattccaaatgtgtctgactgtcgtcccattctcaacataacaacaacctcctcccttcggacctcgttcaagcgtgtatcatattatcttgcttaacaatcttcgactgtaatg

SEQ ID NO: 2846 - DNA, 703 bp, Nannochloropsis_gaditana
tgagatgccttgtgcgggcccgaggtcaagctcgtggcagaaggggaaagctcccccttaaacctcacaaggaaggcaagttttacagcgcgtgcacgttacctgctcaaagcctcgtggaaccagggtttcaccaggagcgggacgtctccgcctgctgcggcccaaggggggctggagttgtgccatccctgtcgaccgcgtgctgcttaggttcttgtcggactcatgcgcccgtcaattcccgcaatcctcggtgcacgcgcagtgagctcctgtatgtgtccatcctaacatgttcaggtgtcgatcgagctggtgagtctccgaataagaaggcgagacacttcccggctggatgctcatgatcgctgatatgactgaaggccggaacttggacccctccctcaccctcccatcacgcctcgcacgcacagaaagggggcacgcacaggtgcgtgtggatatcgactggtcaggtaaatgaaggaagggttcagtttcttggtgtgcggactgctgcagcttgcgttccctcgttcgatggggttcggaggttagttcagtcgcatttgttcagcatcacggctgagtagtttattacctttctcaacacagcgccctatcttgcgcctggaagcacgtgtgcctgtgagtgttggcggtgctgccgctgtcccgtcttcatcctccaatcgcaatg

SEQ ID NO: 2847 - DNA, 703 bp, Nannochloropsis_gaditana
tgtatgcccatctctttggtggccttttggtgcataagtgaaaagggcaagttctaaatcggagagtgcaacctcaagcctgcccaccagatagagcacaaagcggtacgtcatgatagccgataaaataccacattgtatgtcaattaatactctgatatcgtgcaagcgtacatctttcggtgtctcaggctccctctcctttggtacgaaacgtgttgaccatgcttgaggtttttaacgtctcaagcgacgggcaaaagaactagaagccaggtattctccaatgaaatactcctcttttagcccttttgactgcacccaaacgggaaatgcgtccacgacctgccagagtcgtccatgatagagccattcaccgcctggctgggttttgatctcgcctatactttctagtcgtagacagttaatggaccatggcaccgtcaccggcggtatcagcgactcgggttccgtgctccttggtctcgtttcctcccacttttaccccacctgcacgttcctccctgccccctcgcctgtctattcatcataatttatccttttgttacatttggggacctgtaggctccaccataaggggcgggttgccctgttcgtgcccctcccgggacagcgctttcaacgcgatttccttgtccgaaagctgtagcagctgctattctggtgctgctcagcaactatg

SEQ ID NO: 2848 - DNA, 703 bp, Nannochloropsis_gaditana
tctctctgttctcccactccttctcctcctcctcctcctgtcttcctccgtgccgggtccccgaatgcggtaagcaaggctggcatctcccttaggaagcgttgcagatgccgagcacgttcctgctcgggatacaggtctcggtagggaactataagaatcgatgttgcacgttcctgcctttcgctaccatttcccctgtcttctctcatggccgtctccgccacgtccttcgtgacagagggagagggtcctggacaagagccttcgctattaccgccgccagggatgctgttgctggtagcgtcgggcccggaaagcgtcggaaatgttccaggaagggacgactgcggctgttgctcttgtggttgccgattttgccccgtgtccgtgtcgctagcacagggggggcggggttcaactggcgcgggcatgacctgaaatgtccaacctgtctttttggggacgagtctgtggcttgacgggaatccctttaccgtgaatttgttttcttgatagatatgttgccatgttgagtgtcaattcattcactcgtattgttgtgactagaagggagggaacgggccggccgcacggaagccaaaggagaaccgtttttcagaccatgttgccaacgtaaaatcctttatgccggccacgagaaatcatctcatctcatatttcttattttacccatcacaca

SEQ ID NO: 2849 - DNA, 703 bp, Nannochloropsis_gaditana
atagccgttcatggacgatggggcctcatccgtgactgagggggggcatgcatgggtggcgtttgagagagagtggtattagaggcggggtaggcatcgtgtagaggggagtggagcggggggctgtggtgggtgaggtcgatcgtgggaggagcaccggagacatttaaatgaaccacaaccttaccacgatcatccatgagcgcgcccacccaaggtgaatgtcagggactccaggcgcccaggtagctccaatgagtgcacaaagaagcagcctaggagggtggggaaataagagtctggtcaatacctcgtcgactccggtcccagtcaccagcataaccgagcctcgactgcgatgatatggtcggcgcactgacgggaaatggtgccagcagcaggtgtaggcccacactcagacttcaccagtgcgtcgagtcggtggtgcacgcggccgatgcctgtaaaaatggtgtaaggcctctgtgtcgtagcgagccggtcgtcacgctcggggcgagaggcgagctccaccgcccacggacaagcttaccctctgtctcagggagatggggatggatcacgtccgtgcacaggcaatcaaaacacgtctcaacgcatttcaccgacaggtatgcctttgctacgaagacggaggcctgggttcataggcaggggtcgctgtcaaacgcccccgcagcta

SEQ ID NO: 2850 - DNA, 703 bp, Nannochloropsis_gaditana
cttgtggctctccgtgacatgaagccgttaacttcgtcaatggcggccgacaatgactgcccgcggaccatacttgggccctcctgctcgctctcctcttcttcggcaatagcaggaggcagtacgaggctgagccctcctgatgctgtctgtcggagggcccacaaagcatgttgtgtctctagtgctggggaagacgggtattgtcgagtattcagcggccagttgctgtaaaatattactcaatttccccatgcattagtggtgggattctgcatcctctccgtccgacgtgaaaaagcgggccctaacggaagactacgctttggactctttcgagaacctcttgtactcgatatgtcgcttcaaggtgagaaaattagggaaaatgaagttaattcgtgagggcttcaaaaatctggccacaagatctcacgtgcgacacactctgtctatatgtacaaaatggaagcagtggagggcataatatgtaacgatctgaaaaagctttgcagaaaaaaatacatttttgcgggtgaagcgcccacccactaagtttacatgtatttaaagactcccctatccgtccatatatgtcatttagcacatccagagcattcccattgattcacatccatccaattttgataagcctggcacataggagtatactgaccattatccgacacgcatctcagtcgtg

SEQ ID NO: 2851 - DNA, 703 bp, Nannochloropsis_gaditana
ctcctcttcttcggcaatagcaggaggcagtacgaggctgagccctcctgatgctgtctgtcggagggcccacaaagcatgttgtgtctctagtgctggggaagacgggtattgtcgagtattcagcggccagttgctgtaaaatattactcaatttccccatgcattagtggtgggattctgcatcctctccgtccgacgtgaaaaagcgggccctaacggaagactacgctttggactctttcgagaacctcttgtactcgatatgtcgcttcaaggtgagaaaattagggaaaatgaagttaattcgtgagggcttcaaaaatctggccacaagatctcacgtgcgacacactctgtctatatgtacaaaatggaagcagtggagggcataatatgtaacgatctgaaaaagctttgcagaaaaaaatacatttttgcgggtgaagcgcccacccactaagtttacatgtatttaaagactcccctatccgtccatatatgtcatttagcacatccagagcattcccattgattcacatccatccaattttgataagcctggcacataggagtatactgaccattatccgacacgcatctcagtcgtgtcttttgcctttaagcaaaaacgcttccgatttcatcatcgtgccgctttgcgttttcccgatagtcgctttgcctttgtgggcgtggaccc

SEQ ID NO: 2852 - DNA, 703 bp, Nannochloropsis_gaditana
atcgcgcctgagcagcaattgctgacgtcgggcccgaggagtggccgctacgacaccaaagccgatttgtactctttggggatcatttttttcgagatgacgcaccctcccttcgccaccatgatggaacgcgccaaaaccttgaccgcactccgtaccacgcaggagcttccctccgagtacctggcgcgcgtaccccccttggtcgccaaggtgatccagcagcttgttgatccctccccttccctccggccctccgccgcggcctttctcgcctcgggagatctgccggggaagatggaggtggaagaagtctatctgaaagaagccttggccactttgacgaaccctcagtccctgtcctacagacgcttggttcgcgcgctttttgcgcatggaaacccccctgaggtggacgcgacctgggatttggaatggatggcggcacagaaggaggagatgacagcccgggtattggcccgccgggaggccgtctccgactacgtgaaaaccgtttttcaattgcatggggccttgcccgtgtccgttcctctcttgcgaccgacgccggccgccttgggcgggagggctgggacccctggggcgcgggcgggaagagaaggggagctcgtgcctgcccaccgccggcaccatcaggagggaggacgggaaggaggcgggaccggtggaggggagggtcagg

SEQ ID NO: 2853 - DNA, 703 bp, Nannochloropsis_gaditana
agagggagggagggagggagggagagattgactcaggcccttgacgctcttcgagcgatagggcgtgatgagggaagatctccaaagagggggacacttctcgtcccataacaaagcaatgtgcgtgttgctgcacagacacgatacagatacagtagccagtcacatgatgggcgatggtgcgagtattgaatggctttttgggtgcccgtttgattacgctgacgatggagcaatcggcttcttgaacagagaggggcatccatggcgggcttcttgacgtacgtcagaattaaccatctgaccggctcaaatggtggtgacaggtacacaagccaatgcatcgcaccgcgatcattcactgtaacatgcatgtgagccagcaaagctgggtttcagtcccccaaagagcccgtgagcttggccaccccattcctcccgcccgcgtcaagtcgaccatgtccgaccccgcccctcgagaaatgtctcatgtttcccgtcacgatggccaacctcaccaaggtggtaccggaaaccgtcgcgctgacttacggaggcatcggaccgtgcgccaggcgtggaaaaatgggcagtggtgtgcctgtcctggcgagcctctggggcatgcttgtcaccagacatccgccgaatcaatgcatgtgctgatctttcactcctttactcaaatacacgggacaacatg

SEQ ID NO: 2854 - DNA, 703 bp, Nannochloropsis_gaditana
cctgcctctcctacttggacacaccgtcgcatttctcatccaagtgcatacctgcagtacaacaaacccgtcgtcatccctccgaatcggcttcacacgcaaagcatgccttgttgctgctagcacactgacaggatcacgcacacgcccccggcgtcgtgatcttaagatcggtaagccacgcccggaagtacccgatgaggctggcgatgacgacgactcagaggggggaggagggaaaagatgggtgcgagtgtaccctctcgggctgggatcatacggcggacagacggcagtttttttagggcggcggaaagaggtcgaaaaagagaatggtgggcgcctggaggctttgccagtaccggtcttcacctccggcgacttggagatgctgcaagcagcatttcgagaagctgaacgaagacggaaaacggaggcggaaggattgcagaacagccggggctctaagagccaattcaaagcatcttcgatgtggacgggcaggcatttgtccaccaaagacaacggctttttcgataacgcgccctgggagtgggcagaaaggatggctagggaggcaggagaaagcgggcagagcgtgccgaccgttgcagcgacgaatgttaaaaaggaagcgttcgacgcctttgttttcggtaagaatgtacgggcagactggacctcctctccttacgcactgatg

SEQ ID NO: 2855 - DNA, 703 bp, Nannochloropsis_gaditana
tccatagacgggacaggacagagttttggaaggccgggaggtgaagttctccagtgtacacaagcatgaaacctgcgacagataaagatgtacagtcgagcgtaggagatagggccacagccaaaagaagttgtgcactcactaacggtgccgctgcgaacgatcgtgagcctgcggtagtgacactcgcaatcccaaacttcgggcctgccgagagagtaaatgcaagcctccaaatccttactacctccttggcaaattttttggattcaaagttcattgtaaggttgaatgaaagtgccggcgtaataaaaccttcacaactcgttttggaactcgtggtggttaaagaggccccggatggagacgcggcaaaattagcagctcgggcggggtatgttaccagagccatgacatgcacaatcacaaagccgcgtcaacgtttgcatcaaggggaaactggcgcactgacagaggagacaaggggctcagggtatcctcaggttattgccgtgccatgttcccgttcatttcttcctacagatcatcccgtggccatggaaactttcaaaaacgcaggaccgcagctaacaaatacggcgagattgctttttcacaaggctgaaccaggccttgtctatccaattaaattgacaaagtcaagcgctttgtgcgtacagcaaggtgtcgagtacgtactttt

SEQ ID NO: 2856 - DNA, 703 bp, Nannochloropsis_gaditana
gccatggaaactttcaaaaacgcaggaccgcagctaacaaatacggcgagattgctttttcacaaggctgaaccaggccttgtctatccaattaaattgacaaagtcaagcgctttgtgcgtacagcaaggtgtcgagtacgtacttttagcgatgcctccgtgtcaggcacttgcatctgtcttgcctgatggttggtcaaattctttacaatgcacctatgaaaccttgatcagagtatttttagagcaactagttggaaaagtgacacttcggcaggtacttccgcagaagatggatagtaagactgaggtcaacagcaccacagcgccaccttcgttggataagcgagaggaggatcacgtcgagtcaccacatatccctgtctaccagcatcctggccagccactccagggtggtggctggcatggtgctctaatacgatacctggatcacaccccagaactcaggcactttatcttctatgagacttcggagtggatggctatttatgacggctaccctaaagcaaaggtccacctgctcttgattcccaaacccgaattcttgaccattaattctgtcacggaactcagccatgacaaacacaacaagcaaataagtaggctgcattctgcggcccgatgtatcgctaccaagttggaaaaggacacgaatggactgcgtctccgtatgggatacc

SEQ ID NO: 2857 - DNA, 703 bp, Nannochloropsis_gaditana
agtatcctcgatcgacacgcagtaacggtgcttacacgctcaacaactgcaacgtaaagtgtgacgggagcaatttcaagaagaacccgatctgttgcctggcgtcagcagggggcgtgtgcaatgatgctgaagccgacgagtctgtccgcgccggagcagtatgcgccgcggcaggaaagccaagttgcactgaatctttagacgcagagagcccagacgtgccagccatcacaagtccaactcctcaaattgtaatcactccacacgaggtaaagtttcttgcattcatcatatgatgaatgacgacaaatgatgtgtgaaggtagtttctcggatgattttacgacgcgcattcatggatgtttgtgtactcggatatgtaccacgactcacgtagccatcgcttatggttacaaaacaaccaggaaccagatgacgagtctccccaagagcatcgtggagggacgcaaagaagcctggtaagtacccattgtagccaaaggcgtgggtgataagagctgacttcaatggacctatttccttccacaatacaggcgaagcgtttccccaggcttttagaacgtgcccgtcacggccgttaaagacagcgaagaagatgcatatttatagtatcacattcactcaagaattaacgaatagagaggaggcgtaggatgtactgaatagtgcaaacagtcgt

SEQ ID NO: 2858 - DNA, 703 bp, Nannochloropsis_gaditana
tcctactagctcaagcgtcattcatgaataaagtctcaccaatgaccctgttaggcattaccgcactgcaagaaacgtacgtcctcgctaaatgtttcaacgtgggagacagaggaatctcaaggatctgggccttggcaaaaaaggtggagcccttgcatgttgctgagatagtgcgaggcagaatcggtgagattagggtattagctacgagtatctaatgcgaagtgccaatattttgaagcgtgacgcgactactgttttggccgcataaagcagagcagactcttgcaccacgcacatcgggtctcggcattggcaaaggcagagagaggacgaggaggatcgattgagaatttaagccaaaattcagcaggtctcagtccatgaattatatggtcttcgttatctttcggcctgtaaatcagcttaaagagcccaagccgttgccaacctgacatgcgacatgatttggcagtttagccgttgactaaaaatgggccatatgtgcgttgctgtgtgtgcgttcgctcctaccaggctcgacaccacgtgagcatccaatcgaaaagtacgagccaaaaacttccctatcatttgatgacaacatttgaaaccacatacacagtcattaaactccgatacgctagtggacaccgtaaattgtcatattcgtccccggcgcgttagcatacttaacatg

SEQ ID NO: 2859 - DNA, 703 bp, Nannochloropsis_gaditana
gatgtggtcgcatgcctgtggtgaaaggtgaccgaagacaggagagggtgagttgttgttgctgttgccgggaggcgaagggcgaggggtcaccggtttccggagggggatggccgccggtcaccaaaacgaggaaagattcatgaaagcttttacgctgaatgtacgattcaaagcttggcatcgttccagcgcgtaaaatatcgagatccaagctgcgtggtcgtgactgtagaggtatatcaggcaccgcctctcatccaccctccccgtgacgtgacacgggctatcaggaggcaggggatccccgcgccagggccaccaaaacaaccttccaaccgtgatgccatgtgcttcagtgaaattgttaatcgtgcgtcatttcactctccacggaaatcagcatttcggagctttgtgtggttttatttatcttgtgacgatcccttccaagaacgctttcgtcacctctccgaggcgtctccgtcataaaccatttccaggctcttttgtacaatctgcccgcacctaaaactagaaagggcgttgtcttaactgttttctcacgctttttacaccctcgaaccgctttccatggacagacgtgcgggttttgctgcctaaagccccccacggggcagtcatttgtgaggagaagtgctgctagctactgctcgggcgcaggagtcctgagggtgccatg

SEQ ID NO: 2860 - DNA, 703 bp, Nannochloropsis_gaditana
tgagcccccgcaccaggatacaacccatgcttccagttgcactttttgcccggccttgaagtcgtgcctccccactgtgtaccttgcctgctttcccaaccgttcctgcgacgctgatctgcacagattgggtcgcaaggtgggtttgttgggcatgatcgtgcttggaaatgccccaacgaggttttcgcccgcctcccaggagggtccaaccccgtcgagatcatccctcccatagtcaagccccttgatgccggctcatttattcttctctttaccctttctcccctgttttcaacacgtcgtaaattcatcaacaggaaaaaaatctgttgatggcatgacctggggtactaaggttccgttttggtctgccattccttcattgacaagaaatatcgcctaccacggataggagctgccgcttctattgcgtagctttttgcatcacctgtgactcaaatcctcatgataaacacctgtaagagagttcgctggcttctaataggattgataggctatctggaatggagctgttgtcgaaacagaataagaaaccagacagcggccttttctttcaagcctcacccgtcctggagcggagccaatctcctggagggaagtcgggtgacggccttcttctttcatgcctcacggcattataatttgaatcagcaaaaatattcgtatagactggtagcag

SEQ ID NO: 2861 - DNA, 703 bp, Nannochloropsis_gaditana
ttatggccgcctgccaccgggcggggcaaaccgaacgggtcctggccctcttgacggagatggaggaggcagggacagggggagggaaccggggaggggcgtacgccacggccgtccactctaccttggcctcgagagagtatggggagatgctgcgggtgctggagcggatgatcgcgcagggtttggacgtagaggaacgtcttatccacctggtgatgggcgatttggtgcgggagggtcgctggaaggaagcgaaggccatgctggacctcgcgcggcgggcggggaagttaacggccgatatctacgtgaaggcggtggaggcctgcgtcccagaggggcagtgggcggaagcctttcgacacttggaaaccatgcaccaggaaggctttctcaggcacgtccgcgtccccctcgatggggcgaccgcctcgaccatgacgctgtcgtcctcccctccttctggacctgctgcgttgtcctcttctcgtccgtactcctctcccggactggacacgactgcccccggcactctagcaaattacggcagtgggggcgctggcgcgagcagcagcgggagcctgagctccagcaatgggttgccccaccacgggggggcggggtccacgggaagcaatcctcttccaatggaagccagcgaagccgccttccgcggcgccatgtccgcctgtcgacaggc

SEQ ID NO: 2862 - DNA, 703 bp, Nannochloropsis_gaditana
attgctaacttagtctgttgaatgttctaaaagccattttattttttgtacggtacatttgcctcttgcctaattcctgccttgttcgaaagtcccttaccgtcctttctgcagaggccaaaagcggctgcagcatacagacagcgcaagccaggctaaaatgtaagagatgcatatgcgagagatccaggcctagtttgtgttggttgataaacaccttagacggactcattgcaggaatattgttaaatcgagccgttgtttctctgtttcgagctgcccaccctcaggtaatgcacttcccacatgcaagactcactttcgaggagcctttcaaacccccacaacaagcagcatattttttcatttcatctttcaaggcctaggctgtacccaaagacggtcgacataagcgtcttttgggttttgtgcccccccgataacctcccccctccctccacaagcacacgcatgcgtgccgtcgccgcagcgatatcgccttcagcctttatctgttggctgaagtcgtggtctcaatatcaatcgggggcatggatcgacccccctccaacgcacctggtaccattgacccttggaaacgtgacacatgcatcctttctaacagccatggaggagatcaaggaagcgcaagcggggcaggaaccgaaacgaagtaaggaagccattctggctgctattggcg

SEQ ID NO: 2863 - DNA, 703 bp, Nannochloropsis_gaditana
gagataaagcgtggagggcaacggtatgtctgcgcactaagggtaagaaggaactatagggcaccacggaataatgtatgcgccgagccttaaaaacaaatccagccgttgttcagcgtataccgcgcaatttatcgatcctcgaaggcttgaggcatctttaatccatgtctcacggattcatattgtccaagagaggaacaatgtgcatggtttcaggcaaggagggaacataccaaccacgagacaaaataatatgtgccccaaacaagactcgcttgcggtagccgaattttggaaaccaacctcgtttcatgcaagcaggtgtcgtggacggtggaaaagcgcatgaatggcgcggtttacttgtcctcctccttcaggaagcggtgtggatgtatcctttatattagtgtgtcgttctttgtcggggagacgacggcaatgcgttcaatgtcttagcatccaccaaccgtcggatataaacctccttattctcgccagtaccatacatgagggagttacatgcacaagagaggcctcttttcattttggtgtacattctcgtgtgagtgcgcaaccacacctcctgcgtttcttaattgctatctttttacttgaaaaggatacgataaatcctttttttccctgcaggcacgaaccagacacagtaccgtcaaatttcttgctaacaatatccatg

SEQ ID NO: 2864 - DNA, 703 bp, Nannochloropsis_gaditana
cacagcatctccgataaggcgccgacgatgcagccaacggccgctccgactgtggcgccgacgatgcagcccacagtatctccgactgtggcgccaacgatgcagcccacggccgctccgaccattgcgccaacgacaaagaccacggcagccccaacagaacctccgacattgcaaccaaccacagctccgacggctcctccgaccaaggcaccgaccatgcagccgacggaaacagcgcccatgactacaactctggcgctcagttcacaagctctcctactctcatcagttgtcagcgacaactatgcgtagtttgggtaagcaaattcttaatagacgcgcgtcctgttgtactacttctaagttgttgatgatctcggccaaatcctactcacaggactgattctggcgatgtagtaagggtcaatctctccgacttcagtgaagcaggcaatatatatgtcggctcggcagtaccgtcctcggttgtgcgcggggaccatgcttattttgggtaaatgatggctgagaaccaaaccacagggccacacttcatgctctgtaacttctcaacgcgaccgcctataccccatacataggacggctaatggtgatgtcgtagaagtagatctcaccgattttagtgaggtcaaccatttgtatctcgattctggatctgttgacacggccattgttaatg

SEQ ID NO: 2865 - DNA, 703 bp, Nannochloropsis_gaditana
gaatgaggatttgtggtctttttggacccctttttgcatcctaccagacagtgagggtcgacgcgaggtacgttcctcattccacctccgatcaagctatcgatccatccatcaagcattgtcccccaagaagctggagtagcctgtaccacactttctcctcgaattctcacgcaacggtgagggcaattaccatatagatgtagtttagatttgctcgacacatgctccccgtctagaatgcgtggacggggaggtgcttggaaggaaagccatgatgcacacggtacacgtgcacgttctattgttttttccctcccatgatgcaactttcatcaccgactctctggtgtgcatagcaaggacaggcgattgtgcagcttgtgcgatggtcatttctgtatcattcttgtcgtcgtctggtgcttctgccaggctggtcttgcttccgctgcgaccgagtccttggatccgatcccggggttcgcacgtccgcagtgttgccagtaggacaaatggcagcattgaggcttccgggaaggtgaggatggaagtgtaaggcttgcgggctattggggggctaaggagtgatgaagaggctgccgcagtgttgagtagaagtagatgcaattgaagtctcctgcctgctacttgtggctgctgagacgttgcttttccttgtctctcgcacgcatactagacg

SEQ ID NO: 2866 - DNA, 703 bp, Nannochloropsis_gaditana
gcctgtcccacgaagtcatgcccattcttttatgaagtctgagaatgcgttagaatatgctcacgcttcgaaatgtcgattggctatgagcctgggaatatgcgccaggcctcttgtcttaacagccaaaaattcaaattgctcgttgataagcttcttggttgttggcacgaccgcgtgtatatctcaaagttctatcagtgcgaggaccacgaggcacgtcttgatacacactatattgcacggtacaatgcatcgtgtgctcgtggttgatctggtggtccggtggttcgtggttttgtctttttaggtttttgaaacgccttgggttatgttaacggctggcattggcgatgcgggcaattgccacggtcgaaaaccttgcccacgcacgatcactcacgcacacgtccatgaaaatgacacaggatcgtcaagcagcactatttgaggctcttcgtaacctgaggtcaaagacggcgcccttctacttcctttcacggcacgtgcccgctcgtgcctccgacaaaccgacttgacctggttaccgtggacaagggcctgtctaaacacgatcgaatttcgaattgataacacgcagttactcctgccttctgaacgcacctttgtaggacgtcgtgtcatcgacatagtcaggtaactcgccatcctgctggacaccctcgctgcacaggatatcatg

SEQ ID NO: 2867 - DNA, 703 bp, Nannochloropsis_gaditana
  misc_feature (199)..(208): n is a, c, g, or t
cgggttgctcttccacagacatctgctccccgtcttttctcacggccttcctccctcccttcctctttccctccctccacgccttcttgctccttatccgcagacgccgtgcgtcgaatccgccctcagctcctgcaacaataccatcccaccttcatcgcgcccgaccgtgaggtacctccttccctccctccctccnnnnnnnnnngagagcactgcttccctccctccacccctccctcccgggcaattggtacggcccacacctcaacggcggtcgagcgggaatctgttgttggggaaccagagcaggaacaacagcagcagcaatttgagccgacccaccggcagcaacgtcggggaggttgaggaggtggccagccgcgtgcagagcgtgcacctatcgcgggcctcccccccccctcctcgcttcaagagcgtctcgcctggtcttggagaaggagaggacgggtacgagggagcgcaggcaggcgcggggaacgtgatcgcctcccgggcgtctctgggcgggctgtcaaaggatcccgaggtgtgggaggaggacgtcttgccctccaaaggagggggagagaaggagggggagaaggcacggatcgcgatggtggtgatcgggcatgtggatgcggggaagtcgaccttaatgggccaggtgttggtctccaccgggatggtgtcggtgcgg

SEQ ID NO: 2868 - DNA, 703 bp, Nannochloropsis_gaditana
gtcaaaggatcccgaggtgtgggaggaggacgtcttgccctccaaaggagggggagagaaggagggggagaaggcacggatcgcgatggtggtgatcgggcatgtggatgcggggaagtcgaccttaatgggccaggtgttggtctccaccgggatggtgtcggtgcgggaagctcgaaaattcgaacgggacgcccgggccctcggcaaagcttctttttacttggcttggatgatggacgaagacggggaagagcgcgcgcatggcgtgacgatggaagtgggccaaaaatgcatcgaactcccccaccgggtcgtcaccctcttagacgcccccggacacgccgactttgtcccgcaaatgatcgtgggggcggcccaggcggacgttgccttgttggtcgtgcccgcgacgacgggggaatttgaagccggtttcgccgaggcgggcaccggtcgcgacggcctcagccagggccaaaccaaggagcacgccctgctggcacgggcgttgggggtgaaccaacttctggtggcggtgaacaaactcgacgcggcggacccgccctggtcccaggcccgataccaggatatcgtcacaagcttgacgcctttcctggagcagaccgggttcaagtccgaacggattcggttcgtacctgtaagtgggctgacgggggagaacgtgaaggagggagggcgg

SEQ ID NO: 2869 - DNA, 703 bp, Nannochloropsis_gaditana
gtcaatgctcagcagagggaggaaataaatacttggtgcataccggtgagaggcaagccgggcgtcactttggggaagaccacttcacagcatgccctatgtctttgatggtacgagtgaaaaccaaagaatttatttaccggttctttaaaaagaagttgcaagccgcctctcgctcattgatgctcctcacgtttgctgtcagcgaggctcaagatcccagcaaaaaacacgtgacacgggcgtaacacaaggcccgttcgcgagacttaaggtcacagtggtgctgaataccttgtgtgtcagcaagagccattcactgtgatgtgcttggcaacatttctaccgctcttgatccctctgtatcagacctcgtactacgaacaggtactactagtacctcttgctttcatccgtccctccatgcccgtagccacaaattgcttgcttttgcgtcccgtcgccgcccatccgacacatcctcaacccaatgcatatctttcactcgacagatccattcgccaggccagccttaggcggtcttatgcgaaacggtggtcatctacacgcaaccgaggtcggtcaactaggcgtggccagaagcctccacaacgtcattcccgccactcagtccccaacattttcgaaagaccttcctacgcggtcaagattttgtattttacttctcccgtagccgagcatg

SEQ ID NO: 2870 - DNA, 703 bp, Nannochloropsis_gaditana
tggatccatacgccccgcctgaaagttactccccttttcacttgacgtggcaagaacatgcgaaatggaaatagaggccttattcggtttacatttcgaggcgccatctctttcttcgtggtggcctcgctgagcgagaagctttgcagcgtcgccaccacatcagaatgtttccccttgcgattgaacaggactggtggtcattggtatggcgacaatagactactggtacagcaacaccctctggctcgaagaattgggcggctgtttactcattctttcggtgaatgggcttaaagttcagggcggattccataatcgtccaacctcccccctggaaagcagcgtacgctttgtgtgccttattcactgcgttcttgtttaaaatgcactgaacgtgttttaccttgggatttagggtgcatttatacacagtaaagatatgtcgagtacgaacatctcgtgagggcccgctgccggtcacggtgcctatgccccggtgccttgtttttgacttgaagaggcttaccctgtttagtcaagtattgacacctcgtaccagacgagacggaattcatcactttagcctggcctttgctatttgcagtatcgctcaaagtgtgttcatcttgggacaagcgacaaggcatattcttttcttcattccttcactctctttccttcccccacactctgcgccaca

SEQ ID NO: 2871 - DNA, 703 bp, Nannochloropsis_gaditana
cgtcatcgtctgccacacgtagtccccagatctggtgtgcgatatgtacggcggtggctatatccaccactggcttcaggccctggaagaatagggggcaggaggcaagggtgatattactaggactgctagaatctctgttgcaagaaggcatgcccatcaatcggctacaacacatgccaacaacgcaccttccgccgctcctcatcctcagctgacatgtttttacccttcccctgtgtaaatgggcaatatgacgggtgttagcggaggcgagagggaggccaggagagcaacgtgcgctcgtcgctggacggtcttggcgagaaaacgtaggggaataccacaggaccttgggggccttggaaaaatgccatgctggtgtcttgggtttagcacggatgccgtcgctggagtcttggtgtgcattcgataaggctgaattgattcgtccattgccgttagtagggagggacttcaggggggagattgggctgaccgcctcctttcccctccctctcttttccctgatatgaatcccgccacggctctggcacgacttgtggtgatcttggtaagcctttcaatgactcacatgtatgcacactgctccactatcgttggcgcctaaaaggtgtcacagggtgagttgcccggcccgcctgtgaagagagcatcccgttcaacggagagcagcggcatg

SEQ ID NO: 2872 - DNA, 703 bp, Nannochloropsis_gaditana
gcgcaagcgttgatgaagcacgcgccggagggagaggcggaggcggcggaggagagcgaggatgagggtctgattggcccttccatggacgatggccgggaagcggtgcccgacgagatgtgagcaagcagggagggagggagggagggagggagagaccggggtaggcagtgggcgacgcgcaatgagtaagccactgcaagggaaagaggagacggaggagaaggaggagaacgagcgtcggcattgtcctcggaaggctgcttgtcacgcatgccccatccttccaccaccccctcccctcctccaccccaccgacccccttccctccttccctacttccctccttccccacagcgcctaccgtcacgtccgagagaagcgggctgcggccgctgctgcttccgcgggtcaaggcgggagggagggcgggagggagggcgggagggaggaatggatgaacctagccccttctgagctgatggctgggagcgcccagaacatggagaggttgcggcgggacgccatgacttcccaaaagcatcggggatttacccagtacgtggtcggggttttagggcggttgtgggaggttttgcctgaagggcagacgcttgtctcagagggacggagggcgtgggagggagggaaatgattggcccttcgagccgggggtaaaagcgggagcggtcaagcagacata

SEQ ID NO: 2873 - DNA, 703 bp, Nannochloropsis_gaditana
aagaacagttttcccaggaacatgcgtcgcgtatcatagaccgttacttttgtcaaccgtcattcccagcccgaagtttgttaacatttttaaaatgacgattctatcttgcacacaggcacattatgcctcgtcaacgtgtgggatatcgccttactgatcatgagataagatctgtgaacgatgttgtttgggtatacgaggatgcgtcaatggttttgcttgggggtgaggtctggccagctgctttcgtcgtaagcgagtatctctgcagctttcttaatttcggtccatcagttcgcccaatgaagccacaaacaaccttgacaatcattgagctcggggcaggcgcgggattatgcggtttagttgccttggccactgcattaaaatgcggcggaaagtacgtagattgtttcctcaccgatgagacacacgctttatgtgaggtcaatctcgcccattttagggcctcaatccccgctactctccacacaagtcttccattgaatctttctgatcgttttatgaacacggctgcacgagcgacctgccccactaacttctctgctcaagcattggagctttcctggggctgctgtccgtcaaatttagctcccgcccttgttgatgcctgtcgatctgcgaatgaattatgcctcattggctgtgaggtgaccccaatgctgcagacacaacttgc

SEQ ID NO: 2874 - DNA, 703 bp, Nannochloropsis_gaditana
agagcaatttgtgcatccgcagacctggatcgacatatttttaagagcctgagcgtctggggcgtattccttgtaaacttcaacatgatgctgccacaaatgctgtggctggttacttcctggtggcgaaaagggtccgtggtgcgaaaagctcacatatatgttctgttcatgaccggtgattggcatgagggtactcacaaaataagggaagtgaaagtatctggtgtgccgcctccatgatggagacgcgtccagtgctttgcgaagactcccctagaaatacaaccttcttgacaaaagtacctggtttcgtgaagttttggagcatgagtgtttataccgtatcacattatttttaagttgcctttttacgtaaaagcgcagatcctgtagcagcagcgtttgaccttttcttcatttcgtcgtcgacttgatggaatatagctgcatgtgggtttaaaaattttgatgcttcacagtgagccatgagcattacatatgtccgcatattgtgctctccgggaccggctgcctgcatgtgtattggttttttcttttcaggggctgggttgctggcatgtcacgtgtaccgaatccaacgcaggaacggttccacttaccattcgtctcttattaaggccacatgttgacggcaagtttacaatttcataacattacatgaacaaaacgtatagggatg

SEQ ID NO: 2875 - DNA, 703 bp, Nannochloropsis_gaditana
cacgacgtttaccaagacagccgaacttacactcaacgatggcgaaaacatcctttatagtgccgttattagcgagaagtacgcctatttcgggtatgaaatacacctttaagggagagaaaattataggaaggaggagtctaaatggttgattagcttcttcaactgctcccacgacatcagcacaggaacttctccagggattgttgtcaagattgatctggggaactttacccgtgtggatgcgctgacacttcattctggagaaaataacctttattcggcggtcatcagtggtaatttcgcgtattttgggtaagaaaagatgatttacagggaatttatattctaattagactgattcttcgtaaactttcttgctcctgctgcctacagagctgtaacatctcctggtgttgtagttaaaatcgatttgcttaatttcactcgagtcggtaacgtgaccatgaataccggagaaaacgagccatactcagctgtagtgagcggtggatacgcctacttcgggtaaaattatatacacacgaaaatagggaagaaggaaatgctgtgattgatgaactctcatggagctacgcattcatcattctttctatttagaactggaacttcaccaggcatagtagttaaaattgatctgaacacttttactcgagtcgacgccctgacgctgaatagcggg

SEQ ID NO: 2876 - DNA, 703 bp, Nannochloropsis_gaditana
  misc_feature (680)..(689): n is a, c, g, or t
gatatgaaaggatggtgagaaatacgagcgagaaagcaaatgagggaggtacgaaggtaagaagcagagcatgaactgtggagggaaaagggataccaaagaaagcaagtatctcttttaacaaatatccctcttattcgacatgaggagtgcataaatgagacggagagatcgcatctcacaagagataaaatgcttaagcacgaggacaaacgtcttttaaaagagggggatttttgattcaaaaattgatagcttatccttgtaccccgaaaaaaagaatctattcgtcttctctaacaatgtatccattttatttcaggcccgcttccatccgcgtttttcatttcgttcagttcgtttccatgcacttcagcattcgggaatcaattgttgcgtcggacgagctacatcagagagatcgttagatatatgcgatacatacgcaccagatgatgcacgatatcaacttttcaagccacttggacctcacggtcattcagaatcgaaaatctttaaaggtccagtttatcctccaaataagcattttttaagggaaagcgggctcgatcactcagatgaactatgacaatgactgagtagtgatctttccaggcagaagaaaaaaaatggtcatcgcgcaagcgagcctaccacaccgcctgagcaactttgaaatnnnnnnnnnnttcctccagacatg

SEQ ID NO: 2877 - DNA, 703 bp, Nannochloropsis_gaditana
ggccggggccatgggaacccgtgtttctccacagcacaagagggtggaggcaaagtagggagcggtaaggagggggacaagggcgtgcgaagccagcatgggcgcgaggggaagggaagggatatgatgaaggaagaggtgtccagcagggatgagggggaatggacgggcatggagagcgaggagaggttacggtcgcaggcagcagccgcggtgccttcctctagtcgcactattgaggaagcaatccagtgggagctttgagaggaggagtggcagaaggtacttggagagtgggttgccccttaagacgtaatcctctttcccctcctccctcgatatccttcccttcctcctttccttcctcacctcccccctttctcatctccttcaaggtgctcctccgttacgagcggctgttgacggagcagcaacaggtgttaagggcagtgagcgcgcccctcttctccccgccttcgccgtcagcctcccctctgcctgcaactggagggccgcgaccccagcaaccaacacaaacagagagagcgctagcagcacatgaacaaccgtcacaagggccgccaccgcaggaagaaaagataatgcgccacgcgcagcaacagcgttacaacaacaacggcagccagaaaacaaacgcagcagcaacgacaactgcagcaaaaagaacagcagcagaaagatg

SEQ ID NO: 2878 - DNA, 703 bp, Nannochloropsis_gaditana
ccccccacgcctcgtttcccctcttgcccgccccctcccacgcagggcctcggcaagacgatccaggtcatctccctctttgccctgctccgagagaagggcgtgaacggcccctttctggtggtggcgccgctggccaccttacccaattgggtccttgaggtccggaaatggttgccttcggccagtgtttgtctttaccatggcacggtcccggagcggcaggcgctgcgggaggagcagatgccggtggggagggagagggagacgagcaagcttttccccatcgtggtcacctcgtacgaaatggcttccattgaccggaagcacctcatgaggtaagcctcttggtccttacttttggtgtggcggctccaatttcgaccccgatcttgcctgtcgaggccccgaccccgggggtggatggctttgccaggattggttgcgagacttgcgaaggggcggcaaagtgccctgagtggggttgcggtagagtggaaggcgagagggagtccggcgcaggggtcgatatcttcccaggcatccccagtgctttccacgatccttctcgatcgcttgccttgatttattcgctgttcctccctccctccctccctccttagttatcactggcggtggctcgttgtggatgagggccaacggatcaagaaccgaaacggtcgcctcttcaacgaattgaaag

SEQ ID NO: 2879 - DNA, 703 bp, Nannochloropsis_gaditana
  misc_feature (1)..(681): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccaaacgaacccccagatg

SEQ ID NO: 2880 - DNA, 703 bp, Nannochloropsis_gaditana
  misc_feature (1)..(672): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcccgaagacgacgaaaggggcgcgatg

SEQ ID NO: 2881 - DNA, 703 bp, Nannochloropsis_gaditana
cccgtcgttcaagcgtcgaaaaactgaaagcgagggagaaagcgccgttcctacagtcttgagtcagagcatcaaccgtctttctcccggacctcacccatcctctccccacgacctagtctgcaccaaaagcgaacgcgagacgggggacctcgatgacttgagggcgttgaatgatccaatactcaccgcgtccatcaaagccgcacaagaagaagccgagcgggccgtggcagtggcgcgggcgaaggaggacgaagcgcggaaaaagagcggccctgtggtacctcgtttattgcaaggcgtcggagtgacggtaaacgacgctcccacagcagaagaagcattggaatcaacgagtaatgccccagcttctcacgcctcgtcctccttggatccaggattgccgatgaatggtgccgctaccagccggagcggcatgcgtcggacggcacagcttgataccttgttgcaaaaagcctcgcacttcaacaacttcatcctgggcaagctggagcatgggggcaaggccgctgccagtgccgcccccgtcggggcggtgaagtcgaagaagaaacggggcccgggaaggtcgtcgaacgaggacgaagcggcggctgcacaggcggcacacgaccgagaggaagccctgggagacgcggcccgcaaaatggaggggagaaaaggaggggagggaagcatg

SEQ ID NO: 2882 - DNA, 703 bp, Nannochloropsis_gaditana
attcgctactaaacgctctttcagtgtttcgaggggcaggtctgtgagttgagtgtgcatgagtgagcccggaagactgtctacgagggttggaaggagactttgtcgtgccgtgccaagaaaacgcctacatctgggtgctttcatgtgaatgatattctttataatttgtcgaagagacacaggaggccttaaagactttaacgcggacctttccgtgcaaaagggggcatgtgcaacagtctctgttggaaatccgtaaggagggagaggaagtgttagcaggaaggcgaggggggaggttgggagagcccagcggagggttcaagtgtacggggtaggctctgtatcaacgccaaacataacctattatacttccggtcttggaggataaagaaagacctgtagcgggcaggcgatgtcgtgcatggctctgtaatttccccccctgttgtgctcaaggcaaggatcttgagaaagcagtcctagtcgagatagaataaactgacttcaactttccaacaaaaaatagactaagctgaccaatccatctccatagtgcaggcgatttgagtggtgtcggcccttgcatattttccactacgtccacgaaacggcgccacaacggacccttgccaggatcgcatctcagaaacgttgacgactcccccagtcgcacagtagtcttttgtgaagaattatg

SEQ ID NO: 2883 - DNA, 703 bp, Nannochloropsis_gaditana
tcaatctacaaacgaagtatgttctcatacacacgaagtatgttctcatattttcaagggggttcgaaaaacaagcgaaccaaaattttggttgtcaatgtccaattcgcgaaagtgtacttagcaccactgccatttcccccccttttgtaacccatgttactttttttggaacaattcttcgctatatcaagtcagcgtgcgatgggccaatttttcgcttggttgtgtagttgtcgtggcgcacgcgttgacttgaagatacgcctttgaagtgagcgtttgctcgttctccccttcacgtgccaaataaagataaaggcacacttcccttgcaatcggtagacaacatttctgcacattttgttacagagaggcgcgggcgttcattcgtgttgtccaagagctgaaaggacaaaaagcatgattgacgcaagcgataggaagaagaagaaggcgggtacgcgatgacgacagctgaaatcaataaatgaaattcgaagcaatgagaatcaaatgctccttgaatgtgcatcaagtcgtacgacggcagataaggcgtgctactattggacatgctcacattattaaattgtgctcgtaacccatacttggcatgtaggcaacgcgaaaacgcggcgacacgctagtattctcttaaaactaagagcgacttaaaaaacgttcgaaggccccgcgcatg

SEQ ID NO: 2884 - DNA, 703 bp, Nannochloropsis_gaditana
  misc_feature (15)..(24): n is a, c, g, or t
  misc_feature (571)..(666): n is a, c, g, or t
agcagtgcttgcaannnnnnnnnncgaagcgcacagaacccgtcacgctcgcgcttttttctgtcctctggggacggacgtggcaggtgaccaagactccgtactgggagaagagagtcttgagctcctccacggtggtctgtgggagggaggaaggagcagaggaaggagggagggagggagaggaggggaagaaggaagggagggaaggagggagggggaggaggggacgaaggagggcgtgagtggagaaggaaaaggagggaggagggagaagaggaggggaaggaggaaggaaggagaggaggagggctggtgaacaatcggatcgcatggaacaggaggagggccctcacatccaacgaggaacgtctctcctcccctcaaaacctatctatcattccttccgccttacgttcaagcgcaggttcgacagatggacgaaggtcccgtcgttctcttcctcccgcaccggagggccctcccccgccccctccacctcgccctccttccctccctcctccgaccccaccgcctcctgcagagtgaatccttttatttacgccttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgcactccttggcctggtgtctccggcacagatg

SEQ ID NO: 2885 - DNA, 703 bp, Nannochloropsis_gaditana
agcgctaagtgatttcaaagggtagctcagagtgatacgatatttggaatgcaatgtacacgtatatggccgaattcgaattatagcctacaactctcgcttcagagcatcttggattattttgggtacatttcctttcaaaagcgctgcctgatgaagtattaacagcctccaaaagtctgtgctgcctataagtcaccttccttaaaaattaaatcacattcggatgtatctttccttcgaaagagtatgttctacagctctggagggagaccctgctccgtccatggaatcgtgccgtagaaatactaacgcctagcaagtttgcgaaagccttgcaaaagacgcaatatacatcaatacggagattaatcaataaatgcaagtccacggacgtgcaagagggtacaccgacaagtttcttgtcactggtcctagattagacaccagtgataaggaacaagatggaacgtacgagcgagagtgctgtccgctgccagtccccatcccccgtcctgatttgctggccgtcatcgagcaaatttacacgctctacagtgagttggtcgctggcaaaaggttatattgtcggtgggagggcactgatatacgctagtagctcacgattacgtttgtgtccctttccgcagggcttggtccgtgacaagattacagccacaccgccataccaccgtcaatcatg

SEQ ID NO: 2886 - DNA, 703 bp, Nannochloropsis_gaditana
aatgagtactcttaatggtaagatagcagatcgggcgaagaagaagaggctgcgagggggaccacccccgaggtttaaaagtagtgccgggcggactccttggatactgaagtccaggatgcaggaaaaaaatgcgtccactccaatccaccaaaaaccatcaacatcaacgcgcactatcacctcagcctcctcgtcatccactcccctcgtgcgagatcgacccgtccgttttcattccagagcccgccgtgggccctgcgctagcaagaagaaaaagaaaggcccccggccgctgcgagagagcctccaggcgaggggcgggtggcggggaggttggcaagcaggaaggcagatattcaacaggttacttgccatgcctgcgtacctctcacagaggtgtcggtgtacacatatatacaggtatccaagtttttaaggggatttgctggtgtcgtttgtggtctcaaatatggtcagaacgacacagaaacggaaggcggctatgacttctgctggtacaacatctgcgaagcctgccaaaaaaaaacaaagtaccactatcagcagcaagcaagagcaagcagaatcccgaaatagacggaataaggacgaaaatgaggctctcactcgggtagaagacgaatccgaggagcaggaagacgaacaagagaaccttgttaggcgctcctctacccgcatg

SEQ ID NO: 2887 - DNA, 703 bp, Nannochloropsis_gaditana
  misc_feature (1)..(622): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggtgcggaggagtgtaggcggaagcaggaggagaagaaaagcagaaaaaaacggaagcgggggggcgaggccgcgatg

SEQ ID NO: 2888 - DNA, 703 bp, Nannochloropsis_gaditana
ggatgcggatctgcgtaaatcgaacacgcatttgttgaatttccaagacggaagggatagaagattcagtagagaggagagagcactgatccctctgtctatccctacggatgtcgaaggaaagtaaagccaagacgagggctcatttggcgcccttgccgagtaaagtcttgttttctgtccgccacccgattccttgtttcgtgtccaatccgaaacttgcagagagcgcatcactccctaccgtgctctcaccctctgtgcttctcttcctctcttccgtgtattcccctttccctcgcccagacttggctgatggatggagcaacataccccatcattgtcatcattaccttcgccgtcaccatgtgcagtggcttcactgcgtgagtaaccaaagagagtcagcaggcccaggtaatcatggaaccaagtcatgaccctccccctccctttttccccgccctccttgcctccctcctatcagatacaagttcctccacagcccggacaaccgcgtggacccgcgcaagcgcacctccttgatgcgagactggaagtaggcctaggcgcctagcagaagggaaggatgcgagactggaagtaggcctaggcgcatagcagaagggaattcgtggagggaaggagaagagacatggagaaggtaggaaagaatgggtggatatagaggagaaaatacatg

SEQ ID NO: 2889 - DNA, 703 bp, Nannochloropsis_gaditana
caccttttcttggagatgtgcctttcccgcccacaattccccgtccgagagtgcccttggccgtcttcatacgcgccatggctgatatgtataaatatatatattacaagctttgctgtacggccgccttgaatgacgagtctagtggtgacaagcggctgcagcttgtagcttccagccctcctccgtcgccgctagagaaaccagcgaggctctcaccaacaatcaagtccgtccgccttgcacgtctcagctccctgtgcattccaaagagatagatgcatgtgagtgacgcggacaatgtggcaacccccccgacaatgccttcgcactcgaaccgcacaaggaaaaggagggaaagcctgtcacacctctcatctggtctccgtcattatggcgcgaaaatattctgcgaaaattgcgcgaaaacagcatatgcaaaaactgcgcgaaaacatcttcgacctcccccgttccaggggacaatgctgtggacataatagtttcgaggcttgtacatctctgtgcacctgcgttgtgcgaaacgatgcgggttgatttttttctgaaaaaactttgtattgatggttggtagcaggcagagtgggcgaattacagtcgccacggagttacaccttcctgcctcctgctcatactttttttcattcagcaacaacacaaacattccagcaaaaaagacatg

SEQ ID NO: 2890 - DNA, 703 bp, Nannochloropsis_gaditana
aggggagtgattgagactcaggtttagccactcctcatgctcgtgtaccttgcccatgcgcttgtgcaagtcatgattcccgtacgttcacgtcatttctagtatgtttatagaagctggatcatcgttaatgactgaaaacgtcctcaacaagttaaagtgccaattatgtaaaggtccttcacgctttaaagagaaagttcgcgccatttctacaagcttcaccttcatttccaccgaaaatctcgtcctggtgacaggcgaaaaagtaatgagaaaatatgaacactagaatatacttcgaatttcgacagctcgcacgcagttgaatattgtgcgagtctttacgatcacgtagaattatgtaaagggttttgagcagcccttcagtcttcaaccacctgccctcagtcgtcgaaggcatgggaaagtactttctagtatcgaaattaacaattggcaagaaatcgcctaaccgatgcatacccatcaatcatcaataatggactggcacttggcaattgtttcagcttttcaaaactttcttcatgttgttttccaagagaacgcttcttcctctcgagacagatttcacaacacaaattggggaacttgagtcactcatcagcttgcttcatatcatatcaatcctcctgccgtagcttactcaccacagactgaaaggggacttcgacttcctatg

SEQ ID NO: 2891 - DNA, 703 bp, Nannochloropsis_gaditana
tggatgatcgaaaggtagtttgctctgtattcgctgggtccatatcactgctatcattttaccttttccattcgcacatttctcagccggattatccaaacatggcacgagttgtgggtcgtgcttacagatatttggcagcggaaggcgtggaagaaaaaatagatcttaatcccatagcctggaaacgagtctatgttgactcaaggaaactgcttgcggtcgttcaggacgttctggtggagcggacggagcgcaaagagtggttgtgttgttgattacggtaaacaatagaaatctcttgatgattaaaagaaaaaaagaacgaagtaaagctgaaggagttacacgcacggattgaaacaagaaaatccaatggtatgccatggtcggtgcctgtacacgggaggttgtgaaattcaaaaatgggccgaagccggaagtcatcgtgcgctcgtcgttcgaaaatatttctgtacgcgccactaccactagtacgatgagctccagaaacgcacaaagtcgatactctctcatgtacatactgtgctgctgaaactaagtctttaccgttctggtggagacctccgttgagcatgatctacgctgtcaccgatatctctcacacccatttcgagccactgacaccctgccgccgccccgccatgcacagggagacttttctcatcctcggtcgaagatg

SEQ ID NO: 2892 - DNA, 703 bp, Nannochloropsis_gaditana
caagaaaagaaatgtatatcatgacaaaaacaaagcatgagctttacgataatgtcaatatttaatgtcggccttgataaatgaaaaacttttttggtatgtgaaggggcagacgtgagtccttgcgcacgcagcagagagcatgaagctgagtgccacgtttatcacacgcttagcaagacattaaaacacataaaagcccacacctgtacacaaccaaaccaaacccaaaataagcagggagaaagtggtatttcgggggagattcctacaatttccaactcgaaagcgggtctccaaagtccacatgatgacgtccgtttttaaaccatgtggaagcagtccttctcctttgaatacaaagcgacgcgtattgtgcgacgtgtgcgttaggcttgggccttctcgtggcttacgtttttgtcagcactcggcggttggtttgtatttttcccttttcctggggattggacacctttttctcacatgggttttcccagcttcaacgaggaaggccgacgaggaattaccacatgcgaggctcatccagtgtcgcccggggtggcctttttgggtttttttcgacgatttttgcgcttgtccaatcctttttcaatgatgagctcacttttatgccctttccgcgtaccagcattcaaacagaatcagttcactcacccaaccacattatttaagcaccatg

SEQ ID NO: 2893 - DNA, 703 bp, Nannochloropsis_gaditana
gctcatcctcggaatatcgaattaaccttcggcacacccaatcgatctccagggcatgaatctgaccttgagggcacaatatcgacctcgggggcaccaaactgagcttccgagtaccaaattgaccttcgtggtaacttgatcttcgcgtatagatctactctaacggatcttcttcggcgagcactctccaactaaagtcgaacatgtacgctgcaacaagccgtatagaatatagtataatcgcacgcaattcccacagaggggcgcgcagtgaattttttttcgctggctcaagcagcgaaattgatgcccagcaactcatgtagttatgcaatctcgggaatttcccagatttgcgagcacgatgagcttatcgtaggcacatcggaaagaccacaagttcatgaaacgagactgcaatgcggacaatctaggacgaggatggactgcggcgacgttttttcatgctatttctttcgacctggtagctgggaaatactatacacccttccattgtattagaaatatgcgttcgagcgtctttttacgttacatggctgcgcataggcctaccactctttccaactcaccatggacaacattcccattcaatgccccgacatcagccagaaacaaagcatacatttgaaaaaggaaacagaatattatgcgaccgctgtcctggtgtctataaaatatg

SEQ ID NO: 2894 - DNA, 703 bp, Nannochloropsis_gaditana
  misc_feature (1)..(654): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggtcctggccgtgtcggtggtgggtttcagcaactgcctctatatg

SEQ ID NO: 2895 - DNA, 703 bp, Nannochloropsis_gaditana
aacagttggtgacaactttctacttccatgtcatgacttgttgcctaatttgtccacaaagtacaattagttctccatatgtataaattttgttgtaaataattttgaagatattactttattgtttccacatctcttcatgctatgggcacgcagtacaccccctcgtgccagctttcagggggaggtcaggtcgagagactaaataccccatccattctcgtcacacaagtcgtagcacactaattgcttacatcagcgcgtttatttttcatgccgtgagtgaggacacgcgccccgtgtttcagtgcatgctaagagaaaaagctagcgtcttgccgaaggaggagcaagaacttgaaattttgaaaaatcgttaaatttcaagctctccgccggtttgaggagggaagtggttcatgaggggacacgtttgtcccctggtttgacggagtgtgtagatgatctgtctgcgatttacccatgtgatataagacatcaatagtatccttttaggcatagtctttatcagggcgatcatggatgggacatcgacgagacgtgtttgggattgaagttttctcctgacgcagggcatcgaaggaagtagtcaagtaattcgatagcacgtaacgatccgcatacaatttcaacaggattaaatatagaatgcaggacatagaaacgacgaccatttagcatg

SEQ ID NO: 2896 - DNA, 703 bp, Nannochloropsis_gaditana
aagacgcttatctgctcgagctggaggcgtggatgatggagggtctttttgtcgtgcttgcgtcgacatcttcgctcggaagcatcggacaattacatcaagttgttcgatccattgtcatattggtagcttgctttgctccctgtagaggccttggcactttcccctgagtcttgctggaaagttttgctttttttgcgtgcccctactaggaggaggtaaaaatatttcctatatcttgatccgcggttcgcattgatttaagggtagtgatgtaatagaggaaatagttgaattccaaatatggaatggagagcaaacgactttggcttaaatcgaatttttgcttctgctctttttggccgtaaattttcttattgtatgggattagatctgcttcggccgtttaaatgtctgcacatcgactgaactttctccacaaaaatgtggacgccttacgaagcccaaaattcatgtcaggcacaactgcgtttccagagagatacacatggtggtgagtcacagaccagattctaacgaaattccgcgagtattcggatatgtgtggccagctccctttgtctccttcccaaaccgcgatggtgctgcccgaccgagcccggatgtcgcacggctctcacgtgctactcgctgtccataccaacaatgttacagggataaacgtgtgaaacgaccgaggatg

SEQ ID NO: 2897 - DNA, 703 bp, Nannochloropsis_gaditana
  misc_feature (1)..(552): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccccccccttcttttactattcctgtctgccccccccgtcgtcctcctttttctcctttcctattcatcccacccttttctccctccctccctccctccttccttccccgcgcgcccgtcctctgccttttcctcttgctccaggtgg

SEQ ID NO: 2898 - DNA, 703 bp, Nannochloropsis_gaditana
acgattgactcattcttgaattcaaaaaagagttatgccactagttcaaacctgtcatcacgcatttgatttgacgtgcatattcactagatgacgccggcgtccttttcctttctccctataacctcctgcctctcaaagcaacatgtagttccttacactatgcagacaatatgccctcgaacaaataaatttttctttatcccatcgatcctggcagtaatacccttttcaaatactgatttggcacacgtattctttcagcatgtccacagtgctcgatgcatttcccgtccgtcgcgaagaggtaactttttgcctcgatggactcccgtggccctagttgctatttcaggtgggttttagcgactagagcgatgcttcctgcctacgcgcatgccctccataatttcgtcagacaaaagcgtcaatgccgccacaacacgtccttggcatcccggcagtggatggagggagaagacgcccggcgtgctttgcatctgcatacgcctacattgacaaagggaaaacttggtttgtgacggccttctccaccacacatgacagcctcattccctgtgagggcccatcctacaactactcggggtcacgccacgaagaaattgtgggcttagtggaggtgaccttggctacgaccccctctcgccttctcctatggcaaacaaaagagggcaggggcgac

SEQ ID NO: 2899 - DNA, 703 bp, Nannochloropsis_gaditana
  misc_feature (479)..(547): n is a, c, g, or t
gagagtccacacaagataatgatagggatgccagcgcaagctggctcgggcgaagggggccaaggcggaggagagaggagcacgctaagggaggcgggcgagaagggagggaaggagggagggaggaagggaggagcgcgtacctgaggctgtcagcttgttgactgggatgccggtccagcggctcactacctcggcgatgctctgctcgttcaccatctcccgcaccatgtcttagcaaaggaagggagggggagggagtgagcgcctccagaccccgcgcgccttgtccttcagaccccccctccggccctccctcctcgaaatccccacctgactggctggcgtccccccgcttggcctcgatctcggccgagacttgggccaggcgctgctctatctcgggtaacgcgtggtacttgaggtccgccacctgccgcgaccgcgaaagagaacggacgggtgagaaaagacggacnnnnnnnnnnnnnnnnnnnnnnnnnnnnnnnnnnnnnnnnnnnnnnnnnnnnnnnnnnnnnnnnnnnnngaccatacctagagccaagcccgcggccagtacgtacgcctcccggtcctgtggtagggcgtgagaagcagcgtgagatatggcgcagcggtggaagggggtgaggccaggggaggcacggagggaggagaaagcggtgcgccaacgggcggcggc

SEQ ID NO: 2900 - DNA, 703 bp, Nannochloropsis_gaditana
cgcttcgctttacgcacgaatgtgaacattttccttctgttgttctgtctgctttttcttggagttccgcatgctatgttcaactttcgcatgttggtatgtctcattctcctaaagtttgtttctccataatgtctctttgcggataatgcctaggttaagtgctattctctgcatcacatgcatatcgggcgcgtaactgtatgcttgtaggtgactaggaagccggacacttgtaaatattttcacacgcgtgccaaacgagtgttcgctacgtgtatcgtttctatgagcttacgagatcagtgagatgcgcgttcgtgagaggctgagaagtctctttgtcatccagacattccattatcgcggtcacattttcttcttatctaaaaacatcgcttccattctatcttcaattatacacagcaaaaagcaagctttcgctacctaacatactttcaagcaacatggcactttctcgctactggcgtgacgaccccctcggctccaacctcatcgagcgtgacccttttgccgacttcttcagcactggaggtaagccactgatcgatataatacacggcgtgacattgcggagaggaatccgaggacgtgatcttcacttcagaagaaagctcgaagggtagacttatacaccttggccgagatttattgatgcattcttctcagtattaatttcatg

SEQ ID NO: 2901 - DNA, 703 bp, Nannochloropsis_gaditana
gattccgccataagttttatcttccaagccagtcaatactgctggttgtatgacgagtgttcgaccgtacaaagactctgctgacgtagtgtattgaccagcttgcttcccctgtgacccccttactcaaagtcccaaaaggtacaccttgtcgcagatccaatacgataagcatagattatctgtgtctcactcttccgtgttgcaacgtgttgtgcgctgcgaacctttgtagactcgttaattaaaatgtatacggttctcgtcaatgattagccaaacacatgggacatgtatagcggtctctcgactgtatcgtcttggaaaagtcagttatctcatatagataagaaataaaaaatctctacaaacaggcatctgtaaactcttacatcccctgatgattcatcaacgccgagtcatgtacctggcagtaccattgtggatcgtgctcttcggggctctcaccgcgacagatgcctcgcgcagcaacattgtcaccggccacacacacaggaaaggccagctatcaggcaatcgaaagcttgtacgactcgcggatgaagagaaaaagggattcctatcaattcctcaggatgaccctgaccccgcgggccgcgctctacgcttgagctatagagcgcctttctgggagtttgtaccttatgcttccaaaaatccattactggttaatttgaccatg

SEQ ID NO: 2902 - DNA, 703 bp, Nannochloropsis_gaditana
ctccaccctgataagccgcccggcggagccgttgctacaaatctggcgcgcggcacagcgtctggtggagtgggcggtccggcagaagcagtcctcgggcctcacattccctgccatggccgggctactggagcacaaggcgcagttcctcctctcggtccttcccagcacaacggctcaggccgtcgcgcaggagctcgcggaagtcacccatgcccacggcctccctattgacgctgaggacagagacaggtccggggagctcctcgccgaagccgtcactttcctggaatgcggccttcgtgacatggaggccctgcgtaaggaactgctccggacttccctggccgccttcgaccgggcagccggcctccgcgcctttgtcctcctcctgggctcctttcatcccccagcaccggtctcgggcgcgactactgcctcaatgggccctcccgccccccccgggacggaccgccccttgacgttcggggctgccgtcgcctctgtcctccaatatctggcgcctgctctgctgggccacctggatccattttctttgaacgataccctgtggcagagtgggggagggtcgctcttcgggcaccatcagtccgctccacccggggggaatggggcggggatgacggggggaggaagcctcccgggtgcgcaagctgccagcttggcgttccagtcccaccgg

SEQ ID NO: 2903 - DNA, 703 bp, Nannochloropsis_gaditana
aactttcatcccttcttcatcttcccctacctgtgaaggagacagagcgtactaaataccccgcgacgcattttttgaatttttctttttgtaacgcgtggaataccgtattcacatccgacgcgatgttatcacaaaggatgccctcatgagaagcgactcacgacttgctaagtgcagccgcgggaaacttaggtgcgagcgtcgagcaggttgacaagcccggccacccagaacgtttccgaggaggctcgccatcccttcaagccgccacctcacaggccgtatgcacttgtaaggaaggctcccctgcgccacggcacctgaagactgtatttcgttccgtgtgacagcccgggccacgagtgggatggcgggtggtggcctagcagcctccctggtgtgaggggtctccgcctgaatcctgaaacatttgctctctgacgcctcggtcagatcgcgcggtgggagtgttagtgcacttcatttcattcactgcctcttcttggcagtgctccctccatatgccatccttctttcattcacgcgcatactttggacagcagtagacacggttgaggtttacgtgcgggtgactcagaaggtcgttttgtgacaccgtgttcctcgcctcctctcccgttctgatactcacgaatttccacgaaatttctacagacaagcagcatatcagccttaaatg

SEQ ID NO: 2904 - DNA, 703 bp, Nannochloropsis_gaditana
acacaagacgccggctatcaacactgtcgaccgcccctttcctgtacaaggcgtgcggtctccgcccggcggatgaggcatgccgcagagccaacccctgagcgggatttcgagataacaagaagcataaatgagcacggtgaatagaaaatccattgtaagtggcctcgattactatgacccggacctttccgaagacttcacaaggttatgagcacgcacgggagaggggaaaaacccacttgccgatccgctccgctcgactccccagacgtgtgatacgaacgcccacggcattgtaacatggagactctgaccgctgttgacacacctccccgcgtgcaaacaccaattcactcgccatcctcgtcccggcacgccttgttggactcgcgaacttggcaggagggacagaaatttggcggcttcacgcagaaggagggccccttcacctggcggggaggctcctttctctatgatcacgccccccggcactgtgaatcgaaacatgtgtacggatatgtgtccacacggtgtcttagttgtgcagatgacgtgaagccggtgccctcgtgaagttgcgggcacttcctggcgactgggctccaaagtcggtcatgcttcttttcacctcttcctcctccgatgcccaacccgctctcctactctgaatcatggacaggttgatcacacactgttgatg

SEQ ID NO: 2905 - DNA, 703 bp, Nannochloropsis_gaditana
cataccttacagcttagaacgaaatgtgtactctgtgtatgtaaagtccgaccgtttcgtccctctcactgtggcaatagggactcctgaaggggttcacatttgaacgagaacagtaaggcttctttccgccctcgtaattgcttaataacctgcacaatcacacaatcattttgattatgttgcatagcatattgtactgtagacgttaatgttacttttgtgaactgtgctatggttcgaaggcgatgaagagctctttttgttggctgagctttgactcgcatgcggccagaaatttgaagatgcgtttcatatttcaatttgaaaacgaatcggcacccgaagtaaggagaaacgacaacgcttccacgcgctggtaagatcgttgcgcgttttatgctttgtgtattctgctatccactttgtggatattcaattttgtaaggggcattgagttgttggatggtgagtttcgtcggtggaacatcgtctgaaagctgcacaactttctttgaaccgccatattcttatcctggtgtgcggttttgtgcggtgcaagaggcgatcttacctgtctgtagtgctagatgcgtccacatatccattttgtaaactacaacttcttatgaactcatgtacaaatctgcaaccactgcgtttgtggcaaatctgttttgatcataaggtgcggccttccatg

SEQ ID NO: 2906 - DNA, 703 bp, Nannochloropsis_gaditana
gaagaaactgatagccagcgaggagaaacgtcgtccagaagggggcgggaagaaagagggcaagaaaggagggcaaggaaggggaagtggtcgacgatgagagagtgcgagatattggatagcgaaggcagtatcttgaggcgtggagggagcctttagccagagcacttgtatgtaaagaaacataagtaaggcaatctattttgtcctcgcaactgtttctatacttgatcgattttagaatgacgttcaagcatcctccctcatgatacagtacaacgaagtactggctttaggcgaagaggacgcggggagccttcgggcgccatgacaaccaacccggatgtagggcccccccggtctctccatgcaaaggcgtctttacgcaacaccttacgtgcataccgacggaaaaaccagctaacgctgtgagaatgattcgcgtgatgtgtatcggtgctacccaattttccagtggtgcggcagttcttgggagagcgcatggcggtgaggggaggaggttgcttcgcatataccatgacgctttttcatccttctagccaagtttgcgtgtgcgcgtcaacgtactaaaacccagctcaacggcgcgatcgagcgtttgtttgagacacctgcggtgcacacgcttttaagatgagatgccttctcatgaggatcccactcctggcgccatttgcacaca

SEQ ID NO: 2907 - DNA, 703 bp, Nannochloropsis_gaditana
catttgctgagacggatgactgactttgagctttggttgcccgtgcgtaatgatttgcgtggtagtctggtcgctatccatcgctcggcttcctccttgctcctccacgcctcgtctccacatgcacccgcattcgcaaacacactgagtcatgtgtgactaagcaatgccaaaccttacaaaggcaagatgtttattccatcgtggtctgctttggtcttccccgcgcatgattgtggcaggacgttctacgtgcctacgctcctgttcctcgtttgtcttcaccaaaatagcctttggtgattgtatggtttttaccgccacgaccccgtccgctgcgtcatccatctcggtaggaaacccctggggcgcaaacattacatgtacctttcacacctttcacacacccatgccgcacacacagggagccttgtagtgcgccgtgcacgttttattcccgtgagcctccagccatttcatggcatcgaccgccttcctcctcctcgaatcactattccttactggagagaatgacctttttctaagaggcgccggtgggggggcttttcttctgtggaatgcacacacctggctttcgcaccatttcatcgcatggggactcctggtccttgcaggtttggaaattttagcctgtctggtcttcgccttcgggcgtctgcgacgggtgccgtcgattcccatg

SEQ ID NO: 2908 - DNA, 703 bp, Nannochloropsis_gaditana
cttgttgaagaccgaaaagaaccctttctttcgatggcgcgtggaacgattgatggaggcggaaacttgaggtcaaaacgcggccgggaagggagggagggaaaaaaataatgcttcgacgagaataggaaagactgacgagaatgatggtgttggagtgggaagcgtcaagcttgttgggggcagggaggatgcagtatagggccagcgcggaaaggaattgcaacgacgggagagagagaatgcttgtccttgttctttctcatcaaaggcgaggctggaactaggaggaacgggcacttatgtatgctttatcacttaccagcaattgagtgcttgtcatcaccaacactcagaaagaacagcgcaacggagtcaaaacccaacgtttcccttacggatagacggcacttggccccttccattcacgatttttaccccatgcggatttttccagtaacaccgcttgactgagcaaacccttctcagaatgatggaatatgtctcataacctcatatgtgtacagacatgctctctttgtcccggactccactagctatgcaaagtctgcgtcatgtctaaacctccccaccctgccagaacatgcccatgtcctatttgagcgttccctgaaggactcacgcccttgaaacaatcctgtgtcacggacacgtagttaggtacacaaagaaatcggccatg

SEQ ID NO: 2909 - DNA, 703 bp, Nannochloropsis_gaditana
gaacaggttgtctagccaaggacatgaagacggtctgggaccgcattgtacgcacaaaatggtctggaactcagagagccgatcagggatcgtgcagagtaccgcccggggcgaagacgcgtatgtccatatatgcggggagagacgtctgcccatgaagtttacaaaagcagagagtcttcttaactttccgggaagacgtcgctccccggagatatcgatttatgtacattcgcgtcttcgcccctggcggcattcagcacgatctcagaccattttgtgtgtatgtcacggtccagactgtcttcatgcggtcccagaccgtcttcatgccgtcgtggaccgatattctcggtccccgatcattctgtacattgattctctggtaacatgctcgcttcgacctcctaaatcctgggtggagcaagcgctacctcgttcgggatcgaaggtttttattgctttgcgttgaaccctgcggaaaagttcagggttgtggaagtaggctttgatgccaagttgacttcaataacaaattaagcgagcgagacgagcgagaagaggaggcggctactacgagtgataggcacgagacaggggagacaaagccgtcctcgagcctgctcgtgtcgattgaatgaatttaaatacaagaactttgtgccattcacacacagggggtgtgtagcacgccagacagatg

SEQ ID NO: 2910 - DNA, 703 bp, Nannochloropsis_gaditana
  misc_feature (1)..(296): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggcccgccgcacctttatcgtcagagcgctcccggaggacctcgacccccccaaggacgccaacgacgccctgcttcgaaatttgaatttggaacggatgattcaaaatgcgcaacggctccccgacacgcgtgtcatccgtttctccgaccttcgccccttggtgtttgacgagctgcggaaccgggacaagcacgaaggcgtctcggccaagtctttcccgggcctcatggcgctgctgaaaggcttccggaagggggagatgacggtcttgacaggccccacgggcgcggggaaaaccaccttcctctcccagctctccctggacctggctcgggggggcatgaacacgctgtgggggtcgtttgaggtgcaaaacgtcaagttgatcgagaagatgatgc

SEQ ID NO: 2911 - DNA, 703 bp, Nannochloropsis_gaditana
agtcggaccgctgagaatgggagcaggcccgaggggggagggatacaaagttttgggtcgcacgcacgagggagatccatccctgaaggcatgtgtaaaagaggggaaaatatgcagtggtggcctcgatgtatgcatatatgcagggatttagggggccgggcgagtctagccagcgcccagccctttggtagactcgccttgcgtgcaaagagagaggctttttctccttcctccgcatcgtagagctcacaccgccattgcctggcgtgtaaggtctcaaaatagttgcctctcatcagtgacacatatcaaaatagtcacatccatggaccaaaaggtttcaaattgtcgggtaaggggagggagggacgagcattatctggcgacagaggtccgtggcgaggctgcgacgacggcttctcggtttaaacactttgtctcccgcagcgcctttttgtacaccggtttatttttcgtcaacatttttccacgaccaccataagcaatgtgcatgtccaacacgtgcgtgcgtcggccttgtgtgccgctcgcgcgacagtcttgggcgggcccgtctccgctacctccgaacgctaacgtttgcttgaaattttgaatatgggccaccaggcgtcacgcgaactcgggcaggaggggaggctgccgcgacgtcttggcaacgaaccacacacgtgccatg

SEQ ID NO: 2912 - DNA, 703 bp, Nannochloropsis_gaditana
tccctctcagggctcgaattctacatggcaggatcctagcctccattataacgagacgatggccacgaacatggtctactatgctgcagccgcctactattgtagaacatccgcctgcgagacatgggcatgcgggtaattatcgacttgtcaggtctcggttatcaaagggctccattgtcgagaaggacacattgtcctacttgtcacgtctactatcttatctaaacaccgtgctcccgggctttccttcccactcagatcctgtgcgcggttcccaaacatgacagtgcgtcgtgtctctgcgggattcggcaatggttatgtgggttatgatgcaaaggaaggtaatatccatgtgtaacttgcgaaagcccgacctggcatttttgacgcacttattacccgaaaaattactcttctcttcctgcggctggcgggatccaggcgcgatcgttgtggcgtttgccggtacggattcgagcagcatcgaaaactggatatctaatttggatgctttcaagacagactacactgtaggctcttgcgaggtaaaggttatcttctaagaaatgaaatgagataggcatttccttctttagtaagagatggtgatcggaacccgcggagaggagaaaagcaacacatagactaacagacagtcgtggagaaacgttatttgaaaccgcctaatatcatggac

SEQ ID NO: 2913 - DNA, 703 bp, Nannochloropsis_gaditana
ctcaacgtcggagatgaatgactttgaagcccgcaatacatgcactcattgattattatgcgtatttggcatggatattggccatcacgcttactgatgccgacgacgggagaatggatgacaggctggtgaccggtgataagtttccgaggactaaatccgcagaaggaaaaccaatcgattgagaagaatgtaatgggatgcagcacttatgtcaagcacgtcagagccccttgttccttgacatgagtgacataataatttttgtggttgcgcgcctgcctatctacctgtctgtctgtcggtctcttcatattcctcctgaacctcccggcgaaaagcaaaagtgcatcgtgtgcggcatacatttgaaaaatagaaatatgaaaacagaaagctacatgagggtaaggttgcatatatggagtgaaatggtgtctgtctttcccccccactattcttcatagaaggggttttccccccaatatacaagtatctgttgtagagccgccactggagatcggcctgccatgggatacaccacgacggcaatcgtattagtacctttatcttggcttttatcctctctgtgattcagccactgctttactgtgagccctcccctcagtttccttgaccttcctactccttaatccttccaccgtcctagagtacaacctccccccccgccgcccgcaatccg

SEQ ID NO: 2914 - DNA, 703 bp, Nannochloropsis_gaditana
gagtgagaactatgtgaatgaaaagggggggggaaagacaggccctcttccaacttttttggcgagcgccggcgaccccgaccaacagtggccggagggaggaggcagaggagggggacaagggcacgaggtcaacgtcaacgacggcggaagagtttcaagtcaaggcataagaatctcacgtcacactagattaggtcacttctagtccagtagtacgggcctttatgtcatcttcagccgtagacgctgcaactgcgaggtcggacccccgctgtgagttccgacggctggtagacgccaacatttgtaagttatgtagaggataaggaagtggcaggacgcacgtgaaacataaagaggtgaaaaatatccattttattgaccctcatatccagtgaaatgcgtggaatccatggggcagctcataaagacagcaaaggtgcgtgactggccgttacattaccaggtttctaaatggaagaaatttatgtatactgcatttattatcacatctcagatgggctcaacgcgggaagatgcgcacatggacgccaaccgtgtaaccatattgaccgggaccattgtaagtgtcatagatccttcggagtatctttctgtggaatcatgcagacatatccatctcgtttatttttatttacctgtcggagttttggcttgaagtccgtttttggcattcgtc

SEQ ID NO: 2915 - DNA, 703 bp, Nannochloropsis_gaditana; identical to SEQ ID NO: 728

SEQ ID NO: 2916 - DNA, 703 bp, Nannochloropsis_gaditana
cttgctctacagaaagcagcgtgaagagttgagagacaagacaaacttctgccagcgctcgttatttgagcatgctgctcatgatgaaaagaaagtggtttaattgaagcacagttgtccgctaataatttggaatacgaacaaaggtctcggagttgtgctcgctggtttgggatgtgaccaatgcgaagaaggaaagatggatacgggctgaaaaatgatattgaaatcgtctcggactacctcatcatatgagcatcctacaagattctattttactttacacgcacctttgcaactcgcagactccgagacatagtgtgctaccagaggggacacgccctcctcccgtcggcgcgaggggcgttgtcgcagcgacgcattcatgaggataatgaatgtctctcaccggcctccgactcaattacttctcccagctatacgttgatgagcctgtctggatattgccagtattgtgagctcacaagacaaaaatattccgtccgaaaatcccccgtgcgcaagtatcctcccttcgaagcgagccgcctctctctgcgacgtcatgcctcgcccgctcgcccagtccatggaccatggcccctgtgcaacctgtcgtgcatcacagtcgcggaccagaaatttccccctgtcacccctcgcacgccctgccctccttcaagtgacgacagttttcgacatg

SEQ ID NO: 2917 - DNA, 703 bp, Nannochloropsis_gaditana
caagggagcgagtataagagcgtgatttggtgcaagtcttgcaagtgcagcagggggcagggcgggaggatgacggaacgggaggctttgttctatcctcgcccccggccacagcgaacactagcgccacccaggcatgtggctggaaaaagagtgacgcatcctgcacggaaaaggcaggcgtcggcccctttctcgtagagggtattgagcaacgggcgtgcagcacaatatgtcgggcgacacattgaaaagcatcacacgcgctcttttgacgtccatcagtgtttgagagcacgttttgtggcattggcgcggatggactcgctggcttctcttccgagcactgtttcatgtacccatgcctctttcacgtcgtgccctatgaaccgctcatgatgcatgagacaaattgtgccacgttgcctctcaccacggccccaggcagagatctttctctgcctatcatgttgtctctgtcttcccgtttagtgtcgtactcttctcatggagtattccccaccgatcttccaattgatgcgcagcattcgccccgcgacgaccatcttcttaggcacgcagtgtgatgcacagcacaatggagccaatggcaaataagcatgtcttcgcgtcttatattcctttgtgtgacttctttttaaccatacaggtccgccttaaataacgtcaccgttcgaaaatg

SEQ ID NO: 2918 - DNA, 703 bp, Nannochloropsis_gaditana; identical to SEQ ID NO: 734

SEQ ID NO: 2919 - DNA, 703 bp, Nannochloropsis_gaditana; identical to SEQ ID NO: 735

SEQ ID NO: 2920 - DNA, 703 bp, Nannochloropsis_gaditana
ttttcgtggatatgtgcggagaaatcagcgcatagggcacgctttaggctccagtgcttgactataatctcaaactaatcgtcatgtaacacatgtgactcggaattctgaacacgggacgatggctgacctgtagcaggaaatatttaggtgtgtaggtgccacacttcatgcttcttgcatcacatcatggccatcacgcactcgttctccgtgggtcacgcatggcttctcaattttccgatcactcgccatcgtaacgttgcacctcacgataaaaaattgacatacgcacatgcgtatcaaaagcgttcgtggcaggacatttcattttatctcatgtagatgccccctcctttcccccggtcatcaaagaagagagcgtctcggtcgccctcaccacatctaacctgagtttgctttcgttggcttccgtctcgtcgagagctcgtgaaactgtgcggcgctgaaaatggcaaaaagaaccgagaacaccgcggcagtacatttgaagtctctggtcgggccaatgcaagatactctaaatcagcattgggttgatggtaagcagtcttggatggaggtcgaagagtttcagcgcttcagactggtgacggcgtatctagattgtgctttatgacgcttcgcttttgcacatcgctcaacttatgcaggtaaaaaaaagaacttcgggttcaaaatg

SEQ ID NO: 2921 - DNA, 703 bp, Nannochloropsis_gaditana; identical to SEQ ID NO: 714

SEQ ID NO: 2922 - DNA, 703 bp, Nannochloropsis_gaditana; identical to SEQ ID NO: 716

SEQ ID NO: 2923 - DNA, 703 bp, Nannochloropsis_gaditana; identical to SEQ ID NO: 718

SEQ ID NO: 2924 - DNA, 703 bp, Nannochloropsis_gaditana; identical to SEQ ID NO: 722

SEQ ID NO: 2925 - DNA, 703 bp, Nannochloropsis_gaditana; identical to SEQ ID NO: 723

SEQ ID NO: 2926 - DNA, 703 bp, Nannochloropsis_gaditana; identical to SEQ ID NO: 725

SEQ ID NO: 2927 - DNA, 703 bp, Nannochloropsis_gaditana
gtggttggagccccgatgtgcatgagctttgagtctcatgatgcactcgaggctctccgacaatttaaccccacctctgacgctttgcgcggatgggtgtcctctttggccggctcgctcgtcaggtcagggagatagtatcataggcgtctgcagtgctgtttcggatgcatgcacaattgagaagggaagagccatcttcgtgagcccaacaattcttcttaatttttactagctaatcattcgaggtacaagggataataagtcttgcatcaacgcagccatcagtgaaaaagttatttcgagcactgatcaatgcatcggtcgatatgataattgcagcaattgagttggcgtcttcttccagtcaaagaaaggctcttcatagcccatacccgctgtcatgcccttctttgcacgcaatacacgggcatgtaaagcatttggagcgtctcgaggccattgactccaaaaggacggtcagacctcgtctcgcgctgggattttttacatttgatggtatcgccaagaaaaaacgaggaagctgcgacgggggcaacagccgacctctgccctgacggtgtaaaagccttccttgctaattgcatgctgagacatacataaccatcacgttcatggatgcacagggacgaaattgtacaggctctatcgttctccggatttttgaaccgcaggcggcatg

SEQ ID NO: 2928 - DNA, 703 bp, Nannochloropsis_gaditana
  misc_feature (391)..(400): n is a, c, g, or t
gtgcggtgggacgaggagcggcagagcgacgtattggtggaggtgacgtttgcaatcccttcctcggccatcccaagcctttcgtcctcccgttccccttcctcgacgattgtcatcaccagtctcgatgaggcgggagtggcgcccgatgaagaaaatataggagcacgtgaagacgtcagcacaagtgcgcagaggtcagggcatcctttggattcctcacgaattttgcggttgcaggcatggggaggttgggaggggaatgctgctttgatcgaaacgcacgagggagccatttacaaatacacgcgaagacgaggattaaagaaaggaggaaaggaaactcatcggtcgatcacatggatcatggacatgttggagccgtgcccgnnnnnnnnnntaccattgggaaagagagtcgcatcgtgagcatcgggtttcgacaccccaggaggtggtgggactctccacgcgtgcacgtctctattacggagagcaccttttgtgcaatgcggtggcttccgtgacagttaatcctgcgtttggtatgctcatgtacgtcactttgggctcccaaccgactttacggtttgtgacctttcggagccttgccggccttgacgtgatgggagggagcgaggggggggtagtggaatgccccacggagggccgaccggtggaacgagggtcccgcctgattatg

SEQ ID NO: 2929 - DNA, 703 bp, Nannochloropsis_gaditana
gcaggtgagattttcgataccgtgtcacgtcacaagattaaacagcgactgtctgatctcacgatctctgagccccgaaacatgaaacaaaaaaaatgcatcccatcacatttctccatgccgccatttttgagacacgagcaaagtaaaagcatcagggatcaggggtctcccctcgtcttgttgattttatcgctagagaggccaagactggctttcgctggtgcatttcgggactgagagttgcagcctgtaggatatcttaatgccttgggcgagagcgggccgatggaactaccggggggagggatggattgagatgcggcattgatgtatgggctttccttcatgccaatgtgcgtctcgatctgggtgggtgggagcatcgggggttatattggtggcacgtgttgttttgggtaggccgcagtattgtcgtgatcggtgggggcagggcaatccacgcgcgggtttggacaagctcacttttaaaaaaaatcctgagtgcaatgaaagtgtgttgttcaacattgctgcacttgtggctcatgtagaatatatgtatgccctcagttggatagaatggggccctttgttaatctgtggagacgcgccttgtgagttggtgaagaatccgtcgagtcgccacccctcacgtgtttcctttatttaatcattgaccaacagccatcaaagcatcatg

SEQ ID NO: 2930 - DNA, 703 bp, Nannochloropsis_gaditana
cctccagtgcgattgggcatggggcatgatggaaaaagaaggcttgaagtaacgcccttcagggtgccgattggatggggaaagaatttttcgaataaaacacaaaaagttgaaaatagacgaggcaaaagatgtgctgtacttcctagaaatgatgagagattgtaggaagatgttatgttttacttcctttctaggataggaaatgcccaatatcctttcgaaggacgtttctttaaaatgagccatccacaattatcatcacagtatttttctgagcgttttatacgtttacatacgtttacactcaatgcctcaagcacgtgtgtcacggtagggcttcaggtttgaaaaaggcttgttatgttcccatgattaacctcctaccttcaagttgtagcacaaacaagctttcgataggctgcactccttgttgctgatgctacccattatgccctactatcggtgcttattcatgccgcgtatgcgtttgtacacggatttgtacgcgccttggtggttgatgcatgtctcgcggaggtaccgtctttgtcgcgagggattggtcaggctatggccgctcccgtgcttttctgacagcaaccgtcattcgagcaagaattaagaatttgtccgaaacagcctcatccaaaagaaatgtgcttacaactcgtccgcgttttctcaacaaggtgtgtacatg

SEQ ID NO: 2931 - DNA, 703 bp, Nannochloropsis_gaditana
tgacttgcttccaatcaggacaaggtgaagtcatgttttacggggggtccgaattcctgtgccccgttgtttgagagtgatcctgtgcactgattttataacggaacgctatgtgagcttgtgaaagtgccgtaagattactgcctcgggaaacattggcctccctaaagtatgttgagtagctcgacccggggcttgctgcaggcctggtacgtcaaacatcatatcatcagtgagctatccgcaggctcggtacgttaaacaccatatcatcaatgagctatccgcaggctgggtacgtcaaacatcatatcatgagagcgagctatccgcaggctgggtacgttaaacatcatatcatcagagcttaagttcgtataagcccgcgaaagagaagacagaagacgcgcagaaagcaagcctgcggtcctgcgccatggctgggcggtgggatgaatctggaggcatttagcaggttgaaatatatttttgttcctggttgacctttttttatgacttttcaggaaattttgacgtttcgcccataatctcagggagggggagacctcaaggccggcccagacccaagtgctaaggagacagaggtactgcccaacctgcattgctcctcaactcttcgttattaacgctgtacgtatataaagtcataaaaatttcggcgtgataggccattctatccatg

SEQ ID NO: 2932 - DNA, 703 bp, Nannochloropsis_gaditana
  misc_feature (1)..(671): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccctccctcccgggccggaagggatc

SEQ ID NO: 2933 - DNA, 703 bp, Nannochloropsis_gaditana
cgtttgcatgcgcgtaacagtgtcgagtcagcaccgcatccaaaaaacacaatttattctgtagctacgaagagaggggagggaggaggtcgggatgatggtatttagcaccactggcaacgtacctgtccgtcgatggacgtgtcgccttgtaaagtcacgggacgcagcatgaataccacgctctggtcagtcctagctgtgctatgggaaagagattttgagaaaggagggaaacaaaaaagacctaaccctgggctactgtgagagccggctgctgagatctccccctttcttgcaactcacgatctccccaacacacaaacttagtacagccatcctggcgcctggatttcaacgacccctccttgcagcacatttacgccacttcgcattcctccgtcctaacaccacgtctttgttcctcctggcctgcccgtctcatcctccctccctcctccactcgctcgccttccgccccactgccaaacctcttcaccccttcacaaatcctcaacttttctgttcccaacggtttcttgggacgtccagcagtcttagcagcactcttgctaattacagtggtccttggcgccttctcctgtccatttcaggagggctcaaccccaaacataccttgtcaagccgcctctttgccagtagcagcggcagcagtgacaccagctgtaacaaaagcgaaatg

SEQ ID NO: 2934 - DNA, 703 bp, Nannochloropsis_gaditana
aggggcggacgcagcggtggcgcccacggcgagggaggtggaggttttcccagtggagacaggcgcaaaggccaggggcatcatgggcgccgtgtttggtctctgtggtgggaagagaggagagggtcggaccggcttgtcgtgggaaagtctcccagtgaacgaggagtcgatcgagcaattccgtcggctcaccgtcatcaccgtcctctccaacatgcaatacttgccctttctcctccccatcctccctttcctcctctcgggccttcccctcccccgggcggctttccattggctgggggtcttctgttgtctcacggcggcagttgtgatcaacgcgtacgtgaaaaccacgcttgccaagccccccccccgcctttcctccttccaccacaccctccttcgcgccctcccctccctcattcacgctctccccgggctctgcaccgtactggcctggagggagggtcaaggcccttctgtggtcggggaccggggggggctcccgtcggctttccccgcctggttctgtctcacggcaatctactacgtctacctaggtctcactttccgggggaggccggaggtgacgggtgggaggtacttgggtgaggggctggaactgtggaaggggggctggtccctcttcacttttctggacgggatcgatcaatatttccaagccaagctcgtcttcatg

SEQ ID NO: 2935 - DNA, 703 bp, Nannochloropsis_gaditana
  misc_feature (102)..(111): n is a, c, g, or t
gcggaggagaggaggcatccgtaccgccaccgacgcgtcagcgtgggatctcctgtgccatgcaatggagaaatatgtacgcaatgaaggatgacaacgtgnnnnnnnnnnaaggatgggggggggggaccggcgcgcgtccattgatgtgggatgaggagcatgcctgcgtaacggaatatgtaattgaagggggatgggagagtctttgtgcgggcatgtgcgtgtgtaggtgattgtgggcgttggtggttggtggggggacgagggggagggaaaggagctgggagggatagggagcgccaacgttctgatgatgatgcgcctgccgagcttttcgatccttctattctgggatctatccatttttcttcctctcttactgactattccattctgaccattccattctcagtaccaggatgcctatgtacggggagagatcaaagcacaacgaggaggcaacgcgctcgggctccccccctcccccccgccctccgcctctccctcctgctcctccactcctccctcccaggcttcagcctcggacgccccctttttctcgccaagtccctctgttggtgtctcccctcctccgtcgccctttgttcctgctccccccaccgccttcacggacacggagggttcgctgcccggaggggtcaccttggggaagaggaaaatgggccaaggcccggaagaa

SEQ ID NO: 2936 - DNA, 703 bp, Nannochloropsis_gaditana
  misc_feature (1)..(676): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgacggagggagcgggggaagaatg

SEQ ID NO: 2937 - DNA, 703 bp, Nannochloropsis_gaditana
gcagcaaagatagaaagcttctcctcgttacaaaagtcgtctttgcccacttcggtgctttgacgattttgctccgcgacgcatcaggcaccaactacagcagccactgcagccattttagctgccattctaggagcatcacagggcccttacagattatgtttctactgagagaatcctgtttcttgctttcctatgctagctgttgtctaccggtagtgaaaggaaagtccatacacttaatctttctaggcaccaggacaataacaaagccttgccttaaagctcttcaagtttctttatttaagatggattcagcgcagaggtcaacggtacgcgacaattgactttcttacggaagttacaacatcgtcaggcgccaagaaagaagaagcaattcgatgacaaacacgcatgaaatatggttcaagacacgaagtatgtccataaattgagccacgttgtcctgagtactcattgtattgacatgcgtattgtaaacgaggccctgttgtcgatcagacgctgcaagtaggaatcggacggggagagcatgggccaaccgcaagcaaaaccgcacaacaacaagtaactctgtagacggcagccattctttcactggacgacagagctcgtcgtaggaagggactattttggtcgcccctgtctatctgcttatcctccgttgtaccggcccgtaatg

SEQ ID NO: 2938 - DNA, 703 bp, Nannochloropsis_gaditana
tcctcttaacatgactttctttcctttcccatattataacctccccctcccttgccttagtcatgctgaccgatacacatgcgacccatttctgataaaaaattgacaacagagagattttagatgtacaagatgccgaggagacgcccttaagacccagacactaagcattttgcattcccccccccaaaagggacgtcacgtgacgtcatgcttcgctgagccgttgcccttccctcctccgcctgtacgttgacgcaaaactcccacgacgtgctatgcccccactgcccggctgcacacgacttgaagccggacacctgtgctcaacgacgtggcattaggtgctgcgtgcgaatatgggggcagttttgaagggaggggggatgcattacgccaaacatatgtcggttgcttgcgctgcaactcactctgcttctgatgtttcatttcatcctattgataacctgacagcataccgatgaagcggcggcgcagatcagagagcggtaccaaaggagatgcattgaataatggaacacacatggacatctctgccatccccatccagccttctaccatgtcagaattcaaaacgattccatcccctttttcgttacgcggcaaagagggcggcttccttcaacgacattggaggaaattcaagcacaagcgggcgaaaaaaaaggtcgaggagacgatg

SEQ ID NO: 2939 - DNA, 703 bp, Nannochloropsis_gaditana
gacgaaggaggatgcgataatttgtgtgggtgcacccccgtactttagcgccttcctgtccttgctcctcctttctgctgagggtgagggagaaacgcttggtgagcttggccgccctttcccccgtataaaaatgccgacatgtctgacgtcacactacaaagccgtaagtgatcactctggaaggcatcgggaggcatgcgccgctcgcagggtctgaaatgcccgtcgagtttccgcaccagagaggcttagtgtgtcggggctaacgtcctcgctcgtgggtgagctcgttcacagggacggcaacaagtaaccctacaatgcgtgtgcatgtccattgccattgaccgctggctccatgcccgtattggcaacatgacgcttgacctggcttgccatgctactctttggctttttaaccacgtttggcctccggtccgtcaggggagtcaataacctccccacctacccccttcgcctcagacccgaatggcataaaaaccttgtatgcttttaaagcgtgcgcctttatttgttgaacacggatatgtctcctacctaattctcaatttttgacgttcaagtgaagattcctgagtcctacgacccattgcttagcctttttctttgatcctcctcattcgaccccccccgtctgccccataacatttgtcttgctctcccccaggcaaaataaatg

SEQ ID NO: 2940 - DNA, 703 bp, Nannochloropsis_gaditana
cggtacgcctatactcccattagcaagacgaacgacagcacagtcaagacgcgtgattttcgatgcactgtctcgttactggggtactgttgggggtggaaaacgcaaaaatcaacgcgtgagtgaaacttccaatatcaagcctcggaaactgtagcagacgccagaaaaagtaattgcactttaaataagcaacactaagctccgtcgtcagtacagcaacgtttcaacaacatccgtcgggtacgtcattctttccaacgtgggaggaagaaattcgcagcgtgcctgtccgcggaacatggcggctccgcggtgtcttccatgtgaagtgtttgttttttgggtttttattttgagcagccggcggcttcctccgcaagttgacatgcgccgcaagctatgacgtcatcctcccggaaacctcttgacagccttcctaaaagacaggttatgcggtatagcccgaacttcggtgaacattggcacgaaatttattcgtgtgatttgtttggatgtgtaggaaaggggcttacaccgtatcaactttcaggaaaagacgctcgagggtgaagtctccaactttctttttcttctgctgcctccgctttctgtggggcctcatggcacgtactttatgcgtccataattttttttaaacaactgttcctatcgcataccatcactcctttcatcataaaaa

SEQ ID NO: 2941 - DNA, 703 bp, Nannochloropsis_gaditana
  misc_feature (456)..(557): n is a, c, g, or t
atacctctcacagtatctgtcgatcactgaacactcatcccttccgaatgcgatatgcgtcatctacggcctctgccaacgccttccccgaccctcgcaccattggcatcgtccgggagacctttggaaagtgggagcgccgggcccccctggcacccaaacacgtccaggctttagcccaaaaaggtattaaagtccttgtgcagccttcgtttcgaagggcctaccctgactcggcctatgcggccgcaggagccagcatccaagaagatttgttgccggcctctctcatattgggagtgaaacaggtgccagtatccgctttgctaccggaacggacgtatatgatgttcgcacacgtcttgaaaggtcaattggagaacatgcctttgcttgacgccatccgtcgcttaaagatccgcctgttggactatgaatgcatcacagaaaccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggagggagggaggaagggaaaaaggcgggatcgtcggacgggagggtcaggagagtaaggtggcgggatgccagcacgtgttcccaacgtccagagctttcctatcccgtataccatgcaaggaattcatccgcctttaatg

SEQ ID NO: 2942 - DNA, 703 bp, Nannochloropsis_gaditana
aaaatgtcatcttctcctcatgctttttcatccgactttattaaggatgagtcgcgaatgctaaccaggcacgaggctgcgacaacttcttggaaaccattttgtgggtgtgtgggaaggcagggtagctgcattcctgttgttagtgtttttattcccaccaggtcttgatctagaaattttatcatttttgggggggacgaagagcctgacataggttttcagaacgcagtgcgtgttccgtcatatcctattcgaacgttggcggggtcgatgggatgtatcggatctttcttttccacctcgcaacccgtcacagtgtccccacaaaggctgcaaacatcgttaggagttagtaaagtgacattgcatgcatttggattaattttgggcgtccctgtccctctttctttcctaagccctagattgcttgcatcgtcggccatccatctgactagattagatccacttttctaaaaaatcacgaaacgcgcaagacgtgttttttaaagcctgtacacgtaaattacatgaatctcggcgcaatggcttctctttttctcttcacgcctcgattcaggacagacaatttttcttttgttcttcgttttcctactctgatgacactgagaatctcataaagttttccattttccaacattttgaaggaaacaaactacccaccactaccaacaacaccatg

SEQ ID NO: 2943 - DNA, 703 bp, Nannochloropsis_gaditana
aacgcttcgattctgctacgcctaggaaagtccagtcaaggacaagggagaaaagcctttggaatgctcaagcccagggctggaagttggatccccgtaaaaccgttgcctgtaaggtcgtgacaggagtggtaagagtatcgtcgcgtgatgaacaggggaagggaacggcctcatgaaaggagagcggtcaggagagataagaggcggagacctgcatctctcttccgaaaggagcaagttaaaaacaactgacgcgcgcaggtaatgagtccttcacaagaatgacatcacaagaaagacaaaacgcatcgcattccccgcacatggtccttccgaagcctaatgccggtggaagggtttcaaatgggggcacacgggccccgaggttgtggtgttgatgagagcagtgcgtcgctgagaaaggagcgatgattgctttaagccgtggctgatccatttcgttgacaaaccgggccacgaaatagggcatcggtgtcactaaataattatatgaacactgattctgggcacacgatggatcacaggtggtttgatttgccttggaggtttggtgtccgtaaaatcggcctaggactgattgccacagaccccccagggcggccgtctcctcacacacgtcattgcctctgcctgatcacaagccgcgactttttgacaacacaacgccgccactcccatg

SEQ ID NO: 2944 - DNA, 703 bp, Nannochloropsis_gaditana
cccacaatgtgacaacctgtccagaaatccgagaaaaaaatgaaaaaggtaagccacgttattatgctattaagcttaatgtcttgcaaaactaaaatttaaagtacaaaataccattgggaaagagagtcgcatcgtgagcatcgggtttcgacaccccacccaagcaaacaaaacaccttttatgacctccacgtgacatggacggtaccctgcggaaagactcgcaccgatcatcccgcagacttcgatacacggcttggctacccgcgtcgtcttgttccctttttgtgttcctctgtccttctgtcccatcatgggcgaggagcaaggcgccttctcctccttgtggaccgagcaagggagaaagcgcttgtctcgatgacctccatccttccaatccaaaactcacgccccggtggctctctgcctcgttgacacaggtacccaccacttgcacacgtacggattatttgaccacgtgtgtgtgctagtataggggctagaggacaggaagatggcgccgcttccttcgagccttcgacagccccctccctctgcaaggagtgacagtgtatcgacactcaccccacgcgggcaagcgcccaataccaacgggccaaccatcttgaacccttccacatcacatttgtcgcgggcttcaccgctcaagccgtgggagcaatctgcacggcgggtaatg

SEQ ID NO: 2945 - DNA, 703 bp, Nannochloropsis_gaditana
gaaacgatgaatagtggctgatgaggttgtttggaccggcaataaggcaaatgaagataaacaggaaaggatgtccaagcatggcaaaattgccgcttttggtttaattctttcaaaagcatgtatttgttggcgtcaaacttgaactttagcgttttacttcctcaatcttgcctacctacttcttgtcttgcggtatgaagtgtgacgatggggcaatcaggatactggaggagagcatggcgtttcctgtcaaacaaccatggcataggtgcttcttcgagttgctcttagaaataaataattctaattgcaagcacatgcttgattcgtcaaagcctgtgtctgaaatgctttctcctatttatagtgatcaggaagcccctcaaagtggcccatgtctccctccaggttcgccgcccgtctttcctttccagcacccgctcccgtgttctcaaaaccgtaacgtaagcaatgcaatgataatctcatatcctcctgcaatttattcttgctcctggattggggacttctcggggcctgatcccgcgtatcttttcgtgggactggccgggcggccttgttgagcgagaagccccttcgctctcggcatgaccgctgaacccgtacttctctccaactgacaagaccgctttcacgcccatgcccacaggtcaacgacatcaagaaatcctccagcatg

SEQ ID NO: 2946 - DNA, 703 bp, Nannochloropsis_gaditana
aaggcgggagaggaagggagggcggtgggggacaaggaagaggaaagcgaggaggcggcagtggataggggccatgggcttcggaagccatcttcccccaccccgaaagagcaggcaccgcccaccgaggaaacatcccgccaaccggacctggaggacgtccagggtccagagataccggccgtgcccgcctgggggggggtactcagagactgtgcatccgtccaagacgccggggccccagaggccttcgtcttctccccgaccacgcccctgccccccctgctctcccgcccgcccgcctggaagctgggcagtcctcggtccgcctgcaagacgccgaggccgggggccacgcggcaggagcctccccccccggcaactgcgttgggcagcgcggcggtcctccccaccgcaccgactccggtcgaggagcgggtatccagcccgtcccaggcgccccgggctcccgccaagcgcaaacgtgggcggccccggaagcacttggcgcgggcctcgcacggggttcaggcgagggagagtgggccggcccagggcgaaggcggggggaagctgagtcggcggactcaggagaaggtctgtgtctcgcgcggaatggaggaggccaacaagggagaaaaggtgaccgctctcttcgatgaagatggagcgagtgaaagcaagggggcgggtaaggacagcg

SEQ ID NO: 2947 - DNA, 703 bp, Nannochloropsis_gaditana
gtacggaccacgccttggcggaggagctgcaattacgccttgagctcctgaaaaggagttcgctgactgcaacttcgatgttgacgcgcaaggggaaagagaagtgtgacattgaaaagtaaaagtttgtgcaatggttgaaaaatgttccgaggtgaagtggatgatgaaacagaaagtcatcgaacgaaaagcatacgaagagctgcccaaatgtaagtggattctatagagtagtacattatagaccgcaacgaccaagatagtctcagaagcggtttgacctaaagcgacgaatatgcctgcgaaaaaggactggaagtcgttcacaacatgaaagtataagaagtgacactgcgccgggcttgtgcatgctcagaacggacgacgttttttgggtggtatacagacatcacgcatactgctgccctagctcagagggcctgtgtgtgcatgccccgtggcactacatatttaccatattcacaaattcaaatcctatattgcatagggttcgtcggctgaaactgtcagaaactcgctaagataaaaatagaagtcgtagaatttgatcgcagcccaactagtttaccgctactcggctgcgcacgtaccctcccatgccactcgatcctctcatgctgctgacatgcttaacctttgtaccacaacgacgtcacacattcaattaaagccatacatg

SEQ ID NO: 2948 - DNA, 703 bp, Nannochloropsis_gaditana
gtcgggagacccgcggagacgcatccagtggtgcgcttgtcttccgtacacgaactgagactgtggatcgggagggcaaggctatgtccacttactttgcatccactgccaagagtatgacgacaacaaggcagtacgccaagttattttggttgttgtcgcccttgatgacctcgatggtgctacgtgagggcatggctcaaaggtcgtgtaaaggtgggcggaacaataagactctggaatccccgtgaacgggtcacgcccttctgctgttgctgttgaggtcactttgcgtgctcaccacaattctaagagagacagcaacctggtgtgccacggatgaggccacccacagacacgccaggcgaccgtgcctgttcgcaatggtgtatgtcatggtgaggatgaaagcagccaggtggggcatgggtccgactcggaaccgcgttacaagatgcgctactgcgtagtgctcattctgtccagaaaaaccacgcgttgatatcatgggtgaccatttcgcaacgcacacatctcccacctcactacaggacggatgtctttcacatggcctacgctttgggcgtccgtactcctgcttttttgggcacaatgtccaagcgctgtttccttcactttgacgggccatggcgacctcccccgccctcgtcgacctccccccgccctcttcattgccaccatg

SEQ ID NO: 2949 - DNA, 703 bp, Nannochloropsis_gaditana
gtcatcgccgccccctccgagatctaccacggatctgccatgcgtccatctatgcgtgtatatttgtcgcccccgctcgcttcctccaccacagcgatacatgccaaggggagggaacgccatgaggaaacatgttgttggaagccttccaatgccatgtctgtactgtgaaaattgcatcccattggtcacaaggcgctgctttcgcacactttggggggtaggtggcctgagagtctacgcttttccttccctctaaatttcgcagtcagctcctgtggcagtaatttggtgaaaggcctcgcccaaatgcagggcttgtaggactttctcgtgtactaaattttaggggcatcggtcacctgattttgccttcgcatgtttcttgcatcgaagttgctgtttcctttgatatcttctccgcaggcactctctgtctgcgtccaccacagattcgctcgtgtgccgatctcacgtccggtctttaccccccaaggtcccgacgtatgcttttcccggtctacatctcattgcttttcttcgagtacgccacgattgatggagagcgtagagtttgtgccaaagatatcgtaaaacaacctcttttcgtacgcacccagttcttgatttcgtcctctcccttccacagcccccaccgtcactcctccctcttgaaccttcctctgacctcaacgcacccatg

SEQ ID NO: 2950 - DNA, 703 bp, Nannochloropsis_gaditana
acgctgcactccacgatggccatcctccgccggcactgtctggggagcacgcccgtctccttccaggtcatctccgacccggcgccgcaaggagagggccaggaggcctccccgcccgccttctcccacgtgaactacgaggacccgaactacgccgtgggcctgcccgtcttctccatccacgggaaccacgacgaccccacgcgggacgggccctcggagcccctgtcggccatggacctgctggggatgacgaacctggtcaactacttcgggaaggcatccgccacggacgccgtggaggtggcgcctctccttttgcagaagggccggacctgcatggccctgtacggcctcgggaacatgcgggacgagcgcctgaaccggatgtggcagaaaaagaaaatcaagttccttcggcacgcgcctcgggaaagaggggcggcgccggacttcttctccttgttcgcgctgcaccagaaccgagacacgggccgcgggcagaagaactgcgtgcaggaaagcatgatcccggagtggatggacttggtggtgtgggggtaagcccggcgagggagggagggagaacttgacagagacggaggagggaggaatccatcatcaaggttgcctggtcgagacactccctgtaccatcccttcctccccttccccttcccctcccccctcctccgcgcaggcac

SEQ ID NO: 2951 - DNA, 703 bp, Nannochloropsis_gaditana
cgacgtggacttacttgtctgcgaatttactgttttacgcgcctctctggcatgggtggtgatactttgtgcgatgatttctttgacgaccactggcggctccttaaagtggcgtttttgcgtcttggccgcgacatggtgcatcccagcagcgccatccatgtgtgtggttttgctcggcatgcctgtgcctttcattgtgtatcgttgaggaaagagtgttgacaatttgcattgtgttcgcgaaggtgcaccgccacagcggcgcgtaggccaagtgttgtgcaacgaacgaagactggttgctcagcccgcccgcgatatcgcagggagacaagttggacctgacacatcggaacacctgtcctcaatgaacgaatacggcgccatcgacacccttgccgctaacgacgtgttgcgactcatgatgagccacttagagaagcgtgggtgtggggggtgaatactcacgatggtatcgagtttgaattttgaacgtcagcagacgcgggaaaagccaaattcccgagcatgctctggcccaggaattagctgcagtcacatgccctggcgtaatagaatcccacgccggtagattattgtttgaagtatgtttctgcgtgtagctcatccgccagtttttttccaaagctcttttatgtccacggcaggagcttgaacgacccttccgaacagcaacatg

SEQ ID NO: 2952 - DNA, 703 bp, Nannochloropsis_gaditana
ggcgtcgaggcagtaaccagccatgaagccacaaccgcaacgaagtgctgcgcgctacaattcagggctttcagggcatcgatggtggaggagctgggggggtccatagtatcacgttgggaaagacgaggcgccaggagactatgcgtccgcaggtagagtaaaattttcaaacatcggaaccccgtcaagaatatgcagcgtccacatgctatcatatgtgttagaaagagtgtccccgtcagtcccagtgatcgtgcataaataagaacgtgggggcgggtcgctagctgctgccagcatgtcccgcctacacagccgtacgccctcagtccctgaacgttccgccaatgtcatggcgctttatctatacaagaagagagattttgcaagtgttgtcgagcttatcaatacgagcctctggttaggaagtgagtgacgtgtgtagcaaagacgtcgcctactgtagttagtaacttcttgccttgacctccccaccttcgtttgccacagctccccacagcaaccttgggtgcctttcgttgtacttcgaataaattgcacgttgaatagtagagcaagtacgtgaagtcatcggtctcgtttgtattgggtacactcggcttatctcatccgttttcacaacccccgcgagcagggcccgccacacagcaaagtcaatcgaggattgcacacaagcatg

SEQ ID NO: 2953 - DNA, 703 bp, Nannochloropsis_gaditana
accggaaaggctccacgcgcgctttccccccaaatcatcccctcattccggtggactaccagttcactggtcagcctgtcttgataggggggaccatgggcacatgcagctatgtactcacaggcacggacaaaggcttggaggagactttcggtagcacgtgtcacggggctgggcgggcgcagagtcgaaacaagagtcggaaaaccctggaatacacggaggtgttggcggccttggaggagaaagggatatctattcgcgtcgctagtccgaaactggtcatggaggaggcaccagagtcgtacaaggatgtgacacaggtagtagatacgtgtcatgaggctggtataagccgaaaagcaattaaacttcgcccgatcgctgttgtgaagggttgaaaataaacctctgggagaggaagcagttaagaagtcatcggactctcaaaaagatgaaatggaccgttgtagaagaaagcaccaataacacagaaacttccatggttcaaagtccgctcgctggtaaatgtcattttcaccttgaacaccgacgtgcacatgtgcgatatacaggccaggtggcaggggcctgagaaaagctacccggacccacttggatgggcgacatggcttcaagcggcccctgtacaaatttccgtgcccataaacatcttcaagtactcaaatttcacatccttaca

SEQ ID NO: 2954 - DNA, 703 bp, Nannochloropsis_gaditana
aaattttaacatggacaatggctcgtcggggggatggggcagccgccggccggccgttagagggggccggcacctgcgtccgtctctcaagcccgccatcggtttctcaccggaattaggcctgactgaatatgtgcgctttcgtcttgacatcatgtcctgaccacctttctcttgcgcgcgctaatcgtagtgctgtattcgtgcagagcacctgtcatgatcattggaaactcgtcttgtcttctggtctttgtacgcatcacgtgttggggcgaccgcagttgggcgcgggcccatgccggcccatgcatagaatttattgatcgagcatcttagcagagtactccttggctggtaattactcgatatgaagtgtgtagttgtatttattgaagtgttattgtaacttccattgggaaatgttttttaaaggtggagaagagttcaaccgttggctgcaggctagattcaagctcattgggcttttaagctttgccccacatgtatcggccgcaaaagttttcaagcgcaaatcccaatagaatgttaagcttttactcttaataatccaatcgctatgtcaaaactttctcgtcgacactattcttacaggcctcaagggttcaagccttatacggcctgcaagctttgtatatctacttgaggctgctcttagacacctgatttcctgtgcgctatg

SEQ ID NO: 2955 - DNA, 703 bp, Nannochloropsis_gaditana
gaaagattcttgagctaattgtaatgaccagacagaatatgcgggcccccaattcgtgatcagaaaatgcgtgtttgaccctcttacatacgtctttccctagggctccgccccaaagcccgcgagggagcgcctgtagtagttcccccttcgcaatactcccctctttgaatcccctcagtttggacaggcccggtacagcggagcgggtgcagtgtcatgcatgagtcataactgaccatcgattgattggttgccattcatcaatgaccgaatataagtaggggtgacggtctggccttggccccagtccatagaatgcgcccactcgccagtgagaacgaaagtgggaggatttggagagcgtttcgagaagtgccccactcggatggccaagtgggggcttaaatttcactttcttagtgtgcggccatttcaagacgttcacgacattttggagaagttaatgggagtatggactcggagtgtcttgaaagagcaagaggaatagaataatggtattcttggggctttgtgtgggcttgaagtggttggtggggtgggatccagtacacacgagtcgccgaaaaggtaggtctaggactcggcttagggacgaaaaagtgatcaagtggaaaaaatgtcttgctcacaatccaaagaagataacaacacacacaatacaaaaaaatagcaaacaaga

SEQ ID NO: 2956 - DNA, 703 bp, Nannochloropsis_gaditana
tattgtagtacccaatctgagtcgcgatctattatctccctccccctccgcccctccctcgctcccgcccctctctcctcctatcctcatcacggcttgcaatcacgccttccatatcccttgtttgggacaggtcccttccccactctgccccgtttgccgttacaaccacgatgacgcccttgcccaccattcctccgcctgcacggactgcgggcggaccaccgacctgtgggtctgcctggtttgtgcctacgtagggtgcggccggtatcatgcccaccattctcgaaaccattacctggccaccctccacgcctatgccatcgaggttcagacccagcaagtctgggattacgtgggggatggctacgttcacaggttactctaccatccgtactccgcaggaggagaaggcggtggggagggagggaaaatcgtcgaggtccccgatcctaacaccaattccaatcaacggccgcggcatgcgcccttgccggaggcgatggaagaggaaatggtgcaccggaagctggaaaactgggccgagcaatacacggtgctcctctcgacggggctacaagagcaacaaacgcgctttgaggcacgcttggctgcgctacggacagcattttcgccttctcatcgttcttcctcgtcgggcgctacggtggtggcagccttgcggcaagaaaaacggcaa

SEQ ID NO: 2957 - DNA, 703 bp, Nannochloropsis_gaditana
tgaaggagcactgcatttgtacttcaagactttatgcaataatttaaatgagtacgatttaagtgacgccaattccacctgaccaaatttggcaacgaatcgagtatgctcacgcacggcactcaatttcaatgtatcgtcattactgtaactcattcacacctgctcttcatacgacacatgtatgaagctgataatatttggcaccacatgtgggcatcgtaggaccctccaacgaaagcccaagacttgctcaggaggacatctgaaattaacggtcaaacgtcagtttcagagaaacgaccgacatcaaacgaaaaaagaacagtcaacgtacacttgataagattgtgatgagtgtttacatgacaggattgcatgcatactggagaagtctttgtaaaccatttatataaaaattcatctctacattattacgcaagtagagcctaaaagtatagatgttgtgaccacgcattcacccagagttttcgaggcgtcccacatgtctacttccgctaaatatttaaccaaagcgatcatttcctttttaccatggtattgcctagcccctcatttagaattcacactctgccatgtatgtcatctatcatatctaacgacgattgctttgtcactgatcacttttctttagacagcacccactgtgggcataaagcgtccatctcacacaagagatatg

SEQ ID NO: 2958 - DNA, 703 bp, Nannochloropsis_gaditana
accaatgtcgcgtatggccaaatgtggtggaagacgtcataagtaaactctacttggtttagaccgacggccggtcccggggcaggaaaaatatcaaatatttgaacttcgttcgtaaaagtacagagatctccaccaatttgccacgatagaaagtcgtgctctctgactgacagattgcatgaatacgacaaaatgaactttgcatatctatcaatggtctagtgtaagcatctgtgagccctgtaaaatggtctcggctcgcaaatgtgtaataacacccttttattttatccgatgttcagcttactgataagcttcaccccattgaactctcaacgaattacgaaagtgtgagcgatgtctttctgtccccccctgggacgatcgctgtgatgcctagatttgtttgcatcaaagaccacacaccgtctggtcgtacagtgtagacgcgacggaaagtgtccaagctattagatgtgcttcactgcattagcactgattgtggttgcacaagcgatgcttctcacagatattcatcgccatctctgatacatgctatgaagttgactcttcttgaaataaatgactcaggacaagcaccacgctacaggaaacgacgctgcagccttttcaggcgaacgcgcaagtttactggtgaagattagggttgtcgactggcattggagtaagaggagagatg

SEQ ID NO: 2959 - DNA, 703 bp, Nannochloropsis_gaditana
tgttactttgcacgaagttcaagaaaaaaaggacgctgaacgctgtccaaaacctgataagggaggaaggtaatacagacatcatataggagtgctcgctgccacacttacaacctcgtcctcactggtgcaacattagacaccttgtaacacagacgaccaagcacataattatttccttcacaagcttgtagatctttcctcgaaaaataatatttaaacaccatatagctttggcacgtaccgtattctgatagtttccatcctgcttgttcctcgcccattggtcagttcctcgatgcgggccatatgcgagtccaagtcatatagcaactaagcatattgctccttggtacagtaagacgatgcctgagatgatgtttaatcggccacataagccccgcgtgggacatttttcccataaagagaaagggggcgggttgaagatactagatggctcctcgctgcctccctggtgatgccgtcattgatcagggggatttcgcaagggaaatacatccattaataatccaggaaacgtactgcagcgcaaatctcaggtggcaagatattacgagaaagcatttgctgggaataattcatagtcatgctcacttagcatttcccatttttgtgcttttcctgctcactgcgctaccctactttacagcacacataattaattcctcctctcagtgccatg

SEQ ID NO: 2960 - DNA, 703 bp, Nannochloropsis_gaditana
cgcatttcggctggacatgactaagcctgccggccgcgattgcgaggaggacgccgccgccgacatcccgcttgatgattaatgcttcgagaagcgtctgaacgctacagaaaacaatctacctagaatgtaatcaatggggggaagtgaggtcggagaagagctaagacaagaattatcaggtcctcattacgagaaagtctccgcagccaaatcttcttttgagtgctttctatggtatcacagagcagcatatgtagagcgttccacaattgcctatcaagttacggggtaggacgcagtcctccataagagcagcaaggcctttctatgttgcgcttgcctccccgttcctgctctccgcttcgataggtctatgcgtccaagatttacacaggtctgtggcagcgatgacgccatccttgttcgtcgccccaatggctctcaagcgcccttgaccctcaatcctcttggtgtgtgcaatgaaccaacataagcttttcgcagtttcttgtgtttgcaagagatccaattgggtaatgcgcgtttagtgacagtgtgaagtgccgagctgaggaccgtgatgaacttacggcagccactgatgcttctatcgcctcctactcgcttctcttttgacggacacaccttatttacacctcgtttttaaaattagatttgtgcacatacgtacagcattatg

SEQ ID NO: 2961 - DNA, 703 bp, Nannochloropsis_gaditana
tcaaggccgtgcgcaacatcgtgggggtggaggccgcccatgtggaccgactgaacctgctccagctggcccccggaggccacttgggtcgcttttgcatctggactcggggtgcgttcgagcgcttggacgccgtcttcgggacgcagacggagaagagccaagtcaagctcgactacgtgctgccccgcgcccccatggccaacgcagacttggcccgtatcatcaacagcgaggaggtgcaatccgtggtgcgacctgcggtgacagagacggtgcggctgccccgcaagaagaacccactcaagaacctcgccgccatggtccgtatgaatccttacgtgctggtgcaccgtcgtcaagagcttaagcgcatggccgctgcggctggcgcgaagaaaggagggaaggagaaggaggagaagaaggcgaggaaggcggcgggtcgggctttctacgagcaggcctctaaggaaggggatatcaagttctaagcggggcggggggatgggtgggggggagacaaggactggtgggcggtaggcagtgatgtaagacgaggaggtgaggcttcgacgaacgtgcccctgcctcataatggtcacgtctagccaggtcacctcgtctcaaaagagggccccgtgcatcaaaaggaatgaaaggatttctcaggcacgtgtcaggagcgtgagtcctagagcat

SEQ ID NO: 2962 - DNA, 703 bp, Nannochloropsis_gaditana
agctccgagaggcgggtgtgaaccccgacttccacgttggaccggaaggggcttccttgatctgcgatgggacgacagtggtaagggtgaaggacaataaagtcatgctagagggcccgcttagcgagacttacttcaaagttcggcaagccatctattcgcggttcgtggctttgtagggaggatgggccagagggatgaaaagtgaagcatattgccaaagcacaggacctggtgtaaagcactggaattaaatcgattaaaaggaggttcatacactgcggtacgattgtttacatttttctttcacgcagtaattacaaataattcgcaagtctgcatctcagccacggctgtgtgatagttttctctgcgcataagtttttttctaaaatcgcccgtcaaaaaatggaaatccgatacgtgacggtggcaattgaaatcagtccttcgaaaggcaacaatttaccaaatcaacaaatggaaaaaaagactacaagcatgggcatgagcagaccgacagctgtctcgtcctttcctcccgtcatcaacctcaagcatcgtaaggccatatttcttcacgtcgctcgacctggactgtctcacccaattcatgatgcactcacgtccatgcaatacacatatgatagggcgccccgcggatagttttccgcttttcgtccttgtgaagcaaccggtgcgc

SEQ ID NO: 2963 - DNA, 703 bp, Nannochloropsis_gaditana
cggcaagcgatcgaccggaagtgtttttttaagcatcgccaacattgtctgcgtggatgtggtggtacggcatcagcattagagagcatggttggattacatggcatcggggcggtgggaggagcaggacaggaggttactggaatggctttgaacatccgagtccgactttgccatgtacgaagtagaaggaatgctccagatgtagacctgaaatggtgatatttgactttttcgttgcacccttcttaagaggatgtctgaattgcatgttgttgcgccttacgctgtgcagacagtaactttcctcgcggtcaatacgccccctttccccccccaccccagaggcaaattagcatgcccgatggtgcaggtcgagccgccgccgccaagaacgagggaaatagcgatgtaaaggacctcgacgtggaaccaacagcggaaaatatcgctatgtcgcccggtgacgctgccagagggactcctgacgcgccgggagaagaaacgggttccacggccagcgccccctcgcctgagatgtcatccgccgtggaggcagagttccccgctccaatggaggtagacgaagctgttcttcccagcgagagtcaaggaagtgccaacgggggcgttcccgactctgtccaggccgaggctggggccggtcctgacgcctcccgtcccgcgcccctgcttcccgctg

SEQ ID NO: 2964 - DNA, 703 bp, Nannochloropsis_gaditana
ctctgtccaggccgaggctggggccggtcctgacgcctcccgtcccgcgcccctgcttcccgctgtgtccgcccaggtgcctccaccacctccagcagcctccgacacaggggagggcctgacattccgggtcctttacggggtgctcgagcacgaacccttgtgctacctgttaaaagtcggggaggcgacccttctgctggactgcgggtgggacgtgcagctggatgaagccttgctcgagcccctgcttcctgtccttccccaggtccagctcgtcctcctttcctttccagacctttcccacatgggggccttgccctgggtggccaagcacctgcgtcccggcgttccaatttacacgacccagcctgttttcaagatggctcagatggtgctctacgacctgtacctgaacaagtgcatggacactgccagcggcgccgccgggtgtcccgcctttacactcgacgaggtggacgccgccatggcgcgtttccagcttctcaagttctcgcagccgctggaagtgcggcagcagggccgcttctacctgagtgtgactccttaccctgcgggacgcatcctgggcgggtgcttttggcgcgtgaactacaagaagatggaggagatcgtgtacgcggtggacttcaatctcaagagcgaacggcaccttacgggggccgtggaggccttcaatgcg

SEQ ID NO: 2965 - DNA, 703 bp, Nannochloropsis_gaditana
  misc_feature (554)..(606): n is a, c, g, or t
atcgcgctggtcgtgtgttggctcgatttttcctcagactgtggacgttgaagtcctcagcgactagtgctggaatggcttgaacgagacccgtatcggctgttttcataacgtaccctggacgtcgacaacgcagtaaaactagactgcatggtttgtcgtcaatcatgacacttctacgctaccgtttgtgcgtcgttttcttcgcgtcccacattcacaactccctatctgatgtaaactagcggatgttcctggcagtgtgcttccgggtgttattgtccttcatctcacgctacgagttcaggcccagcttgctcaccatcgtgcaaaccaactctaaaacaggccatgatggcttgtaaagctcttgttattggcttcctaggcatcgcaaacgaagtcaccgccatttcctccactgtatccggtttctgctttcggcgtgcgttcttcacgacacgacgcgcgtcatcattcagtgctgccgctcgcatgaccactcaaaatcacccacgcgcattattcttgaaccctgagaatcagcacgcagnnnnnnnnnnnnnnnnnnnnnnnnnnnnnnnnnnnnnnnnnnnnnnnnnnnnnggccgccgggatcctcaccacggaccggtaccccaaggtacgcgccgccacggtggcgggggggaaaatcgtcggcatcgccaaaggtgccggcatg

SEQ ID NO: 2966 - DNA, 703 bp, Nannochloropsis_gaditana
tcggttttcttgcaaaaacgcgtccctgatagtaaaacagagatctgagtgacaaatgggctacaacgttctggccaggaggttgccagtggcgactcgccacgcgatcgtttgctacccggacaaccgccgccttgacgcaggtaaaggtcttttactgaccatttttgataagtagagtggagtgctgatttatatagtaacttaaaatttgtcgttacctgatatgatacgcggatgaagattttttttgatgaaaatgactttgggaccgacgggttgcatgtcttgtcgcattttgggcccatgtgtacaggcacgttttctcttaatttccgtcgcaccttgacacaaatcttaatttaaaaaacaggcatggatggagccttagcaaaggataaagcttataccgggactggcagagaaaatgtggtaaaggaaggacagccagtcgagtcgaatctgggcaaagatgttacctgttcatcctcaacgactcgcctccggccccgcagctggactagtacaggtctaccccacgaaactcagagcaaggcatggcctttgaaaaaagtccccagcataagctcgcaaaactatgaagcgcatgaaagtgaggtggcgcggttgtacgagctagagcagcggacgaattgccactctcacatgcgtgatgagactacctcttcaggcattgaggatg

SEQ ID NO: 2967 - DNA, 703 bp, Nannochloropsis_gaditana
tctccttctaagggaaatattaactggatagggggttaacgtatgtcgaggaggggaatccgatcgatgcattcgagccccagcgcgcatcaaggtacgcagagcatttaaatatttttgaaaacactttattaaacacatgttgctccgtatccaacaaaacacgaatgtctccagggcagcagtcacacgcgaatatgctccctcgctggcccaagaataccgccagggtcgctgcttgggcctgctcctcccatgggaggcaacaaattgaaattgatcaaaactgtcctttcaatttctttgaagtgtcttgtccaattgaatgcgagcttttcatggaaatctaacatgtttctctccatcgacactattatttgagacgcagggatagaccttcaggaaaagagaccgcctgccatccctttgagaggagacttcgaatattcccgtgatcgctaccttttggggtctgaattacagaccggtagtgttcacctatgcccacaaaatgataagattgattgcaagagcggtggtaagaaatttagccgtaagactcaatcaaaacaaaaaaagaaaggttatcgcttaaaaaagaagagaaaggttgtacatcctcgggaagctaggatgatattttatttaaaaatgactcatagcaataagaataggtcagtgaatgacttgacaaggccgcatg

SEQ ID NO: 2968 - DNA, 703 bp, Nannochloropsis_gaditana
attccgcattaaaaatacagccttgcatccttgcggttgtgcgcgcctatttcatctctcctttggaagatacagatttttttatcttcttctggtgtgacatttggtgcgtatgctcgatttttgacttactgcgatcagcgctgaggagaggactccgctcgcggtaaggccgagcaagggaaaacacacgaagataaagatcaaatctaacaccgttgcaactgtatgaaacacactgtgttggcaaagcgtgtatggtatctcctgcgtgcccgtgtcgcggtgtgccctgtcgtcaggctggcaacgcagtggagtaggggagggtggtgcgttccagtgcaaggaggggaaaaagccgacagtctgcccacgtgtcgtctgaggccttgggggacaagttaaccccgcttcgtcgtccttcggttctcgtgcatgaacagctaccagtacttgatagctacgagttctagataagaagcattgtggtaccctcaaaaggagatattcacggagatttgtcccgccgcgaccacgtcggaaccgccgagtataagtacgccggagattgaatgtcctgcactattgacgttgttcatttgtctaaccgcaccgctacgacacactcttccacccttcattcatctctacgcttgaattgcacttcttctctcagggtcctcaacttacaaacaagatg

SEQ ID NO: 2969 - DNA, 703 bp, Nannochloropsis_gaditana
tgatccgagaggtgcccttgcctccctctcgctcgagccctcccctcccgtcatcttcagttggacttcaaaagccacccatatgcctcctgccaatgccagtagccccatcagcaaataaatataatttagaaatctccatgccttcggaagtgctgcggtactcttgttcatcactgctttaggtttccttcctcctttgcccgccccccttggactgggagaagaggccggaccgctgagatctccattagcgctgcttcgacgtctgcttcgcaccggggtcgtgggaacaccgcctggcgacgaggccttactccgcgtcgtgaccatgactggtaagaacctgcgccgggctatgtgtgtgttgaggagggcgggttcaagatgggcatacgttgtctacgaagatatcttgcctcggacgacaagcaagtccttcttgtttttccccgaagcagaaggttggacacaaatgatccaggcgggacacatggcccacaacctagcacagtgtctgctctctgctgccgcatgatggccatgacctcgtggggtggcatttctctgcctgtttccatggggcgcgggagccctcaagcatccggcgagcgggcgacaactctcctcctgggccatgccgcatctgacaaaggagatcttgacctcatgcctcggacgccaacttccccacacctgcaca

SEQ ID NO: 2970 - DNA, 703 bp, Nannochloropsis_gaditana
gcggtggtgggtatggcgtgtcggctgcccggcgggagcgacagtccagcggctttctgggagatgcttgcggaaggtcgcgacggcattgtggaagtgccggcaagccgatgggacgtggacaaggtatacgacgctaaccctgacgcggagaacaaatgctatgtgcgtcatggtggtttcatcgatgatgtggagctgtttgatgcagcgttctttggaatctctgccatggaagctagtagtatggatccacagcagcggttgttgcttgaggttggatatacagcgctgtacgttgctggagaatcaaagggatccttattgcagagttccaccggtgtttttgtaggtatctcaacgaacgattggacgaggcttatgtcggaatgggcgtcggtctacacaggaaccggggcggctgcctcgatcgcagcgaaccgggtatcgtatatcttaggattgaagggtccaagtgtgagcatggatacggcgtgctcgtcagggctagtagcgttagatatagctgcacagaacctgaaacgaggacgttgtagcttagcctttgttgctggcgtcaatcttatgttaactcctcatgtaactgttgcgcattgcaaagcacggatgttatcaatgagtgggcgatgcaagaccttcgacgagtccgccgatggatatgtgcgtggcgaaggctgtagtg

SEQ ID NO: 2971 - DNA, 703 bp, Nannochloropsis_gaditana
tccctccctccctccctccctccctccctcctcccctccagccctccctcctgacagagtggcgcttagacagctaccttgccccccacgcattcctcgtctatcaagtggaggcctcgccagacttccctcccacaggtcggagggagggagcgagggagggagggagcgagggagggaaagaagcaaagagggtcggacaccacgataccatgccccccatcgaatagattcagcgggcccaaccctcacgttttgtccctccccctccctccccccctccctcaggccggtacgccgtcgctctcctgggcgagtacctcctctgcacacctgacatgacgcccgatgctcatcagacacatacttgggccccccctccccctccccgcccgtgcttgcgcagggggaggggaaggaagggagggaggaaggacaagcgggagccggccagtagacatgggccgacagggtttaagaaagcgaaggaaagttttgagaacgagtggttgttgaaggcatccgtcgcctaagggacctcgacggtggatgccaccactgatcgtctatcggttattttctccacgttttcctgccctcccttaccccattgcgatggctgcggcgcgctcgtgctcacattccctgtgcatttccaaccgtctttcaatttgacggttccaaactagtctcggaaaatgcg

SEQ ID NO: 2972 - DNA, 703 bp, Nannochloropsis_gaditana; identical to SEQ ID NO: 1800

SEQ ID NO: 2973 - DNA, 703 bp, Nannochloropsis_gaditana; identical to SEQ ID NO: 1801

SEQ ID NO: 2974 - DNA, 703 bp, Nannochloropsis_gaditana; identical to SEQ ID NO: 1802

SEQ ID NO: 2975 - DNA, 703 bp, Nannochloropsis_gaditana
aaagagttgtaggaaatggcaagcacagatccagaaagatgcaagagcgcgaaaggcatcaaatgaagaaaaaggcttccctttaccttgtgtcgcgctcctggtgttctctcggccgtcaagtgattcgaatgttctacatgtttaaagcttcttcgacgccatgcgacaggtttcagtgtatgaaaatgcccgatgcatgtgacccctatattcttacgattacgggggacaaaataacgtatccccgccgctcccagaaaattttcctcacattccaaaggtgaatcggtgccgaaataatgcgcaggaaaaaaggaagcaagtacggcggaataaaagaccagaatccatgctgaatttcctttcggatatggagattttttctaaccgagggatgcaagtctctcaacacttgtgtcaatccgttcctagaggtcacttgggaaaaaagctcatagaatgttggtaattttgtgcaatttcataagagatcttacgcagaaaagggatcgaaaagcggagtgccttttgttgtttcctgtgttccgagatcgctcctgcctgctcaaagaatcatacccggaccttcagcgggaaaccgtcacattcgtgctcacacgacatacatacccttgctattgacagtccactcacttttcgtacaatcgtgctgtacgacagcagcttcggggtagacatg

SEQ ID NO: 2976 - DNA, 703 bp, Nannochloropsis_gaditana
catccatgccaagcaccaaaaagcccccgctgcctgccgacgagccatttacagcttcacgatgtctatgacacagtgagagagggttacgaggtggacaaaagcatgtgaatatggagggaaagggtacaggaaactcacggcccgttagcagggagagcgaggtcaacatgaaattaatgacaggcaccgggagcatcagtccgtgggcgggatgtctacccgcccgcatgttacccagacgcttcattgcatgggtgcacgtgcacgccggcgacggccaggacgcaagaacggccatgtaagaggggcagagattcgtacgggaagtcatgggagggagtggaggaaccggattaaaaaaacacgcacaacaaacatacagtcaaaccacccgtgtgtccaaatttagaatccgcgccagggtctggcagtacgatcgacagagtccttgcgtgcggtacattcggcaaagatacaaggttcgccttgtcgttttttcagggcaacaggctatcgtattgcaggtgcctcattcgtatcgctctgtctcttggcgactttccagcggaagcaacccaggccaaaaggatggaaaaaaagaatattgcaggtccacagttgcaaacataacttctcacgtctttcatccacaccgtcaggaactgagggaacttcgtgcctcgtgaaaaaaagcatcatg

SEQ ID NO: 2977 - DNA, 703 bp, Nannochloropsis_gaditana
aatgcggtcaggatgtatgcacataccctgcccttggcagggaaagtgctagcgcccagtgccgtgtggattacgatcgcgaacgtgttggtcatctcgatatggaggctgaatggagcagagcctttgtatccgttcaaaaaacggcgggaatgaaacgtaatgcctgtcttgtgacttatcggtcagtgggggcgagggtgtgctcggagcatgcgccgtttgatcttggtggtatattgagtgtgttagagagggcatcgaggtataaatttgttttgctccttcctgcgcatttagtcgtgtgagacttatgaggtgatggagtacaacaaacgctccataagaaaaacgataagaagcagctcatttataaattcggaacgaaataatcagagcatagcaagcaagagggattattgcggcgattagaaaaggtttctttgatagaccccctttcaggccccttctgttcaaatgcaagtacctcgggattccttttttaggcaacctgcctcgtacatcatgccatggctgtttcctgtggattcgactacccataggctgccgtgtgcgatgcctacctgggatgcaaacattgagacgaatgaaacaagcccttgaattaagatgaacttgactgatctcctgcgcgctaccaagccattgcatttataattgcccggcatcaggcctgataatg

SEQ ID NO: 2978 - DNA, 703 bp, Nannochloropsis_gaditana
gccagcgcaccgtgatggctaatccttgcacaagccaactggtcactatgtaggaagcaatgatttgatgcgaacgtgtgccaggtggagagattggtgagatatgtggttgcctttttgttgttgcgttgctcaaaagagtctaagtaaaggcctataagggtgctaaatgggtcgagttgccggccttgccagcagaccgtgatgtagcatttgcactaggacgcatgaaatgcccggctttatgcgtgtgaaagcggaaacgcttgacatgtttctgttcgaccacttcgctcagtgttcagctttcacggtatcgcgtctctccaacgactcgcccactcgctttcttagatcagcgtttggaacccatacccgcgctcccgatacacaagcaatcatggcggaaaacacataaagtgtgctgagctttgacatacgcattccggttcatggattttgtgaatttggttgcagaaagggcatttccggcttcatttactctccacttctcgcatactcgcctcctcactcacgaaagcctctagcactgattgtactacaataattgtggcaaggccgacgtgaccgaaagcttatcttttcagacgacaaatacccgatcccaacacttcgacagggctccctatgtccaaggtggtggtgaatatatactgagagaaaggcttggttgaataccatg

SEQ ID NO: 2979 - DNA, 703 bp, Nannochloropsis_gaditana
agtactgggaagaggaaaaggcgcgcgtccgggtatgacttgatgcgagtatatgattgtcaatggaggggagcgaaaatgtgggggacgaagagttcagtgctttctggaaatcgtcggtttcctagtcactaatttcctgatgcttgtatggaatcagaccttcatgcctaatgtacgggagagattgaggtgacacgcaagcttcccttgcagggaggttgtgggaagctttgcgattgaaaagaagaagtctgttcaaaatgtgcataaatgattcttcgctaccatttattggaaataaaagaagtatgatatgattttatgagtgtctaaaattacttgtcggcaaatctcgaggaagtacgcacagggagtggcactccgcgcagcgtctcgggttactgttcaaaattttaaaaactcaacgtcgtcccacaaccgttaacggcacggtcgaccattgccctcgcgacataattacgggcccattacaagcgcgcatggtctggcgtatatatcaaccatatataggcatagaatttcaaatcgaggtctcctacctagatctcgtgcgcatccattgatttgcttcttatcgttaaacctcccaaggagcccggtactaccctacccccgtaaatgcatgcttcatcccactttcttcggtttgagaaaacagtgatacttctcctcatcgatg

SEQ ID NO: 2980 - DNA, 703 bp, Nannochloropsis_gaditana
gttttttcgttcgcaccaattgctttgcatgatgattgtgtccgtgtatttggttctccaaattatcagacgcgtgaatagagtcaaagggtgtgacttgacgccggcctccatcaccggttcgtaatggagtggtaatgccctcctctgtgggggagaggatgaccactttctcctcatttactagaacaggagtaataggtagctctgtcatgccagatggaccacctcctggacttaatctgttaccataagccccatttacacgctttcgagggctggcgtccatagcagagcctaatatatatgggttagggggggagggttaaggcaaagatctgtgtcgaatccccgttgtgatcaatgagcacgccccctattttttgcttataagaaagagatattgaggaagcatgcctagtggagtctcaaataaattacgcacgcattcgacgtttttaataaaaaaaaacaacgaaaggaaggaagaaaaaaagctccatccttcggagagggacccaaaaagcggaggttgatctttttaaaattttgaatatcaagcccagttgctatgtcgcctctgtctcatctgtacatgatgtgctttaggtcccacgcgccatgctttcgtaccactgcacgattattaacctgcgcttacccattctgtgtacagacttatttttgacgccggacaatcatg

SEQ ID NO: 2981 - DNA, 703 bp, Nannochloropsis_gaditana
  misc_feature (92)..(101): n is a, c, g, or t
  misc_feature (324)..(396): n is a, c, g, or t
  misc_feature (691)..(700): n is a, c, g, or t
ctttcgctccacacccttccttcccacctcatcactttcttctttccttgcatgcacgaagctgtttgcacgttcgtctttttgcatgcacnnnnnnnnnntccttctctgcctaggcccatcctgtcctcgcccccgagcccgcttccgggtatcctgaaagtcgccatcgacccctcgaaagcttccttcccaatccttccttctccgcttctgcgtgctgcccacggcggagggcgcgagcgttaccttctcccctccctgctcctcctccttcccgccctttttcttgggcgggaaaatggctaggggccgcggtggtcnnnnnnnnnnnnnnnnnnnnnnnnnnnnnnnnnnnnnnnnnnnnnnnnnnnnnnnnnnnnnnnnnnnnnnnnnctctcctgcacgacccagagatgcctttccttccctcccttcctccctccctccctacgtggacgaaggccatgaaggccgccaaacgaaatttgtttttgcactcgtggaaggttcccaccagcaccgcgccgcaggtgaccatcatggtcatggagataatgtctatggaaggagagggaggtaaagggccgcgtgatgagaagggaggggcagggggcgctcgttgtcggggcctgaaggggaggtacaggctgcacgcagcccgtacgagcgatggggggggaaagaaggnnnnnnnnnngtc

SEQ ID NO: 2982 - DNA, 703 bp, Nannochloropsis_gaditana
gtggtccattctcctatccacatgacgtgtggccgggccgtctcacgaatccggtcgctccatgtacgaagttcatatggtgcacgcgggagatttggggcaccacgtctggtttggtgcaggcggcccggttattgcccgcgtcagagtgtattgctgctctcccagagccggacatttccctccccttgaactttgaggctttagctctgcatacgacgaaactatcgggctcgccgtacggtcacttggcatgggcgtgattacccccccaaatgccggcagtgacgcggggccgtggcctcttgggaggatggaggggcgtggtcgtgtgtgtcgtgtggctttgtcggggcagacgcacgtcacgacaagaaagagagcgaggaagtggtgcgtaggccccactgccgcttccgtcagcagttcctgagccctttctaccgggcatacggaagtcgaaggccacgtttttcgtgcattgtgcctgacgcgtgacgtaccatgtattgtaccaacaggtgcatgtaccgtgttgttgcgctcttcggtcaaggcaggggacgacgagcttaactggcgcaccccgtgacgagagcagggggtggagtgggcgaatactacaacacaccgccatcaacaccttcagaagctgagcaaatcaagcggtaatcagagagaagcattcgcatcgcttgtcatg

SEQ ID NO: 2983 - DNA, 703 bp, Nannochloropsis_gaditana
gcacgggtacgacgggtgcatcaggcacaacgggtgcaatgggcactaccggtgccacgggtgccacgggtaacgcaggtgctaccggtgctacgggtgcttcgggtgctactggcgctactggtgccacgggtgccacgggtgcgatgggtcctgcagggcctggtgaccccctactctgttccgaggcctgtgaagctgagctggcagaggcctatagattctgcgaggtacgtgcatctagaagtatttaaagataaagagaaaacatctgttattttgattctcaaatattcatttaaaaccgtgtctgcagggcatttatgaggacgagccacgtcgcttcgagtgtcaggtctacgcatatggggtttatactgcatgctttaatttctgccagagtactggaggcgagcaaatcacgatgctaccgaatccttcaagcagaatcggcagcctgacactgaatacgggtgaaaatggtctacgatcttcactcgtgagcggggactatgcgtatttcgggtgaggaaaagtcaaaagaaacacgcagcatcgcaggattcgatgcgatctgactttctgatacgcttcgctatactctctacacagaactgacacagctcctggcaaggtggtaaaagttgatctgagcacctttagtcgtgtcggcagcctgacactgaatgcaggtgaaactgat

SEQ ID NO: 2984 - DNA, 703 bp, Nannochloropsis_gaditana
  misc_feature (1)..(692): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaggcctc

SEQ ID NO: 2985 - DNA, 703 bp, Nannochloropsis_gaditana
ctcgttcagaggcgctgtaaaggaaaaaagggagcggaagtaaacggagccgtaaagcagggctcggtctccaagatcgtggaatggtatcccatgcactcgcatggcgcattgagggctctttttgcggtgtgcacgtctcacccacgatcttcctctttctaactttatgatcggccaatgcgttgctgtgcggacgtcctaccgaggtttctcatcacgattttctctgtccgttctaagaacagttggaaaagtggcgtcctccttatcatctgttcggagctacggtacttttttacctctgctgccgtcttcatgggaggaggaccccattactagcactccgtcgagcttgacttcgtcgaggacggccaatggcctggtattccccgtcttgtacaggttcgtggtgacatggtgtcgaacacgacgatgagtgaaagggattaggcggcatttatgctggggatccgtccatacggcgcatttgtgagaatatctcgtgagctccaccgcgttggcttttcagttgatggtatacatatgtcttgggtggagcgcttggtacattggtactctcgtgttttgtaatcggcaacttgttcgcttcattgccaccggtggggtgcagaacgcagcttgatttcttttttgtagtccaaaaaggcctgcaaactcacgcctcgatggcggataaatg

SEQ ID NO: 2986 - DNA, 703 bp, Nannochloropsis_gaditana
  misc_feature (21)..(30): n is a, c, g, or t
gccctctccacgaagccgacnnnnnnnnnnttccaccagctccagatccctcgcccgttccgccaacgccgttacgagggaggatgcctccttcgctacctcctcagtgacttcctgggcctcgcaccatggagcgtttcccgacaccattccctggatggcactggcggcacgtggagggaaggaagaggaggggaatgtcacgtgagctttcctctgaagttagagttgtgcacgttctgcacggcctggccgtccccttcatcgcacggcttgtcgcatgtgcccccttctttcctacctcgcggcacccaacagccgccccaccacctcccctgccatcattccttttcggaaaccttcatcaaaaccttcttggagtccggcgggatgccctgcgctggcaccgtccctgtatccctggttatgtagaacacgttgttgttcctcctggggagggaggggccgtgagggaatacccgcagccgggggcgggcgatgcaaagggtcatgtacgtcattgtgatcgctatagctgtcttcgtcgctgctgtctatcataatgggggcggcctgctgaaacaccgaagacggaaaatgtgacgagtcgaagggaaaagggtaaggcaagaggaaagtgggtgaaaaagctttacgcaatcaccccaaaaaagcacgattcccctctttctgcccaaccatg

SEQ ID NO: 2987 - DNA, 703 bp, Nannochloropsis_gaditana
ggaaattatcagccccaaaatgcatttgaacgcgttaaaagagatatagggtcatatataaacaatatataggcaatagggtcaattgtatgcgtgccactgcgacagtagatcgatacttttcaaggtttaccgatctgggcacaggtggcggaaggttttcttgcatgattctttactttttcatggagcggtttctggttataaatggctccaaaaaagtgtttcaggtctgtaaagtaagcttctgtgttatttttcttcaaaaaaaaagacatcattattacgggaaaaataggtgtcgagagtactgcttgtagaaaagttcgtaaaaaaagcatggaagaacaacgaagaaagatgacgtcatccttatgagacttagtgcattgaaaggtttgtaagatagaaaatgcgcaacataacgtcaatggtccttgatatgtctgcacatttaccactttttttgatccgttagaaagctaaggatgtatcggtttggctatggaagctttcttttcagaggaaaaggctgggcagacacgaccggcccttccgctcgagatatgatagacaacgtgcgtcaacatgcatgtaattgtaagatacatgacaatgagcattactcttacggtcgatccaactgggtgctcacggccttttaatgacgatttctatacggaaaacagggcacccgaccatg

SEQ ID NO: 2988 - DNA, 703 bp, Nannochloropsis_gaditana
cgtgtaccgcgtaatccggaaagcaaagcttggaagcttgtcacaggagcaacagcttattgcggtacgctttagaagtcttattacgtgagagaccgacaataataagaaatattccatcatatcctttgttctcataacgccttgttccacaggatgtatggaaacttgtggacgggatgttcttcgacagaacctttaatggacagccttggctcaccgtgttacagaattctatcagaaaagattatgcttcgatggaggaggcttacaacgctacgagggtatgtatgtgtctaacctgctcaaatattttggcataaaaagttgattggaaaatttcgcgcatgggcaggctatgctagatttgcttcaggataattacacaagattcctttcaccgagtgaatacatggagtttcaagtcgatacacttgagaaagaatttgcaggtgtcggtgtccgcatgcaaaatgtacgtcacatgcaaaatgtccaaatcaagcacatcattttacctcttctcggcctttcaacgatatcctaggccactatcgaaatagtcttagaaggaccagccaaaaagggtggcgtgaagcctggtgacatagtactgtctgtagatggtcaatcaaccgagaatttgacaacagaagtcatcgtacagctgcttagggggcctccagagacaaacgtctgtatg

SEQ ID NO: 2989 - DNA, 703 bp, Nannochloropsis_gaditana
ggtgcctggggctgtacagaggatgccccttccattcccaactcagtcacttcaagtgcttcctgtaagatttagctaaggcaaggaataaaaaaatcaggattttgatgtccttatatatattgttgcggggctcttagagctcgtgctcctacggctttatgggcgggagtgtagcgacatggtgagggatggatgctttgctgtgcctgggtaaagcgccaagtagatgagcagatgtacatccgatcatataaagactcaaattgttacacgactcgtcgtgtgctttgcgcgaaaatcaaggtaatcccgtggaagtgacgggatgcgtgttcgcgagacgaggagagggggaggttcacgtccctcgggcccggtcggcaggttttggcggacagaccagcgacttgctggtcgatttttggcacggacgatgcatttgaatgttcctgatgcttaattcttgtgcctaagctacgtgcataaagcgaattggcaggcacatgatttctagcggacagttgccctcagaaatctgaaagcaaatgctctgcagcgctctgttccgacgtgacttccctcacgtgtcttcaaccaccaaaagatcgaatgcgtctgtcgcaagaatgaatcccgaaactctgcggaccacatgctcatatgatccaaaatcctcatgttgttgttttgaccgtggaca

SEQ ID NO: 2990 - DNA, 703 bp, Nannochloropsis_gaditana
accattctcttaagtagtttttgaacaaatgagaaaaattcggtgcgttcgtattcctacggtaaggtttttgcggcgcgggggcataagcaagggctcaggcggagagcgccgctcggcgggttcgctgatcttctgtcacgcctactacacaattgttcaaattgacactttttgcactgtggtatctctctttcacgcctgccacagtcttgacctacaactccataatcagactcggaatgcccctaacgaatagattgtagggggggttcgccccgaaggcagcactggatgaaccagcgatagatatttcgcgcgcttttgacgtttggatatcctttccacaaacaagaccgactgagctcactatgccaaattttgacctgtcgctagacatgcttgatactggagtagtcgcggttgaatcaaagaccacttcgtctccgaaacggagtacgtacgtaaactttgcctccagatgcgctcatcaatttcgatgtcatgactgtggaagtcaggacttcgcacacccggaagggcgacatggcaggaatgcaccgcgccgaagacctgatatcaatgatcgaaaactattcttttctcgtatgagtagaagactgtgattaaaagtgcacaacaattttcagtgaaggaagaaaaggatatcgacccgtgtccgagtagcaaataaggcgcttgt

SEQ ID NO: 2991 - DNA, 703 bp, Nannochloropsis_gaditana
acggactcagggtggcaccgtgcgactgaatcagaggtaacattggaaaggctcaaggacgtatggtgcgaagtggttcttagcgataaggatgcacagtgataatgtatgcgactctacaaacaacatgacaagcagatcacgggagaaactaagagccgcactacaaatttgttgctgggccgttgtcgcgggctctcccccccctcccgcctccgtgcgctctgattggtccactaagccgttaaattttcatggcgtcatgttttacatccgggttagtgtcaaaattgctcagtctgtgacgacaaggcggcaggcattctatgttgcctcgtcacgtcgttgtgtttctcttcacttttctcttttatcgtttcaactcagcacgatgccttgttgatttggcatatacatgtctcatcaagtaattggactgtagcacaacattaatcctatcgtcaccgtcatttcgtcgtgcaaatttcttttgtactcctctgagctggcaccaacatgattctggagtgtcttgagatcctcgcgtgctcgaaggggtccaattcttaccacatctcattgttcgagacagtgcagtgctcaaaagtgatgtgcgatattttgtggacatggacgaggaaccgaattcttgacatccccttcccatcgtgcaggaatctcctcaagacactagcaaaatatg

SEQ ID NO: 2992 - DNA, 703 bp, Nannochloropsis_gaditana
cttccatatgacaggctctcaaagattttttaccccccgtgcgagcggatccctttttagtaagcgactcggtcagcaacttatcgccatgcttattccgattcgcttgcccgccttacatgggaacgataaaaacgttgaaagcagcacatgcgcaccaagtgaagcatcgaatactgatgttggaaacacctcgacatcagaactggaagagtggtccttggtagaactgaatggcactttaaattgcagtggaagaggcaaacctgcttccactgaggaagggttgggtggtttgcctttaggcgacctatcatttcccgcgctaaacaaggtaacatagtaaagtcggtttgggtcctgcaaatccatacggctgagtgatctagatgtaatgctagagtgatctcattcaatcacaatcatgggaggggcgagtacatgaaaggacttgacgtcgttttcagaccagggcttgctcctgcgttcttatgtgaaaagcatactagagctggaggatccttgcctggctcttgcggtatttgaacgagacttgtactcatttgtgtcgcatcgtccttccttgaccgatttctacatccacccatgcgtttgtggcgcccccccgcagcccgtgctggtgataggcgcacacaagctggaaggagaaatcgtccgcttaaacaagccgttcctcgtgatg

SEQ ID NO: 2993 - DNA, 703 bp, Nannochloropsis_gaditana
cgcttcgagcctgggcgctcaagacgaacccagggagaatgcagcttagggccgccaccaggagcagctgcttcagaccgtagccaacgcgggcagactctgacgatcgtttgtttcggtgttcacagcccatggttgaaattattgcccgtttaaacactttttatcatcgcctgtcagagcacatgtagcattagaaatgactattcgaatgagagaaacgacaggctgagatttgcaaaatatctcggcactcggcccccgcatcggccaaaatacctccacaccctccgtctccaaatttgcctacgcctggctgccatctgtgtgtaggcaggcggggtctgaaggccggagacgggggagatggaacgcggagaagcagatagtcagcgacgtcccatcgccgcctcgggggcgggcaagcgcgagacatgagaaccccatgccaccgttccccacctctacgctatcacaagcctggcgcgattcacatgtgcattgcgtactattgtcctgtttcccacttgatctttgtccgccgtcgcagcgctgggatagtggtgtgtcttgggtgtcgcaatccatgagctagctgtcattacttcgatgacgttgggatggggaaatgctttcttctgtgtgacttgacactccttccgctccgtataccgcacaaaacgctaatcacaccatttcacac

SEQ ID NO: 2994 - DNA, 703 bp, Nannochloropsis_gaditana
agcttggcagcacggtccaagtcgctcatcatcaccacggctgcgcgccgggcggagacggataaagtgggttggggaggacggaagggttgtaaggttccaaattgcctgcagacccccgcgttgaagaatgccatagctggtgtcgtagtcaataccagactgactaaggacatggccagggtaaggcaggaccgggctgtccgcatgatggagggtcgcctcgatcctctgtcgagctgatgctgcgaggggggagaggggcaagatcgggcgagggatctgcgcatgagtcgagttgggcaaatgtaccggagtgattctgggtaggagaaagtcaacagtaaccactttcacgtataaattgatctggatagggaggcagggaacccctacgcaggagacaggcattcggactcgcggcccgtgcaagcgtcactctccctgttcctcgctgggtctggcatggtccttgagatgacatgcacaggacaatcgcgcttcaagcagagaaagtggatgaaaacaacgacgcgtgcatgctgcgcagttctgttggcgtgccacttgcgcctgcgtttctttctcttatgtactgcatggacaagcacatctagtcaattacctcctccctccccttgcctagatcaaagccctaagccattgtcgctataatgcttgttagtagtgacggaaataaatg

SEQ ID NO: 2995 - DNA, 703 bp, Nannochloropsis_gaditana
ccaagaggcgcctagaaattccgtgttcacagagtttctgatatcggtagcacacgaagcttcggtctccgccaaaaacgtgatgtgacactttcgtgtcgctcgagacgtcgcacgtattgaacgtcaaaaccactcaaccccgttcggacaccggcgaacacaggcatttgttcaaattggatgatatacaggcagtcggcatcctgccgccttccacgacggctcgctttggtctttttttcgtgttgccttgcaatgccgtcagcggagagttttgccgccccagcctcacatgcctcgagcacaagcataccggtcaactctgtccccgagcccacgcatttagcggtagttgttcatggacttcacggccggcccgctgatctcacatatttggggaacgcgattggctcaaggggccaaggccgcatccttccgcatctagcccactgcaacctgcacaagaccatggacggtgtcgtcaaaggaggagaacgcctggcggccgaaattaaagaggtcgtcgctgcccatccctcgttgcgtgccatcagctttatcggcaactcgctcggtggagtgtactctcgctacgctctttctttgctgtgggagccccgaacacgcacggtccttggcctgaagccgattaccttcatgtccatcgccacgcctcatctgggagtacgccgcttcacgg

SEQ ID NO: 2996 - DNA, 703 bp, Nannochloropsis_gaditana
cagtaggagaatcggcgagcccgagtatctgaggaagcgggttcccagtccccgcgaccccgtcccccgcgggggaaggggcagtcaatattcagtgttgtgaggctctgtgcacccacaaacattttcaaatggtagatcggcaagagtcacgcattgctacatggctccattaaattttgtggattgctgaggagtgctaggaaaaagtgaaaaagagggcctcagcgggtttggactccatggccccttcttgcatgtgcagtgaaagcacacggacgtcgcttctacaatccccttttactcttgaatcattattaaaaatgggaatcttacacattcattacaaatggcaatgtcgcttcctcaacataggcacactgttttgatgttgccgcggacgtactcttccccggggcgctatggaagcagacggaacagcatcaacgatcgtgcctggttacgcggggtaacagtagttaagtgggtatggctagtcgcctgtatacttcttctctgcctctcgttacatttttgggctgaaactgtgtgggttggcgtggacgaaggagggggcacaatcccactcagccaagctatccgccagacgttgcgcctggcgaccaagaggcctttggtagggacgaaagagaagcccttattgatcgtaggaacacaccacaaaactggaacggcactcatg

SEQ ID NO: 2997 - DNA, 703 bp, Nannochloropsis_gaditana
  misc_feature (171)..(180): n is a, c, g, or t
ccgccaccagcttgtgcatcagccgcgccccctcagcccccttccccgccgccagggccgcccacgcctcctccgcgtacgcaccccccttccagctcttcttgaccactgccacggcctgcgagtacgcggataccacgtctgcgtacgtgccaagctcggcgggtaccnnnnnnnnnngggggcgagtaagaagaagaagaaaaagaagggcgggggtgaggacacttcgtttgcgctggagggcaaggagaggaaggtagcaaaggacgtgtccgcggggtctcatgacctggagctctccgtgcaggagggagagcaggacgagccggtcgcctcaccgggggtgacggctcccactccggccgctgagagcaagagcccccctccctccggcgacgaccatcttctccccgagcgtgcctcagaagacagtgggcccaccctggaggagagagtccgagcgactcgtcccccagggcgtgttcgcgtcttgtcggacggcgccgccgctcccggcacggcctttgtccgcctggacaaggtgagtgtcatcttcaggaaccaggaggtgctcaaggacgccagctggggggtacagacgggggagagggtgggcttggtgggccctaacggggggggcaagacgacccagctcaaggtcttggcgggcgagctggacccgaccacgggggaagtgatg

SEQ ID NO: 2998 - DNA, 703 bp, Nannochloropsis_gaditana
  misc_feature (1)..(643): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggagggagggaagcagggggggttggcccggagcgagaacgagctggtgttcctgatg

SEQ ID NO: 2999 - DNA, 703 bp, Nannochloropsis_gaditana
gggtggcgggagtcctctgttgtcgccaaggaaggatacatcataatgatgctgacgagccgtagccgtattgctgaaagcgccgtcgaaagcatgataatgaccactcgttcccttcgcacagcgcttcactcatacatttcgttgtcttctgttgcaacatacgtggacacgaataccttgattgtgtccgattaatacaaaggagcaattcgtactggctttggtcgccttcgcccccctccgtccttgcttcaaggagaggagcctactgaaacccgttgcccccggattttcatatcgcgtgcaagattttcaatcctcatgcgttttttctcagggtgaggggttaaaagtgtgaatacaattcgcgtgataaacgttgcagcatacgttgagtggcgcgacgtttgcttcaggcggcattatcatcctcatctgagtagtgaacacccagcaccacaatctctcttccacacgtttctcctctctctgtacagcggcattgctgcacgggcagcacgcccttcgacgcagtctgccagtaaaaaggaatcttctgcgtgtgatttgacagatcgagatcaaaagataggacccccgcggccagacgcagcaagcaaagtgcggcttgtcagattgaagcgcgtggggccagcaagggtggtgtgaaaaggcaaacacgactttccctcataaaatg

SEQ ID NO: 3000 - DNA, 703 bp, Nannochloropsis_gaditana
  misc_feature (1)..(700): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagc

SEQ ID NO: 3001 - DNA, 703 bp, Nannochloropsis_gaditana
acgggaggaagggttaagtccctttctcaatcgcgtaacagaaagccctccttagtattcttgtgcatacgctattttctggagcgatgacggagtctatgagctggatggtacgagaagatgaagcggctttcactaggaaagtgctgcacattatttaggtccctacaagggcgatttcgtgcgacatcgagacgatccacgggccctctgacatccaaacttgtaagaaagtacgcgaaaattggatgagaggtcatcgaatttgcttctgctctttactctttccttcctttttcaacccagcatggtaaattgcgtccgatccgagcctcccagtcaggatacaggcaggtgaggaatgagacaagcgaggggaaagccacacaccaccacccctagctttgccgaccatactctccagggcaagttcccgcgtctgcaaccacgtacagagcaaaaggatgtcattgcatgtgcagggttcttgaccgtgtgcgtatgcccttggcgtgagacttgggtcatgccgacgagtagcctgagggcgcagatcgtcatgcgcggtggggggaaagcaggcttttctttgctccccacccaaaggcgggcaggcacacgcatgctcgcattggacggatggcgtgtgtgcatggtaatttctttctgtaatgctgatatcttccttcgcacctgcctcaca

SEQ ID NO: 3002 - DNA, 703 bp, Nannochloropsis_gaditana
catattctagcaatgtcagtggttggccgaatgtctcgccctcctttcaacgcatacatggcggccatggtatctgatgtccctcatctctgggcccatatgcaacacggcaggcttctacaggagtagcttgagcattaggctgggctatgtcgtcgattacgcctccaaatttgtaccgtgcctgccaagggcccatcatcttaacttttggggaaaaactcttgagattttccttcgtacaatcagtcgttcctgaaaagtcacaaaacgatgccggatttatgcacaagcaccgccgagcacttttttcgcgcaattgttcttccccccgtctccactactgggggcgtgcctgcctgaagctcatgcctgtcgacgcttgtttatattcaggtctggaccggggttgataatggaagagtatgcgtagaaagaagagaataagacatagtctctgccacgggtgtgtaattcacatttttccggcattgccttgaggtgctcgtatcaggacataacacagattagtgtgtctctgaatgacaagtcatttctttctcttgcaattttcttcaattgtacagatacgcatccggaacctttctctgagcaagcaattggctttgaaaggaaccacccggttgaaggagggtggtggtagcggcaagtcggcaacgagaccggacagggctgcagcatg

SEQ ID NO: 3003 - DNA, 703 bp, Nannochloropsis_gaditana
acaacggttcgagatccgcttgaaataggcttagcctgtgagtgtgcgccactattaccaccgctgccgtccccgtcggtagagctccttgcacgagtgctgtccttggcttccatgtccaaaagcagcagcgagtgattgtcccaatgcacggcaaccttgtctccgatgccttcgataaatacgggcagcagcaattagttttacttttgcacatgataaccaaaaaacacacaggagctataacttctgctttggcgcatggtcaccaagaacacagattaatccgttgcgcgtacctctggaacgctacacatgacgtgaggacacttactcgtagtgaggactagtgcgttgcatctctttgtgctcgccaagtcgattacctcccacccctacaaaacgtctgaagcggacgacatgtcacattgcgattgagccattagcacgcaggctatgtgatgttgtgtacaacgcccagatagtctggcggactctgcgtgttgcttggtcatgcaatcttcttagcctcaggttgtcttctttgtccgcgccaacctcctcccgtgtcgaaaatcgcacgcggaagccataaatactccccaaaaagacaaacctatactcatacacccccctaaaaacagctaagattgctgcattagatttcttgaagagcatttgtccgtagaagcaagatctcatg

SEQ ID NO: 3004 - DNA, 703 bp, Nannochloropsis_gaditana
tgacgtacctctttcgtcgtgttctaggatgaaatagcgtctttttgcggtcatttggccacgttttaaaaggtagccctccttgactatcaaatttgccatattttggaccttggggggggttaaatatattttttatgagcacatttccatttcgtcgatcgcagggagggaaggaatcgcgacggctgcagcaccagcctgggcccattccgcttggccgatgtcgccataagtcaaaagtcccgcatataaagcgggactccgaatggagaacatttgaccttgcccacacaaacctgcactatcatacgcatggaagcgtccaagatgcatcccgtgaggacaagtgcacggtcctttggtcccggccgcggcccccctgtgcccgcgccaccgacctcgccgtgccacccgcggcctcggcgacgtggatggcaagaagagagtagccggaaatccaaggatttattccaccacggcccgtctcccgccccgcctggaaatgaaaacatgcccttggtgtcaactaaagtgcaggagagtggaatgcggtcggtcgtccgcactctcatctcacgtgtgtcgggctcacataaagctaacctacggcttactccagtcgcgccctcgctcctcgcgctctgtcatcaccgatgtagtcctgaagcactctgcccgtcctcatcaccccacgtctgac

SEQ ID NO: 3005 - DNA, 703 bp, Nannochloropsis_gaditana
ttgtttgagcgtgacgcaaaagtatctattgccctcacgtgtcatgagcacaaatcggaaggaggtgggttgggtgacagcctagagctcaaggacaggaaaacacgcccttgcaaccggttaaaatgataagaaatttctatcagtttgtctgaattcatacgactgctcaacatggaaacgggggaaacattgacttgataaacgaggaatgcaacgtttaaaaaggcattcctgccctgcacccgtgtttgaagttatttattcaattgaaaaattaaccttgacgcgccatatatgccgcaatttgcgagacagtatgtcatctatagcacccctgtctgccaaaggggcggcttcgatgcttctgttcctaggttttgtgatgggaagcgctacagtcattgctgccgtcgcgattcaagatctccttgatttggacccgatactccgaggctggttgaaaaagaggcgaaactccaagggagatggcagcaatggcagccctttgaaaaggccggtcccgtcgtttttggaagccatgtatttgtacgaaagaaaggtgggatggggggaagttatcccctctagtccacaggaggacggtttctgcatgccggctgcgtgggaggctcacgcgggctgctggctcctcttcccctgtcgtcgcgacaggcgggcgcacgagttggagggcgttcaa

SEQ ID NO: 3006 - DNA, 703 bp, Nannochloropsis_gaditana
gcggtaatcatgccaaataaaaggaggggctacaggaggaatggatggtgcggccggcgagtctccttgagccccgcagggcaaaaacctttccagcccaaactacccaccaagaagccaaaaccaccaccaccagcagccaacacgccaagacacgtggcgagtcgctacagacgtggcaccaaggcgtggggtgcgtcgggaagcgtggtcacaacaatggatggtgcggctgggaaagccataggggagggggtgacgcacagacgcaatctgtgataaaattgccagacatatacacctacacatcctatcaccaagtcgctcccacaggacctacagatcgatgccgtccgcgacgacggcaacctgggagggtgctcgagggagagaatggagagggtagatgttcaattgaggcacatttttatggatgatgctgcgtggttgcaagaatcatgcgcatggcacatctccacaaaacccaacgattaaaaatattccctccaatagcatttccttccccgtcgcaccccgcaaggcgcggaacggaaagccaggaaagcagctggcaatggacactaccttggactgtcttttggatccaagcatttcgtaggaaacatactttttccgtacgagggcgggtccgcaggactgtaatagtcaaatacagcaaagggtcttattggaacgaggcatg

SEQ ID NO: 3007 - DNA, 703 bp, Nannochloropsis_gaditana
  misc_feature (513)..(522): n is a, c, g, or t
atggacactaccttggactgtcttttggatccaagcatttcgtaggaaacatactttttccgtacgagggcgggtccgcaggactgtaatagtcaaatacagcaaagggtcttattggaacgaggcatgctattccttcccctccccgcgaccgcaggtatgtcctccccccaccccaaaaaaacgcacgaccgaaattctcgtgcattgggcctttattttacatcgacgaccctatcatgatgatgcaggctacactttaacgaaaagtggcaagaagctcttgcgtttcccgtccccgcggacgatccttcaagcccttgcgcctcgaacttcgacctctttttcgttcagcacgaccagcctggaactctccacgcggagacgaagaaaacgaagaagggaagaccgcattccttccctcttgccctccttcccgccctccttcccgccctccctctctttgcaccgaggaggaagccgacgggcgtacgacacggaaggggcaactgnnnnnnnnnncctttctctcaccctctccttcatctttcatgtgaatggacaagaaaattgtcttcccttttcctctctttgatgaccctccctccctccctccctccctcctccagcccactttgccggactcaagatcaaggaattggtcggtgagaagcctctgtatatctactgcagcccttacatg

SEQ ID NO: 3008 - DNA, 703 bp, Nannochloropsis_gaditana; identical to SEQ ID NO: 2087

SEQ ID NO: 3009 - DNA, 703 bp, Nannochloropsis_gaditana; identical to SEQ ID NO: 2085

SEQ ID NO: 3010 - DNA, 703 bp, Nannochloropsis_gaditana
ttccacaatactgcggcatatgaaaggtagaagaggagaataaagtcgaggaaccatgaatttcaagccaccccccatgccaaaagagacacgcccgaagggtaaagaagtccacgcaccttgcagccacgatgcgccacggcaaattggcttctttagcagcagcttcgtgccttgacaactgcgccgcgcgcgactgcaagtatgctgccgttgatgaaggccgtttccctttcttttttttgggtttgaggcctcctttttttcctttgccagacgatgaaggtggagttggggaggatggggctgtatcggcttcagatgtccttattgcggatgttctaaagcttctttttgatgccacacattctggtagtgtcctttttgtagttcttgctggtggtgctggaacggctgatgttcctgtggtgagggtggcaaccgctctcacacccagaaataatgccctctggtcccctagtccctgtctcagccaacatagaagcatcctagaccagtaggaagacattaaagggaattttgagcattcttgagtgaacacgtgcctgtcgcacggtcgacaggaggaggggcaagatatgtgacggtggtaagcccttcgcctgcgtcgcttttcctggacgtgccccgcaaacctcccccccccctctcacgcgcacgccctacgagcacaggtggcatg

SEQ ID NO: 3011 - DNA, 316 bp, Nannochloropsis_gaditana
tatgtgctcggattgaaaggaccgagcatgagcatcgacacggcgtgctcgtcatccctagttgcgcttgatgcagctagcgagaaacttcggcgctggaagtgcgatgccgcggttgtagctggtgtaaacttgatgttgagcccagcttcattcgtggctttgtgcaaggcccgtatgctttgtgcagatgcccggtgcaagacgtttgatgcgaacgcgaacggctatgttcgtggtgaggggtgcggtgcagtggtgctgaagcgtttgtcggatgcaactgcggcaggcgatcgtgtgttggcagtggtga

SEQ ID NO: 3012 - DNA, 703 bp, Nannochloropsis_gaditana
gacgcatacaaggtgagctgcagaagggggcatgaggacgcatacaaggtgagctggtgcgacttggcaaaagcacgtccaaggcagggacaatctctcgactcacctcttccaccgtcaagccgtatgctccacgatattcggagccatcggcttgggccgctccgtagcaccccacgctggccgccaccaatggccgttgccgtgtccctccccccgcctcctcggtcttccttttccctgcttcttcacgtgaatacgccgcccaaaattcgtcacgggcctcaattgccagtgccactcctttacggatcaaatcctcggcttgcgctcgggtgacacggacacctgctgagctcatgaacccctccaagctggcctggtacgtcgccgctgttgctatgtccgcaccagcttcgaagtattgcctatgcacggctttgatggctgaagggtgggtgcgcaaacaccccgccgacctgtgaataagccacagcgtggtagaaaacaatttctggggaatgtgcgtgcttgaaggctttctacgactgcgacatgggatgtgataactcaccacaatttagaatccaagggtgcaccgatgtaggcctccagaagcgtgcccatgcccccatcactaatgatgcaattttgatgggccagcatggcagctaaagggttgtgtgatgattcatcgcgcatc

SEQ ID NO: 3013 - DNA, 703 bp, Nannochloropsis_gaditana
agctggcctggtacgtcgccgctgttgctatgtccgcaccagcttcgaagtattgcctatgcacggctttgatggctgaagggtgggtgcgcaaacaccccgccgacctgtgaataagccacagcgtggtagaaaacaatttctggggaatgtgcgtgcttgaaggctttctacgactgcgacatgggatgtgataactcaccacaatttagaatccaagggtgcaccgatgtaggcctccagaagcgtgcccatgcccccatcactaatgatgcaattttgatgggccagcatggcagctaaagggttgtgtgatgattcatcgcgcatctcaattgacaagagtggcacctttttaaccaatgtaagctactcgccttactctggcttcagctccttcgactctcttaaatcgtgagctttccaacgcgaaagcccattttgccacataacttgtgtatttggattgagagatacctggaaaagaggagatatagccccgagaacgcgtaaaagtgatgtattcccattcaagcccggctgtgggacgtggacgtgcctgaacttgacgttctcggcgacggtccagacctcgggggggaccaaaggcttatcggggatctttttcgagatcgtgctcagtgctgggtgcgagtgggaggcatcttggaaggggggacgacattgtacgggcgtgcacatg

SEQ ID NO: 3014 - DNA, 703 bp, Nannochloropsis_gaditana
ctatgattatgtacagtatgttcttcactgcgagagaaccgttctccgcgcaaggagatgtgggattgcaagacgtcgtggccggggcggcggctactccgataccgaaaccatgaccaaagagcgtcaaagtatatattgtcaactttaaaaaggtgaagagttgaagcgccgtgaaaaacttgatgcaaacgttatgcacgaaatgtgctcggttcaaagtcatgtgtccgccagttcccaacgctctggctggtattgatagtaaagacgttacagcgaagagctttttgagtgtcgacgctttgttgatacataaaatgattgaaaaatgatggcatcgagttagaaaattctgttgcagaggagtgctgagaaccgaatccccacgctcccgtgtgagcggaggtatatgaaagcaagtgataaaggaaactgaggaatccactgcttcgtcccacaggcaacaatggtggacatgaggttcaccatgcaggtggcacgacgtttatgcctaaccgtaaaggtcgcgtcccttcaggcttttgggatcgcatttgaatcagaataacctccccctcacttcaattcgaacaagtcgacacagacaactcccacactttcagagctctcaccacaacctgtcgtgattttttttaaaacgcacccgcgcacggtccagtatgctgatcgctttatcatg

SEQ ID NO: 3015 - DNA, 703 bp, Nannochloropsis_gaditana
agcactctcatagccatcgagcttggcaggccgtgcaccaccacccaaacaagtgataccactgccataagcgtggccccaagtttacattgacttgtacactgtgtctggctttcgtgactcgtcgaatttatttcgttgattattcttagtatgaacatacgacacccgaggctcgccagtgccatgtctcgttgccctgaaaaccgcaaggaacaaaacttttttcaagcccagctttgccataaacttcaagataaactggatgtaaacaagtgtggaatgtttttccccaatgacgtcgacacacgcgaggcatgatggacgctcgggcgtgtttttttaatttcggctgtaccccccttgcactgcggataaagctgttatgacagggccagcgagtcatgttccacgcgagtactcccattggacagtgatgaacacgaggcggaggtcgagaccgcaccggggtgttacaaagaccattaccatggtgctgaccatttcaccagtgttgtgacggatttcttccccgcgcggagtacattttgtatgttgcttttccacccctagggtacgttgagaagcttttagcgaccccgctccatggcccactgcggacacccgctttgctcccgaattttccctcaccttcacgacccccgtcaaaaaacaggcgcttgatcgcatttgagaaaggatg

SEQ ID NO: 3016 - DNA, 703 bp, Nannochloropsis_gaditana
  misc_feature (1)..(612): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagggcggggtcgagggcgtggggcaggtcgaggaggaggaagggggggagggaaaaaagtgggcaaggaggatttggacgcggagatg

SEQ ID NO: 3017 - DNA, 703 bp, Nannochloropsis_gaditana
tctcggttcatctgagaaaagaaagcaatgtatttctccatccgttatttttttttcgtgtgtggagaggacccgcctccgtcattgcatctacgtgatgcgtttcgatctcttggatgcccttcgcattctcctgtacttgtctgactgcttcattaggtacccttgacctagcattattatcctcgacaaagagatttcgtacgacttatgaagcttttcgttcttccccggtgttgtgaccagtcaccacgtcgcaaattgtaattgtccgagtgattcctcaaaaataccaaaaataccaccggagtgaccttcaaaagacaagattacacagacaagtcattactcatccagtcttccctgcacgaagttcagcgcggccccggtttctgtcaaccggcgattggaacagaagagtaggtaacaaaatatgcagatcaaattcacaatttagtaagggtcgttttgggcccctcttgtgcccaatgtacctagggattggatttgttgaaattcacatcaaggcaggaggttacttcccggtgctttcatctgtcgctcctacttccccggaaacatcaccaggcattccagtttgaagatgcctgtgcacactttttgaccatccacgttataattacaaaacacgcagtgtgtggggctcgctgggtgggaaggcagggatccgggccgagacatg

SEQ ID NO: 3018 - DNA, 703 bp, Nannochloropsis_gaditana
  misc_feature (107)..(412): n is a, c, g, or t
atagagaaatacctctgcctcgttttcaggaggaccatgacggttgtagatacggtagatcatgtttaagatttaaaggcaagtcatcaggctcgcacacacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgaccatctccctccttccctccccagaactcccggcgtcgaggacagcccagccggcaagtctcgataacggcccataaaattcaggcattgcgggaccaggtagacgtggccgcagtgcaactccaggtcggtcggtcggtcggtcggtcggtcgggagagagggagggagggaggacactttgtgggagggcgaaggtatccgtggaggatttcttcacagtgtggcggcaacgtcctaccaggcccatgccctccccttcctcccctcatcctcgtggggatg

SEQ ID NO: 3019 - DNA, 703 bp, Nannochloropsis_gaditana
agaagagtttttcatggccatgttgagctcagctcaggtttgtaacgcacatgtggtggattttaatttattccactgttatcgatcgacatgtcgtgcccacttcatcggattttctcataaaaagtgttcctattggagatactcgtagctatactacgccatggcccatgttgtcctgtatacccttttttcgtttatcggtaaaagtgaggcagtgacgtcgcagaatcagcccctgccacaccaatacacatactcgcatgctacaagtccattggggaacagctggagttttgggccatggcatgaggcctactcagatacaaccatccaacccctcctacggataactaacctcatgggtttcgcgccatttttttctcagcatcgcctgcgaactgaacactcgaacaccaccctctccttcgttttctcctctcaccaccctgagtgcctttccctccttgcccacgaggcccacggagtgcatgggcggtcagaggcctcgtgactccccggcttggatagtttgttgtcggcgcggccctttgtgttttggctgtgccccatgggcatgtcgacgcaaggtgttgtggacggtagaattctcgctcaacaatcgactcctcacatttatctgacacatggcgcgctaatttcgcacagaggccttcccagcagcatccttgcgtttgtcatg

SEQ ID NO: 3020 - DNA, 623 bp, Nannochloropsis_gaditana
taggcggtatcacgcccgatatcggggtgtcggcgctcagcagtctcatgtcgcacaaggctggtttggcgcaggcggcggtgatgccggtgtcatggtccaagtttgcagctcgttcaggcggtcgtttgcctccatttttctcgcgtgtggcgcgaacagacatgtctgccgtgggcggtacgtctggtggatcgggcggtgcgttggagatgctccagtcaattgctgcgtcggaccgactgctatatttgcaagagttggtgctcgagactgcgagggaggtgtccggtaacggagagctggatggtgacgcgccgttgatggagtcaggcttggactctttggctcaggtggagctgcgcaatactttgtcgtctcggctgcacggtatgcagctgtctgcgacgttgtttttggactaccccacggtgaagggagtggcgtcgtatttgttgcaggagatcatgccgtctcaaggtgtgcgcggcgggttgcagcgtgtggtgctgtcggcggatgcgtcatcggaaggactggcggtggtgggtatggcgtgtcggctgcccggcgggagcgacagtccagcggctttttgggagatgctcgcggaaggtcgcgac

SEQ ID NO: 3021 - DNA, 703 bp, Nannochloropsis_gaditana
cccgctacctttcggccggtaagaccccttcctgactatgtccgccgcgtggtagcctcgctctctgcttttgtttggggcatagacagggcccggtgctcatctagcgggcattttcgtgttcgggggcggagggtgcggttcctcacgactggcattttccgaggctgccgtgtacgccatggacgcgaggcgggcagtgatgcatgttctgtgcatttcagctaggatttggcgtccttgcggcatgcgtggtgttgagtctcccctggcgtggtaactacgcgtcactgaaagaagtgagcgaggaggaaggagggggaggctggaactttgcactactgccatgcctcatggcacctcgacagcaagtgtcacgcaataatgcgtacattggcacgcttgcatgtgtggtgatgctggtgcatttgcaaaatcttgtccgtcataattttcgacactgtgcctgctcccttggcacccacagagaaaaagtggaagaagtgccatcctccttctcaactccctctttccccctcgatcaacgcgcagacaggcacaccataagctgctttcaggcctctagcttcggccacacagcaccggttgtcgtcttccctctctcgcgtcggaaaagcgccacagcattgaccggtcccatctttcagcgtgccgagtcttcaacgcgcggagtgtccgcatg

SEQ ID NO: 3022 - DNA, 703 bp, Nannochloropsis_gaditana
agtttcgagggaaagtaagctcgcacccgtcgaaaccatgcctggctttcaggagggacgacaagaaataagcgactttttaccatcaccacatcttgttcaggccttcacgaggatgaccgcaacagaacatgtctttagcattgattaggtaagactctgtgtcctacattcatgaaccttgtaaaaagagaggcgtgtggtcggttttcccatcgaccccgttttgtcccctcgatccccgacctcccggcatatggccatgctgcattccgacgtaatccatctcccaacacgcaaaaaaacaccaaaaccctgcctggagggccgagatagccttctaatcagaaaaaagaatgagaggtcgtaaagacacggcgttgggctggtgattttatcgagatcggttgcgtctcctcttgcagattgaacgttggtattgcagagaaaagggaggagagcagtcccatgttgtaaaaataaatttaaatccgaaaagattgtgttacggacgtcccaaaaacacagaaaagcgtaacacatccttcatcggtaaagtatacacagaaggcagcaacttgtcgaaagatgcttttttggggggggcttggaagatgcaaaagcggggggtacccagactttttgcctcaggcctcaacttttggtctttacccccctgccaaactcagggccagccaccatg

SEQ ID NO: 3023 - DNA, 703 bp, Nannochloropsis_gaditana
ggatgtccgaggcacgagaagacaggagaatgagccctcttggcccaaaaacgtgcacagatcaaccctccgagagccaacacatccatgagcactacgatcgtacgcgtaggcgcgttacgccatggtggatcggacgagtcgatgaggaccaggggggccatgtcttcttcaacgcaggagtcgctttttaccggctcgaaaagtatctgctaggctcccgcagcttaagcacgggtcttaggcctcgccttaccaagctgattgtatgtgtgtcatcctaggtgtttgttatgcggatttgtaaagtgagacgtctctcggaatcaggtaacaatgtggtgcaggttttacgtgtcatgcgagagatggggggtgctgttcgtcgagtatgttccaatagcgactcagagcataccatgcgggcgagcgtcgtctgcaccacgcaaaagcccctcgttgcttgcgtggcttgcacctgaccttttttagacagtttttctcctctttgcattgattttattgcgcgcacacccgtggcccctgcgaaagccctcaggattgtggcaaactgaaagtgacaccgtggtcctccttcatttcctctacgacctaggcacggacgcggataaagagtgccacttcaaagctcatgtatcagtctgtccaaagcgagacattggaatggagcgaggtggccatg

SEQ ID NO: 3024 - DNA, 703 bp, Nannochloropsis_gaditana
ggaggaggaggaggaggaggaggaggaggaggaggaggaggaggaggaggaggaggaagaagaagaagaagaagaggtacgtaacatgataatcccctggtattcgagactgcacttcatgaccgcctcgcgccatctgcacattcgcaggacatgtctgatgctgacgaggaacttgatgagcttggcgctgaggatggagacgtaaatggagaggcctcgacaccgccaataccgccacaatcaacaggcgaggaggacatgcccgtcctgaagtatcatcgaatgaaggcgcacgtggagacagtacagcgagttgggggcagggacactcagataacagccctgtgcatgcacccgcgctgcttgatcgtgggtacctcgacagggaccgtgcacttgttggattaccaagacaaggggcgtgaattagggcttatccgcgcagcggctcacggtggacgacagatccggtgtttcagcatcgatgatacgggagaatacctggcgagctgctccgatgcgggcgtggtggtcgtgacgtctttgactttcccagcccagacgttgtcctcctcctcctccttcctatccccatccctaacgcgcgggacagctaccttcaaaacagatagaaaagaggaagaaatagccgagacggtgaaggctggtggaggtgccgtagctgcaaccaagctttctt

SEQ ID NO: 3025 - DNA, 703 bp, Nannochloropsis_gaditana
aacaaccaccatttctgacactagggtcatggccttccatccaacactaaagacgtgtggccatccctacctggtaccaagcccccatgcacacgcccgtggtgcttcacttctcgccctcgaccacccacggagggccgagagcgacgcaggcggcgagaagctatcacagtctgtgggatgtaaaccctcgcccggggctctaggttagttcggactccggcacatgccaaatggactgctgggaggacgtgtcttgtggtgctggacgccagaccttcgggcacgatgcctgctctggcaggttgttggcttgccctgggtaacgcactgcgtgttcatgctagtcactcttttcctttcctcggaaaagcgctcatcagcggcatctgggcgagcttgcttcctcttccgtgatgttatcgcctgtccatcgcggtttcacgatggctgcatgaacagaaggaagatgatccgtaatgagtacgctcgaacaactgacgattatgcttttgtccacagactcttagaatcgaggaggttgcccctgcgagaacttgtcttcccaagacgctatcttgttgaaagttacgtcctcttccgccttccaggcccgagaaattggatcgaggaatcttctgttctggttctgctctgaggaacgatttcgctgccatttttggggggcgtaagcaaaatcatg

SEQ ID NO: 3026 - DNA, 703 bp, Nannochloropsis_gaditana
cgcaaagaggctgggagagcattgaatgttgagtggagcaatagcatacaagggaaaaagacgggtttgatgaactcagtgtgacaacaatagaacttcgaatggtatgtgcaacattttgtagatgaaaggcgggaaaaacaaggagcaatacaccagacggtcagcttggaatttatttgcgctgagatatggggtcccacgtaatgcacagcgcccattacagggatcgatcgccttgctggctcttaagccacaggaatacttatatgctaggatatgcttaggcgctcactacatgcacacggtcgatgtgatagaggcacgtcatgagaaagccgtcaaacagtagtagtgatggggcggggaggttaaattgtaaccaggaaatctacaggagcaaaatgttgatttcaggtcgattcttctcaggagaatacaagcttagcagagaatgctgagtggggatgtagttgatgtaggaaaagcagagaaaacagcactgagccttacgaagcaaagtgacgccatctacgttcctcttccttcctcttcgcttgttgttatgaggaagcacgctttattttcaccggtgcaggctcgatttttttttgctgagttcgttttgcaaacaatacttcacgtatgcgcgtccatcaccgtgacaggcaaaatgacagggcccctgcgagccgcaccgatg

SEQ ID NO: 3027 - DNA, 703 bp, Nannochloropsis_gaditana
atactttgcaaggacttccatattccccgtatcgggggcgttgcaattgcacgcctctggagccaaaaaagatctacccataacttcgctcagcaccgcatactctaccatattcaagcccgaatgatagacatcacgttccatcatgaaaaggttccaaagccccaattttcgagccttccccttcagcgtctctattatttcaggaatcatccagcgagaagatagttcagcatgctgcctctcgtacaccacctccgcaggaaggcattcctcgtcaacgaatgccgtcaactttgcgtatagtgtcttggcatggggagacaactgcggatacatccctcgagggagagcgcaattggagatgatcgctctggtcgcccttgtgtagtttggctgtttctctattgggaaagagattgatgatttttttaagcaacatctctgaaggagatcattttcttacggaaaatgacatgcgtcttcagcttttcatattttagcatcaaggtcctaaaaaggctgaccaactggcaacacgctactggtggggaggttggcgttggggcttccttgctgccttttcagctactatccgcaccacacgagacgactcgacctttattaatgtttctccttgctttcaacatgtgataggagctggagcaggagcttccgtggactggattggacagtaataatg

SEQ ID NO: 3028 - DNA, 703 bp, Nannochloropsis_gaditana
tgggttgcgctggcacgtgtttgccgatgcaggcaacctgctgccctggtcggcgcctttgaccagcatgctttcagatatgcgagtggcttgtgggacgggtttggcgattagcttggggatggcacgcgtggagatgaattattcagtgcccgtcaagaaggagatgaaagattttgagcaacggtggcaatttgggctagccgctcatattggctagtattatgaataggacttgcgtaagtacataggtgcgttggtaggacaatgaccgttcaaagtatattacaattcatagagctgcggattagcgtacgaaatcttggcctcaaatttttgttgcatgtcacccttttcgacggaaccgagcaccgtgtgggaaaaaatgtcgaccccgtgcgattatcagaataaatcgaagcgataaatgttttgtgttacacgaataacttgtggtacttcaatcaattgatgcaatttggtctaacaagtacacccaagggatgggaaaggcaggaggttagacactgcatgggccatcgcccggacgacagacgaaacaagggccttgtggctgtcatacaaatgcttctcgtttagcatcatgacagaaagtagaaaaaacctcaagcattttaatgctgctaatgctggtccatctttgtcacaggccgaaagacaatctctaaaggatactttgatg

SEQ ID NO: 3029 - DNA, 703 bp, Nannochloropsis_gaditana
gttttcagcattatttaatgtttttttattttcctcatgttggacatttttcggccgcgagaattgattggaggctacgcaatacttcactgtgatcataactagagatgtttcgtcatcatcatgcgagtgcgctggatacaacatgtgcgccttgcgacgtgtctactagacgtgagggagcagcacgtatggtattattccaagattgcggctgcatcctttcccatggtcaagcactgtgatgcgcatttaaatcttttaatttgagtcggaaacttgacgcgccacttttcctgaagtctctaaactgctagatcttagcagtcctgaatccacgctccaggcttcctgaaggcgtgagagacgtcatcgaaccaagtagttcaaactccctctaacaagcgcccccattgcatgacagggcgcgtctttcatgaccatacctgccgcaggaacaaccttagtactgccagaagttggtacatcacttgaagaaacaggcgtgtcagaaattgtggtgcacagatcggacttgacttgttgtgaagaaagcaagacgccagcagagtgggcggccgaggggaacaggcacgctgacagtggcagggaaaatctcccgtgcaaagacgccggcaatcacgcaagcggggacactccttgtgataaggctcatagccttgaccaagaaagccatcgcatg

SEQ ID NO: 3030 - DNA, 703 bp, Nannochloropsis_gaditana
aagaggaagcacatccttggcggtgtgaagaggcgtgaatggcagttttactttgtggaatggacctcattgacgtcttgaaaattgtgggatggtctctaatgacctcacagcagcatctaacgggtcacgacagcgcacgttcaagtaaaaaaggagaacttgcatgactctcaataaataaatgtgcgcgggtttgatccattccaatgtcacaaacatgcacagatttacaggaagatctcctttatttggccatgaacgtcacgttggaccggtttcctgattgatgaggttcctgccttgtcccagccccttggcaagtgtttcttggctttcacggtgctatcctcatactatccagcccgctttgattggcaatagcatcgacagtaaaagatggacatggaatctcaaggttttacaatggaagtcatcccagcgaactatatttcaatacctgtggccgcctaaatccggcccatcactttctcatccagcaggaaagacagatagcggctcccaaaatgatgtgggtggggacaatggacaggacatttctaaatcacaaaatctgtattcgcataaagacctgtacaacaaggacacattgtggggcgcgaagacaggcgtcgggagtcgaatgcctttccctcccaaggcggaagactccctgcttgaacgtttggaaaaagcgcacatg

SEQ ID NO: 3031 - DNA, 703 bp, Nannochloropsis_gaditana
gccggtttggcatgaacgagggcatttaaaaaaggagaagttgggatattattcccgagggggggaacgggcgagaggcagcgagggcagccaccaacccccccccgcgctttaaaaaaaagcaaaaaccgttccttttggccgacggacgggtcaatggccgagatcgtgtgatgtccttgcttcttgggcctgacttgcaaccctggtttggtgtatgcgtcctgttcgtgtcttgtggttggggtcacgcgggcccactgctttttccggctggcaatcggggaatcaacacatggcttattgccagctgtaagtggattcccctttttccccagacgacaaccgcacgtgtccatctcctgtttctctccatgaatgtcgcccggaagtcgtgtctttttgcttatctgatcttcccacggggctatggccttggaaagacatggataacgacgccgggattttattaggggcccaccctcgattgctccaccagaacatctgatgtcagagagcacataaaaccctgaattacccgaccgcggagatgggttcaggccagcaccctcacactgcacctctaaatttctaagacattatgactgactcacgtttgctccttttttgctcatagacgccttttttgaacgttgggtggtgccctgtggcctgttgttctgccgagtggcagactgacatg

SEQ ID NO: 3032 - DNA, 703 bp, Nannochloropsis_gaditana
aatcaagcttgcattgcgatgagcaacaatccgattacgcataagaggacgaagcatatagatgtacgattttattatgtgcgtgagaaagttgagagtaaggaagtagtaatgtcgtgtcaaacctggtcaagtgttcacgctgttctacaacacgattcctccaacagcggtaacggcgcttgaaaacgactccgtcatggaaaacggtttgcccatatcatctggcagcttcgcatactaagcgctacagccaaccagtcaaccgagtggcgagtaatgacagcttatagaatcaagtataatggaatggtgtacataaaggttcggttgacggcattcaaagagacaatgaatagctggtggtcatattgtgtggtaaacatgtcttagccagcaagtggtacctgtaaataagtgccagacgcttctctttaggtcttcaaagtcagtcgaaattatgacaggtcctagaagcctaataaattttcaattcgggtatttccttcctctttgagattgtatcaggtgtctgctctagtttagtagagaaatgaggaaggttgacaagtcgctcaggcttgagtcagaccatcaaagttcttccctaataatcaagcggagaagtgtccatcttcaactcttcatggttgcagctatgacgatcatattggtcatcttattaacaataacttcgcaggtg

SEQ ID NO: 3033 - DNA, 703 bp, Nannochloropsis_gaditana
gtgtacataaaggttcggttgacggcattcaaagagacaatgaatagctggtggtcatattgtgtggtaaacatgtcttagccagcaagtggtacctgtaaataagtgccagacgcttctctttaggtcttcaaagtcagtcgaaattatgacaggtcctagaagcctaataaattttcaattcgggtatttccttcctctttgagattgtatcaggtgtctgctctagtttagtagagaaatgaggaaggttgacaagtcgctcaggcttgagtcagaccatcaaagttcttccctaataatcaagcggagaagtgtccatcttcaactcttcatggttgcagctatgacgatcatattggtcatcttattaacaataacttcgcaggtgcgcaagttctacgctgaggtggtgactgtgaccagctgaaaaacggtctcaccttctgcaataaacaatctctcctattcagggtcatcttcgcttcgatgatatcgcgcagataaaagaacaagcaaccgttacgtctagtattcatcaagttctcaagaatcataccatttcagagcctgcacccagcctacgctacaacgaagaaatcttccgtctctcaaccatggatccacgtgagtagatttcattgcttggggatctttgcatgaataattctgatgaggcctaccgatatccctctaacagcac

SEQ ID NO: 3034 - DNA, 703 bp, Nannochloropsis_gaditana; identical to SEQ ID NO: 1695

SEQ ID NO: 3035 - DNA, 703 bp, Nannochloropsis_gaditana
gaggtggccgggggaggggagggggaggggaggtggacaatcaagagttctacaaaatcctcggggtaaacacggacgccaatgagggagacatcaagaaggcttaccgtaagctcgcgctgaagaaccacccggacaaaggtggagatcctgaaaaattcaaagagattaccatggtgcgtacaacagtgtcgcctcgtctgcgtaccttggtgggctatccgacagagacagcaggccgatcttgtcgcgttcgtcaagtcctattttcgcctctcgcaaaagcgtggggggggtttgttgcctctttttctgtggaagcgattgtcatggataggcattttgctcaccaagtgcaccctctcctcctctgaacccgacattctcaactgccggcacaggcctacgaagtcctctctgatccggagaagcgcaagcggtacgaccagtacgggaaggacggtttggaggagggaagcatgcacaacccggaagacatcttctccatgttctttggcggcgggcgacggggcccgagtggtccgcgaaagggggaggacatccggcaccctctgaaagtgaccctcgatgacctgtacaatggaaagaagtgccacctggccatcaaccgcgacaaactctgcggggcctgcgagggcttagggggcaagaaaggggcggaacgttcctgcagcacatgcaa

SEQ ID NO: 3036 - DNA, 703 bp, Nannochloropsis_gaditana
agagcctaaagggggagtgggcacgatgcaagcagcgggtgactaggcgagaaaggggcgttaggaaaacggtcacggcagggactacatttcctcctccattcctccactcccccagcaacattatactttcacaagattggagggactacaagatacacctttgggtgattgctgtctactacacgtgcattggcctgagccatgtccgcgactacgatttccatctaccaggaaatagtttcccactcaatatcaggttcaaagctgccttaagacttttcaaaaacgtacctgtttaatcgattgcatctcggttgcggctgtcgcagaggtagacacacattgccgctcatcgtgtccgctagtatccctggagctgaagttgcagcctcaggcggtcggcaggatggcaagaaaaatgcttgcccagggctcaaagaaatgatgaatactacaaacatgcatcccatatataccatgaccctggttgtcgtcatccttgaatctaggatgtctgtgggggttaaaaatctgcacgtgaggtgacggcccggcatatcactcgccttcaggatggaagaagcgagaggagacggtacttcacaatttccactgctccgacgcaacgcaatgtcttcagagcgggccatgtgatactctcagctgattgaatgcactcatacagcaagttaacaggatt

SEQ ID NO: 3037 - DNA, 703 bp, Nannochloropsis_gaditana
gatgcatgcggagagggagggggggaaggaggagggagggaaggagggaggggaggatgggaggaagggggggggcgatagatagcatcatgtaaggacgtgtgccttgttttcgtggaacgaaaacgagacagaattttgaacgatggaaggttcatgctaacggagaacacttgtgggcgcacgaagctgttcaacacagcttgctccttgcttctttcgaaacgcgtccatcgctgaggtgttcttggaggagggatgatgactgacgtcagtgcatcctcccttcctgcctcccaatactgctcctgaattatcgctccttccactttcatcataaggccctgaacctgcatcgatcatccacggatgaggaaggagccctcccattgcatcggtggaaagtctatcacctcaacctccccccttccccgccttagagacttgaccgtttcccctacgtgatgctcgcttttcccttctttcaacccctttcccgatccattgccttctctctctcattcttatggacctgctctcctgcctctcttccttccacccttctttcttcccattcttctttgtgtgcccggcgctttctctttgctcatccgttaattttcaaattaaaaatcttccttcgtctccccttgtcgaccccctggcttctcttccctcctccttgtcagtattacataattta

SEQ ID NO: 3038 - DNA, 703 bp, Nannochloropsis_gaditana
tccttccctccccccacccctccctcctgcccgcttgtcacctccccctccaccacgaccaaacccgtcatcgcacctcctcccttggcatcagacatctgcgcgcacctctccaacaaaggtccgtgcagagccagcccatgctccacctcaggcttctgcatgaatttggccatctccgaataagccgccgcatgcctagacaggtcatcgcagaccaccaggactcgtcccccctggtcccgccaatactctccctgcgcacagcccgcgaagggggccagaaaccgaagcccggggggcatgtcctgtgtggcggcgactactgtaacgtgctgaaagcaggcacggcgggtgagttcgcccacggcctcttggactgcccggggctcctggccaatggcgacatagacgcagtgcagtggggcggtcggggaagggacaggcgccgccgtgttctggttggcgatgatctgcagggccagcgttgacttcccgctcccgggccttccgaagagtcccacgctctggccgtggccgagggggtggaagacgtccagaaccttgacccctgtgcgcagccggtggcacaggggttttcgcgccatgatcccgggcgcccggcgctggctgctcatgatgggagtggaaggaagggaagcggaggaagaggaggagctctttgtgtttgtgcggtccgatg

SEQ ID NO: 3039 - DNA, 703 bp, Nannochloropsis_gaditana
gaaggcggtagacggggggaggaagaggaggacgacaacgctcctcacgcactggcaaggcacagctaattgtggcaaccaaacccgcccttacaccaagctactcctatccctttctggtggacgtgtgtattcctatccacgactgcgcgtaccatgaggttcgtcgaggtggagatgaaggattgaggggcttcgggcggtaacagcatcattctggtcgcaaccttgcccttgccacatctcgttggaattctcaaatgaccattgagcccccaactgggcagaacgaaggcatgtgacagcactgcactgaagaaaaggagagacaacgtggttgcaattccttgtcttagacccatcatgagcatgaagacggcgaggcggagggaaattacgactgcgaatcacggcaggcacacccgaaatgtaacgcaatcctctaacctgcagtaaaggaaaagttttgcgtgagtgtgcaaagtacaagtagccttgtcgccaaccagaaaagtttcccagacagtgatatcttacgggaccgtgcggggtggaaactgacgaagaaaggctcgcctgggactcacgtcgtcacatatccattttaccgcaataattgtggttttatcaccgctttgtacatgaaggcacgtttctaaggatctcttttacgcgacctcatcaaattcatagggccaccatg

SEQ ID NO: 3040 - DNA, 703 bp, Nannochloropsis_gaditana
tataaagcgctctggctcgaccgcacttttctcgcggcactcgacgtgcatgatactagagctggctacctgcgagagaaagacaacccgctagctcccatccgtatacttccccgcccaacgacccattggaaccctgctttcccacggttgtgcgcataaattctgtcttgaccatagcgcacgtctttacgcgctcatttagcagtgcatgcgttcgtctaattgccttttcagcgtcacctcctggaggagggagaaggccatcgcccctaggcggactcaagatcatggattgttccatggtcattctaacagcctgccctttcctcgatactcacagagcaccacgctcggtggcggcattgtatcagttctggcgcttgtcacggacgctcgtgacgggcataactggtacgttcttctaatacgaggaaagatcgtattcgagtccgcctgcataaccgcttttaaaagctgcttcgacgtagttgacctgaaagccccccttgcccgcacggcttgatcatcgttgcagtgcagagaagcatctgagtgtgaagctaggtgcttgtcttctctgccgcaatatgccgctggtctgctcccattcccataccatcgacgcaagccccggtggtcgggccgtagagcaattcttcctcgctctcacatgtttcatcatcacgaccacagatcaatg

SEQ ID NO: 3041 - DNA, 703 bp, Nannochloropsis_gaditana
cctcttgctcccgcacgagtacttcttcttgcgcgaacacttggctgtgcagcttcttcagagggacgtcctgtccgtgggccggaccatcgatgccctccgtgtgctcgggagccacgaggagaaccccatgatccgcgccggcatgacctacttgatgcgtaaccaggcccaggcgggaaattggccggcggccacgaccggcgcgcccgtgacggaggaggaggacagaaataccaggctagggggatacggcggtcgaggcacaggccgggatcgattcgtggcccctaccctggcggccacgcgcgcgctgctcgtgcgggagttcaacggtttcggaccgcttcctctcgaggtcctggacctgctgctggcgtggcagaaggaggacgcagaccctctcccgggcgacctccccccgcagggagaggacgggagcagcgtcttcctgctgcccgacgggacgtgggaccgccgggtcaaggatttggagcgcatcgtcacaaaaataaagaagcaattcaagaagagacaggctggcgccgctgccgtccgtgcggcgtctgcaactccttctgctgcctctacccccgctcctatggtccctgcttctggagcccttaggatggcggacacagcccatccactagcggcccaagggagtcaggaggccgcccccctggacgagcgtgcgaggatg

SEQ ID NO: 3042 - DNA, 703 bp, Nannochloropsis_gaditana
  misc_feature (153)..(162): n is a, c, g, or t
tcgaccacgtcatgcctcgctccaagggtgggaaggggagctgggacaatcttgttacatgtacgtttgcggagggttggtgggcacgcgtgttgaggggaaataggacatgtccttatcgctgtcgtcctcccgccttttcctttttttttnnnnnnnnnngcccacggaggaaggcgtcacgccgcagccggcgcccacgccaagctaaaagccctcctcttcatgctgcagcgcgtcttgctccacccttccctcgtgccgttgcaccagctcgacaccatcaagcggtcgctgcaaatccagcaacgcctggtcgccatcgccgccgacgccggcccggcgggcgccatccctgtgctcggcatcgaggacatgctggcacggctccagggtcggaacgccgccgggggtttgacgcgcgacgtgaatcggacgtgggccttgcacggcgacgagctcgtggaggcccgggataaattggagaccttgtcgttgcagcagctgcgagcacgcatggaggcggagggcttgcctctgcccatcgcctgggtacagctaccgttgcgggcggcagcggcgcggggctcacgctctttgagtgttcgtgtgcattacgaggacgaggagcgcggcaagggtggagaaggggggggcgtggcatcgccttctcagggagacgctgaggagaaggagatcatag

SEQ ID NO: 3043 - DNA, 703 bp, Nannochloropsis_gaditana
gatttgcctctgtacggtcagcgagcccaccgtcacgcagtgctgccacgtatactgtcagtcttgcatattggcgcagatagaagaagcgcagaaacagcacgagctccatggaggctacgggggcctagccaacctaggcactcgctgcgctgtttgtcggaagccaatctcgcagaagagcttgatgcgcttggaaacgtcctccatcgagcgctacgaagcggcggccgaggaggtggacgggaaggtagccgcaggggtaactcgcgccgacgccgtgagcaatgcggcagacgcagagagtgggccgggggggggcgggaaggggaatgcgggggagagcatggacgtcaagataccgccagcattgcctcggaacaggagcggtgatggtgatgacgcggcggacggaaggggcgagacgaaggcggtagacgcgcacccagcggagcacggcgggcgggcatcgaggcagtgtcgctccgcggctgcaccatccccttcctcaccttctcgtggcagcgcaatccgcacggtaatgaacatccctcaggttggctgcccccccgccgccgatgaagcgacgctgcagcgtctgcccgttccattcgcttgcggtcgtgacaacagcctgccgtccttggaacccgccttcctcgcccactacaggaacacctccatggtaccgagcgccaaaatg

SEQ ID NO: 3044 - DNA, 703 bp, Nannochloropsis_gaditana
ctagatccgcatctaaatgttgagccgcaacctcatccacgcaacaactaccgtatgaagtgtcaccaattacaaaaaatagaggctcagtgtgctctgagacatcgtgttgtctctccttttcccgcttttgacgtattttactttgggccatgagaaattgacacacacgcggcgcgtcttttagcatttcatcggggaactgcaaagccacgcgacagtagccattacattcgatggtgtctaaagtcctatcgcactcgtactggtctgacaatttttccatggatcgatcggtagcattgtcaagcacagccattacctcctgccttcccacttaaaagcagcagagaggcaaaagactcggtgcttgtagctttcgtaaaacctggaaggttgtttgaaagaagaaacaggagtctggtgtagttgtatacaaggaagaaatgtattagagtccattatattggcctagttcaaagtcatgaacttctataccccagcgagcactgaggtaacctttgcgctcctcgctccgcgctcgctgcctggtttaatggctgccgtacatcacatttattgttgcgactggaatcattgatatattaaattttgcacacgataaataaagacagggtcttgcaagttgtgctatagatttactttgctgcattgctggctccgcgtatgagcctgtgacatg

SEQ ID NO: 3045 - DNA, 703 bp, Nannochloropsis_gaditana
ccggcttctctgcgccatggacgagaagaaagctctgtgccccgaggagtcccacgccagcatcatggagcgcctatggtccctccaaaacccgcaatcctcgccatggcggcggcccatgatccggcttctcacgtcccttcaaccaccaccagccatccttcttgccccggacgagcccgaggaggaggaagctgacctgaacgtggaggtgacattccacgtgtatttcggccgactaattttcgagctgatcgcgaacagcgacacgcaggccctaatggcagcgctgacaccggccggagacgtcttttccgcagccaggctgcctccgtccaccggcaggtttcgccgcagcccgagtgggaccccacgtccgtcgagcaacgccacggcgggcgcaacgtcgagcaatggggtcgtggacgttgtcgaggagagcgaaggcgaggggcgggtaaaggaaaggaggtcggaggtcgggggggaggaggcctctgtggggggggtgctggagcctggaggaggcgaccatgggccggagcaggaagccacgtccgtcccaggagcgaccgaaggtttgtcagccacgccctgggagcgggcgcggcgggattttcaattttctctgccaggtctcctccacgcggccgagagcaccgggtacgccgtccgcgacccccagccccggggcttgaccgtt

SEQ ID NO: 3046 - DNA, 703 bp, Nannochloropsis_gaditana
ctggaggaggcgaccatgggccggagcaggaagccacgtccgtcccaggagcgaccgaaggtttgtcagccacgccctgggagcgggcgcggcgggattttcaattttctctgccaggtctcctccacgcggccgagagcaccgggtacgccgtccgcgacccccagccccggggcttgaccgtttccatgtttgaatttcaacggtcgacgttacagtggatgttggaccgggagcggggcccaagcctgaacgagtacttctgggagcgccgggcctggaaggacgcggagaccgcggaggaatgtttttactacttccccgacgcgggggagctccggttggagaagcctcctcacaggacgggaggagtcttgtgcgaagagatgggcctgggaaagacggtagagtgcttggccttgatcctggccaacccgctggcggctgaagggggggggtcggacgagcggggcgccagcggggacgaggagaaaggggatagtccgtggccagggggaggagacgcggtccctgctacaacgggcgacctgggggggcagaagggccggagaagaagcggggggggttcgaacgggagccgcctggcacaggggacagggggcgccggcgctgagggatggaaggaggacgggctggaagaggaagacctgacaggacgcccctcccgtgcgacgctgatcgt

SEQ ID NO: 3047 - DNA, 703 bp, Nannochloropsis_gaditana
taaggatggtgtaacagaggagaaaatttaagtccgcgaaaagaaacggattttcaaatgaaaaacgtgtgacgatgcagctgacgtctcccctctgcggaatacttcatttcacctacctttatgagtgttttttgtcgactctcatatctgtcgatatttctcgcagtatgattggaaaatatctatctgaccagggaaagtccctcacgctaggacgaggattgatgaagctgtcatcggaagagccccgaagacgaatgaatttccttgtcgccgccggaaaacggacatgacgctccttagtgatggacttgatcgcccttcgcattgtgtttttttttaaactgtcattctgtccgcgtgcattcatgagagtggattcattctactttgaccagcgtaggattgattgtacgtcgacgcaaagggcgacgtgcagtgttcaggactgttcgtgtgcttgactgaataccgtgcgctcgctttatccaaccagtactttgtgtcggcttccattccagtcattgtaccaaaatattattctctcgtcaaatggactactatacgatcggtttgaatttcgcgctcctcaaacacagctcccaagggaacattccatcaggctcgccttcgagtacgccatcactgctgtcgcctgcggagagggacatcggtacccttgcattccaaacctcgcatg

SEQ ID NO: 3048 - DNA, 703 bp, Nannochloropsis_gaditana
tctcgtccagggtcgccatgcgatgctcgatctgacgcatcctggtcgattcgatcttttccaacgtacagagtcttgccgctgtggtagacggaggctccatctggacgtcgaccaacgcgggcgtcacctggacggagcaaacagacgctggctcacgtgactgggtatcaatcgcgtcctcgtcggatggcacggtacgtgtgtggatgcaggccatgacgcgaagagcaccatgccactgtcctcgatggtggtcccataatgtgtgaatctctcgtccaggatcgccatacgatgctcgatctgacgcatcctggtcgattcgatcttttccgatgcacagagacttgccgccgtggttagtgatggctccatctggacgtcgaccaacgcgggcgtcacctggacggagcgaaacgacgctggctcacgtgactgggcatcgatcgcatcctcgtcggatggcacggtacgtgtttggatgcaggccatgacgcaaggtgcacgatgcccctatcctctatggtgatcccatcgtgtgtccatctctcctactgtcgtcatgcgatgctcgatctgacgcatcctcctcgactacatatcccatcatgcacagagccttgccgccgtggtgagggatggctttatctggacgtcaaccaatgcgggcgccacctggacggagcaaaccgccgctggt

SEQ ID NO: 3049 - DNA, 703 bp, Nannochloropsis_gaditana; identical to SEQ ID NO: 1819

SEQ ID NO: 3050 - DNA, 703 bp, Nannochloropsis_gaditana; identical to SEQ ID NO: 1820

SEQ ID NO: 3051 - DNA, 703 bp, Nannochloropsis_gaditana
ggtgtgtatgattaagtcaggccggtgcgaggccaaagctgccaaaagtcctatccgatcctcatggtccatggggacgaactccacgtcgtcgaacgtgtccgcaccgtttttcttcgactctaagctcatccatcgctctttggctttcttaaacttggctgcatttcgaccaccgacgctgataaggttcttcgtgcctccgggaagcctacgaagggcccgaaccgtcgaccccccaactctacctgttgccccgatgaccaagacacgctttggcgcatgatccaaacccgcaagagggggggacgccatcatagtaaatgcatttgcgaccattgtaaaggccatgaaggaggtaatcggcaacgagcgcatctgaatttctattgtctttcctcggtagagggaggggaggtttacctgaacgaaatgaaggcggtggctggaagtagtagtgcttgaagcttaaggaaagggcgtgctgctgcaccaccacaaaacaagttctgtaaagtgaccctgtgcgtgcgtgtgttttgaatgctggcttattttccgaccgcaggtggttaggaccgagatcatgcggatcgatgctcaccgtcaacgttacggtgacgaacaacaacatcggacaaaatgcttccctcctttttcacaaacacatcacaaaaattaatcctactgcacaaacagtgag

SEQ ID NO: 3052 - DNA, 703 bp, Nannochloropsis_gaditana
attacatcattgtctgccatccaacgcacacatgtcccttcgtcaccattttcagatactgtgctcatacagcaaagggcttaaactttgattcgagaatgtccttgagctccgatgaaccgatttggcgttctcatcccccgaaagcttatactgagtgtatggacgaagctcaatgtcggatggcacttggcagctatgcaaccgggcagtcccgaaaaatgactggaatccacgtatcacgtcatttctgtacataatctgcactttaaaaacggtttgcattgttcaattatgaaatgatccatcataattagaaaggaaggccgccctagtccttctcgcgccttctggcttgaagcaagcaaggcactgactagaagttgctctttttatttgagctgaattgtggtcaccgtccctgtgcggcagattgtgacgggttgggctatcgcattttcatccggtacatacgtgcatatgtgcaattggcatgttatttttattttggcatgactagcattggctgtgttgtaccgacggcgggacctccccgctgcggcacagatagtaccgtcatgcttgctttatgcgctaccagctgaaaaatatgcatttcgttccttgttatttctcgctactattctacttcaggagcggtgaagtggtgaggcatcccttcccacgaagcactagtggtatg

SEQ ID NO: 3053 - DNA, 703 bp, Nannochloropsis_gaditana
atgcgtacccctctgaagctaataagccacatgacacatcaaacgacaaccgcaacctcgtaacaacatggaagaaagtacagcccacccgcccctgattttttcgcaatgatgtgcaaaatacaccacttgtatttacccaacatgcgtgggctcatggtggggggaagccggcagtcttgttcaagtttttcacaagggggggaatgcgcggtgtcgaaagaagcttgctacgccttctccgcccgaaggtcaagcctggtttttttccagtttttggatcccgttgcgagcggacacatgcaaaggccttgaatccttctcatacactccctatgtacatggtgatgtgccatgtgccggtcggtgtgcgaccatttgtcatgggggaaacgcctgtctttcttacacgtggcagtccgcaagggagaagaaatcccaaaagcccggatatcgccaggggaaaaacacaacgtgaggtctgggacgccgacggccacaacgaaacaatggcgataagcctccaacatatgcttgttgtacttttgacgatgaatgtaaatagggtttgagtggcccctcatccaccgtcttatgtgacaatcttctattcaatagtaatccacctcccgcccatatggctttcctaaattaaaaaaaaagtgtctcaatctgatcagccatctccggcctcttcacaaac

SEQ ID NO: 3054 - DNA, 703 bp, Nannochloropsis_gaditana
caaggacgagttcggctctgcatttcagcacgcacctccggcgctggtgaattttcgcatctctccctttatatatttcccaccgacggggagcctgaaaggggccatgggctactctttggcttggcccatcgcgaacattgcggagggcgaggaatgcacacacgactacgcgtttggctgcgccgatgtgcgcgacaattccatcacccaggaagaaaaattcttaaggtggatgaaacgggcatgcaggctagctgtgtggttcgagttgcctttgtccgttcgcgccattttcgaggccgctcacgcagagagaaagcagcttttcctctccttggctgtgtcggtcaatgctgcctcgaagcccgttgcggatccatccaccgcacttgccgcgcacttcagccgctcttggcggcattcgccactggtcttgagggtgtacaacgataacggccaggttctccggcatttgagccgcgcagacgtccagcgggcggcagagcccgccgaggccgacgtactctgggtttaccacacggccattactccccactaccgacgcaggcatgggctgggattggacgtggtggtgagccagacggggggcgacgagtgtctggtcttcaaacatctgctacccctgacggccactcgggctcccggcagccaggcctggctccctgatacgtacaatatg

SEQ ID NO: 3055 - DNA, 703 bp, Nannochloropsis_gaditana
  misc_feature (1)..(350): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttatctgacctcacggccgcaccattccctgtgccgccaacggcttgaagtttctaccgttacgctgtcccgggtcgtcttttaagagggtttccgttgcctcatatgggtgcttggcccgcgcagcctctctttgggtcctttgctgattgataccatcttgtaaatagcgcagacgtgatcgcattggtaggtcatattttccgcacttctcctgcgatggcataagcttggagacccatatgaaaggtacggacttcgagccttccacttctacccgtgtatttcaaaaataaaattatgataacctttcaaacgatatgatgaataatacagatagaggagcatatg

SEQ ID NO: 3056 - DNA, 703 bp, Nannochloropsis_gaditana
aaggacagggacagggtggaggtagccgacctttacatacgcttatcgcgggtgccacaaggattgaagatatgcgatgcatgtacgcgagaaactttcatcattatttcacagagaatcgaaaagtgattgaataaaaaatacttgttcggccaaggatctgaggatcctgctccctggttcagcatttctgcaacactgtgaaccaaactagaacgtaccctctgaattggtcttgcccactttgccgctggttccaatcacagacgtcgccacaatattgagaacgtaggcaccaagattagcccacggaaggaggcggctcccaagtggggaggtgtcgggctccgaggagaccatgtgggagtgcttgtgatgaagggggagtatcttgacttcctgaggatggagggtaaaagggcgaaacgccacgaaagagtcaaaggtacaccacggcagttcagataagcaagataacgttttccaatgcagtggcaggagtcgaaatttgtgttccaaaatgggtctccgtgcgaaagacacgctcgtctcgccccataagggggaacctcgcgaatttcaagccgtcaggcgagggcgtcgaccttggagcatgggacctcgaaacaaacaagccagccctcgcccgaacaagtcatgccagagattgggaagattacagcattcatacagaggtgagatg

SEQ ID NO: 3057 - DNA, 703 bp, Nannochloropsis_gaditana
tgtggcgcctgggaggacatgataatcctaaaaaaattaagcggcaggagctacgccgttggcgagtaccaagagatctgtcttctaaagagcgcttggaacttgttcgagcgcgacagaagtgtgtaaaaattacgtgatccgtatttatttgtattaatcgacttcgggaggggatcgtggcaaacaatgtgtatgcgtggtgccccttttgtctttgcacatggtcagtaagctcaacctccccgtttccagctttgaccccgggagataattccccacgttacctcatagtcagtgtggacagagttggtctatgccgtccacgtcaagcacatcaaatcttgacgacaaacagacagatacacccggtcctcccaggaagaagacaaccctccatcatgcgcttttcatccgggggccttccccaccccctccgccccagccctcgcctgcgcctacaacacttacgtcccaaacaccttctccatcaaagaatcagtccaaacacagcacgtccaatatcagtgcacctaatagctttcttcacgatcgaggggctcatccaccgcgcgccgtcgcagacgcaccgctaaccgttgccttaccgggaggcgccgagggctttcgtgctcctctcttatcccgcaactggatacacaaaacaggcgggaaggtgaaaacggaggaagggctattcatg

SEQ ID NO: 3058 - DNA, 703 bp, Nannochloropsis_gaditana; identical to SEQ ID NO: 1786

SEQ ID NO: 3059 - DNA, 703 bp, Nannochloropsis_gaditana; identical to SEQ ID NO: 1429

SEQ ID NO: 3060 - DNA, 703 bp, Nannochloropsis_gaditana
gtttctgtgctatgtggcataaaatttctttcaaaaggttaaagtagctttgagctaaatagcatagcatatcgcgatcagggtcaacgtaacacggagacgacaaagtgcgcgtgctcttttgaggatgatcttggggcaaggtatgcaaggattgaagaaatgcgcatgcgtaatttattagattttcaagtttactattatcatatgctttcgtcgtttgctttatttttgcgttttttctcatgctcgctttttgctctgaagagatccaggcacggcaagtaactgtcatgactgtaacatgacaagaaataaacgatataaactgacaagatacacttcatgattcttttcttaccataaagctgtaactttatccgcaattcccgccgtacagagaagcggcgccgatgttcctctcccccccccggcttcggacgcgtcgcgaacttcaaggtaagccccagacgatgccatcccgacgggctgatttacccctgactgtcgcaccttaatctgtactgatgggcttcgcggggtaatgtacgcgcggttgctttccttttttccacttctactcggtactcgaagaagaataaaaattgtttattccccgtaacgctctgtgcgtcttccaacatcccgccccattcagaacaccggcaggagcaggccttgagggtgaattacaactcatatg

SEQ ID NO: 3061 - DNA, 703 bp, Nannochloropsis_gaditana
gatgtccctgacacggaaagagagcatccatcccccgccgcattgggggctttgaggaaagttcaagccaagatagaggggcgttcagtgggcagcaacgccgatgatcctcgaaaagcgttagaaattaggcagcaagtggacaaatggatacgggaggccaccgatcctgatcgcttatgcgtgctctttgaagggtggatgccttttgtctgaggatgtcgtgtaactatcaggataaaagaagtatagaccagaaagatgcgtcatgaaaggtttcagttgaccccaaaaatgacatgttgtcccctttttaacaatgtgcactcgagttttggggcgtcttagaaccaagaaatagattatttgcccccgcgaatgcaatcgacctccccccccccttaaacaacttgtattcaaggccgttggcgaaaacaagaacaacgattgccgcctatcctgcggccctccgtgttttggagtgaaatgctgggctgcacacaacgccatcgagcggtgtcgtcgttctaccttgacttagcctcgtcgcccccattttgtcttcacattttagatttattgtgttcgcagtctcgccgaaggcgcacaacaacctcaaaagtctctttgaaacctgctgagctcgccggcctcgctctttctgagcacttctaaagaccaaaaggcccatcagaaccccatg

SEQ ID NO: 3062 - DNA, 703 bp, Nannochloropsis_gaditana; identical to SEQ ID NO: 222

SEQ ID NO: 3063 - DNA, 703 bp, Nannochloropsis_gaditana; identical to SEQ ID NO: 219

SEQ ID NO: 3064 - DNA, 703 bp, Nannochloropsis_gaditana
ggcgtttgagctccgcctgacagaaagagggagggaacgatcgaggtaagcatggcgagtccaggagcaggaaggcacctgagagggacaggtcacagatactagggagctgaaatcatacaaaaattaaaacatcgttcataaggcgctttgttgtttatgtcatgttatacactaggcggcaaaattctatctcagaattgaagtattgcaggaggacaaggtacttaaagagacgcattgcgtccacgaaaaaaggagcaaggagattttcaaccgcaaaaatacatccacttaccttcatcgatgcaggaaacgtgcaaattagcgcggctgaggtgtttgtatcactttttgttgtagttgccatgctcaaggcctcgtcttcggcaggcttgctcgtgggccccgctgacgctgggatgtcctcctcgttcaactcacttgccatggcttcacaggcacccaatgtatctactgtgctcgatctggttgtccatacgaatgtaaaatacaggtgaggcgaagatgctttttccccaaaagtaggggtgaccgcgctaaggtgatttgtgggggaaacctcgacgttggtagagggcgatggcgactgaggaggtcagactgcccgaggccttgacgtcttctttgtgcgcaaaattcaatgcatcttggtgaaaactaaacgacacactatgaaaca

SEQ ID NO: 3065 - DNA, 703 bp, Nannochloropsis_gaditana
gtatcacgctcatcaaaacgcgtggcagattctctcctgacaggagcagcatgatggtctgcttcaaggcctgaattttgtacttcacgtccggattctccaaatccctcatgatttcttcctgttgcactgcagatgccttttcggtatggaagagcaccgtgcatgatgtctcgatggatgagacggcgggaaggcccgatggggccatgatgcgcaggagatgctagagactcgaaagcaggaaacgcccacggacgaggcaaggcgatcagcccagtttgtaggtgtgtcccagtaccgtgaaggaaaatcctgtgatatccagaatgcccgacgtagaataaggtaggggtatgagcgaagtgagacaggcttatgcacgatgagcacccccttaccctcatcaagttaaatcatcccgaggaaaaacggccacatgtggtgcataccaaggaaatcgatttcccagacagcctcattttcaacactgtcaggtgcagagaggcatccacagtcctgggagacagcgtgggaattctcgggcgtgggatatgtgtccagacagacgacgaaactcctcgctgagttcctttggagagcgcccatagacccccccccgagaggtcttgcgtggcgatccaggcacattcacacgtccatcgtccactcacccgtgaccagggcattcacaggcaaaatg

SEQ ID NO: 3066 - DNA, 703 bp, Nannochloropsis_gaditana
aacacggtgatttgcgacggtgctcttcctattgcttttcgccatgcgttcatgtgtaaaaggatcatgatagagggtacgaaaagtagtcaaaattgtggattttgaaaagaaaatttggtatcatgactcgtccgcttgagcctgtataggtatatcacggagcctaaatttcaagagtcctctcacacattctgaatttatgtttttaaatatccgtggacagaaatatttcgacgttagaggtacttttggcatgcgcggtagcaagaagtgaaacttttaatgaaaattctacctgcgtcaatccgtcacagttcgcaatcacacaagcggccaatatgaactttttctatttttttttttcggcagggcctactttcccatggctacggacgcaggaagagtaagaccaacatctgcatcgtcttctgtcacaaacttgagtgattcgcatgcgccaataaccgaggagatggatggtacattccttcctgcgacagaagtcgtggaggcggaggagcaggatgttgttggcgcttggggtcgccctatatctcgttttggttttcatcgggtaagccgtgtgatatgcgtggctgcatttttcaaaatttgcgtatcataaatacttttccatacgcatccaaatacgtagcacggggtctatcgacgcaagccacgcctgttcccaagtagcatg

SEQ ID NO: 3067 - DNA, 703 bp, Nannochloropsis_gaditana; identical to SEQ ID NO: 1378

SEQ ID NO: 3068 - DNA, 703 bp, Nannochloropsis_gaditana
tcttgaaagcgcccgtcttccttggtcttgaggaaaaaccggtaggaatgcagccccgcgcgcggtggagcggtatccttgtcgcggacatcgtccaagaacgcttgaaagcgactgaaggattcctgattgacgtctttctgttttgggtaatgtgtgaagaggtctggatgcaccctcaagaaaaatttgcggagtgtttgctgcaggagaggatgcgctccgccgtctccatcggcctgatgccgccaccggggggccaaccctgcacgctttcgcccgccgcgctgccgagcagtggaaatggcctgagaggtcattattgacggctgacatgatactcccacccaagagaaggggaggggcaggcaggggcgggctcggaggcggctagaggaggaaagagaggcgcgaagttgcggcagcgcgtgcatggcccgggcagtcattttgaacgcctcagaacctggggggtggaatgatggagttgagtgaataccgaggtgtgagagtggtgtcaagatgtcagtgtttctgatgccaggccgcaaggtggtgcacgcgcgagtatcttcctgtccgggagctcgcctccgtcatacaggtctcgcgcccattgcacatcactaattcaccatcactcaccggccctttctcctatcatctacaagttcacagtgaaccgactcacagggagacaatg

SEQ ID NO: 3069 - DNA, 703 bp, Nannochloropsis_gaditana
aggcgcggtcgagccttgccagggcaaactggtaggacattcacatttgtctaattttacctgtcatcgtcatattcgcttgtcctcttcacctctctacacagccagatgccgtaccttcgtgccggattacgtccagtagctcgcgagaccgcaagagagacgaccgggcttcagtgagacacatgtcgccgtcctgcagcaaggtgagcaggtcctccatgcccaaaaaggaagccagctcctctgctttctctgttttgtaaaaatttgtctcgctgtggcttcgactgcatcagactttgataaggtccaggagtaaaaaagcatgggagaggagtagagggccccggaggcctcttgaagacatgggagctgataaacgagacgaaaaaaatatcagctgcgtgcgccgagcagtaattgccccgacagaataggcttctgcagaaaaattagttgtcgtcatcgtcagtaattcttttttgcggttgttacgtcttgtggagggagcggacgaggccttgtctctgggcacttgagctgtcgccctcgtctcccctccccggtggcacgccgtcggacacggagaacctgtgtcatattctacacgcctcggacatgaaattatccagcgatttgagccgctttgaaacatatattttcttcattgttcaggtcgctgtatttaattttgcccatg

SEQ ID NO: 3070 - DNA, 703 bp, Nannochloropsis_gaditana
ggtccaaacgttccagacctttctacgagaaggttctgagtgcgtcggcggcgtagcgaatttatttgtgggaaatatctcgtatgacagcttccgttttcgcgtgcaaacataaaatgtgcatggatggattgccaacttgtttgccatattaaccgccacaccacgtgcacggacggaagatttttggtcatcactcagtcatgtctttgagaagaacatcccgattctatggctctgacgagacattttccgtgaggttcatcatcctttcctttttcaagcagtcgatttcggatagatgaactatgtgtgcggcaggtactggatagattggtcctttgtacagcagaagcgaccctacgggaaagtttgtcggggcttgctcacattgagacagcatctttgctgagtggctgggacgagatggaacatacttgcctgttgctcctgcccgcgaactttgtcagagatttcgggcgtggactagttggtgtcagagacgatatggacacggcgtgatagcgctgcgaattgtttcaggggttgtgaaagatgtgaggcacatgtgctccagcacggcggcagcgcagacggatctgtcgaagaacgtttccacgatttccaccgtgagataacctcttttcgtacttgttcactgatacattcacagcaagcaacttagaaacaaatctagagcatg

SEQ ID NO: 3071 - DNA, 703 bp, Nannochloropsis_gaditana
ggtatgactaactgtggatggcctttccctgcgaagctttcgatccgaccgagagccctctctagcatcctcacgtccggaaaccttgcccgcatgactctatgcccgtccgctccaatgagagcctgtcttatttgttggacgtgtctgtgtcttgcgtcctttgtcccttgacacccattccagccacaatgtcctttgcctttgggcagctgggccgatctgcccacggccttgcccccatttctcacatcccttcacttcttacccctgcatctaacattgtcagcgacagcaacggtggagggaggatcaacgttaggcagcgggagctgagggagcaacagaggcataagacatggcaggggcgctacccgatctcctggggcgatacgtgcccccggaggagtatactcaccggtactacacggtcagggggaaggagttccaccaggtcttccaaggcttccccgtcctggagcccttctacatggaatgggagaaaaactacaacgcggagaaggtcttctggttcatcgtggacaacgcctggatcccctggctctccatctgcatctacctcctcttcatcttcggctacccctccctggccaagcgcttcggcatcccctacatatccgcacgcacgcaaatggcatcttggaacttgtttctggcggcgttcagctggttaggcgccatg

SEQ ID NO: 3072 - DNA, 703 bp, Nannochloropsis_gaditana
gggtgcaggagccatagagaaagggtttgcgacaatcccgccaaccggggccgtagcaggcgcaacggcaccggagatggaaggggtaggagagctgaaagtcgtgctacctcctccaaagaggccggcggatgctggtttgctggggatgttggcatcgcccgtggaggtcgaaccgaacgcggtagacgtacgattgcttgtatccggggtctttaccgtgctgccaaaccctccaaatccaggcgttgcgggcgctgtccctgcattggacacattaaatccagaggcaggggtcggaacgccaggttgggagaaactaaatgcacctggtttaggtgccccagcatttgggtcgttggtccctgtccccgagctgcttccaccaaatgaaaaagacatggatgcacgatacgagattacaagcagccctgttatgatgtgcagctgatggtatgaaaatgaagacatgattatcgagaaaaacatcatgtgttctcttttttttcgcttcgtttgttttggagcagctatcgctgctctggtgcgtgtctggcggcggcgacgcgtacatacgcagcgggaggctaaaatactacgttgaacacatttgcaatgttgaccaccgtgtgcgcaacattttggccggcacaatttgaaaaactgcatacttaagccacatctcaccgcggtattgtgaaca

SEQ ID NO: 3073 - DNA, 703 bp, Nannochloropsis_gaditana
taacagatcggcatagaagaacaggcagattaagtgatgcgcacagcaatgttcaaggcagattaagtaatgcgcacagcgatgttcttcctctgagaaatgcacttttgtctatgtcagcctctctccctcccaaaccccctttttttcttcagatgaccatgccctttccatcttttcctcaatattacaagaagaaagtacgtactctagatttccgcttaagttttgggaagtatgaggtgcagcgactttattggtgctgaagggtctcttcgctgctgcttctcgatgcgttttgcacgtctcatccctctcgattaaaagcatgatatgtaagcactgagcactctacgaggagcttcaaccattgaagtatagcatctcagaatgcgtcgattgtcgggcgaaaagcgtgggagtgaggacaagatgggtagtacaatcggaacgtatttctgtcgcagaatcactgtgacaagtctccgctcccaaaaacaagaagacacatcttacgcctaacaaaccgatggtaaccagccaaccgaccatttgtcaatgagtgagggcagcttgaggaagtggactgcgtggtggtgctgctttgtgtgtgatttttaggggtgtggctgttgcgcccattggcagggacccgacctcggcagcagcctcctctcccacgaccgctatttggtttgcgatg

SEQ ID NO: 3074 - DNA, 703 bp, Nannochloropsis_gaditana
cagttgcaagcgacgggttaagtttaatggcggtgattgttaatggcctgcggccgttgtacgtagcagggaaaatttttgaggacatagaagaagaagatgtcgtgtaaatttaaacaatttggagtatgtcgcgtaggtacatgccagattgcgggaaaggaagaaagtcacctttgtatgtagttattttcgttttagttcgactctcgtgagtgggataaagacatggcatgcgcacgcctcatgcgaagcataaaaagtatatattttttccagatgaaaaagacacgtccttgtgatcaatggcacagcaatatgttttcaaagctctgtactcctgcctgtcgcggactgtagtacgtcacgcgtaacggcgtacgtgcccgttgaacctccccactggatttttccccgctccttcttttatttcccacgggctttattacacgattatacatgtttcctgccatttttctgattcacactgggtatcatatctgaatcctaggataaatacgtttccgaaattgaatcactggatatttcccgctccttcttaaatttcccacgtgctttattacacgatggtttatatttcctgccacttatctgattcacactggggatcacattaaaatcttatgataaacacatctcctaaactaggtaacagacaacaaaaattgacttggtaaccatg

SEQ ID NO: 3075 - DNA, 703 bp, Nannochloropsis_gaditana
ctatacctccaccgacgcgggggtcacctggacggagcaaacaaacgctagttccagtagttggcaggccatcgcgtcctcatcgaatggcatcgtacgtgtgtggatgcaagccattacacaatatgcaccaagcccctgtcctcgatggtggccccatcgtgtgtgcatgtatcgcgcatggtcgctctgggacgctcgacctgacgcatcctcgtcaactacccatcccgtcatccacagaaccttgccgccgtggtcaatccggactacatctatacctccaccgacgcgggcgtcacctggacggagcaaaccatcattggtttccgtgactattactcgatcacgtcctcgtcggatggcatggtacgtgtgtgaatgcggaccatcacagaggaggataaaccatgcccatggtggtcctatcgtgtgtgcatgtctcgtcgaacgtcgtcctgcgatgctcgatctaacttatcctggtcgcctacccatcctgtcatgcacagaaccttgccggtgtggtgtatgggggcccactcgggacgtcgaccgacgggggcgtcgactggacgccgcaatccgccgctggggcccgtaactggacctcgatcgcgtcgtcatccgatggcatggtacgtgtatgaatgtcggccattacaaagaagcaccgtgcttctgtctttgatggtggcatgcc

SEQ ID NO: 3076 - DNA, 703 bp, Nannochloropsis_gaditana
acgtcggccctatttttcgcttttgggcttattgacaatcttgttcgccataggtcacatgtgttcgtggtggtgggagagaggaagtaagcatggcttcccctcggctggttcctggtcccacggccgttaccacgatcacgtgagccggctccgtcccgaagacagcgaatatcgagccctggcttccctgcatccctggacagctgcttctgtaatggagacgtattgtccggtcttcaatgcctccttgctgccgcctgacattttcgaacgtcgaatttatattgcggcaaacttgaaggacaacgaggggatcatggccaatatgatcgagcagcttactctcttagcctctctttatcccgatcctggcgcacatttattcgtctcgatatatgagagcggttccacggatgcaacgtgccgatggcttggtctgctgcaggatgagctaagggagatgggcgtgccatcggaagtggttgcggggggggagaagcggagggtgggtgaggaagacaggattcagtttctggcacggatgcgcaacgaggcaatgggacctttgtatcggatgcatttaaaagagggagaaatcggggcagaaaggggtgggagtagcagtcaggcgacgaagggcgcgggatgggggagaaggctggcaggagaaggaagtccaagaagagacgcgggccgaatg

SEQ ID NO: 3077 - DNA, 703 bp, Nannochloropsis_gaditana; identical to SEQ ID NO: 1768

SEQ ID NO: 3078 - DNA, 703 bp, Nannochloropsis_gaditana
tcgaacgcttggaaacgccggacacaaacacccgccctgcggccgacgaccggaacctcagaggtcacgaaggacgcaaatgttccatgcaaaccatgaaaaacatgcacacaccttgacgtcagggtgtatgggagaaagactgggacagggcgcaagtgtgcacacgatcaatggtgaggcctagcagccatccacgtgcaagaacagaggcttaggggaggcaaagaagcctccctggcccccaacattcacttcaaaaactaccaatacgtctcgattaattttacccgccaactcgaggtctttcacaacaatggttcttttcacgtagcgcatgtggttgggttttttgtggtttcctagacggtgcttgtgcaggcgtgtattttcactcggggaggcctttttcttcggtggcttggagaagggttaggaaagcgggtccacgctcaaattcatggctcttttttgaaggtccgtgacggcgcgacggtgccagctactttcctcctcctgatgtgtgtggagcggagtcaaggcacatttttggcccgttgcgatatggaacacattgtatattgtgtactgattttgtaaccttggctttctggcgcaagctcgtccgcgcatacgcaataaactttgtgtacagcaatgaaatcggacggctcatatcactactgccccatttttttttaac

SEQ ID NO: 3079 - DNA, 703 bp, Nannochloropsis_gaditana; identical to SEQ ID NO: 128

SEQ ID NO: 3080 - DNA, 703 bp, Nannochloropsis_gaditana; identical to SEQ ID NO: 129

SEQ ID NO: 3081 - DNA, 703 bp, Nannochloropsis_gaditana
tcatctgcacctagcaccggaatcgtcgatgcctacactcactatgcgccactagctttggctaaatacctgcaagaagactgcaacgacgggatgcctttggtatttgccaagttattcgaacgtacggaagatgagggaggaaggacattataggattactccccgtagcattgtggtataaaattgtgatacaggaatcatgaagggcgaggagcattcgactagggagagactataaatacatatgagttggtcatctctttgtattccgtttatcggctccgccctctctgccctcgaagtcatttaagtaacaactcctttgccaactgtaaccctactatcagggattcccctgctgacggatgtatcggccaggcttgctttcatggacactcataagatagacgtccacgttcttgttcctcttccttggctggaagtcgtacctgcctgtcacacaaataaggagaggtatgtcttgaaggaatcggggaaatggtaagcacaagggcatgtcagagcctgtaggtctcttgtagcagaattaaatggcaaaaatgtaagatatgtatcttactatgaagctcacggaacatggcatcaaacaagaaataatcgaggtcggccgcatatgagctcatccaccaatgcctaccacagagctctagaggcatgcaaacgtgcgaacaatgagatg

SEQ ID NO: 3082 - DNA, 703 bp, Nannochloropsis_gaditana
gtcacttcgttttctttaaaggattggcaggtcgtctcctgcttgccttcccagctacgctcgctcatttccctacattccatcacattttcgaggcccgatagtcaacattcggggaaaacttgagttatcagtagcctaggctcaatcgtaacaaggctacatgattcaactgaaaccgcagcgattacagggtagaagtctccagtcaccatgcttatttctttcctctttctttaacgacatcatcagcctgtcgaaatgtgtttcattattttacccacaagcttggaaggatgtcctcaatccactttctatttggttatgagcgcatgtagtagaagtgaaaatttgtacaatgggattactccggaaaagatgcatgcagacaagcgacattctacctaaaataccatgtatactcattcaagcgaagttaccctccccgctgcgcagcttaaaagatcttcttgaactcttgcaatgcatgatcaatgccctgtacaattctttcacatctttctttaatttcacgtccgttcactcgttcaaacgccgtcctcatacccttctccccatccactacgtccttcacaatatgatcaggaaaagattgagcaaatagcctgaaaggaaaagacccctcctcgtgtttatcaaccagttgggcctcccgcagcggcaacttgcctccttcaccatg

SEQ ID NO: 3083 - DNA, 703 bp, Nannochloropsis_gaditana
agccaagaaaaaaaaggaggaggaggccgccgccgctgcagcggcggcggccaagattgatgtggacggaggctcgtcgtcatcagttgcggtggaagcaggagaaagggagaaggctcacgacggaggagcaccagctacggaaaatggaacggtgagcataatgggtatcggcggcaagagcgtgaaagctgctcagagtaagggcaggcggcggcagcctgctgagcttcgtattcaaaaggatctggcagaagtggagctgggtacggcggcaactctgatcttcccgaatccgaacgacttgacggacttcatcgtcgaggtttcaccggagtctggcttttggaccggcgccaagtttacgttcaccttccgctttccagccgagtacccgcatacgccgcccaaggtgacctgccagactcggatcctgcacccgaacatcgactgggagggcaacgtgtgtttgaacattctgcgagaagagtggaagccgattctggacgtgaacgcgattatctatggcctcctccatctctttgctgagcccaacccggacgaccccctcaataaggaggcagctgagctcttccgggcggacgcgcggcaatttgaacgtgtcgtcaagcagaccttgcgtggattgagttatcaagggcacacatttgaaagactcctctaggcaagacgatggtgtgat

SEQ ID NO: 3084 - DNA, 703 bp, Nannochloropsis_gaditana; identical to SEQ ID NO: 1406

SEQ ID NO: 3085 - DNA, 703 bp, Nannochloropsis_gaditana
aaaagagattctgtgattctaagaccgcctggtgcccaatcacaggacataacgaagtctaccggtgaggtaaggtttgtgcacggccctccgggagttcgattgtaggaggttaaacgactcgtgagactgcagagggctgttgtgacaccaaaagactcgttaagctgccgtaaggcacagatgaagacatacctttcaaagacattcgaaacgagaaaactcagcgggcacattggcgtttgtgctcactgccacagcgatcggaagaaaggcgagggttaagcgagggaaacagctgcggatgaagcaatggttagggtagatttaggtcttccaggcgctttgctcaaaccagtgactgtgggcaactacccacatagtatccagtactggcttttcttccgttgcttgcgcgatccttcgcatggtgtctcatggcgagggttttctgtaaagacaagtaagccggctgccggcgtgatcgaagatactaccactcggcgtcctgctccagcttcagacgcctgcacatactttggcaaagccgcaaaacatggactgatcaatgtagaaccgcatacttagcgtctcctcttgggattgctgccgacttggcatgatgtcccactttgtgtcgcatcgtgagattcaccctgacgttctctcccatccccatgacggcatagcaactgtaggaatg

SEQ ID NO: 3086 - DNA, 703 bp, Nannochloropsis_gaditana
ggaaacggcgggccatagacgacaacgtccgatgacggccgtggtaaatggccgcacgcgcactctccacgcttttttttctttacaagaaaggaaaaaattgaaagggttgaagaggaaagtggaagctgcactctgtatgcacactgtctgagaggatttgacgctaccgtgctgtctcccggtatcagtcttcgcgcttcagctccccgtcttgcagagacagaaaaaaatatcaagtcccggaaaaaacaaatgcaccttcgcatgacttgcgtggcttgtctgcttataaacgtcttttgtctctctccggacgagtctcatcataggccgtcacgagttctgtcggtagaaatattgaaccagagttgtcggacataacgacccgaaaattcgctctcgcgtggagggtgaaccgtcgacgcatgacatgcgcgaacatgcgtgaatggacacccgcgtcatgacatgaaatagacgccaaaatgcccatgccgaaaaaagccactgaattcgcttagacacgggcatgtcgtgtttattcctggggattgtggcatattcgtgccaggtctcgctagccgatcatctcactgctcaaatctgccggcgccgataactacggagagccctcagtgaagatttcaaaaattcaccaccgtcttaccaccgctcccgcatcaatacagctcctttcatg

SEQ ID NO: 3087 - DNA, 703 bp, Nannochloropsis_gaditana
aggactgtctacctcgtcgattgacgagtagaatggcacacttgacaacattgagtggcaggggaaagattaatgatggctaatttttttctaccacaacagaaagtacgtacccgactctgtattttcttccatcaccataagatcttgggcctccaactcttggagtaacgaatgcagcttgagtccatcctgcccaaggcagcatcaggagaggtaggaggaggaggtgatactgcaacatgatgttggctccagataccgtcaaaagcgatccaagagaagaaaagaagcaaagatccctggtaagacgatggaacacccacaaaacgaggccaggactgagtcatactatcattcacgagcggaagcgccacgtataacacgttcccagccagtacgtggtctaatacctcttatttttacggggccagggggcgtggggttggggcgtcatctaacggctgagcgagccgccgtttccgttgcttctgcggccgccggagctagctagaaggcctaatttaggccagagcaagccgggcaccatcattgtcgcacgcttccgttcaagcatattatcagaactatggaaattatttgttagttgcattatcttctattttgagcatttgattcattgattatctatacagcgtcgcacggtcgtggctcgcccacccgtcctacacgaaaggccatg

SEQ ID NO: 3088 - DNA, 703 bp, Nannochloropsis_gaditana
gagatgctctcattttctgatagcttaatttgtattcaatgtacatagttttgtacaaaactcagtaggactttatgtattcaaagatacaaattcgaggcaaagagacctgatcttgagcgaaaataatttccttgcttaaatttctgtgttcttcacagaacatacatagaatcctttcactgtatggctttttacactcacttttcctcaaaatgcagctggagtgaaaatattatcatttgcaagcaattcttgttcagatatggagtcccattagctccaaaagtcattaaagcgtctttaaagcaagcaaggcggcaccataggacgcttctgtctcgctcgcctttcctgttggtactcccaacaattgcctccttattcgtgtccacaccttgtttctggctccccctcctgctgtccttacttccacaagctcgtctgcccccaggtctttcaaaatctgatatccgtctctctctacccgcgcaattccctccaatatcccctgtaaatattcgctgcgcctgggaggacgaggcgtcagtagcgcttttttgcttgggtcgcacgagggaaaccgctcccccgcatcgcccgccaaggggtagtaattgaggtgccggcaaggtctccgtggatcgatctcctggcttagtctctcaagctcgggattggaaaatccttcttgtctgagtac

SEQ ID NO: 3089 - DNA, 703 bp, Nannochloropsis_gaditana
ttccttgcttaaatttctgtgttcttcacagaacatacatagaatcctttcactgtatggctttttacactcacttttcctcaaaatgcagctggagtgaaaatattatcatttgcaagcaattcttgttcagatatggagtcccattagctccaaaagtcattaaagcgtctttaaagcaagcaaggcggcaccataggacgcttctgtctcgctcgcctttcctgttggtactcccaacaattgcctccttattcgtgtccacaccttgtttctggctccccctcctgctgtccttacttccacaagctcgtctgcccccaggtctttcaaaatctgatatccgtctctctctacccgcgcaattccctccaatatcccctgtaaatattcgctgcgcctgggaggacgaggcgtcagtagcgcttttttgcttgggtcgcacgagggaaaccgctcccccgcatcgcccgccaaggggtagtaattgaggtgccggcaaggtctccgtggatcgatctcctggcttagtctctcaagctcgggattggaaaatccttcttgtctgagtacggcgcaacctacattgctcgcaccccccaccaaccactgattcccgagtcgatggctgtagacgccccgagttgcatcctcgactgccttgttgctgagcattttgatggccaaagtggaaccgaggctc

SEQ ID NO: 3090 - DNA, 703 bp, Nannochloropsis_gaditana
tggtgccgctgattgctacgcgggccatccgggatcgtattgcagggggtatgtcatctagaagtctaaacatcgccaggcgccattcctcggcatcttgcacagtttgagaatggggccatcggaaggaggcctgatgaacgcaagtaggagtctcagaggcctcgaggacgactaatcgaacgccgctcgtaccgaagtcaaaacctgcaccgcagcggggtttgctccctgaagatggaaatgcccagagcaaagaagaaaacgagcccatgatgatcaaaaaccagcaccacgacaggaaagacatcgcgccctgtgggcacatgggaagaaaatggatgaacgcattggtgaggatgtgcaagtttcaccaggcagtgaagtagtgaatattcttgtacaatagacacgactgtcgaaacgtccgaattgagaggcctttcagagcgcattgtttttcttttcctatgtaaagggatgcagggaagccgggtaaggcggggtccgcccctgtcgaaacccgtcgacctcctgcttgcttgctgtccttcctttctgtccttgcaccgcatgaatgtcggagtgaacccgcgaggcaccggtagatgtcatatagttgctgggacggggtagccgactcgatgtaatgctcactttcacatgtctcatactctttctcttcgccctcagcccgaccatg

SEQ ID NO: 3091 - DNA, 703 bp, Nannochloropsis_gaditana
ttcagacgcaattttttctggacgagcatgcttgctccaataggatcgacgccagtagaggcctttcttgcacaattataccaccgacactttgccaccttttctagatacatcctttatcttagctttcagctcactaaacttaatatattttgtgaaaagttgacaaggacatcaccatacttgagagaatgacaagtacggggacctcctgaggtggtaaatttgaacatccgttgcttgggcatgtcagccgttaagaacggttgtggacgattcaactcctccgcgccgcgcccccgtctacgccacaccttacagcggtggctctttcttgcacacgttctcgcgttttcaaacattgtctcatctttaccactgaaagtgatacgatctcacctctgtggactgttttgattaccgtgtcatatggtttttgcaaaacataaataatcctgcggcactggaattgcatgagctactttttccaggttagcaccagattaaaaaacatcctacatgtctacttcaggtggacttttgttagccagattggattatccaaatcacagcagcccaaattagtccacattacgaggaattactggctctatatatatatgcttgctcccaccttccttctggcaccactccaaaaatatagtagcaggacacataaaggtcattttaatcaaatacaatg

SEQ ID NO: 3092 - DNA, 703 bp, Nannochloropsis_gaditana
ctcgcgcctagcccgtaatatgagggccaaggtgtcctcgtgaagtgtatggggtttatcttgatgtgcgtgcatcactttgttcatgtctcgacgcggcgtctggagtcgggcagtctttatagccggacctaactcattcatcattcttatgagagtgtcgtcagcttccagctgattacctgctcgctcagatgggatggacgacggtggggcagaaggggggggaagggggagggactggttgtttgggcttctgccttcgatcgttactcccgaaggagcttcttgtgtccgggacgcttgggcgactgcctgccgcctagcttgaacggccgcggcagacatgacctctcctgcaggcttactccctcgcgctcccatcgtcgacgctatacgctgctgtggatggcgagggagataatgtccgtgacggtgacgtgttggggaggttgcctgagattcaggaagcgactcctgtaatttacgtgaggtgaaagaatagggatgcgtctatcaagaaagctacaaagaagaaaaaggaatgttttaaaagggcttgcaatctagcttgtgggtgcttcacaaagcggggggtttcctccatgatgcccacgtagcatcgccaaggcaaacctcaagtcgctcctttactgcgattgcttcctgacaaagtttgatttgcatccaatacatcttcaca

SEQ ID NO: 3093 - DNA, 703 bp, Nannochloropsis_gaditana
tgctccagagttttagaagcgatgttttaattatataacattttgtttttagtaagtctttcacaaatgcatcgcggagcggaaaaaggacattgacgagaacacgttagcacgcacaccccgcctcgcctgtccgtcgtcatcactccccacacctaccgctttccctaagaatacatcacatcacaatgtcaggccttgactagagcaacatgcgacgggcaaaacacttccatttttgcatgctgtccgtatttgctgcacacgacaatgtattcagtcctgccccaaggtacctcacctggcaagtccttctcttttttgtactctttgcatggtgacaggtacaagttagacgtacaaatgtttcatatttagaagactagaacctacaacaaaggaagcgagcagcttggaggcagcttccacccgtacttttgtcgtgtacatactccgattttgtctcaggaggtgcgtcattcctcttcccctcttcggttccaccatgatttcagccctcaaagtcttaatctattccagtggtgacgtcaaattttagtcaccggaagaatgtcatgtgttacccatcttgcccacgtttacttctggggatccaccacaagggatgacggctccgtcagtctcagcctatgtctctctcctctcccccattgtctctactcatctttccgtcttccagatg

SEQ ID NO: 3094 - DNA, 703 bp, Nannochloropsis_gaditana; identical to SEQ ID NO: 1058

SEQ ID NO: 3095 - DNA, 703 bp, Nannochloropsis_gaditana; identical to SEQ ID NO: 1884

SEQ ID NO: 3096 - DNA, 703 bp, Nannochloropsis_gaditana; identical to SEQ ID NO: 1885

SEQ ID NO: 3097 - DNA, 703 bp, Nannochloropsis_gaditana
caagacggtcgacgaggatacagggcgggaggaagaatcgaaaaacggcgccacaactactttgcagagctcccccggagacttgatgagacacgtggcacctgacgtctgataagtccctgtaaagaagggcttaaagatgagaaatatgataggagtcaagggcgtgcaacgtgcgacgcaagaaggaaagccaagctggcttgtggaggtgtcagaagccagtgggtgggcgcgggaggatagtcgcatcttacaaaaccagacgccggcccctagcaccctgacgcacaccacatgaccacacaaggtcctactaaatacatcgtgtcccgatgtggagccaggggccctggaccacagggacctgtgcgaggctcacgcggcccctgacgccgcgctcgaccaagggaggatgagcgagcacgccgccgagcacttcacgcataaaaaacccaaacatgcgaaaacctccaagtcgaagttcttcagcgacgtcgatgaagttcggcactggaaactttgggcgacgtgagggtcaggctcccacttgttcacccactcccgtgtgcttgtgtccactgagcctctctttggtcttttctcgtcacagtgatcagacttcggctgctttccgaattaattcctctccttcggcggccgtactgctgaacgcgctccctcccgacgaggcccgtgcatg

SEQ ID NO: 3098 - DNA, 703 bp, Nannochloropsis_gaditana
cgggaccgctgtcagaagcagtacattggggcgccaatgctaaggtatgaaataaagctgccttaatgtcgcctatgtgcagggatgacgttctgggtatcactatgtcgcaggtatacgggctgcatggtgatgggaggcttactgtaatatgccaagctcgcatcgataggaaggaagacaaaaattgattgaagccatcctccatgctggacctgtaaaaccaacaacaacgaaatgttatacataatcgtcgattttcaagctaggggatgttttttaccgagaccacagtcaggaatgcttcagggaagtaaacggccgctaacggctacggtgccgtttatcaaacccgcaaacgctccctcttttgtctatattcatatcgtactccgataaacgcatgtggtaattttgccaatgtgtatatacacttacagggatgtggtctatggaaaacaaacctaaattgggagtccaggcgagatatgcaatgtcattgcgaactttaacacaaaacattcgcctccaagacattcctatgcgtatagtcactcgtaatcgccgccttaagtcgacttttttgtcgctttctcatactaccaatccgcaagatcaatcctccacgctaacaaatatgcaggagcctagacgcaagcctccttgctatcaaaaagacccccacatatcaggtggggagatg

SEQ ID NO: 3099 - DNA, 703 bp, Nannochloropsis_gaditana
acatcgtccacaatgcggtaagggcaaggctcccggccctccattgcgcgactgctactgctctcctgatctagcgcggtcgcccaccgcccggacggctggcaaagcacctaggaatgctgatgagctaccgataaccttgtacaagatgtatttggaacgtgtcacaaatgtatgagcggtcttgacaagttcaaagaagtgcattaaataaggccctgcagcaagcccctcaaaagaaagtactggtagtatcctgatacggcgccaagagaatgtgccgcgaaaaagctgtgtccagaaggcagactcggcacaatgcttcatctacaaccatacacacgtatattcacttgcctgatagagacgccaggcctctctccacgacaaaagtgcaccatgcgtcaggggaaaaggggcggtcgcggaggagcctcgtttgagaagcccctctcagcgatggtaccacattcctccccttgtgcctccagcccacctgtcggcaagcgttgctgccctctagcccaaagagggagtctgtgagccattaaagcaccagttgcgtacatcatggcaggctttttctggcgaggcacaactcaccttggtgcacctcatgagccatttagagcacatatcagcagggaattgtaggctactcagatttttactatggctaaatggctttgatactgcacagatg

SEQ ID NO: 3100 - DNA, 703 bp, Nannochloropsis_gaditana
gcacgtgacggagaccttagcggaatgccacgcatgccagtccctcctatcgctgtgaatcaagatagaaacgagtcgggcgtgccccaccacacatgtggtgcgaaagtactggccggtgccggcatcgtgcagtgcaaattatcacgcgactgcaccacatcgagattctcgtgccggcgttgaactgccccgctgccggtgataaggagccgcgcgggcgcgtcagtctcgcccccttctccctctccgcgtcgccgctctcgcctccctcacgcccttgactcgctttgagcaggccttcggtcacccacccctcggcgtagcaggcggtcggggggtggaaaccttcgctttcgcgtactttgtcgttcggatggaaaccatctccaactacattgttgcgtcttttcgattgctccactcagctagcctctcatccgcacaaaaagggacagaagtatcaccagtggcccgtccgtcatctacgatgcatactcgcccctgcgcagcaaggaaaaggcctcgatccttctctctcccatttcgtcagcttttgctcgttgccgtggccgcaactacagggatagttagaacagcgcaggcatttattctgcccagcagtagcgtcaatcaggcactgcgtagtgcgcaagtaattcgcatgggcaaggggggggccgggggggatggcaaaaagagg

SEQ ID NO: 3101 - DNA, 703 bp, Nannochloropsis_gaditana
gcaactttttgacgacaccttgctccatgcttccatggagcagattatgcgagaaataaaaagagataagaatctaagtcagggactgcactacatcagaggttccagtgaaatgtacaagggcaaaagtcgcgtcgtacgcttcgcaagatcgaacgggcatcgacatgctgagttcaacttgctagtgtcgtagcaggttaagcccgccaaacaaacgcaaccatgacccttacaagtccaaggttgcagaaactacaactttaattataacgcccaaattccattcaaaggtttttcagacgtcgtcacacagagtgctcttaatacctttttgaaaagggaaatgacgtctgtcgtggaattttcaatttttgaaaatttgaatgatcggccggtacctcctccctctcccttctctgcctgtcactccctcccaattcatcgctctttctgcatacttcggtcagctatgcacaaaacatatttcttgctattttaagattcgtctgtctattggcattctgtgttcgtcttgcaaccttttttccgagcagacatgttatccgctggcgggaccatcagtgcaaaccttacaacccggcatccccgacaatcaacatcattcggctgtactgctggtacaaggtatttggaatacctgaactttactggacggggactttcattacataaaaatatg

SEQ ID NO: 3102 - DNA, 703 bp, Nannochloropsis_gaditana
agcagtggaagtcaaggagtgaggcgcagcttttgcaatgcagaaagacgtgttgtggtatgacgcttggaaaaatgtgactggatctagcttcctggcgcagtgagccattattttctcattgcgcgcatatacctgccgtatttgagggctcagctcatcatctaccccggcactgtactgagttccgcggaggacgaacgcagaaacgcggccaattctagcgagtcgggcgatgcgcgctttctgaagccttctaaaccaacgagacctctaggcatcccgtgtccatgaccacttccacgcccagaagaccaaatggtcacagttgcgtcatacataagccatcctacttctcatgaagcaccgcggaaattccatagacttgagccttccagggagcgcgccatagcaaacagcacggttcaaagctaacctcccccccgccccactgcattcctgtacagcgcaagcctggactcgcagcttacactccagtcgaatgacaacgcgatattactagagcatagcactatggaaggagaagagcaagtatgcgcaggtgcttggggcacgagtgcggagaatgtgacgaccgacgaggctgtcatctcgccagatgtgcaagttggtgcaccgcctccggccactcccgccaatccggtggaatatcaggaaacttgcccagctgaaggtactgatg

SEQ ID NO: 3103 - DNA, 703 bp, Nannochloropsis_gaditana
aggttgactgcttcctttagcagggcagcaacgtactcgtgttccctctactggctagcagcagccactcacttgcatcgcataaatgcggtacacactacgagaagggcaacgtcagatgcagtcaattgtggaacatgagcgtagagattgctgaggaaagactgttgcaatttcgtctgtatcaccagtcgtcatttaaacgaggaccttgactcctgatcaccgacgggatggcactctgctatgtgcttgaaatgaggttgttgagcaagacagattcggagagtgtccagattttgatgacaaggccttatgtgatagcaatgtgggtggttgccatttacttgttacctgtctgctttgttttttaaatttttactcttgacaaacgccgccgcaataacaaccccttctcgtgtcggcgcgtattgttgctcacagagaatgcgcggccatgatgacttacttcctcactttaattggatagaagaatgggaagggaaggtattactgatttttgcgttggaaggtgtgagatattgccaagaaataggattttcagacgatcattctgcgagcctcatctttgccctcgctcctgcacctgctttcacgtgtacaaagccgagcattgacgatatgttttgggtccatcacaacaaggtaggctgacagtccatcttgttgctccctggtcatg

SEQ ID NO: 3104 - DNA, 703 bp, Nannochloropsis_gaditana
tagagagctgcccgacatagcctagtgtgttggagccaatatacaggcgcaacattctcctcctactatgcaatcttacatccttctttcccctggcaaatggagatggtctgaccccgtcaacgtcatacatgccacgtcctcattcgtaacaagccttacctggtcttagccagcttatccaaattaatgacgccacgctgctgcccgtaacgagcgtggtattgcctattgacaaggcttgaagacttggctgcaggaatgacaaaagcattcgcgatggtcgaaatgacgcagagaaggccaagagcgaaagcaagccgcatcgtggacatgattgcgctgcgcggaccaaattccgaaagaaaagaagcatcacgtgtggaattaaaatgatgcacataaatcatggaccccaaggcctttggaacgtgttggcacgcttaagcactcacgtcctggttcggaagcgccggatctcagctcccttgctctctgtgactgtggccatgccttcacataaagcgagtcgacaattccacgacaaaagtgcactcgcgaccgcatcctccccgatctccttatccgactgtacaaatctgaaacatgctttgctctcattttacttacttcattctttattttaatcgtcacccgtaattaggtcgtgtgtttccccccccggcccgattggaacaaaatg

SEQ ID NO: 3105 - DNA, 703 bp, Nannochloropsis_gaditana
cctcgaatctctcccataagcttgcagggcttcgaaccactccacgtctacatcccctccttctataccgctattgccaaattccaaatcaggcgcgacactggcggccgtggccgtgacgggggcagccacaggtgcaccagagacgaggaggcgctttagccgaagccgtggtcctttgaagactgaaaggagaaaggaagcaaaaaacaatcggttgtataacgttgactatatcatattgaacaatagcataaaggctagtgcgacaaagtggtcgtgtttacctgagccagcccgtgccgtcgacagcggaaaagcttcaatttgcaaaaggaggctgaaagcaagtgtgaccgccgggacgtgacaccgcaagaacgttccaccgcccataattcctgtagaatagggaaatagagtcggggtgcatgtcaggcacatatttgctgtgcttcggtggtggtggtgtatgtgggaggggcagacgctagagcctccgtgggatggacggctccctatcatctcgcacgaatatcgtgcccgaggcctttttttctcctttctctcacgcccgcacatcactttgaatacgaccgacgaatacacagtcgcggcgggaagtccacagctttttcttgaggcttacaccgggttttctcccgcagttttctttttccccccaagctttgcgaggacgatg

SEQ ID NO: 3106 - DNA, 703 bp, Nannochloropsis_gaditana
aaaaggctctcctcgcctcggcgtttgccccccccggttgctgcggaggcgactcgggaaagccaggcctgcattgagattgggctggtgtgcgttgtctagctttgacagagacactcagtctttgtggaataatccatgatttcactcgcagtgatgttcaatggtggtgttcctgtacgtctctgtttgtgtgtgtcgtgtatgggcgagggaaacgtactaaggcatcgtggtgggttgggcctcctctaataaaccgatgaacgaaggccatgcaggcgcaacgacaaaaattgaaagtctttccattcacgccgtgaagcgggcaatgttaacacgaaaagacttcctgttcggcgctccggacatgagggctaccgccgttcccctttcccaagttgagcaccttgagcgaggccccgatatttgatttttgaagaacatgctggagacagcggacagaaccccttgaccatcaagacaggtgcacgcaaagacatggcacgtctcaagccgtgtcgcacaaatcacgttgccgcacatgtgtgcgtgcgatagctctgcctaccttgatctcaccgttctccttgtttttcaggacgctcgcggggactgggctttcaggcggtgtgttgaccaagcatttcccaggccctagatactcttgatcaaggggcctttgccgttcaggggagacatg

SEQ ID NO: 3107 - DNA, 703 bp, Nannochloropsis_gaditana; identical to SEQ ID NO: 663

SEQ ID NO: 3108 - DNA, 703 bp, Nannochloropsis_gaditana
gaagaggaggagggagaggaggaggaagaagaggaggaggagaaggaggaggaattgagtacgtggacatccgatggctgcgagaggcggagctgaagaacggtgcgtgtggtagatcatgggcaggatatgatgcctttttccatggctctcggggggatcgggggggaccaacgcggagtcgccgcgcatttttcattgaatgccagacaaggagcgcttgagtgctttccccgcatgttatctcccctggaaaccaccgtcggtcgcgacgacgcgtctaggcgagccctcaagcctcccaggcccggcatggcacagacagcgccccgcctgccccccgacccgcacctccccacgcctgacatcgcactccccacctctctttccccttgttccccaggccgcgtcgcaatgcttgccttcttgggcttcgtggtccaggaatttatccgcctcccaggagacctgtactcggagcccaacggggtcaaagccttcttccaagtcggaccccagcccctcattcagatcttcctcttctgtgggtttttggaattcaccctccacaaggggaagatgacgcaaatggacatgtttgcggacggaaagcgcgagcccgggaactttggctttgatcccttgggtttcggcaaggatccctccaaacgcgagcgactggcactggcagagctcaagaacg

SEQ ID NO: 3109 - DNA, 703 bp, Nannochloropsis_gaditana
ctgttcctcgcatgcgatcgagccatgctaatgcactttcacattgccttacagattccctgtgcaccacttcactgacagaatcatcgcagctagggcttgggagggcgtgtgggcataatggaccgccgctctccggacccggaagctggaatgtactgcccccgccgacgtgctgacagcaaggagcagcatgcagacttgtcgaaatacaaacgatggaattttaaaacctttctgtttctacgaggtcgcctagtcttgatggccgtgggcttgttcgctttcaccaccgggggttctttggtggtgagtatgctcacctccggctcggatgagggcagcaggggccacatgctgagcagcacgaccacctcacacgccaaggtacgtttcgacggtgatcttgcagtacccgaggcgggagtaggactgcagaaggacgacatgagcacgccgcgtccagcctcggtggaagacgagggttctcggcgcgatcatgtggatcacgacctggagcagatggaggagaaggagggacgtgtcagggagcagagagacggcgcaaagaaagccgtcggcttgggtgatgacggacatgatggggcgggaagcgaagaggaggaagaggatgaaggtggggaggaggagtgggaggaaggagcggaggataggtgggaggaagaggatgaggatgggtggg

SEQ ID NO: 3110 - DNA, 703 bp, Nannochloropsis_gaditana
tcaagagccgagaggcggtggagatgatggtccgcgaaagacaagaaggaggaggcgctcgggtgcacgagaaaggcggggtgaggctggcggcccgcgctcaagcggcagcagaccgtattcgtgagaagcgggaggaaatggatgccccagtggagcatccaggtccccgcgacccctccctgcccacccacgcctctctctccctcgcagaggcccaggagaagctccaggctttgggtcggtccgtcgaggaacaagcggcgttgaatgtggcccgacggggcgcggtgaaagctgcgattttgcacgcgtgggagggctacaaggaatttgcctggggcatggacgagctggcccccgtggcaaaaaaggggctgaaatggttcggcttgggcctgactctggtggactcgctggatttgctctggttggtgggggagaaggacgagttctggggcgcccgagattgggtggcggccgacctggacgtgagcccgcaggtgcacgtgaacgtcttcgaggtgaccatccgggtgctcggtggcctcctctccgccttccacttctcccaggaccccgtcttcctagaaaaggcgcaaattctcggccgcaacctccggtcggccatggagagcccgtcgggggtgccctggtccgacgccgtcctgggcgaagcccgggccttcgcgccccccacggc

SEQ ID NO: 3111 - DNA, 703 bp, Nannochloropsis_gaditana
ctggacggtccttcctgtacacatgtttctcttcgggtcggacacggtcgacgacggtatttatctacctgttctccttggtaccgacacaggacacagaggacaaaattaacatccttccccaaagctgttttttgcttggtcttgtgggaatcaaccctctacccaacgttgacatcaatggtgcaatacccaataaaaagcctgacatgatggagtatcgaaaaaggtagctcggtttgcaagagagtagggagcatgcaccagattcacttgtaaagccacttcaatgccaaagcgcccccttttccaagctacggcggtttggacacaagcgtatcttaacgactggacgaatactcaccatctgtgcatccgtccatctgaactcttgcggaggcaccttttcaatccattgatttgtgcataaaggatttgctggggcgtgtgtccagggctgccttcacgcaggaaccaagctggaacaaattgagcaaggaaaggaatgttgaagttcagtgagacgtgcggtgcgcagtctcagagcacatgttgaggcgacttgatcttttgggtttgggcgtgttccgcggcacgtgcacgcatcagaaccagataaggaagttcattgagtatttaaaacggacggaatactgacgcgttattttcttgggctattcatctattccagacagccgtcatg

SEQ ID NO: 3112 - DNA, 703 bp, Nannochloropsis_gaditana
gtccatcgttattcctcgccatatcttgacgaagctctccctcgatatggggatatgtaatctcgaaatgctgggaagccatgtctcagcgattgttgagtgttgccaaccttgacctctttctttcccctcgctttcctggaacagtacattgccttgttgaggagcaacagcgagaagaacatgctgacgatcggcgatgcagtgaacctggctatcctcgaggagatggtccgcgatcccaccaccacaatccacgcggaggatctacaggtaaaaatttgggacggggcatggagggggaggcgttgggggtcttgtttgtccatgacctgctgcctggtgctcgacgacaacgtcgactgaaatttccactgatccgctcgcacccgtaattcctccatatccttctgcttcccctcaggccggctcctcctacaacatccctaagcttactcagcagacctttggcaaactccgtgcggccgacgagatcatcgacgaagggcatttcattgggaaagcccttggagaggccatgaacggataccggccgatcgttgaactcatgaacaccaattttggtgcgttcccccacctgtcgccttacttgtcctgggtctgggtgatgcgtccgcgaagccggaagggagggtcgtggcgctcttcgggtcatggctttaagtcctgtcacggcattggg

SEQ ID NO: 3113 - DNA, 703 bp, Nannochloropsis_gaditana
cctgcgacaggttccggcatgtgaccgccactgtccagatacagctctaaagctcgttcaacattcccgcttcccgcgtccagaaagttctgagccacatgagggtcgacaccgtccccagccaccatcagaaacctgtccagcccgctttggtctggctgtgggtctgccataacaggcgttttttggtgctgctatgcgcgttgccttgtgaattcaagccccccgaaatgctttatgtcagctcaggatgcctcgccgcgctttgatctgtgctctttctcacttcttcccttatagtcgtccgggaaatttgtgtttcttgagtgaagtaattgaatgatggcgtgatacgggacatcatctcgagaaaagagttgttcctccctagtcacggccagtctcggcgacgcagcacactctggagggaggccgagagatactacgagcgaggtcacgcggggaactagggacgaatctttgccaagcaagggtggcaaccctgccatgtatcctcttgtggaggaccactgatgacacagggggtcacaatataggatcaatggatgcaggaagcagtcaagccgatatgcattccgggcaaagcagggcgctgaagaccctccgacctcccctccctctgattacgctcgtctcatatattccacattagtgacgctacagacattcatcatcagccatg

SEQ ID NO: 3114 - DNA, 703 bp, Nannochloropsis_gaditana
tttaagaaaagaagttgcaccttaaatttaaggaacattgcgagataagtcgaataggcggatgcatgagagagaagggacgtaaggagtgcatgcgtagctgagcctttcctttctcatacccggatcgaagaccgtttacgagccgtagatttctcgttttgcatcctgtcctcccctttgttcctcaataccgcagctgagttggcctcagatacctgtgcaaattttctacacaattgttaaaggtgtcggtactttggccggagtagagtcgaggacttacattagtcttcacagccagtagctttaatcgtgaaactcgctcgtctccggctgtggatcggtggcacaaggcacacgtactcgtaccagtcgaacctaccatccggttgttcacgtgtttgatggtcttgatcgcgacagtatgtctgcatggtaatacggttgcaagatctctctggtccgagtttgatggtatcttttcgagtagtcagccctgtgtcgctctgacctcccctctcaaccctactcgctggcccagaccttactctgttataattagtgacgacgtacgcccgttgcgaataagactttgataaccacaccagcaaatggtactactgacgtgtatttttcactcataaatatgttgctgtacactatgaatccgcttacagaaccatttcgctgccgaatcatg

SEQ ID NO: 3115 - DNA, 703 bp, Nannochloropsis_gaditana
aacctatggaccgtttaacaatcacgagtgtctatatgatgaggaataaataacatgtaaaccgtttctccgttcatccatgtcgcacccttgtcccttctcttcgacgtgcgaacaccacacacatgttccattgaatattttttgcattgaaaacaaatgaaaaatgcaataacttcctgtttgttgcgcccacatacatgtacacatacctctctttcattgctcgagcttgaagggacgaactggctggggctactttggtaggggagaagctgaagtcgggagccgtggtcttcctgaccctctggctttctttttgacgcagcaatgggaatacaacggaataaatacatctgtcttgtagaagctgttgatgtaaaaaaatggattgcatgtgccccgttgaatttggatgattcgtacctgtcgcaccgactgcaccaaaatttattttagtcgggtttccgaagagaaacacttctcttcctctaccttcgcgagtttttcttggcatccattccattgtttggatacatacagtgaacagctcattacttgaagcaagcggcgctcaatcataatgatttgatgtcctctcggcgacttctttcttatcctcatttctcttcctacttcattcctctgtccctttcttcgctacatcagtcggcaggcttgagcgcatgccttcgtaaggatt

SEQ ID NO: 3116 - DNA, 703 bp, Nannochloropsis_gaditana
tgcccaaaacatcacttcctctacccagtatcggacttgacaggaattggaggagagagaaaagcgataccatcaggcctcgcgtctggaggctaatacctagggctttcgtcaggtctgggtaggctggtagcaccaaagctaccgccagcatttccaaagcattggatagaagtagcatacgcaatggcgagagaaaagaggaatgcggtggcggcattctaaaatgagaggatttgtgtgccgtactctgtgcaagtgaagacggtgacgtaccctccttcaagcctgtggttcatattgacaaaggaatgacatgtgagcgaatagagagacgattcgtagctgtaccggtgtactaagggatttatgcagaaatgctgaatggagcagacgaagtacactggtcttctcacacacacagctcgcctctggtatttgggcactgtgacgaatgcggcccgagaggggaggttgaagggatagacttcgcatcctctatatccaggataaggtcctcgagttcgacccctaacacaagtgaacatcgtttcaaaatgtaccgatgtgtaaaaggcgcttttacagaatggaaatagaagtctacgatttcacactgcggttcatacggcccgctctcgaatcaacttcgtcatatctacctcctcctcttttgcttatccgtaccaccagtaggaagatg

SEQ ID NO: 3117 - DNA, 703 bp, Nannochloropsis_gaditana
cagcttggtatgactactcaggcgcaagagacaggcggagaaaagatacttcatcacttcccgtcgtgctggatgcaagagcacttacccgcgtgagcagtagtggctttggcatggtccaagcacgaactccggcaagaagaagagcaagaggtaacaggagcaacataggtctcccggcgctttgatctgtcatggtagacttggtccagtgccaaagggaaagagcatagatgagagttgacatcgcttgaggaaatgcaggcaaatatgcttcgaacgcgatgcccaccgcacgtgagaatccgacggtgcacagtttgcctacatacaccagagtgggaagccgcaatacttgatggtgagtagggcgggagtcaggttcgataggacatcgtcatcactggcttcgagcgagagagcaacctcccttccctctttcaattttacttaatcccttttttatgcgacgacgccggcttattttagaagttaatccctaatggggagaagcggggcgagggctacgtgtacaataatttttatgagttactagccgtgcatcggctcgagagatggccattattcactccatgtcggtcgtctcagacctcagaccttggccctctccctcgttcctttccgcttcctgttttcgtgactaagcatttctaaagcatcaacgcgaccgtgagaaaacttg

SEQ ID NO: 3118 - DNA, 703 bp, Nannochloropsis_gaditana
aatgaattttcatccaattcgattgccatgccacttagaatcactcgtgcaatcccacaaggcaactgcagcggtccgcatgacaaccgcagttcagaatcagaatagcggagcagaaggcaggaccgggagagtgacctcaatgtcaggcgtatcaagaacaacatctggtcagtcatccctcactgacgccgaccacatcgtcaagttcctgtaccctcctctgcaaacaaatgcaaagacgatcccccgcaatttaccaagtgccgtgttttatggtggattgtgcgtttgtgtcgtgttgttgtcggggataacgcggccgggaccgggttggacgttcccggccgggttttagcacgtatgtggctcgttttgtcgcttttttgttccggtgaagacggaggacagcgggcgtgcacattcaacatgggggatggcgcgaagacgaggaaaggaacgtccgaatgtgtgttgaacataacttggactcattcatataatctagcagagtgcctgccacccttgcatcatgatgcagactaccgccatggtgagctttctccttttttctattagtggacaaccccggtgcagtgccttactgcacgtccgattgccactgcgtccgctacctgtgcttgatcgcgtccggccattttaccaccatgtgcacacttttcttcgtccttttccaagaatg

SEQ ID NO: 3119 - DNA, 703 bp, Nannochloropsis_gaditana
tgaattgaaattgacgtattttttaataaagctaataaacttatttatgcaaaaaaaagacttgaaatgtcaggaaaaatgccgtacacgatgtcggagggttgcttgtctctcgggagccaaacgcgactcctctcctgcctcattcatacctcctgccgagcaaatcgcttttcaaaaaccaatacgatttccatcccagtttattcatcccgagcttatctccggccaaaggtagcattggcttcttcgcaccggatgcctgaccacctggagcagttgtttgcggagatatgggccggggggctcggaagataccgggggcggacatgacgtgccgctgcaagatgagggcagggggagggcaagctaggccggggctggtctgtgtcaggtttgcgtcctgaggagcagtcaggcgtgtgcatggtattggggaataggaaagttcttgttggagacgccacgatgggttttcatggtcttcgatggcattttgttacacttcatctttgtttcttggaccggcgacgcgagccagggcccacgcagcagtgactagccgggcttgttttgcgtgttaacatgaattggacgttcaatgcgtgtgacgtccgtaatgaacagcgagtatcgtttaactctgagcctatttctggttttccccttgccttgtgcgaccccgggatacaggcagatcatg

SEQ ID NO: 3120 - DNA, 703 bp, Nannochloropsis_gaditana
caggctcgctgggatacgattctccgtgcctcctcggacggtaggcaccctggcactcctttgtcactgtgcaccttacctcatctacagaaagggcggccaacctctcgccagcctcgtccgcatccagatccacgtatcgtgagccccgcaacttttcatagacgggcaaggacgggacaggaaaaggcacataaggacaggccaggtcgtgagcaaaaataaagacaccccgtacttaaaatttattgccaagaccggccaaagcttacctccttcttgttcgacgccatagaccgccgagaataggattgctgggagaacttgtggatgttaaggtcgtgtattgagcttcagtagcgccaggcgtgaaaaagaacaagtcgggtcccgggggtgtatccagatcggagcccgctcaggcagaggccagcgcagtatttgctgctgcgactgcgcgacaaaggactctaaatgcatcccttacagtatgtgcattgtacgcatcgcatttgttgtggggtcttacttattccctcgcagtcaatcacctcgcgagcgaggcagtggtggctactcgcacgtcctcaatccattccagtccacttcaactccagcgaccgctactgtacttataatcatacacgtcgagatataattcacgtaaaaattgccatatacacccacgcaccagatgcctctg

SEQ ID NO: 3121 - DNA, 703 bp, Nannochloropsis_gaditana
aaagaggcaggagggccacaagcgagggaggaccgagggcggagcctgtgcgccgctgcaaaaactgctcttgccgcttttgttccttcacctgccgggcacgattcaggcgatctcgcttgaaatcgttctcaaaggtacgttgtttgtttccttggcgctgttgtgatgtcgcagacgaggcgacggagacatggctgctgacagcagtgaccttgccgccctcatcgcgcttaaccgcacgctttgacgcaaggtgtcgacgcgctttgtgcttcttgttttgctgcttgagctttccagcccggtgatgaaacatctgacgccatgatatgcattccatatacaagaacggtgagggatccagcattgtcgttgaaaaatgggatatgtatggggaccagtcaagttactggggccaacctggatggatacgattcctaataattaaggcccgcagtgtgtccccaaatccgggcaagcagggtgcacacgagtcctacaacagggttttatcattgaatggacgattgatctttgatgggggttcgatcattgcttaagtccccgtgaaacatgtgagaagggtttgattaggggccctcgccgacctcccgcctcctccagccaaatactccccaggtacatggggcagtttgcaaaagataagtttccacgaaaatttgtttacctttcttcaggc

SEQ ID NO: 3122 - DNA, 703 bp, Nannochloropsis_gaditana
tgagccgagacagcacaccatataaccatgtacacttaatctgcgcttgaggtggattgagaagaaatcacgagataattctagtaacaagaaagcaacgacataatccggcgtcagagagcctcctcgcctctcaatagaagcagagtgactggcccaaactgtggaaagctatctgcttgatttagtgaagcattagtttatatgaaagaggggcatacatactgatcctagcacggagcacctacccctagctactctttaatggggggggaagttgggaaagacatttacaaacaagaatgcgccatccacttcaataaatcattagacccgtcaaaatgcatcggcaatcgtccgtcgaaaatggctcgttcaaccgaagctctcttcaccgtggcgttgtgcagcgtgttgcgttgctgggtcggggggccaggcgagaaacatcatcgccaaagaaagtgagagacatggccagaagtcgaatgccttcctcgcctatcgggacggcctaaacattggaagacaaggccatgatgaggtctgcgaagagttcgaaaggtcatgtaggcgtgtggtaatgtaacgatatcacatgcttatcccctcgctttttccactttgtctttaccccgtaggcaaggcgaggaaatcactagactagtctcgttcttcgcaccgtcctgcaacgggaaaaatg

SEQ ID NO: 3123 - DNA, 703 bp, Nannochloropsis_gaditana
cccgccttcccccctcgctcccccctcctccgggcctggcgcgccttctgcgcccaccactacgtcgtccttctcctcgtcgtccctgtccttgtggagcgtgcattccaccggcccatgcttatggccctccacctggccatttcctgcgtcttcctcctcaccaccgcggggctcttgctcgcacacgctgtcgcctacgcggtgcttggctgcatggcgtacctcctacacctcctcctcgcccacctcgacctggacgggtcgcccgcggtgtggagagagaatggtgtcctagcccacacctgcgccctcattctgggactctgcctcgtctacttcttggcccgctcccgggaaatgattcttcgcgagcacttcaaggtccagttcctgggagcctacctcttccagcgcggccgcctcgaacaagccctggccgaccgcctcctcctcgccacactgcccatggccgtggcccaccacgccctggacccgcgcgacctgccgccgccctccacgtttcccaccctcgctccttccctctatttctccagaacgagcgcggcctcctacgccaggtcctccgcctccttggcacgcgccataactcctcccccctcgtcccaccaccccgtccctgccgctccatcccccgggaaccccccaggcgtcggcccgcccgccatgagcgcgagtggga

SEQ ID NO: 3124 - DNA, 703 bp, Nannochloropsis_gaditana
aagaatgaacacctacacataccagtgcagagactggtgagtcgcaaccaaaaaacggtgtcgcctcttgggcaagtacgcgtcggggtccaatttttccacatagcccgtcattaagacaccctattttgcaacgcatgagtcaattggcgaaaaagatgttcattatgtcggttatggtaagaccccaccgacacaaagaccgtgctggacttaccaaagcacatgcgggcttgcggaaataaggaacgtgcgtacttcccccaagcgacccagaacgttggatgattgtcggcactgacatggtcaagtgcctattgcgccctacacttgagtacctgtggagcagtggtcacgagcggattaggcgttgaatctacctggtcgacgttgagcgctgagtattctacgtcctccgccgatattttggctgtccttccacaccaccaaggctgacagtgcattttttttcatctctttttcgacatagtgtccaccatgcctcacggcaagcgtggcgcccagcacactggcccgcttctcgacgaagggcggtttgggcgagggcggggcgaggagtcaacggtctcggatgtgatggaaaaggtaccctcgcttgccaccctccaacctctcggccatcccgcctgacacgacgcgccgtctttgcgcattaccacaggtgtagtcctcgaagacaatg

SEQ ID NO: 3125 - DNA, 703 bp, Nannochloropsis_gaditana
ctcaagcagacgctcggcaaagaccaaccccaacgcacccaggccccccgttaccatgtatgtcgcattcgtatgtaggtggtagctactgggcaaagacagaatcacctttcccatatgttgtcccaattgcatgtacctgaaggcgtcaacgtactcatcctccatttgaaaaacacgaattggtggagcgtgaagtagacccgcctctgctttgtcacgcaaattctgtaaacatcgcccgtaccacagggggtctttcgtgatcatgtcatccagcgcgacagtctcgtagtgcacgtctgcacgagctgcttgcatttcgtcatgtgtccatatatcgcgcttgcctatttccatgaagcggccctcaggacctagaagatcaacggaatacttgatgaagtcgcccgaaagactgttcaataccacatcgagcttacatcctcctgccaaaaagcttgacatgtctttgaaaaattcctcagggtctcgcgagcttgtgacgtactctacacccaaactccggaggtaatcgcgcttctcctgccttccggctgtggcgtaaactatggcacctacagagtgtgcatattgcacggcagcaaggccgacaccccccgtcgcagcatgaatcaatacacgttcgccggcgcacaactttgcgaaatggcccaaggctacctctgtcgtcgaaaatata

SEQ ID NO: 3126 - DNA, 703 bp, Nannochloropsis_gaditana
cttcaagggatcgcgcattgttgggttcgaagtaatccctttctcagtcaagcacaaatgggacagtaaaaacaaggtaaggaaggcgtggtgatgcacaaaaaaagctccttagatttgggagtgtccaaccgcttcatcatcctcgtcgcagtccggacaagaagcactgaccgaaattctttctccctcatccggcaggctgtcttcgacacggaaaaaaccgtgctggagacctgcaacgaccaaaggcaagtcagccacgaggtagacgcctttcagacggtggagggggagggggaggtcattttcacgtacgacgtggagtggaaggagtccgatgtgccctggtcgagccgatgggacgtgtatttctccgggaatccggacgatgaaatccactatttctccatcgtcaactccttaatgatcgcccttttcctcaccggagtggtggccatgatcatgctgcggaccttgcgccaggatatcagcaactacaacgagatgcaaacgcttgaggaggcgcaggaggaaagcggatggaagctggtacatggcgacgtctttcgcccccctcagacatctccgatgctcctcgcggttctggccggttccggggcccagctcttggccatgagcacggccatcctcacgttcgcgttgctcggattcatgtctcccgccaatcgcggcggcctcc

SEQ ID NO: 3127 - DNA, 703 bp, Nannochloropsis_gaditana; identical to SEQ ID NO: 1599

SEQ ID NO: 3128 - DNA, 703 bp, Nannochloropsis_gaditana
acgatgcagcccacggcggctccgaccaactcctggacggagcaaacagctgctggttcatatgactggaggtcaatcgcgtcctcgtcggatggcatggtacgtatgtggatgcaggccatttgacaagggtcatcatgcccctctcttcgatgatggttccatcgtgcgtgcatgtctcttccagggtccttaagctacgctcgatctgacgcatcctggtcgactactcatcccgtcatgtacagaaacttgccgctgtggcgtttacaggcaacatctcgacatcgaccgacgcgggcgtcacctggacccagcgaaccgccgctggttcgcgtgattggtacgcgatcgcgtcgtcatctgatggcatggtacgtgcttggatggaggtctttgcacaaggtgcacaatgccccagtcttccatgctggtcccatcgtgtgtgcatgtctcgtccagggtcaccgctccatttcacgcactactcatcccgtcacgcacagaacctcgccgccatagttaatggaggcttcatctggacatcgaccgacgcgggcgccacctggacagagcgaaccgccgctggttccagtaactggcagttcatcgcgtcctcgtcggatggcacggtacgtgcttgtaataaatgccattacacaatatacaccggggccctgccctcgatggttgtcccatcgtg

SEQ ID NO: 3129 - DNA, 703 bp, Nannochloropsis_gaditana; identical to SEQ ID NO: 1655

SEQ ID NO: 3130 - DNA, 703 bp, Nannochloropsis_gaditana
ggggggggggacgtaatggcagcggcggagacggggagcggtaaaactgctgctttcgcccttccggtactgcagctggtgatggagacaaaacgccgcgaggccggggggaagagtggcacaacgtgtgagggggaggccaagaacgaaagagactggcggctcagcggcgtcgacagggatggaatgctcggcatcgaaggggtggacggcagcaaggccttcgtcaccacctcccgctgggtaggaggacggtcgacactgggtgtgtgcaaagggaaggcttattttgaagccacgctactggaagagggaaatcagggtgttggcagggtgggctggtcgacagcacgtgcaaattacaatttagggacagacaagtacggtttcggttacggtggaacaggtaaaaaaagccacgaaggacgcttcgaaacttacggggaaatctttaagaaaggtgacgtgatcggcagctttttggacctagagaagggcatagtaggattcagcaagaatggagcctaccttggggatgcctttgtgatggaagagagcttgaaaggactcgcatggttcccagctgtcgctctgaaagaagcccggatacaaatgaatttcactgggcctttccggcaccctgtgcccacggaacggggctttcttggcgtcgcggagctcccccttgacggcgtgctcaagc

SEQ ID NO: 3131 - DNA, 703 bp, Nannochloropsis_gaditana
agttgcggacgtgtcgacttaggtgggggtagggtttctggtaaaaagggtcgtcacaatgtaagtagtacgatacagaaaggagttttaccataatctttgtgcgcgatgtgtcccggatgaaggggaaaaagtagccttctcgcactcgtcgtctgagagggcgtatgtgtgttttccaaaacgcttcgaaacatttgtagtccccttctccttgctcacgaccacaaacgtaccttggtctagtgttgaaaccattaatggttttgcaggtaaaggggccctcatcttttcagtccttactgacgcatgtcgaaggtggatcaaggcggtgacgggggaggtcgcgacgtgccaagccagcagcacgacgccccatttgagccacggggagaggggcgacatcgctgccaagggcacctagcaggataggttgggcgcacggtcattaacattccggtctgtccgcctccccatccctttccagcgcaatgcttcgaaccctaacccttgcgtgctgccgatgacggcagtcgctgaactcgcgtaatgccgcggctttcacgcgaggccgtgcagtcctgcatcgacatctctctctcatgaacttacgcaatccgctccatctcagagtgttagtgaggcctatgacgaggcggagacggcgcttgtacatcgggactggggagcagccgcaacaatg

SEQ ID NO: 3132 - DNA, 703 bp, Nannochloropsis_gaditana
aatggacaaccggcatttaagaatactttgaggaagcgtggacgatggataaagggaagcggccattcccgcaggtggcgggcgtggcatggcacggcacattttcgtctttgcgagaggtggaattattggaagtctttttcaagatcccatttccgtgagagactgtgcatctctgatggaaggccatgtccgtcgcttcctcatccaaggagcctacagattcagagcctgtctcggaggaggaggaggactcctgccattccggtgttgcagggcaaggggacaaaagagacagaataagtaagaatacttctcaatgctgctgcgtcttggcactgaacatattgctcatcaagttgtttttgatggtgccaatatgacaggtacgggattttgtcgggtcagatgaccacactgggagcccgtttcggaacgctgggcacgacgaatgctaaactaagctatttgctggtaactggaagacatattgccatgacacgggtattgaaacattatacagttgacttaatcaaaatgttacaggatccaccggcccggcgactgaaagcgagccttgccatctcatgtacttacacgaaccacacaattttggagctataccaaacgtaccgtgacaggcgttggatcttcaacatcgtggactggtaaagccatgtatttactgcgaaggtactgatga

SEQ ID NO: 3133 - DNA, 703 bp, Nannochloropsis_gaditana; identical to SEQ ID NO: 1401

SEQ ID NO: 3134 - DNA, 703 bp, Nannochloropsis_gaditana; identical to SEQ ID NO: 1403

SEQ ID NO: 3135 - DNA, 703 bp, Nannochloropsis_gaditana
gccaacccaagctgcaacttttaatcgagccaggacgtttagacatcccactcaagttgccacctgtgtcaaggaccgtccccgcggggaaagtcgtgagtcatggcgtggatgcaggcatggggtgaagggcggcattccagcgggttacttcgtttcttagtgtttgtcccacttgggggcaggtcgctggcacagtctggcaacctccccctcctcgctctccaccatcgactcgccccccgccctcagccttcctccccgggcccgcccgccgcacgggtcactcctgtggcgtgtgcacgcgaagggggggtggttgcaggctgcgatctgtcgtcttgtcacatagatgtggggagacgaggaaagagggctgtcgaccgtggggtctgccccctcaagcaacctctcgagcgaagggagcggcaggaggaggaggagggtacatggggcctcgacgctcaataagagcacgtatgacgatacacttgcttccaagcatggactagacccttctttacgaagaggctgatagtttccttcatattcctgtggttctgacgtgcccttgcaacccttatttatcgtcttatcgccatccatcctcctgtgcttcttcgtgcccgctctaccttgtcctgcctaacgcccctctctctcgttcatatcctggcaataacagtgattccacagagcgatg

SEQ ID NO: 3136 - DNA, 703 bp, Nannochloropsis_gaditana
tggtagggatactgcaaggacgtatcttgagcgcactggtcgacgcggcaggaggattgcccgtgcacgcctcaggtcagcgagccttcgccctgtccggccttcccactgggtttacacccacaagtcatgctatcattcagtgctttggcaaatcggtgagctgttaaagtaagaagtgcttcaattttccatcagccacgaagtctggctcacgaaaaagcgcgaggaggccatgggttacctgacttacgacacgccctagccagagcaatatatggtcataagtccctatgattgtatggacgttgcctgctctcaagtgttggcttttcatgccaagagctctgcttcatcacctgtcacgaacactgacaaaacagcttatctgaaaggaaagcgaaagaaactcctcttaaaagcccagtctaaatagtgtctttaactatgcccttacatgcgaagtcatgtagaacgcacaatctttctgctgtgttggtggcaggctattgcctgtcgtacgaagtgtctgcgtgtctttttcttggccgcatgcctcttcctgtcccgtcacgactttcgctgtagttgtctccttctccttttaagcctcatgacacccccatgtcctatcgatattgtgcaaacagacacgtgcgtccttcctcgcggtagctagaagtgaaacaagaagccagccatg

SEQ ID NO: 3137 - DNA, 703 bp, Nannochloropsis_gaditana
aaagcttttctcgaaaagatcgcatgcatgtttgcctctgattgttgaccggcacgacgtgatccgtacccctgttccctgtttgtgtctctgtgagcgcgtgtagttgtggttaagtgagtcacagggttctgaagtgtcattatttgtctgacaaatgtcatgtatgtcctgggataacctgaacgtaacaagtggacatttatgtttgttaatgattctttaaagatactcttctactctttcatatctctacctttcaatcatttttttttaatttttgggggttttacgacaccaaagtaaggaagtgagaaatcgagaaaaggtcgattgggggcggctttccctttacctgttgaataccgcatcaacgaagaggttcccttcccaacttaatagtcatgcggcggatatcgtatgtttacccaaaattagggaagcttgtcctttgatggcttaaattagtggattcggtgtgaaccggcaagccatcgaaaaaaaggaaggattggaaacgggctactcgttccgaagggaaggagccaggaggttcaacgagggtatcctgacggcctctgtatttctgtaattgagtgtgcagtgttctgttttaccgtcaaatgtattcgtgatccaattctaatctgtgcacaatgctcatactcatttgctcgtttgctacgcgcatgttacacgtagg

SEQ ID NO: 3138 - DNA, 703 bp, Nannochloropsis_gaditana
caattctaatctgtgcacaatgctcatactcatttgctcgtttgctacgcgcatgttacacgtaggtgtttaggtatgttgcaacaggcctgcgcgcgcgtggaatcccctatctcacgccgtgtatgtgcaggagcagctgctgctcggataaccccgagaattgctgcattgcgtgcagtttccaagcatttcacatatagcgaacgacaatttacctccagtactggcgcttccaacaaccctgaagctcgcccaccttttcccccttacacatttgaaacagccactgaaaaggtaattccttacacacccgcaacaagtggttttatgatctagcttgacaatttagtcctctcattaggttcgaaaggcacaagacgcttggaatactcgaaatcctgacgtcgtagctctagcatgtacgtcttgtggctgaactcgggttctggtcatccttctcttcatttctcaacctccttttcgctgtcacgttcgatagacacacccgacagcaactggcggaaccgagacgaatttttccagggtcgtgaggtaagtagcgggcctggcatctttaccttccaagagtggtgaagactgtgcaatctctgatgcgtgtctctgcacttcctatgcacacaaggcaatcagagcatttctgcggaaaaagtgggcgaaagagcgcgattattgtctgatg

SEQ ID NO: 3139 - DNA, 703 bp, Nannochloropsis_gaditana
ctcaaatgccgcacatggaccatcctactccaaggacagatatgaaggcctcacaccgtccctgccgccttcgcaagaccacaagggggaacggaacgagcgtcaggcgtcgcgcaggacccaacagctggctgcacgcggagtgagaacattccctgccgcgagcggctcggatcgcttccatgttcaacatgggatcaatgccacgtcaaggccccaaaaggccacactggggggccacaaccatacttaacacctaagcatgagtatcttctgcaggaaatgtaccgtgttccgggtagcaggacccctaagttgtcgaatgagccaaaaattatgacaagcaaatcggcaaatagccgttgacgccctctttcccttccggccaccccgcgttggatgtttgccgggcaaaggctcttctactcggtgcccgtgatgaggcaattaccgaaatgtgggctgcacgaaacatcgacatgaagtttcgcgtttgcttttgtttcctcaggaataagggtagaggtcatatggccagcagaaggcaggaatgtgtctgttctgctcgaaatcagcactgacacttcgcccctcattcgaccctcgaaacttttttccgcggctggacactcgtacgcacgcactcaccatacactccttgctcatgggcttcatgaatgaatgtcacatatctcatccagat

SEQ ID NO: 3140 - DNA, 703 bp, Nannochloropsis_gaditana
gagtctttgcacatgaaagtctatatacaaaacttaagcgaataatcgaaatcgattcagtgtaacacttgactgaaactaagataaaacttttgggaagactgaagcctttttaacggctcttaacggctggagtcggaacggtcgtaacggtccctgaaaaggattgggcttccacacacatcaaacctcttactcgcgatatctcttggctcgctcgtagcgttccattcctatcccagcgctgagtttcgggcgacactcttaggacgggatatcaatgagtgtggatacaagcaggtcaaagacaagcgaattcccagttgtcattatttggccgtccggcccatttccatacatggcagtcaaccgccacttcttcgaagtgtaccgtatctatgagaaggaaagaccacataatggaataagatccaacattttacgttcaagtcctattcaaagccaactttttggggcataatgtccgtgtcgatccgtccttggtaacatcctgataagtgatatccgcctccggtaggcgtggccttggaattgacaggatacattcgcaaagtcaaaatgatttcttcacttgacctgtgttcagcagtctcctgatacacctctttggtgactgacataactcttcaatgctctgacatactctctgcagcggttaacgtaccttccagcgaacaccatg

SEQ ID NO: 3141 - DNA, 703 bp, Nannochloropsis_gaditana
caaactagagccatgtcgagtgacagaaagtgcttttctagcagtcattcgagacttttgcgtacccgacacaagagctcgcgtagtaaatgcttgcgatgggaaccacgggggataaggcaacggagagggagtatagtgagaggaggctaaggacaaatttatgccctgcttgaaattcatgaacgtgccaatacaagaaacgttcaaaattgtaggtagcgtagaaaactcactaaggtactaactaccaaaaatgggctgttgcaccctttcatgtgactcgacagtgtaaatggaatgactcaaccgaaactcatctcacctgaagcagacctgagaagcatcactagagcgcacatcaagacaatcctcttcatgtccttcgctcccttgcctcaatccttcttactgtcgtcgtatactgcctgtcttttattttcagatatgagagtcgtcatcaacgtcgtgaatcaagataaattgcggctctaaaacgcaaggaagagagtcagggggtaaagatacttctcgcctcgagcgagctttgccgctacgacttacaccacgcggagacaaggaattaaatggccccggcccttctaaacttcaattacatcgtttttggacgaggagaaagcgtttctttcatccacgtgatatacacgcatgctccacaacaggatacgcaaagagggatatg

SEQ ID NO: 3142 - DNA, 703 bp, Nannochloropsis_gaditana
ggacttcaagacctgccgtgcatgaaaggtatccatccagatgtaaagccgtagattcatgtatgagcatgggcggcggtgtccgtggcaagctgtgtgaccctacgtgtcgcgtcagtgtcgctttttcccctcgggcttgccgttatcgcgttgtcgtgttgagtttcaacggatgacgaggcctgatctacattcctgctcccaatcacacaccccaccgacacgacgcgggtggtgccggcgtccctgcttgatggtacaaagtggtggcacacattataaatgatcgcacccgttgtttactcatagctcattttttaatggtttgcagattgagacagggtctggtggcaacgtattcgtcaagcaggcagacgtaggacgcccgtaggcgaaaagccgccttttctactacatcgcatctaccatgactatcggcaacccattcttcaagtgggtcagtcaatacctgcggccctttctacgtgaccgattaaaacccctcattgacacgtatgctcccaacaagattgccacattggagggtccatcgcccgtgtcagtcgcgtcgggagtccctgcaactcgtactcttcaacccctgtttaacgatcttagggcaaatgtcgcaacaaaaagtaaggttaaaagcactgtacatagaatgagagcgggcgaaagcagcgcttgcggtagtatg

SEQ ID NO: 3143 - DNA, 703 bp, Nannochloropsis_gaditana; identical to SEQ ID NO: 2056

SEQ ID NO: 3144 - DNA, 703 bp, Nannochloropsis_gaditana
tggcttgtgccaacgggtctcctgagtccgatgattcacataaaatgttttttgggtggccgggtcgacgacttcttcccattcatcctttgtgctcatacctgtcccgaaaaagtagatcaattagggtttgaatgctcgggatcagacgggtagcggcctaaatattgacgatggtatgaaatgggcaagaagggaaaggtaacaacagcacatggaaatgttgaaacaccaggctcgatcgtaagaaatcgcattaaacaaagtttccaatggtcacggcatgcattttccgtcaaaatggagtcgcgtccacccaggaaggccgcgcaagttgcagacatattcaaggaacaggcctgccaggggccctgggtcgaggtcctcgatccgatccgtccactcgccttcccctgggcccccgatccgatccgcccacctcctggcgaggggcgagagaggccgtgacgagccagtggcccacgcggaggggcggcgtatgcacgcttcagggaatttttttacccacggcgaggcctgtggggggaagaagagggaacaaatgactgatgcatgacagtaaagatggtatgaccgatgttgttatcacttgtggggtgtcaaactggaaatttggccgtgtatgttgcgctccaaccatccgtacaccgtcgtcgacgagcagtatctaacgggacgcatg

SEQ ID NO: 3145 - DNA, 703 bp, Nannochloropsis_gaditana
ggtggcaagcttgttgactgcctcattttcctgctctgtggtctagtctgagggaggaggttgcctgttcaactcccccgccttactgacgcctgctggtattatttccatcccatgcaaggcccctgtatattattggataatttgtttttgacaggccatcttcagcttcatcttgtttttgctcacatccgcaccgatttctttcccctgccttaggcgccaacggccattacaagcacgttgaaggctcgaacttcgactgcttacggtcatggccgtcacccgtcgacaatcgcacaaaaaaggctgtagggatagtaacgcggagaaattatcgatcaaggacgtgcaagaaggacaggatgaatcatgggatgacaagaggggaagaacgacaagaatacgtgccagcaaaggagttcgcaatctcgaggcgtcagattcgcacctgcccaacccttggggcagagcatcatctaaggtcccgtttacgccttttacttctataaatgagccttcaagcgacgctgggaaggaaacgagggctcggaggattggtcgcgccgtctgtctccttcttctagccacgattcttataggaacatacgtgtgggtctatatcttgccgcacgcacgaccgatagatatgcacaaaaccactttgaacccctcgcgattgacacgccattgtcaagagcaa

SEQ ID NO: 3146 - DNA, 703 bp, Nannochloropsis_gaditana
tcgtaccccgtgcggatcgtcgttccttcgcaagtcgcgtgatctccttctggacaagagccgagtagcctagtcgctcggggtacttgcctcgttagcgacctgcggtctatttataccatttttttggccacacgaatacttttaaaaaatctatcgaacgcataagaataattctaaccgctttttgattctcaaagaccgactttgtcgatgtgcagacgtccgtgagggacgaggggattcgtgattcctgttagaaggatcaaaaacatgctgggcggcagtaatttctccgaccgtagtgctagtccccacaagtctcgttaacccccacaacatccccgcaaagtgtaattatcgttaccttgacgtactttgtaaatgaaattgtgtactgattgagctacaactttgtaatgggtgctagataccattttcaaccttctatcctgatgtaaactggattgagaaaaatgtgctgccaagcacctccgtctttacgacatttaattgctatgtttttctctctttatttgcaacttttgtaattgtctattcctttgagtgtcaagcggacttttttcctgatacgctcgaagcctgacaagtatgtctttgttttctcttccgatgcccctcgcctgccttctcacttatcgcatgtcttcggttggggaactcagggtaggaaagaaacatg

SEQ ID NO: 3147 - DNA, 703 bp, Nannochloropsis_gaditana
agcaaggaggttatgtcttggaattttaagaaaggaaaggagacactcaccaccgaatctttttctcaaaccaccttatcaggatgctttaattatgctttcatataagttttgtgtgctaaaaccattcggttggagaaggaaaaagtgtttatgaattttgtactctcatcttgtggcctacaaacctaagctatcatttctttgacctgtgatccgataaacctgcatgtgcctgcaacaatcttttgtactgcgtcttattttgatgtcatttcccccaaaaaacacatgaatgcccgcagtagaaattaatttgtccaaaaggcagttgtacttgaactaatcgctggtgatgcgagcacggtccctctggcttgccctccccgtcttccggttccttccattcgtccccctcaataaattctttgtcctctttgggtcattcacgcatgcccgttttgccagcaaggctccaacaaaatgtctcttggccacatggcacggtgtgagtatgcgcacgatctcatcctgggaattttccttcctttctcgtgtacctcccctctcgttctggcctaccccaggcacggctagcggtgtagagaatgctcctgggggcctccagccctcgagaaggcaagaactttgagtgaagaagggccatattgctattttcgcggggaagaggtctagggcaatg

SEQ ID NO: 3148 - DNA, 703 bp, Nannochloropsis_gaditana
cacttttttgacatgttttcacatgtgacactggacgtcttccgtagcccgatgagataattcgggaatggaaaactatgggcttgttcgtaactcttttgtggcttggtcgacagatgttcgtgccttggaaagaatcgtaggccagcgtttttgacaatgatgaagcaggacattgacgtcgagacattgatattgtcgatcgtagcggtgaagattcgactaatggtgtgtgtttacttatggcaccttcacaagggaagaacgaaaacatctatatgggcgtacaccagtgctgtgggtgtttgtgcgtcgctgcatgcgtcaaaataagagaaaactaataattaagcacattcaaaagggccatatcctttatctcttcctatctcactgcacactttttcggagtactgggagttttgccaggcgggaaggggtccgtgtagataactacccggatgtacctcgttccttccctctaggcctcccaaccggtgcacagtctgttcactttcgtggttgtggcgggagccatgcctgatggcacatttgcgtgtcacagcgtgaacacaaaagtgaaaccagaacgttttttgcacccacttgctattccagttgtatctttggcttggcttttgctgatccgcattcatgacaccctggcgtgcatacaaatgctgctgggctcgactccagcttt

SEQ ID NO: 3149 - DNA, 703 bp, Nannochloropsis_gaditana
tccgaatgtcgtgggacaggacgtgatcatggctggcattccttcaggttcgaccttgccgacgtacagtattgcggccaactcggttcaaaacatgagctctggccttctggacacgcgaagggactggaaagcttcccggtacggcgcgttgactttcgccgtagtagacgacttggaggagttcaattacaatgtacacgcgaactacacaggcgctcattcgtcggccatatttgcaaacttgatcaacgacgcactgctgcagcagtacgctcctggctcgagcatcaaaacgacaatcaagccattgggagtcacacggaatgagatcagcactgcagcctcttttgacggatttaccatcgtgataatgatgatgttggcattcgcgttcattccggcagcatttgctgtctttgttgtgcgtgagcgtgagacgaaagcaaagcatctacagctagtatcgggggtatcgttcttgtcgtactggctttctacgtggctgtttgacttcgcaagctatcaggtgccgctttggatgacaatcgtgatcctcaagctgttcgatgctcgggcgttaatgaacggaaaggctttcggagctacggtcctattgatggaattgtttggaacatcggtcacaggattcacatatttaacgacgttttctttcaggagacattcaagaattcaggttgcg

SEQ ID NO: 3150 - DNA, 703 bp, Nannochloropsis_gaditana
cccgccggtgccaacacttgagggacaggatggtgaggcaccgagcgagtggttgggagaggtggttgacgatctgtaacagccttcccagataaggctgtcgtaccggctaacgagccaagacgggtagaatggcgtctcccagaaagaggatgcaagaaggcgtgcctggtcctggcatgaatgatcctcaaattgcactgtagcagaagcagtaatacggcacagagacggaagagggtcgagtagctcgatggtgctcttgtcgccgtagggccttgtccacgtcccggccatggcaacatcctgtacaccgacaagaaagcgagaatgtagaggattttgagtaggcttagcattctctgctcacgcgtaaggcgtgttggcttcacgaaatggaacagttgggtagggcggccacttgaagtcttccggcggacggatcggaactaggagaccgaagactgggtgaaaaggcgcacatcgtgagctcaacataacatgctcctttctcacaaattatttacgtggtaggtatctgttgaagatctcaagcgatgccaggtgctactgttgcagaggaagccgtcctacgggtgagaatgtcctctttctgacctcctcatggcgttgttcctcgcattttccctcttgatacttttcgcgaccttatattaacaaaccctgcactcttggacagcgt

SEQ ID NO: 3151 - DNA, 703 bp, Nannochloropsis_gaditana
gaacaaggcgatcccgcctgacctccttggtccgtcatagctttcgtgtgatcatgttatgtacatgaacattaatttcgtcatcctacatagctatacgagctgtacataatgacatcacatggctttggacccttcaaagcattagtcgtcatcaagtgggctgtaagcgtgtctttcacaaaacatcaaattagcgtgtcttaccgaaatcaactgctatcatgtgccatttttctgtcgctgcttccttatttctttcaaaattcttagcacccattccaaaaaataatccaaaactggccttcacatccattaaatacttttagcggggcattcgccccagtcgcacttttggtaataagtcttgaaccccccagcacgaataacggctcgggactacgtccactcaaatttaaacggtcttcgccacgccgaggagaccaagtgggacgggttccttgtcgtgccaagcatttgcctgaatgagcctccatagtcatgacagcatgatcgaataatttttatttgacgagtgagaggatggctccattcagattttgaaacgccgatcggcggtaacattcttttgcactcgatcatttgacggcgggccacggcatatcgttccattaattcacatgcatttttttaatgatctcacggttgatccagggttgtgatttggcagcgtacagcaatg

SEQ ID NO: 3152 - DNA, 703 bp, Nannochloropsis_gaditana
  misc_feature (1)..(640): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattcaaaaaacttacagaccggtcatggcgcgggcgagtgtgtatcgaagatggagaatg

SEQ ID NO: 3153 - DNA, 703 bp, Nannochloropsis_gaditana
cgggtgcctgaaggcgcgtcgttgtcttgggagcaacagccaccaagaagttccaaaaccatgaatataagcgccaaccctcgaacaccacattttaaacacgtctgctcgtacacctgacctcatgcaatcaattatcttccgcgtgttggcttcatttccccttgaggtctcgctgtaaaggcgtcacggaggtcccaacacgtacgtggtgtctcttcgatctttctcagccctacagattgaggccgatatcatttttttattcgagacaagtccgcatttacaattgtaaagactctaaaatcggtacacttcaagggttaagcacagaaacgggatgttttgggttacaagcggcttaatttgcgttggcacgctttcagcgtgtgacagctgttggcacgtttttgagaggtacctaaagatcgataaattcgctgtctaagcgtcgaatcccagcaacccaacaacaacaccgcatgcccctaaaatttgcaacaaattaataaaaattgttggttttcaccaacgacctgttatgataaatatctatctgttacagatgccgccctttataagacggtttctcggtttaacgaggtccctcagcacccttgccactggtataacatttctcgctttgattccctcctcttgtaacgccttcctcgccccggggtcaccggctcgataccatatg

SEQ ID NO: 3154 - DNA, 703 bp, Nannochloropsis_gaditana
gggcggatctcaggcgtgcttgagaaaggttgcaccttgagctgtttcagcgaggctgtgttgggggccctgatcccaaacgacgaagtttatttcctttgcttggctcctgcctctgagtaatgaagtgtgctggtgtctttgtcttgtcagccatgatatacgactcacaacacggtgaaattgtcctccccttgtcaagtggcaaggatttggtaatgtcgatacgctgtttgctgtgcggggatctcgtattgccgatccaaccatccaagaaaggtctggtcgaaatgactttgaaagggctgatgacctgtataggagtacatgaacatccatgcgtgcagtgtagcgtgttacgtggctgcgtgcatgcgggaaaaacgacactgcatgtctcttgcggacaatcgggcgctttcagccggcctgtgtctacgtggcattatgtcatgaggtcctgcactagatttccgtgcaggtcaagttggttgatcaaataggcgcacggctcgacttcttccctaagctggaatcggactgtgtcacgtgctttcctactactctaccaccactactcatactggcctttcggcgcggaccatttttccccacagatgcaaggagatgccggtccacccttaagtgcctggtgcgcacgcagcatgtcagcacagcgtctcttgaggttgcgaccgctatg

SEQ ID NO: 3155 - DNA, 703 bp, Nannochloropsis_gaditana
gtggcaaggaaatcagctagggtgcgcctgggaaagcgatagatctttcgagggtcgcctcgaaaaccgcaacgcaacgacagccttgccaactctcgacaaaatcctgcgttaatgcagtgcttggacgaaacgtaccacgaaaagtgttccctgagcgtagatcgcgatgccaggggaaaggacttgtcgttaagcttaattttgcccaaattgtggctccccaaagcccgctcgccaccaacccccaacaaattgcggtctaaagcacataacaacatgacaccagacatgattaacccgcgagtgtgacaacatgccaagaaaaataacgccctcaagtgccaagacacccgacgccgtccgaatgtcgggacgttcaagaaaaggcacgaatgtcttctgattcgagcacccgcggtctgacctcagcgcacaatagcacgatcgctgggagtgggccacggcgaggaaagatcgacgcttgttccctcacgtcgccagtaccagcgagtcccgctcagttcaactgggtaggctgcgcaatgctaattttcccgggtgttctatccatccattggtagattcgatgctgcggcgttttccaggattgtcgcacccggcgactgtccgttacgggcgtcgactccagccacacggtcatacactccagtctgaaagcccaggaaaccccacgtccatg

SEQ ID NO: 3156 - DNA, 703 bp, Nannochloropsis_gaditana
aacgaaaatgcaacgcctaagtaggagatgcgactcggcatattgtttgtgttgcctggattcaattcgtgtgaatttcaagagtggattgtgaagggacgtaaaaaaaaacgcgtgcgcacgggtgtcaacatatttgaagaacgcgaggcagcagaaggcgatcggaacgacgcgggagcgaaaaacattatcaaccctatcatgccgagcaacgaaattcattgtgcggccaaccatcagtttctgtgttccaaatccttttatgtatctctattagggtcctgtctgacagcacaatattattcatggtcttaaggcccaaaaccagacacggcccgcgtgaaccttgagaagatcggaacggtctccccgagaggagggagaggaggtcgctcgacagccacggccgagcccatgctgaataaagtctgaacaaaatgcgccccatcgcaaccaattgcctgtggtactcttgcgtacgtgttgattttaaacctttgcttgctgcgcacgctttgcaaggctcactcgtcctttgttttttcatcttcaccctgaaagtttgttctttgcgtgcctcgaaccgtctgaaaaatattgcacgcgtaggcaattaacgaacgtatccctcaaaattttccttgttcacaggcctcccgattataagcaagcaatacattaaaaaatatacgccactatg

SEQ ID NO: 3157 - DNA, 703 bp, Nannochloropsis_gaditana
tttctttatccgaagcgcaggaacatgtagctcgagcaccactgcatcgaagacgaccttatgtttgccctccgcagacagaaaaagagggaaaaacagagcgtcgcacacacctctagacttgcacgtcacgcgattttcagaattcagcccggtgctttcagatgacacgacccaaatcattcgggcattcgttcgtgagacaatctccagtcgtccatggcggcgtgtgctttttccgtacaatctaagattgtacgccgacgcccccgagattccgacagcctctacccatatatgatgcccaagagacacaacacgcgtccattgcgtccgaacccccgtgcatccagatgttccgatgacaagcacgctgtcgccggtttggcaacacttggtatcgcgaaagggagtgctggacttacatgtccttcgttgccttcagaaaacaggacatttgcaccacatacgcatgcacggatcatgctttcttaacaaaatatttcaaatttatttaatcatgcagctaagcttactatatttcattcactggcaggttgcgacagcaataatggtgcccgataagccagtttcccctcctcctccacctcccccctcccgggaaaccactgcatcggaagccgcaaaaccaggcaagcgggcaaagaggtggtttccacttgaaagcaatccatcagtcatg

SEQ ID NO: 3158 - DNA, 703 bp, Nannochloropsis_gaditana
ttgcaataggatagggcgagcgggcggtggcgttggcaagaaaatagtgacaatccggcctttccggctccgaaagcttgttctcgttcacaatcacctgggacaccacccacgcagtggcctcctataaacgtgtgggcggaaaggagagtgtggagcggcaagaggcatgggattgagagacaagtcagtgtacgagcgcaagggcaacaacggtttggcaggcaaagcgagcaagctgtcgctgagggcgagctggcctttaaaaaccttgcaacggagcaggagagagtgtggaggcattgcaagcatggaaacgaggggcagattgccgtttgcaagggacatgaatgaatctgtataaggcaagtggtttgatgcttacgcaagttgcagccaggccttcctccgggcatcttttttggccccacgggcttctatcgcagcagccagacagcacttaccgtcaacgtaaccagccgccactcccgccccaaatgacagcgagaatcatttttaagtacatttttgtattgtatggaacctaaagagggaaccgcggcggtagcagcccggcaggctgcggagaaagaaacccgggcgcgccgtatactccaggcacgtttgcggaagttttgatctgctccttacgaccgttagtgacattatcctcatctctttacgctagaattttttgcagatg

SEQ ID NO: 3159 - DNA, 703 bp, Nannochloropsis_gaditana
tgacatactatattccgcaatagaacccaaacccctgcccgtgatgcatcgaagtcgctgagctcgcatcgggccatcctcacctttccttgctggcctctgcccacgtcctcgtggtggccgtgcatgcattcaggggcagctttcgggcacctccgctgtatgctctggaaattgtcatcctaggagagatcgcgcaggttgaactgtgggggatgacaagggaaagctgtcaagaaagtctctttcaaagtggaaggtatcctcatctattagtatactaggctcacaaagccagttccaaaatgcagcaacaaatgaactagataaacaagtgagtactcaacacatgcactctttatcttacccccgaccgttccattcacgtacgatgtctccaaagttattgtagaagcctttgtgtacttgcttctcgccgcccagataaccatctccagccgccaagtccatgccgctcgctccgtcctcctcgagaaatcctcgactttgccatctctctgcactggagtctttgcctgtactcgacactttaaacccccggacccgctgccgaccaccttcgcggggtggagcgtagtccgttgtgctccacatggcgagtgacagtaaggcttcctgcggcgtccctctaagaaatattgatatgtgcaacgtcacgagtcttaggagaagatgcacaatg

SEQ ID NO: 3160 - DNA, 703 bp, Nannochloropsis_gaditana; identical to SEQ ID NO: 1978

SEQ ID NO: 3161 - DNA, 703 bp, Nannochloropsis_gaditana
ccaagacgcagctcaagtgcacactgctgatgcagcttgacggagcgcggtcgcagcacctctacgggggcctcaatggaaagtcgaaggtcgtacgcttgagcgcgtccaaatttcctgacgcaaaggccaagtttgtttggtttatcgagttctactctgtcaactgcccgcactgccagaacgcggttcccgccgtggaggcggtggccgggaagctcgaggggatcgtcaaggtcgggggcgtgagctgcgacgcggacaattcgctctgcgccaagcacggggtccagagcctgccctctttcaagctcatcctggagggcaaagcgatcgactacgaggggtccgtggagacgaagtccatgctcgacttcgtcacagagaactacccggcgcccatcgcgaacattcggcggacggcggccgcctcggatttcttcaaggctgtggtggctgggaagaaggcaggggccatggtcctgttcacggacgagtacgaaacgcctctcctctacaaagggctcgcttaccagctgagggacaagctcgcctttggggaggtgcgggcttccaacttgcaggtctcggaccacttcggcgtcggcaagtaccccacgctgctctttttctgcggaggagaggaggcaagcgcggtagtggagtatgggaatgggaggggcggtattgggaaggatgtgaa

SEQ ID NO: 3162 - DNA, 703 bp, Nannochloropsis_gaditana; identical to SEQ ID NO: 2191

SEQ ID NO: 3163 - DNA, 703 bp, Nannochloropsis_gaditana; identical to SEQ ID NO: 2192

SEQ ID NO: 3164 - DNA, 703 bp, Nannochloropsis_gaditana
aatccttgggagagaaaaagggaggactgaatcaacacgggacagtagtcgggcgccgagcaggagaccactgatagcacctcctagctaggagggaaattcagcacaacgacctccggaacgctggcatggcatgcgcgcccacgtagactaacggagagaggcatagtacgcgcatgacattgttcctgacacggaacggtggcatgcaagcgggcggtgagggtccattatttaccacgacccccctccataccgtctcgccggatgccagcgcgacgctgtggatacatgaagccccacgtccttcaggtcgggggacttttggtgcaaaacaccggcacggaagagcacagtagagtatggaaatgaaacccttgtcataactgtatgccatacgacctcgtggaaagcacttgtcgtcggaattcattcatatttaaccctcaaccaatcgaccctccccttggcaacggccccctctctccgtcaccttggcgcttttcaacccaactagccttttacgaactcctattcaataccgagacatcctgatcgacgaatacatccattcttagagtttaacagtacattcagccctcgttcatggacccacagctccttccttgttttcccaacacacagattctgttcccttgtctcccttcctcgcactgggcggcgaaagactgacccattcatg

SEQ ID NO: 3165 - DNA, 703 bp, Nannochloropsis_gaditana
gtccacaagtgagcaaaaaggagtacattgtagagtggatgtctccattttttcttccgtggtgacagcaatttggtactgctgtcttcggaaactagacggagcagggatgaacttataaagatcataccgtactcatacttctcacctttaccaaggtgcaagctttgacgatggggactgaatttaaagacagtccgggggacacaatcgtttatcgacttcttttttaacacaaaccatacaatacaggatacaagggccggggcggggcaccagcatgaagttgctgcttcgccaggtctttctaaggcggcaaggcctgaaagcggcatctcgcggaagacggtctatccggccatcatcggcctcatcactgtcaccatcgttcctaaacgtaggggtcttatgtaagcacctgagcgtcgaaaggtatgaaaccgatgcggagctccggaagaccttaggcatgccaatacctttggacgaccatgcggtgtcagtcgccctccccaaatggcagcacgtggtgggatacgaagaaggagacgtggatgtgacagagaaaatgctcttgggctatccacgttttgtctaccacccctttgtcaagcaactggttgatttgtggaaggctggtgcggtcgaaagcggggcagtggccgggcacgaaatagtggaggccctaccttttccctccatg

SEQ ID NO: 3166 - DNA, 703 bp, Nannochloropsis_gaditana
agaggagaggctcgctccatgacttgtaaccccacttgtgttgaggatgacagtgatgaggaaatggacaggatgtgtatgaaagggtgtcaatgaagggctccgaatttattcgaaacaattcgtcatttcatgcggcttgaaacaactttcgacatgccaacgcacatagacgccagcctaattttcatggcgactgtcacgtgcgagcgtgtaccccaatcaaaaagcaatgcgaggatcttagtcgtacggtccagggcgtctcggatgtagcactcgacggtatgtaaagcatcatacggacccacccgagatgacggtgccggcggctggcggaggtatgtaaaacatcatatgcccttcccccctgatgacgatgacggcgacagagggaaggaataggaagaatacaggcctatgcgcgaggcagaacggccatatatttcttcccctctcaccaaagcgtgactaaaacccttctaattgcgtcttgtgacctttggtgacgtttccgcacaggttgccttcgtcttttgtgacgcagctcgaaggaagttgtaaaattcctctcctgtcttcatcgtccatcgcctttgctccccatcattgccggcccttttccattcgacctcgacgtgtgcaagagcgaagcggctaacgacaaggctgactgggtataaaaatctagtgtttgaacatg

SEQ ID NO: 3167 - DNA, 703 bp, Nannochloropsis_gaditana
  misc_feature (691)..(700): n is a, c, g, or t
ttcagggagactttccgacgcatttttcccaacggtggaattggaatcgtagagatgctcttcagaaccaatttggtggcgctagtgggcggcggacgcaaccctcgttttcccccgaacaaggtgatgatatgggacgaccatcagaaccggtgcgtgggcgagctgagtttccggagcgaggtcaaggccgtgaagctccgaagggacagggtcgtggtcgtgctgaccacgaaaatttacgtctatcgattcgtggatctgcacctgcaagaccagatgagcacgctcccaaacccgcggggtctcgtcgccctgtgccccgataacaacaacacggtgttggcctgccccggcatcaacaaaggctctgtccgcgtcgagctgtacgacagcaggaagtccacgctcatcccagcgcacgaatcggagctggcgcagatggccctgaacctggacgggacgcgcctcgccaccgcctcggacaaggggactttggtccgagtcttcgacacctactcaggtgagctcctccaggagttgcggcgaggaatggacagggcagagatttactcgttggccttcaatgcgtcctccacattcgtggcttgctcttcctgcaagggcaccgtgcatatttttagatcggaagagcgtcgtgtagggaaagagtgtagatctcggtggtcgnnnnnnnnnngga

SEQ ID NO: 3168 - DNA, 703 bp, Nannochloropsis_gaditana
actttgcatcaggaggggaggcggagcgcgtgtcttacaaaaagcttgtcaggtcggcggaggaggaggacgaggatcactttgccacggccccgagcgctggatccctgcatcccaccccgacgcacgtcacccagccatcaatccctccacctgcacaatcccaagcgaccctcccttccagagatcgcaatgggagacgtggtggggatgccgactcccttcaagctgtgtgataggactttgaccagccttgtcttgattggtatgcaaaattgactacgtggaaggtatagccggcgtgttgcctatgtgtaaattaaccttgaaaaagaagaaatgtttcacttctaataaccgcacgcctcagtgcctcgttggaggacgcgtgtcaatagcgaacatcatacgttgctgctggacccagaacctgatacaggtatggccactcacaacggcaaatgatggatacaagccagacaagagctctaagcaccaatcattaccggcgagaagacaaggcaaatgactgaaaatatgcaggctggggcggggggcgggcagctcgaaaagctggcacggtctatgctcaccgaccacctttctctacgtcgctgttcccagcgcaagcgctcacacactgatctccttatacctcgcacacagattacacggcctgagttttacgttactcggaaaaatg

SEQ ID NO: 3169 - DNA, 703 bp, Nannochloropsis_gaditana
cgcccgcgtcatggggttccgtagtcaccaccaaaagcgacacatgagttttagacgacctacatctcaacaacatcccgttgaccacgcccttccaaccacgccaacaaaaagagaccgggtctggaggaggaagaacggtggccatgcacgcccacgccccgctgacggctctgtgtggcggcggggagacggacgaaaagtggcgaggcgagagcactttgagagcccgacacggataccgggcaccgcaaagtcaacttgccgtgcttttgatgccgctcgccttgcgccttacgtcgtttatggattttgaaggacggaagctatagtttctcgcagagctgttcagaatcgagaggacaattaaatgccccaaccctttttttggtcttgccgcgagcagtgctgtgatccgtgcctgcaacattcacatcggagcgaactctcatatttgttcgattttttccattcaaacaggatggtcatgcggacgcatcagcgtgagatgtggcgtcagcagcaatgtctgggtagaagactagggtcatgtatattctgtctcctgatggcatcccttttgtttacttccgaggtggtcacagcatttgtgcccgtcgccacgcgtcggcccgacctcctccacgtctctcgccccccatttccttcgagagccacgccaggtaccagagctttgcgcatg

SEQ ID NO: 3170 - DNA, 703 bp, Nannochloropsis_gaditana
tgtattgacccatatgcgggtattaagctgctgccccgaccgtatctccaagtcagacatgaaatcttcagttgcgttaaaaactctacgatgctaccagcgttaaataaccttgcccacgcctttaaacgtacccgatcattaacatatcgactggctgccttggctttgcaccagccatcatcagacttaacgatgggtatgttgcttgcctttcctgcttgaagggggtccgactctctgctttctcgatcgcgggtgtgacctctgaattggaatgtaaaaatgtaagaagcgacgtgtccggtaaagaaatgcccaagctccatcaaatctgcgttgtcggcgaccaaaccatgctggctcgtcgacctgccccggatgcaggagcatggcactcggcggcatggcacttgagcctcgcgggaggaatgtgtgtggttgggcgcaggctgtggacggcccccctccagcgaagcggtcgcctccctttccgacgctttgtgcacgttgtctggtgtcctctgtctcacgcacctcttcaccgacgtggtgtccctcttgttgctggtgagggacttggaatgtggtcctggttctatcctgggcgcgtgtgttcctttttttctctaccgttattctctccatttctgatgtctcaccaccatctccctcaccctccaaccgcgtcgttgtgccaaaa

SEQ ID NO: 3171 - DNA, 703 bp, Nannochloropsis_gaditana
tgtttcgtcgctcagttgcggtgagggggctagtgattgggaaggaagaagctcgacgtaatgtggtcgtaccgcgtgtttgccagctccgcagaaacgatcatttatgcagccatattatttattgaagcaactagtgtacagtatgccaaatctattcatttttttaaaggaggtgtcatttgcttttcaacgcgcgaagagctttaagagagtgacgccacttctgttgtgtgagaaaccgcgaccgagtataccgcggggaaaaaataagaaagtcttttcttgaaaactaatcctttttgttatccttcgcctcctaaatatgcacaaaatagcgctcactttttctaatttcctttctctgtatctcacgttcccacgtacgttcccaggcggaggcctatctgtttgaacgttcgcgtgccatctaaatttctagcacacgagtcagccaaagctctcccttttctcggacgcgtgtgtgttgactgtagcatcacagccctatgcagtatttatggagcgggtttccacattgctcgtgcttgctcgcctgggctttttaacgacttacatcatgccgtctccctttcgcccccgccgtacccctttgtcctagtctgtttgacattctatcatacattcacaggctatcatgcatggccgacgtaaagacgaatatcaaagaacacacctggcg

SEQ ID NO: 3172 - DNA, 703 bp, Nannochloropsis_gaditana
ccacgtacgttcccaggcggaggcctatctgtttgaacgttcgcgtgccatctaaatttctagcacacgagtcagccaaagctctcccttttctcggacgcgtgtgtgttgactgtagcatcacagccctatgcagtatttatggagcgggtttccacattgctcgtgcttgctcgcctgggctttttaacgacttacatcatgccgtctccctttcgcccccgccgtacccctttgtcctagtctgtttgacattctatcatacattcacaggctatcatgcatggccgacgtaaagacgaatatcaaagaacacacctggcgcggagccaggccgaaaaagaagctgcgaaaaacaaagtattcaagtacaaacaacttatggagctggccttgcagcagcgacaggaaatgagacattgtaaggaggcgttggtaaccggagaggccctggataacgacttggtattgtcatcacagttgctcagaataaatccagacgtatacacgttatggaatcaccggaaagagatgatcgtggcatctggggtccttcggcaagaggcagagggtggagagacagagaaagaagagtgtgaaagcgaaagggagggaggcaaagcgcctctacccccggggtcatttttacaaacggaactcgatctagtgatcgattgtattcgcaagaatccaaagtcatatg

SEQ ID NO: 3173 - DNA, 703 bp, Nannochloropsis_gaditana
cggagtgtccgtccacttctccatcctcttttatggcacgtaaaacagagcctatcaccgcgtcctcatcaatcttaagtttgcttttgacaagatattctgcgttgaactgtgatgggttttcgtaaaaaatcacaaaatggaataaggcaatgaaggaaagcgaggaggtttatcagaccgggcggtttacttacgtcgagcggcgtgcgaaaaagccacagctccgcatcttctgcttctagtagctcttctatcgtgaagatcgtcctgctctcgggtggacaaaacgtcgtgtcaggaactggtagaaattaacatagcgcttcggctgccacatgccggagcatgtttatgtgcagtcagcatacctcaggaagctcctgcttacctgacaggaatcaaagtgcggtcttccatgtccgggccttgtacgagcactgcatgtgtgtcccggtgttccgagtcaatgcggtgagatttacttttaagtcgtgggcatgcctggatgctcaaggtgaagaggagctcctcacggatggcgaggcggacctcggaggtcgcggacaaaacctccggacacaggaaggaaaaggaagatagcaacccaagccatgctcacattgaacggtcctctagattttacctcactgtcttgcttatatcacacagataaggctggtagcaatttgcatttatcatg

SEQ ID NO: 3174 - DNA, 703 bp, Nannochloropsis_gaditana
cccacgcttaaagccatgcaagtgccgccttcacccgtgtcgttgggttaaaccatgtgttgttgccaaagattgtactatctgcttcagtaacgcaagcgccgaacaggcctcacgcaagttggtttctgctcgcaagagagagccttgctggtgcaggcgcagcacaaattccatgcgtggccattcagaaaggcatttttggtagatggtatgaacaggttgagcgtggagcgggctgtcagcgcgcattgtcttgtcgtgcttgcaccgttcatcatagtatcatgcctcctgcatgctgaagaaagtatgacgctggacattagcaaccctagtgcatcttttgttgtaatgtttggtgtatgcaatcgatacaagttgtgtgcgcatgcatgatgtgctgaagggcttgtagatctgtgagtgtgccgacgtcatggttgtcgagcacgagcatcgtaaggtttgcagactccgaagggtcatagtatcactgtggctgacgcacggccatgctcgttcatgcgtgcactacatggttgccatatcgtcacagcgttcgggtgcatggtagtgagctccgcctcctgtgcctgactggacgatacggcgtgcttgttctcttgtcgtcgcttccatcttgcccgatccccacccctctctctgtctccctctttcggacctgacgcgatccccgcag

SEQ ID NO: 3175 - DNA, 703 bp, Nannochloropsis_gaditana
ttgacttgcacgcgcattgcgatgcgtattttaacggcactgctggagtttgggggcggaggagctgctgaaggccgtcgcggacgaggcccaggtcacgaagcgcggcaagacgccgaatgaggtcatgtccctccaggagcaagccatcctggccaacattcaggagcttcagcgccagctctggaaggtgaagagcgagcaggagaagcgggacacgggcgaggagaacggtgccgcgggggaggcgtcggaaagcgtggcaaagcaccgcgtgataatcgtcgccaaccgcctgccggtgtcgggcgggcgggacgagaagaccggggagtgggactttcggatgtcctcgggtgggctggttacggccttgaaggggtcgcgggaggagttgaacgcggtgtggatcggttggttggggcaggagataccagaggaggaccgggagcaggtgcgggagaagcttctgcgcgagtacaacgcggtgcccgtcttcctctcggacgagctggtcaacaagtactacaacggcttctccaacgacgtgctctggccccttttccactacatgcccctgcccatttaccagtccgaggcgggctccgacaagcgcttcgacacggtgctgtgggacgcgtacagggaggcgaacgtgctcttcgccgacgcggtggcggcgatttgggtcgagtccgactac

SEQ ID NO: 3176 - DNA, 703 bp, Nannochloropsis_gaditana
tgtgcatggtcgattatgaaacatcaaatatgcgggaggcgccgtcttccctcctgtggcagcaccaaacgctcagccaaagcgcgtgccgcgcacggcaatgcgaacacactctaccccactcaatgtttcatcttcaaattacaccgtatcacgtacaaacacgcctcgtgcatatcgtcaagatggttgaaggaaaactcaagtaggacagctgggactatctcatcaccagtcggtcggcgcgggccaaaaatttaacgccggcgcatttacaacttgcattcatgactttttccccattcaagcttgtgaatcgcatgtttccacattccatgccatggagcacgtgtggcccgcctgaataaagttcttctgcgccttgattttctctgggtggagcggacaaggggtggcgagagggtggtggctgttctcatcggagtgccacctgcttcaagttgactcgcccccgcgccatgccccattcaagcacaccaggggcccttcaaaggctgacgtgtgttgtccttatatcaggacgtctatgtattggaagaggacgtgttgtgactgtctagggcttcatttccggaccctcattctcgacctcttcccttgctctgctggcgcccttcattccgacccttacagactttcggtgcgcaagccgatcaagatcacaatcaccacaaggacaatg

SEQ ID NO: 3177 - DNA, 703 bp, Nannochloropsis_gaditana
cggactagaaggcagccagtcaggcgagcaattgaagaaaagtttccataagccaaaaagcccggagcagccccacgcttccccccaaaacacctgtggaagtgctgtgtagacgaacctgctgtcattcaccgagacagaagcgcgaactgcggttcttagtacttgatatcatccttcgaggaatgctcgctgaagccgtaggacgacctcgcacctgccttgcaggccgccttctacatgtcctgaaagccctcgtttttaacgcatatgatccatacccacaagactgagttactaaatgagtacatgctttattccactgtaccagggcacaattttgtcgccgctcctgttgtcatggcgtcaacagggactacaagtgggccaccatcgcgaggccctctgccagcctacctccaaccacaacagcatcaagaacaacagcagcaaagcacaagtacagcaaatcctgaaatctttgtgcgacgattgtacaagccgcgcctctgtgaccaagtcaacaccacggccgggactcagcttgcgtcgctcagccgccgcatgagcgcgggtaacagagggagcggcgcgggagagggagtcaaatcgtcgacatgtacggtattggcagctgagctggtccaatccgactatttgcttcagccctcactgaccctgcctgaagaatttggtaaaatct

SEQ ID NO: 3178 - DNA, 703 bp, Nannochloropsis_gaditana
caaccctgtcgccctgacaaccacacagagagtcttgccctcgggccaggtgctcgtgcaggcacagatcaaaaacatcacggagcgacacaccaatctcttcctggaggacgtgacgttcctggcggccgacaggctgcattcggaggcggtggggttggcgccgaatgggcggtcggcgttgggggcgatggagcaatggggcgaccgaagcccggaggcaacacttccgtccgaggaaagggaaagcgatccactcgactgtgtggcagcctttgaccgacacgtgtacctgcagccggaagatgtggcgcagttcctctaccgcctgtcttaccgggccgaagacaccaggggcccgcccgatcaggacgggatgcaagcgtcatctcccgtcgctcgcaccaccttgtctacagggacacccctggggcagctgcgggtgtcttggcgcactaccttgggcgaaagtggcaccttgttgagccccctggttgagtgctcaagtgccgtcgcctccaccgccccgccggtcgagctacggctgtcgcggcctttgcgcgcacttcggagagaaggtgattctgagacatcatctgttgatgtcaagcctgcaaaggatgaccaggagggggcggcagtgctggtgcaaggccaggtttacgcggcccactgtacattatacaacaacaccgataaggac

SEQ ID NO: 3179 - DNA, 703 bp, Nannochloropsis_gaditana
aagtcgaggggggggaggatatcgggggcgaggccggggggggtacccccacggtccttatgggaatgcgtcgcagcccccctactcctaccagcagcaggcgggcgcttactccccgcaggcccttccgtcgcgccagcagcaaggcgtgtactttccccaaccgcagccacagtacctgccagctcacattggcacagcggtccggagcagtttgatgaccatgaatgcgctcgaggcccgcgagtatttggcctccatggcggtgcagcagatcgagtactatttctcggtggacaacctttgtcgcgatacttaccttcgtgcccatctcgacgaggagggctgggtgcccttagcgctcatttgcaatttccccaccgtggccagctttgcggccgactactcggagatcgttaaaacgctgcaggaggcctcctccgtcctcgagtacgacgaggcgaacgagacgctgcgcctgaaagagaaggcgacggcctggctccttcccaacgggcgcggaggcatgggttgccctcggtggttgaaacaagcgcccgacacgcccccgcaggaatccaagctccctccggtcgtgctccctaaccccgaggccggcggcgagaagggtgaggttgccgagaagaaggccgacagcgagggcccacggcaacccgtcacccccgtcacccctctgtgctcc

SEQ ID NO: 3180 - DNA, 703 bp, Nannochloropsis_gaditana
gccaatgacgtcgggcttggcgaagtgtggatcgaggatgaacacggggtacacatgcgtggctccttcacatgcctccaacagggcaggattatcgtgtaaacgcaagcctttccggaaccaatggagagaaaccgtgcgagctgcccctttcgcaccaggcttggagacagctgtactggtcattgtgataggacggacaaaggaagcactccgcggaaggtacgccagtgatagggagatagctagtgcgagggtcaataggaatttccagggcatgcaaggtttcttgaagcctgcaggacataggataagcgatgtcagattcataaagtgccaaatcttacggttgtttataagtctcatcgcattatgtctcatggcggcccagcctgtcgaacgtgctgaggtggcaatcgtgctgaccttgatcggcgtacctgctcctttacaagttgcttgataactctagctggttcattcaactccggctacactatgaagctccatttagcaatttggatcgacagggcattccagactccgacacccacatttttagtgttgaagtgtcttgcgtaagagggtctggcggggaggttaaacgacgattactacaacccagtcccccccccttaacaaggatttcgtcttctgaaggtctaacgttggcgtacatcccacatatgcacacatagtaatg

SEQ ID NO: 3181 - DNA, 703 bp, Nannochloropsis_gaditana
aaaccgactgaggagtcctaagccttacttacgagacatattcttcgatctccctgatgatgcgtctcctgtagcggcacgtggcttcgttgatgatgaatatatcctgtacacgctatccacggacagggcaaaggcgttggtgctcgtgcttgtgccaccagtgcttgtttaagtcgggcggggcggaccctcaaccttcgtcagcggaaagacacattcctgttcttggactctgcctgttgccggtgcacttgccaatagagttttcacgaggcaaactctacgaggtaaggttggtggttggggccgcggtggatcgcgggcccgcctgtacgagtctatgggctccaggctcacgtgctacgctagggtatggggggttgttagaccatggggtgagcactagaggtggacgatatgtccgacgcagcggatgcagtctgggccagcgtctcctccatatgattaaaatgtagccaattcttgtagaactttgtggcacctggccacgccctgaaggaagcctgagtgcttgcgggagggaccgactgcgagactcacctctctacctctccgcctttcccttcatccttttgtctcagaccccaacattggaaatatgaatcttaacattaatttagaaagtctgaaaaatatggtggacgaggccaaaaatcagatagtgccgcggaccgagatg

SEQ ID NO: 3182 - DNA, 703 bp, Nannochloropsis_gaditana
gtcatgcttccacctgcttccacctgaggcttgtgtaagtccaggaacatccctttggtgctcactgcttcctgccgcccgcattttcggaacgaatgatgatacaggaggggccggaggaatgttgctgcgaacgacgatcactcgaaaggtgacacgcgcaccgctttgcttccctccttgtcctgtacttttctttatgacaacagctttttcatcgcagcgacaagtggaagagggcaggcctacgcaggtcctctcgcctgtcttttcttcacagtatatgggtgtaaactggaatggaaaaaacaaccgttggatcgctgaggtgcggcacaaaaagcagcgactgttgcacagggcattctctgatgaagaagaggcggcgcatgcaatcgaccgggtcttacgacagcacttcggagagacgattctgaccaattttcatcatccctccggcgtgttcttagatccgaagcatgcatttgtcacaaaggtgtcaacaggaagcagttcatcttgcagcgacaacacttttacttccacggcgacatgggctgtcacgtacgtcgaagggctccgtctctacaaggcggtgatcaaactgcgtgggcggccacatctcattggtctattctcctccagagatcaagcgattgcagttattaagaagaagacacagccgagggagaaggggggcatg

SEQ ID NO: 3183 - DNA, 703 bp, Nannochloropsis_gaditana
tggattttagaggtgtctcgtggtccaaggagaccaataaatggtacgcgcagattcgcgtggcaggacgtacgttcaacctaggatatttctcagacgtcaaagccgctgccttgcagtacgacatggcggcgcgcaaatatcatgggacatacgcgcgttgcaattttgatttacaaggaaatcgaacgcaggttcgaatgaagctcaacaactcggcagctgccaaggtcaaatatactgtgcgtgagaactcggacaaagaagacgagaacagttgacaacgaatgattgtgataagagtgtaatggaacacattcaagtatctgtgaatcatgatttgcaaatcattcgaaatagtttcttggcaggcacgaattcactgatcatgtagagggacttgcgtttcaagaactttttgaatgaagtacccgggctcaagttagccccattgtagttttcggaatcgtgctccgcattcctatacactgagaaaagacagtaccaaataatttgcattatttggaacgaaaagagtagtttgcggtgactcgagttgcttcctgcctcggcccatgcgtcgtcacgcgagccaacccggcgatcagcccaagggcaacttgaaggcataatcactgcacgtatgcctccatgcgcattcctcactcatcgcatcaaactgcacagctttccttcgacgatg

SEQ ID NO: 3184 - DNA, 703 bp, Nannochloropsis_gaditana
acatgccactcacatagaaacggccaatccacgatcgttacatctccgctttcgtttccggcaacgacttgaataattggggcatctgctcacgctcgttttacccgaccgcaaaaaaaaatggagagtggccaccatgcttcaaggagaagctcggtatatgtccatcccgcgtgcctgcaaagacaaggtgaagatgcacccggcgaccatagtgtgtcatgtacctgtttgacgtttactacagggtgccatgctttattggctggaattgtggacgcttgttttctggaatacgaatatttccccgccctgtattaattcccttcaagcagcaagctatcttaacaaacgttgtgcggccaaaggaaaatagccgccgagtccataaggggtcttctgacttcaaaatctcgcgcattccaacgtgtaaatgtgcgatcgaaagagaaagcattgacacagggaataaaaactccatcaattggaaagatctctggaatcggtggcaccctgttccgtgaagaagcgaagctttgcttgcggccgtatgctcattactcacccactgactcgttcacataataaaagtcccgctaaaaccctacaatttcgcttccgacgctccatcattccatcatagaaattgacaggtctactgaaatcatagttccacccgttggtgcgtgtccttcctgcaatg

SEQ ID NO: 3185 - DNA, 703 bp, Nannochloropsis_gaditana
tagaactcgtggggccttgcaaaggagcgtgactattgcgcatacgcccatacctaccggaatcacgagccccccttcctcggccacgtcctctccccctccctccgctcattccggccttgcgaacagcttcgccccgcagagagtcgagtccttcctcatcttcatcgtcgagcgattccaagaggaaatcgtgctcatgaaggtcgtccccccctaatgtcctagcggcagcatttgtgttcgttgcatagacgcccttggccccttgtgagctctgttcatcaaagacgatctcttgtgtcatcgactcctgccagggccgcttctctttcacatatcgtgccttaaaaattgaaggatcggtgccaccgtactccttctctttgactgcagcttcgtctgccccttcctgccccccctgcctttccctctcaccatcctcctccgtccccgtttcctttcctccttccctggtggggcaccgggcggcaaaatggtccttctccccgcaccgatggcaccctccccctttgggatacaggcccttttcgttcctctcgcactgggaagaaaggtggccccgcttgccacagacaaagcaagtcgcgtagttgcatccgcctgaaagggagtggagagggagggagtctgctcagacaagggacggagacaaagataagggtgccccgcgccgatcatg

SEQ ID NO: 3186 - DNA, 703 bp, Nannochloropsis_gaditana
ggcatgacgccgtcgactccgaggaggaggagataatgacaattttagaggaagaagacgaagaatcagatgttcagttatcagggatggataagaatgggacatgagtgagtcacatagagagatcttgtactaaatgggttgacaaaaacgtaagcgtgaaatataacgaattgctgcacagcacacatattccgtcccgcgcgtttgctacgtgactcgggtacagtaagattattctgatattcaacataaaaaacaacaagatgaacgttatcacatgtcatccactctacagtgtagtatgacaaaaaagaattgatgtcttttcaacaagaatggtaaacgcgtcttttagattggtggggggtggggaggttagaaagcaaaaaaagcgactcgacacgtactcctgccaatttgcagtgactcacgcacacgaattcggcttttcctccaataaagcgcgcgcaaccaacagtcacaggtgtaatttgcgcgcgtgatcgtcccgttaactcttcataccaatcagtgggccctttcaattcctgtacggatgctccgctggctggtccttctgcccacaaggacaagacgagcagtcccatgcccactccgatcagtacatcaagggattgcatgtgcggtagacgaaggaagaagccaatcaaacgtcctcctttgctgcttggctttggca

SEQ ID NO: 3187 - DNA, 703 bp, Nannochloropsis_gaditana
gatatcggaagatcatggccccttgagacccgaaagcgatgcagacgaaacgaataatcaaggagaatccttgatgtaattgattctcaacgtttgagcgacaaggatggaaaaaaataggattagataaggaatcatcacctgctcgcaagcgctgttacatgaagctccaagacacacacaactgttcttccgatccagtgtccgccgtgacaaaaaggatattcgaatatcaaatggacaaaaaaaagccttggtatgtttattactcgtttcaatccgctcgacgtctagtaagctgggaactgctggtcttcttcacgcgcccaacacgcagaccatgcctctgtctccgcgctttttattcccttccactcctagaacaaacaccgagcacggggctttgggatagggtttctgaacacctgaaaagacacctggacttccgctcgtcggagcatacgaagcacatgccaataaattgcgcgacatggccctgaagagccccccccaaaggtcttgtgtcactacgtgaaagcggggaatgcgcttccattctccccttgctcccgtttctgctcggctcatggtgtctcgccaatgcgtgccatgtcgatgcacgtaagacttgtaaagaacacgcccgccaatagtgcctgataagtctcacacccaaaaaaggaacagacggcctgccttcatg

SEQ ID NO: 3188 - DNA, 703 bp, Nannochloropsis_gaditana
cgtggcgacttcgctaaacaaggccacacacagagagcgtggagggagagagaaactgtgcccttgtcaatctgacggttaggtcatctctgaaggagtaatccggcatgccgtattccatctgttgcactttgagttgaaaacaagcagatggtaatgacctgctgtcgctgtcatctcccacgtccaacgggaaagcgatccggccgggacaggtcatcagacgcacaatggtaggtggagtgtccgttctgtatgcgcctactgttgattgagaaccattttcaaatccagagtaggactctaagatatgagacggggaaaaatgtgcggctaatgatggcaatgggggtgggggtggaatggatgtcgcgggcacgcgcacatcttagggaagggcatttgtgtgcgagatccctggagctcggtaatggtactcgattcgatgactgatgaaattttacaaaacaaatactgataattgcaatgttagtcacatgatattgggtttttgctcttcttcatagatgtaaatcatctgtcgtacctttaactgcgcggggtacttcaaattttctttcttggacaaaataatttgaaaactccacatttatagggaaaaaagcaaaaaaaagtgtgtggcggcagcgatggtgatagaagaaattgatcggatagggtcctgttcgaacagctgtgtatg

SEQ ID NO: 3189 - DNA, 703 bp, Nannochloropsis_gaditana
ctcttgaagtccttcagtaatgccctttctgttggatgttccactgcaaaagcagccttcacgcagttacgtagagtttaagctgtgttggagttggacaacacattgaggaaagaaatttcggcccgtctgagttgccatcatatctccccattcgtccctctctacttgccagggtacacccgcatctcatttagttgggatagatgcagatggttcgggcccggcactatccagtcgtaatcacgtcacagtttcaagcgcgacgcgtcacacttctacgcgcgtcttccctctccccgtggacaagaatttctccgtgcggcgagcaacaccaaaggctacccggagtggatacagccgtttcctcttaaatgcccttaccaagacacggcagccaagggcaatcaccagcgattgaaagaccggcaaattcccattcaagccacataagtcgcttggatgttttttgactatacgctgttgtcatgcttgattttttccagctgcggtggaggccaccaccataacgtcttttttcccgcgcccgagcgaggcaaaacgcccagccgaggtcgacttgcatgccctcaggttcaagttccactcctttttccaacagattctgatccatccgctctaccaatcaaccgcgacttttcgcgccgcgacacatattttattgcattacagggcgcccatg

SEQ ID NO: 3190 - DNA, 703 bp, Nannochloropsis_gaditana; identical to SEQ ID NO: 1781

SEQ ID NO: 3191 - DNA, 703 bp, Nannochloropsis_gaditana; identical to SEQ ID NO: 1782

SEQ ID NO: 3192 - DNA, 703 bp, Nannochloropsis_gaditana
gaatatagtatggcagggggataggggaggtcgaggaagagatgcaatgcagtgcgcaggcaattttttcaaaaacggaccaccacgcccaatttaaatgcaactcaattatttcagtaaggacttttgaactgaattgacggatgccatttgtcgtcgcatttgtgttgggtccttttgcgttcttgcgcccttccttttcccccccagtcaagtcatgctgcagaattagatgggccacacgcacacaggctgcgtcctaacaattctcatacaagtgaagaagtgccattggactgaaactatagcgcgatacacatctctgcattgaaaactcgtgtaaaagtaacctttactgtaggaaagggtgcgcacccacagcattcatttccaatgcactctcccatcttccctcactcttcaaaggccacctctttcttcacttaaccgcaaacggctacctggaggaaatttttctcgtctttctattcgctttatgcttctccctttatcaaaccttggtcgccgtccagttctagctttacaacgtcacatcggcacgtatcccgcaaagttcacaaccggcgcgtcacctgcaagacgagagatgcatttcgagacgctaaccatcgaaacaaatcgcagtgacgcaccaggcgtggctttcgtcacaattaatcgcccacgcaagcgtaatgcgatg

SEQ ID NO: 3193 - DNA, 703 bp, Nannochloropsis_gaditana
tagcaattccctgccttctgttacctctccttctgagcttcccgcccacccgcaaatttgatttatgccccccccctttgcctgtggtcgagacttgccctttaatccagtcctccagttaaagcagaatgttattcatttcaaagcagagatgtgttgtcactatccatgtcccttacaagccattaccgtccacgctgggatttattctcgacagcattggcctccacattatgtcatcgggcccctagtcgaaccaaacccctggacgtcgtgttccataatcctacttccccacccagcgacgaaaagttcccatggtgtttacacctgctttgaagcgttgcgcctaggttgtggaatttgtttggctttgtggcgcaaggaacttgtgctctcctcgccactagcatacctcttagggccttggtcgttcttaccagacaagcttctcgcatgctccgagctacatcatttgtgtcaggatcgccgtgtgataggccgccagataaaagcaacatgcattcgtgttttccctttcataattttctctacattcatacagcgccagcaatttgtcgaggagagcccatttacttgccgttcgtcatcacatcgcatgccgaaagcaaagacatccaccttgaatcctagctctagcagcgtaagcagtaagagcagtgtcggacgcactcgctcgatg

SEQ ID NO: 3194 - DNA, 703 bp, Nannochloropsis_gaditana
ctggatggccgagacaggccttctctcgctcatcttcgcggaatttcccctccctctcggcccagaggcgtcatcaacgaagtcacggatttctgcctgaacgtggcagcgttggaaccgcctcgctctcggacatacatgcctgctgcctttttctcagacgtgcttgaggcgacgccggaggaagaaggagggggatttaagagggaaggtgatatctttcgacattgcatctgtcggatggaggaggtgaagaattgcgcaaaaaatgagcgagaggatgggatcgctttccgcgaggccgttgagagcgtagagaaacggtgaggagatgagaacgaaaggaggggaggagcaagggagcgggcgggtgtctgacgcttgctcatatctgctcagggctttggagtacaaggaggagatcgagaaccgcgaaatgcattacgccgagcaggtcggtcgtctctcttttctccgagcgctttcccgctcttctttcgtgctcagtaatcactcctacacagcaaattaagcgtcgcctcccatatctttccctcgtcctccttcccttcctccctctccacctttgcccctccctccctttctccgtcctttttcggacctacaggtcgaggcgaaagccgaagaggtggaagagaacaccaagctacttcacaaggagcgagtcgttttccgcagcatg

SEQ ID NO: 3195 - DNA, 703 bp, Nannochloropsis_gaditana
ttcatcttttggacaataatccagctatgttgcttctcgttttcaaaggtccaagcccgttgacaagtagacctgctaatgtaggaatttaagctttttgtaggatgatgaaggaaaggcaagacactgttttttcattgtgggcttatttcatatctacaatcgttcttgcaaatgcatgcaattctagggatgccggtacgcaggacgctcgtttcacttccacttcagtactgtaagacgactgtagagcgcccgaggcaaacacgtccgcgatcttgatcaacattacctctgcccatcacaaaagccgctggtaagaaactctgacactcatttcgtccttggatgttgtcattcgatgcccatttacgtgctgtggagtaagtaaaagcgtaccaaatagctttggggaggtcgatcgctaagactcgcggaggcagaaacgccgaaacgacgtctttcaaagtctttgtcttcccacatttgatatgcacgactaaggacacactcgacatttaattatgaagaagcgggttggtatggtcgtgcgcgccacgttggttggaggggaaagtgataaaaatgattgttgtttaagatgtggcggtgcagcctcctgtacgataatgaatgttgtgcatgcatgaatctcattccaaattgactttctttttcgacaagaaacaggaggtggaacatg

SEQ ID NO: 3196 - DNA, 703 bp, Nannochloropsis_gaditana
acacatggagaatatcacgacctcttcctcgtgcggcaaccacgttgtttgcttcacctggggacgctcctgctcattctggctttgcggtggacttttcatcttatcaagccgccctcctcttcgatcatcccaagccccatcattatccttgtcagatttttttccactgcaattaaatgttgtgacgattttccgtattgcgtcccaggttctcatgtgaaacctttcctagaatattgaaaagaagatggcagttgcaaataaggacgcttccctagcgcgtgacatcgcgtgcgccaaaatacgctagcctacttctactagtaggaagctccgagtcgaccttgctcctctgtcgtactcgtgttggggactgaaaaagtacaagggggaaatcatgcccacgtactccaggcaatgtttgtgcttacttcactgatcacatccatttttgtggcaggcgtcgttccgataaactcttctgcagaagcaaattcttgtgctcgctcactttctgatgtgaagcgccttgttctggctactaagcatgatcgaggtggccgctcctcctaaatcccgatttcctcttcaaaacaccattgttacacagggtctatcatttgagggctttgtttgtaaccatggaacacgctagcaagccaagtccaggtttgatagtagaaatgcggggcctgcgatg

SEQ ID NO: 3197 - DNA, 703 bp, Nannochloropsis_gaditana
cgcagggccttgtctcatgggttacataccgtgttgtgaaagggggagtccttgctggcgccttgcccccccccgtctgcgacggttgagctcatggcaaagtccctgagcgccaagatggagctgtagccataaatgaaagggccctgttcgtgtccgttataacatgcattgagtccctgagaaagtttttttgggggggaggcagctaaaaaacggtagatgggttgaaaaagtgtgacgtgtgtagggcgcaaccgagacggcagcttaagcgaagccagcgacatggcgaaaaagacgcgaaacaggaacacacggcttctggtgtccccacacggcaatgtaggtcaaattgacaagctgacattccctacttcgaatcattacttcgtaaacaggggtgaatcacaggaccacggcatggcaggtatttcctcgatatgtccgtagttagacgccgaccgatacacgagttttccagccaccgtgccggtcgccgtgccgtacaaggcgtaagttggcattgcaaagttgccctgcctgtatcaggtgaccccacacacgcatcggtgtcgacatgatcaattttcaatcaggtggaggggcagttgcattcaaagctccccctgtggtggcggcaatcgtcactccagctcatcgcaagccacgaacccgaaaccccccgaagacaactgtgatg

SEQ ID NO: 3198 - DNA, 703 bp, Nannochloropsis_gaditana
tttaaaaccgaaactttaattcttttacatatgtcactttttttgttaattcggttaaacttattgcaccctttcttcttgccactcttacatctggatactatttttttaggtttaaaacattccacctctttttgaattcacgttatctgcgcaaatctgcttatctctacacttcttacaaataaacacgtgagcggcaccaaaaaagtatcaaaagaattttaaattattgttggtcccactcaagaatttcttcagctatcttgggctcattatctttagtctggaccattatgtggagaatgtgacgtgtcttcaagcacgacgaatggtaaagagcaagtcgcacttcaagttatgaaggccagtcagtgccatcccatcaattatttacactcatgcattggaagggagaaaatgaatgcctttttaatttattaaagggcaagcttggaaaattttcggattggtaacgggtcgtcgattcaacggttcgtcctcgctaaaaagtcgaggaattcaaaaattcccgcggccacacgtagccgccatgccctcccattttcttgtctttctcgacgtacaagaatggatatggcgattgtgagcgagtatacatcttgattgcgctttttaagacccgatacctcttaccttgggtttatctcatatatatcttcaggaaaacttcacacccatg

SEQ ID NO: 3199 - DNA, 703 bp, Nannochloropsis_gaditana
gccgtgtgagtagtgatagaggccgcggagggagcagtagcggaggcgggggcggggccagtgggaggaatcctggtggaggcggcggagcgggtggcggcagggacggggcgggactgaagaagaaccatgtggtgatcggcgcggagaataagcggttgatgctggagcttttaaagcagctgcatttgacggatggggacggggacgacgggatgggcggcgccgagctcctgaatctgctcctcaaagaggagaagcgggtcttcctggagaataatctcgtaaacgcggcgacgaagaagtccgcggccgtgcgacaaaaagaggcgcaacgccttgccacccggggccggtcgtccagggtgcaagtaatcatatgcgcatggcaccacccagagaccactcagaagcgggtggtggtaggccgcgtccccaacctgaccacgcttttcgaggcggcccgtgacaccctcttcatcaaaagacccaaggcagcctttgtcctggagacggggctgtatctctcggacaccatggccgtggagcaggacacggtgatatgtgtgaccaccaaggtcccggaggcggccggggtgccccttcccggcggtgggggcctggtactgcctctgacgcccgccgagagggcggcgcggagggaagaaatggagcaaagcaaggctgcggcagctgcggcaga

SEQ ID NO: 3200 - DNA, 703 bp, Nannochloropsis_gaditana
tgctcgccacctcccccctctcaccttcaggcctcacgcgaatgaccgctaaacctgctggactggggctgtcatgcctcactcccacgcataagagatgggaattgcttgcgtgatgctttgcggacaatgcaagtgcccgggacgcgacaacgaagcttcgttcgtctgctcatgcaccacgtccctttcatcccactagctctctttcatcgcactagccttccttttccttccgggcgtgtgacgcgtaagcccccagccccataatggcgccgtcgccacctccttctagctcagagaagggcaaggaggcgtcagacccgcccgcaagcctggctaccactcgcaatgtcgtcatcgccgtcctcgtcctcggggccgtggccggacaagtcctagtcgcgcgccgcaatacgcagaccttgaaagacatcgcgaaacggacaggggttaaatttgagaaacctcctaagagcaagaatgatgacgactggttttgatcgtgtctcgtcgtcgtgttcctccttgcaaggacgtgtgatgtgctcctccgtctctcagtcccacgagacggaagagatggaaataaatgatttacagacactttgggagatgaaataaatgcaaagaaataaaccaatcaacgtggaacaaacacattgtcgacagggataagggatgggtcgagggcctaacgcag

SEQ ID NO: 3201 - DNA, 703 bp, Nannochloropsis_gaditana
atgtgttcacgaataggggtggacacgtccaacaccatctcatgagagaaccccagcgcgtgcagacatcgttggccgttgggactcaagcccgtacccgctccccgttgtcgatccaattgtgacgcacgttcgtatacagtgacatttatacccttgagtcgaagggcattagcaaccgcaagccccgcgatgcccgcgccaaccactacgacgtcctgaattttgggttcatggccatcggtctggacgtcgggctttcgaggtgaaaaagccatgcaaatatgaagatgcctaaaaaggggaatgcatgagacagcggcaatttttcttggagatagaggtggatgtgagtaccccagtttggcggcttgtgtgtgggccatgctatttcatagctatcgcttcttgagcgaacgcggatactgctgcgctcgcttaagcaggctttagtgtgcatgttgctccactagtaatcattcattcagaacgaaacttcacctccgttcgcaagaccggtcagccaaccgcttcgattgatgcatgttgttgcttagatgcgtggttggttgttcaaagtttatttcctcgacgcaatctgcacaggaaaagcgtctcctcgcttcccttcggcttctggtgagtccgcctggattcatttagcccccgacaccaaacttaattttcgtccgaggccaaaatg

SEQ ID NO: 3202 - DNA, 703 bp, Nannochloropsis_gaditana
ggctgaaaagttctgcgcggcctcctatcagtgtacgggcgacgacggctgtgatcatcgttcttgtcgccagtgatctccctttcgctcgtgccggcagggcttgggctagacggatgtgcgggaaaagatgccaccggcgggcctgatggacgatgcatggggagaccctgtcggccaacttatggtcacacgccaccccttcccctgcacctatccagaaatatgccatgatgaatcgtgagttttgagcggcagtcagaatgcgggtcactagcacaatcatttccactgtttttggactcgccctctgactgcaacccatacccttctcacacgggccgtcgctgttatcgcatgacctcctgcctacgtgctaagctgacggtggcgtggagagttatctcttaaggacgcgatgtgtccgccctagcaggtacatatttgccttgaaagaccggcctgcgcgtacgacagagcatgttgaggcacgcgtttggatttacaatgtcttcttatacgtagaggactggcgggcaccccgacgtcgcaacacgtttttctgtgaccttctcctcaccaaccgggcaggcaattgatttacaggcttgattcgctcatgcgacgcgttttaaattatcgacatcatctattttattcctttctcttactttttttctctcccgtaagcccgaaaggtatg

SEQ ID NO: 3203 - DNA, 703 bp, Nannochloropsis_gaditana
gacctatcaatctcgcccttcttgaccgctcgcgtctcctgcgatgtgatgtgactgacgacatgcctgtctacgttcccgtctctgctatgggagctctgcaagcaagaataaaacatgggaaaaatctcactcatgtctttcgccagctggtcacgtagatggaaaaaagattgtgcgtgactacctgcccattatgggttgtgctctaccttggatggtgaaaaagcgccttttgtggggagttgaaataacctcctccccctgtgccaggtaatgtgaaggcctcagcacgaagcataggcgagcacctttttttttatatttctgtatggactattgaattcaggactaaggcgtgtcgtttttcacatgttgagcaggcatatcactgatatgtcacttgtgcgacggcgagtggtggtatcaggtatagggattataagcccgctggggataggtaggaaggcaacatgggatgccctgctagccggtcgaatcggggtccgtgcattggacgcagagaaggacaaaatacctgaattgcctgcattaccagctcgggtgagtgtcgagtgaaagaatgggtggtctgcgaccagagtttttattttctaggagcggacgcaaacgctctgaactcggggaggggctttttactatccccgacacgtttcgtgacacctctttattcacacatatg

SEQ ID NO: 3204 - DNA, 703 bp, Nannochloropsis_gaditana
tgagcttcgtggccttccccgcgaaatgcgcacagggaagggaaggtcgtgtagatacgctcaaggcctcgaggcccgatgacatggtcctccgtgaaacgtggccggcgttgcttgggcttaacattgccgacagtagcagcttcagcgtcggctttgtccattagagaggataatatttcatcatcctccccagcacccatgttcttcccgttgtcttcctcgtccatatcaccttcgcgcccgtcccctcccttgtcggaatccacgctgctgcgcggtcctgacgaaacacgaaccacatcagcctccgactcatcactgtaaaggtcatcgtccaaccttgccatgctggattagaaaggaaagtccctgaggcaatgagcattgaaaagggagaaagaaaggcatcaaggtgggggcgaaaacgaacccaaaattgccacgcaaaccagatttgtcagcaaggagcccctagaccaagcgcggtagaaaaaatgcattcgtatggcagtacgcccacgctggtcaaggctttggggggtcgcgttggtctgatttttcttggcgagagggcgatgccacccttttatctccacattttcccgcccaggatgtctcccaccgcacgaaaacaaaagtgcaacctcacgcggtcaagtcctttccacaccggtacgacctcacgccttttcctcccaca

SEQ ID NO: 3205 - DNA, 703 bp, Nannochloropsis_gaditana
ggcctacaccctccgcggcgacgtgaaaggggccgagggcgtgctccggcgcatgatctccgcctacgtggcccccaacgcaaacacgtacaccacgctcctgcacgcgtacacggtgaacgggaacgcggcgggcgccgaagaggtcttggcgcgaatggaggcagccggcgtcctccccacggccctgaccttcgccacgctgatgacagtctatgcggcccgcggagaggtggagtccgcgaagggggtcttggccaggatggaggcggcgggggtgggccccacggccatggccttcgacacgctcttgaatgcttacgtcgtggcgggggacgtgggcggggccgagcaagttttgcgtcggcgggaagcggaagcatacccggatttccccctgacctacaacaccttgatgaacgggtacgcagacaagggagacgtggcgggggcggagggggtgctggcgcgcatgcgggccaaaggcgttgggcccgatgagacgacgctgtcaaccttgctgcacgcatacgcggaggcgggagaccccttgggggcggaggcggtcctgctccgtgtccaggggaaggggggagagaagggggacgggggagagtttgcggggctttcgctgacggtcttgatgtttaataccttactgagtgcctacgcggcgcgcaaggacgtgaaaggtgcggagcag

SEQ ID NO: 3206 - DNA, 703 bp, Nannochloropsis_gaditana
ccaacggagtggcgtgtgtaggaagagggagggacctccggtcgaggtgctcatgggccgcgacgaggcttgcaacatggtgtacagggcccgtatcgacatgtatatagatagatcattaaaatgacggagtaattttgacagaatgccgcccttacttggcggcgcaaatttttcatcttttttgcaaggccaatcaattgcaattaattgcacttcgcatcagaaaatgtgcgagtaggcagcaggaggttaagcgagctgcctctaggaggtttcgacacctgtataggtccatccgcagcttgttttctgggtgcgtgagggcgtgcatgccagaccatagctagcaccccgaagtgtcattatttcttctgtgagaagcttcgcgaagtttgtttgttgtgagcgtcatctgtggggcacgctgagaggtgtgttcgccgttttccttttattctttgaaggccaactgactagcatttcttaccatatactccacaattattcaaggtaaattatgatttttggtcctgtcggcagatcggtctccgcggtggccacctttgcgctgctctttcccgtttctggaatcgcttcctcgcatttagcgcaagtttctacatcaagttccagcagcactatggaaatgtcatctgccgcttcgaaaccgcggtctatcctgaatacaaacacgaacatg

SEQ ID NO: 3207 - DNA, 703 bp, Nannochloropsis_gaditana
ttgctgcttcattcagtactactagtccggtgtctggcaagtgagcccccaattttctgcgaccccgaggtcctcgccgtatgtccccacgacacgttcatcccctacgaggagttctccgtttccttccccgtgatcgaatactgcatccggccaaacaatgaaggctttatccctgtcacccgggacacatgcgaatcttttgtacgtggtacctggactgtgcgccctgaatgggccgcacgccgcgcgtcacatacgctgcaggagcaatacaggtgcacggtatgtcaagcttacaacgcctcagcgctcgtcgcggacaaagctggcgtctggatttttaccctccataacacgggcagctactcgaccaagaccttcaaacactggggctctctcttgggggacgtgagtctaaaccagctggtcgtctcagggacagggaaacgctatttgttcgccctggcctcctacgcctcggccatgaagcttttgaacgcgtcaagcaatgtcctggccgcacagcctatgcctgaagagctgaagatctccccgcgcgtggtcgaccgtgcgtcggtaatcgcttcctctgttccctccccgtcgcagtcggacggaaggggagagacctcgactctggccatttactccttgatcagcagccacacagacaccattcttcgagcctcgtaccacgatg

SEQ ID NO: 3208 - DNA, 703 bp, Nannochloropsis_gaditana
  misc_feature (1)..(689): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccaaatgcatg

SEQ ID NO: 3209 - DNA, 703 bp, Nannochloropsis_gaditana
  misc_feature (153)..(162): n is a, c, g, or t
cgacgggggccaccgtcgcccggcatcgctttgtgcggagccagcaggaccaatgggccggccttgtcagctttacccatgcggacgcccagggagagaaaggaaggacacctgtggagaggctcttggcagttttggaagtaaaagcccgannnnnnnnnngcgcctggggcttgctgccctgtcgccctctcgctcgccggctcccttctttgtcccccctcgttcccacctctcgggacaagcaccggtgtttgtcgcgaaagcctccctgggcgagaagggaggggaggagaggagcagcctgaagcccgttcctggcgatcgagagcgtgcctttccctctggcaaacacctgggatcgatggttacccgcaacagcagccatagcgtctctgtgccttcattcccccctgtaacggcggcgggcggagacatgggggaaggtcaaacccccttgtcgtttgactcgtttagcgaccaaccgttcggcacgcggcagtaccggcagttcaactctcccgacgatcttttgtcggcctcctcgctccttcttccctcccaagcggatccagggggatggttcacggggagaagcacgttttttttgggggggggcgacacgagggtggagaaaggagggaacggcggagaggaagagaaaggggacggatggggggcgggggacgtgatgatgatgatg

SEQ ID NO: 3210 - DNA, 703 bp, Nannochloropsis_gaditana
acaggaaaacagcctaattatgctcaggtgtcgaacagagaaggatatgaacacttgatgtaggggacattgtttgtcccacgcatgacttgaaaaattggtgtgatgttgccgtatagtgccttttaatgaaccaccgcagcaatgaaggagaagcaaatgatcgatgatagccatggagcctcgcaaactttttcgtcggtagtaataaagaaattgctttatggaacgtcaggggtccaacctcctccctccacgaggatttttataccaaacctgctttcccgccaaagttttggcgcttggcttgcagcatgacgtgcctgataaatatgtatgggtcgtattgtccctgtgtgctttatttttcatgctagcaactatagtcggcgtactggcccatatctattcgcaacggcagccaacgcgcgtctcgccgtcgtcgctctccgtaagatgaggcgaccaaaaaagcctaaaccctcctcctacacagaagaaataagggcttcatcaatacatcgtatcctttttatcatgctctctgcctttgcattgttgtgacacttacaggatgagcatcgaggcgcggacacaaaatcctgatcttttctcacaacataaacctttccgtagggtaagacgaaggcacaggtagtgttacccgtggccgcgtgcgaccgggcaaggtacacctcctatg

SEQ ID NO: 3211 - DNA, 703 bp, Nannochloropsis_gaditana
gcacaaaccagaagatcaagaaaaatcgggtggattgatgacgaaggaagagaaatcagcagcagaatgtgcacatgatgtcaaagggcctcgcgcaatagtatcttcggggatcttggccatccaaagtatttactggatatatggggaaaaagcgagaggaagcgagagacaaataagccctttccgaccgcccctttccaaagcaccacacagggtgatggaaaaaccccgcgtgcaccgaagtcgtgcagatgctgaggacatttcgttgttcgtctagtttgcagtgcatcggtggggtttcatggcgccgaagtccaagaaagtcgttttgaggaaaaagggcgaggagtgattcaaactttttcttgacgttttgcggcgagggggggccacacgcccataccaaataaatcccgtcccgcccgcctcaaaaatgatatccatcaagcgtgcatgtgccggttgacgtaaagtgatttgaaagaagatggctgggtgcattgaatgcttgaattctgctgttgtgcgggccgtgagatttcctcgtctccgttagcttgtctttgagagacattaaataaagcccagtctcttcctaggaacacacgcccccccaaaataccacgcgcccgtttcttttacgcttagcagatccttctcatctttccacaaccaaagaatccttgcaaaagccatg

SEQ ID NO: 3212 - DNA, 703 bp, Nannochloropsis_gaditana
gggggcgacacggcgtccggtgctgcgagtggggggggagacagagacgcggccaaatgccaggacgcatgggcggcagtcctcttcctcgcccacttgggcttcatcgcttacctggcttttgcacgtggactgaaggcgttgagggaccaagacctgacgacagacacccccacgaccgaagaccccacgggcgagcactatcgcatcgcagagagcggcctcacctccgtgtacattggtttagccgtcgtcttgggggcggccgccgcctggtcggcactctggacgggcatcttactccggaacgcggctcacatcatcacggccgcgttgattgggagcattatcagttcgggcgtgggcgtcattctggccctcgtgtacgggaacttcgtgatggccattatggcggggctcatgggcgcgatccaagtcatgtggtattactgcgtgagggaccgaattcccttcggtaaggcttgcgggatggacacaggaggcagggaaagatgaggttacttgtccccgcgggcataggcggtatcctcgcgggggcctagttcgtcttgacaggtacacaagcgctgacgcattgctcccctcccaccctctcccttttcactcgcagcctccatgaatctgaagtgctccgcgaccgccacccttcaatacccttccatcctcttcctggcggctgtga

SEQ ID NO: 3213 - DNA, 703 bp, Nannochloropsis_gaditana
  misc_feature (541)..(550): n is a, c, g, or t
atgtgcgaggggcccgggcgtcgtaatggctgtggcgtcttttgtctggcgcgcattgccatggccttgcaaatcatgtgcaaaagaccgagagggcatggaggaatctgcagctagcgcgggaaaggatgaggggggcgaggagagcgctctatctgacgcattgatgccggtggttggaaaggtgcttggggaggaggaagaaaaggaggaaagaaaaaagggtgtgggcgtgtggatgaaggcagtcgtgacatgtcgcggccaagcccgagatccgtcggcgtttttcgcgtgagaatcaccgtgtcctttccgttgagagaaaggccagcctcctccacttttgcttagatcagacaccgcagtcatgaagcccgtggctccactatccgaaaggtaatcctcctcttcggcccctccacttgtctcgcgatcattctcgtccccatcgaaagggcgtcggtgagccgacgcccgcccttgctccggggggaaatgcaagtcgtgcgacaccagccgcgctcatggcatctaatgnnnnnnnnnngcatccaagcgggtgggggcgagcgcgcaagtggatgtgggcttgaccaagacgggcgagcgtctcacggatttcacctccgccaaggcagaatacctggggggccctcccctccccgcggtctgggcgggcggccaccagattttcatcatg

SEQ ID NO: 3214 - DNA, 703 bp, Nannochloropsis_gaditana
gcctgccacgacaagaccgatgatcagccacattaccctcccagtatgtcgattaccggtaagccttccactgcttacgcgtggcctgtcatgatcgtggctacccatttttgtcctctcccagcgcgctatgttgcacccgcgcctcggcgcgttgtttgcatccaccattctccacgctgtgtatcttgagcacttcagcgcccaaatgcttaccaccgactccaaagcgtaccctgttaaatgacagcttttgagtaagcccttgtcctgtttctataaattcgtacgcgatgatagaacgtggacgggaataaccaagggcacaaaaggaggcaagttgcagtccgaaggcaagttgctgcagccgtccactcggagaggaaaaagggtctgcttgcgttcaaagccactcgcaggcctatcccacgccacgataacaatgcaaccgtatggttctcaacaaatcagtcattccattgaaatagggtcgggtcgagtttatatttaagtatgtggtcaaagacaaggagtggcaatgcctcattcctctctgggaacgggcgagcagggagactcgcccccttcggccctccgcttcgggtgccactttcctttgaaagcaggcgtccaaccatggcgaattttctctccatcttaaaattttctgttttcctccagtttctaggttctaaacaggtga

SEQ ID NO: 3215 - DNA, 703 bp, Nannochloropsis_gaditana
ataagcacaggaagggtcttgacccagggccccctcggattcctcgattcacaatagcaaatcgctccctagaacgtaccgcgacacaataggctcatcaagagccccagatggcgcaactccttcaactgcagtggaagacatggcccgcttattcacggcaacacacggcgcggatgacagcgagactcgcgactcgcattcgaggggccgctgcagcatactcggtggactgcgagcaagtggtggagaggaataccggctaaaaaggcgtcgcagcatcgtcgatgccattgatgacctgtgagagttgatgtataagattgtcctatccagtcgtttttggccgtttgaggtgtcaaatcgaaccgggaaattcccctgaaagccggggcggcggtgaggggtggttgggcctccctgtccccctctccccttcctggacgttgccttcgtccttcgtccttcatgtgaacgaatcgataggttctgtaaccacaaaaatccttaaaatgagaattaacttgcctctctcatgcgttcacgtgtgctctcgctcagtggcgcgcatgaatgtagggagacgcaggccgtcaaatgcagtgtccgccctcacctccccctccttctgcttcagctcgagcgctttacagggtcagcttggcggcatctgcccaagctgggtagggtgcggcccgtgatg

SEQ ID NO: 3216 - DNA, 703 bp, Nannochloropsis_gaditana
  misc_feature (1)..(699): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcag

SEQ ID NO: 3217 - DNA, 703 bp, Nannochloropsis_gaditana
  misc_feature (1)..(153): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcattgagtagtacagacaagtctctgaggtccccaatccaaggcgtcttcctacacaaacacgtgtccttgatcatatgggcccatcacgcaatacccaagctcttggtaatcgaatacggggtaatgacagatttggactccatttgaaacccggttcataattgggaaagcaagacatgggagagttggggcgtacgttcccacggggcgtcaagtcgcatgggcatgcgagtagcgaaggcgccgactggtcatcaaggacgtgttcatgtccttgcacaagcactcgctttctgttttcgcctatcgcagggtgggtgagcttgacatttgaagaaggcgtgccaatatatgcgggcatggccgctgcttttgttaagcttctcccttgggaaggaaggaagaggggggagtcgggcggtgtaatggaaaaattactcgtaggccccttctcatctcccctaaatgaattaagtagatgtctcagctcaccattacatgccagcgttcactaggctgacaataccgccgaacagtcgccatg

SEQ ID NO: 3218 - DNA, 703 bp, Nannochloropsis_gaditana
aaggactgcgaaagaagcatccgcggggaccgccacagctttttcaactcggaaagttggccttgcacaatttcttccatgcttattcacgtgcttttcccgtacggcttcggctggaaggaagaaagggccgcgtttaggagagggagtgaatggaggttggacagaggagaggcatcagttcgtagaccaccagacgggcaggagcttgaggaaaaagcgagacaaggcacgtattgcaacctgccaaggcatcagcaggcattgagggttccacgcaggacgctgcaagtcccgaagccagagactgcgcgaggtcctggtagggagagtggaggccacagagcaagggagcaatcgaggggtcgtaaagcatcacaaggcaaatgggccgggggaggtcggaccccgggcgatgtttggcgttccgctggtcacggtggctacattgccgaccagggcagtgtgtgattcatttgtctgcgcagttttatgttacgtgtggtcatgctttaaatcgatacttgtgtatgtactcctacagctacatgcctccgtctggtacactgtgcacccaggcctctgtcctcaacttttccagatccaaagcaataacctggacccggaggaacaagctatcctgccttttcgagccctcttggcattcagacatcagactagagactggaagaaaggtacgggc

SEQ ID NO: 3219 - DNA, 703 bp, Nannochloropsis_gaditana
aatttgctaaaacaacgagctcatgtccgtaagccaggcattttgcaatgctgaaaacgctgtccttaccgccgctaactaatgcaacaaaccgcattctagggtggggaggttaaacaacaatagcggacggctctccccgattggaattttgggaatttatgaggagaggtatctccagcacttgtctgtgtgtgagttttatttagttgatcgatatattaatagttggtgagcaaatagggacaatgtactcggaaagagcgtaggcaaccttctcgcctgcagagcaactcaagatactgcacctggcgccctgcagtactgcccgccatcctcttttttcgtacgcgagcacttatttcctctttcaccactcacgcaatagatgtcaagaggaggagaccctttgccacacccacagcagccgtcaccttcctcattgtttcccttatctgcgttctcagcatcgtctcccccaaagcgagctaccaactacacttggaaatccaggtcccgatactccgcctccacgctgctccgtttgcgattgttgctgccattatttatcctactagagatccgaccggtcaacgcattcacatcgccatttcctcggtatcgcttccacagtgccttttcacttggctcggcgcggataagattgaacccttggtctttaccagcaagcaccctcatcatg

SEQ ID NO: 3220 - DNA, 703 bp, Nannochloropsis_gaditana
aagtgatgagcgagagggcaatccacatcctcgaataagggcattttgggactcactgttcctccttctgccagacaatgcgttgtgccaccaatttctgctgcagttgccaagccaaggagtaaggaacaagacctagatgtcaaggagtaagggacaagacctgaaggtaaatttgtaaaaatgtgacggaagagagcaaccgcattcaacgtcaacttgacatgcttaccttggatgttcagggtagcgacgcgtcgacgcagtccagctctcatcgtccccactaaagtccctgctatcatggctggctaggtgccgcctaccctacactgtgttgcgtgtcgggataaaccgatcaaacaatgggaaactcgatgctgctaagagaaaagcttgcattcagtcctgctcgggctcgaggcgcgaagagaatcatcagactggatccatagaagttgtgacagaccttgacggaggtccataatacttcttttgtgaatttttcgaaacaaaaggacctctgaatattcaattcgccagaccactaagtcttcctcgtaggatccaaccccacctgcggaggcgtgctcgacctcccggcgggcagactcgactcggaggaggaagctcgcactgcaactacctcttgatgtcgacttattcgcacgccttaatacctacatacaggtaacgagccatg

SEQ ID NO: 3221 - DNA, 703 bp, Nannochloropsis_gaditana; identical to SEQ ID NO: 378

SEQ ID NO: 3222 - DNA, 703 bp, Nannochloropsis_gaditana
ggcctacttcgccagctgttgcacgacaaggaaaaagtcaaggagcctgacaaggaaaactttgcgtcgctgcgtgtgatgtggcaagggcaatgtctgggacgaggaatgaggttttgggactccgacaagaaggaggacgtagtgctgatcgagtctttcgctttgcgggacaacgaggccccgcgtcccggctggttcgggccacaggcgcctgagcagacaggcaacgaagacatgatgggtgtgggcagctacgtggtcaggggcctgggggctcgacgcttgctctccagccatcccgtgcgccatgcagcctctggtgccgtgagccacgtcctcgtctcccatcggaccccgctcgtctctcacttccacctcctgcaggcggagggtggcgtggaatgtcgcgtcagcaagggggatttgaaggcgtacattccttccgagtactggcgcttccctccccgcagtcccgaccatgacgtcgggagctggtacatcgagcgaacgggcttagcttctccagagacggaaaggactttgcgggcgaagctgcggggcaaaatgctgccacctgtggtcatgatgttggtgtgtgccttcaaaacgcttgataaggaggagcaggaggtcggaaaaggaggagggccgtcgcggttacaggagacactgagaggctgggtgcaaaggatcatgtgaa

SEQ ID NO: 3223 - DNA, 703 bp, Nannochloropsis_gaditana
gcgtttatggcctttagtaatgcgaagcaatcggaatcaccttgctgcttcgccaaagacggaaaatctcgatcgagtggcgcttcaacgtatgcttaaaaagttagaagtccgctgcttgcagctgcttgacaccaaatccatcccacaaaagcattgaaattctcaaatatggggaaccaaacgctcatccaacccatcccaagccccaggcttgcttctgtcgaatccgcagcactcagcacgcatgtgtagtatcttttggataaatcattgcaaagaaggtgtataaggctttttcccggaagcaaaagctcccgtgggcactgtagaaacaaaagtgaggtgatagttatttttcgatgcacggaacggtatatatattcgcaaagcttgtggaggctatcgctgtcctttgtttgaagcagtcttcagcgaagctgccacggagcttcgttcaggaccgtttcttggcattcaaaactctacgactatgatactatcgagcattccgcatgattacagcgcaaagcctaccaaaaagatgcggtaattcacttgcgggaccgcaatcattgtcagccatcagcgcactgtactcgtaaaaaggcgaacattgtccggtaactcgctcatgtctcacttgagctgatgtcctctctaaaataatagggtcggtcccaaactcttttaaactccgatg

SEQ ID NO: 3224 - DNA, 703 bp, Nannochloropsis_gaditana
tactacacatagcctcacatctccccttgatgtgcacgtcggacgtaaaagttagtgcctaaagcttttcgtcaaaacatgtttgaccttttaacttactttcatttgcgaaaatagcagggataaagcgcaccctatttcttgaacccacaaactttctgtcttgtcatggatgacgtattgcgtcgtgaaatgttgcatgagtgtgaactgcacgggcttgtagtcgggaggtcaagcatactaaagcaccatgatgtgaggggaaaggtcccttggtcgggatgatatgatggaaaaggtacccctcgaagccctcgagactcgagtcgaagggccacggtagctgatatgatggaataggcacctccctctcagggcctcctcgagcctgcgaagggcgaggcgagagagggcaaagggagagagcttgtgcccgaggttgttgtccgctttgtgggcgccctttcgtacgtcgacaccggcctgcaaggagatgaagagagcagcctatattttgttccatgtcgtggggaagcagacattcgcccacacaagcgttcacgttcggtatcccattgcccgacgtatgtcgtactcttgctgcccgtcgctccgtcatcttcgattttccaattctcaccgcagcatttctcatgccttctcaatttcgaatcatctcacaaaacagcgtcgacccatg

SEQ ID NO: 3225 - DNA, 703 bp, Nannochloropsis_gaditana
cacgaggaggaggagtccactatagcatgggtacttggcccatgcccgggtctctcccatggttgcgtctgagattttgaaaaatgtgccagggaaaggaggagatggcagtgggatgagactatgatgtgaagagtgacatgatgtttcctcgcacgtagggaaggaaaaatgcgtggttcgttcgtccgttgtcgagcacacagcgtgacttcatttcggccagggggggggccttatcgatcaaagttcccgacgacagcgtctcgaggcgacgggccacgaccgattcttctcctggacggccgccgcccttccatttcacgacgtgcggggaagtggaaggtcggctccatcactccgtatgccgtccgagtttgggtctggcggttgtggtgagggcgtggacttcgcgtgacccggcaggccaaccgaccgtctctacgcgtcgtcactcgcttgaagaagtcccaagcggcgaacgaagcctgcaagaggacaaggcccaccctctgcatataacctgacgcaccggcacattctcaccacgtcacaggtcttggacaaacgggacggtgtccaaggatcgaggagcaggggaataaattcgtttgaacgtcgcctgcacctcccgctggtactacccttctcctagccctcggtgtggaaggcctcccttcaaatccactcatcagcaatcatg

SEQ ID NO: 3226 - DNA, 703 bp, Nannochloropsis_gaditana
cattttcctcgtcatcattttccttacgcagaggcccctcctgactttcaccgacatacacgtttgattctttatattttccaacctccatattgatgctgtccgtatctcgcgccgtgactgttcgaataagagaggcagggtggacaggaaggggttggtgagggggggagaggaggtgaaggcaagccagtaacggtcgaggaagaattttaaatccggactgctcaacggctgggtcgacgaccgatttgctcgaagctagagctctacctacccagattgtgaagcgtcgtccgactaaattgtcagatgcatgcatgatcaatttgggatagtctaatttgcaacagtcgagtttctcatgcggtccagattgtgggctgctcaagcattgctgtcaacggtctcatgtgctctatccggttccgaatcgcgcagtctttcgtacttgatgtataccgttgcagcgtctttattgtagatgtaagacttcaactatccacatttgcatcctgaatcacagtacactgcaggagattggaagggttttcctgcacgaccatattgttgctcatcccattttgaggatcgacttggctgtccagccgacagagaaaagctgtccttttacgggttttcactgcttaaaagataaatcaattgtaaaatataaagacttttattaatacactactccatg

SEQ ID NO: 3227 - DNA, 703 bp, Nannochloropsis_gaditana
tcaaacgtgccccggtctttccattcgtcaggcttgccagaatttaatccgcccctccatcccaccctcttcttacctcgtgctcccattcgtcaacgccgcatcccagccccgcaggatattgcctgtcgtcaatgtgtcgtccaaataactcccctccaagtcgaaaatttgtcgttcaatgttctgcagctccgccttgagtctggttgttgatttgggacgaaagagagaggatgtgaaattcgatacacctcctccccatacatggcttttcctcgcattctccgcccaccgtcgatcatagctcaccccgcacgccgctgctcaagggtattctcctctacaatcatcttgaagcgcaacactccggctcccgatttcctgtgtgcttcctcagagaggaggaagctccaatggacctttaccgcagcaaatgcgacagcacagaaaacaataccggccttcctgtacatgaatcgtcgtaattaaagagatagtttaaagccatgtacacgtgcttgtatatctgccgtagagcacgtctgaaacgagctgccccttcccgtttatatggtcgaagaaacgggactggcaagcgtgtgagcgaggcccccctctcgctcatcttgctctcagtgctaataggatctcctctccccgaacccgcgccaggcacaggcgaggactgttggatagtatg

SEQ ID NO: 3228 - DNA, 703 bp, Nannochloropsis_gaditana
ctctcccgggccgcctcggcgcaggcttccagctcggggactggcgggcgagcaaggaggagtctcaacacacgcaaagcctcatcctccaggcccaatccgagcctgcggacatgcttcgcctcctgctcgacaacccttcctgctgcaaccacgtgaacgtctgcactgtcctgcaccggtgtgcgaggctggccgggacgccgcgtctgacccccgccatcgaggccaccatcacccagagcctcctgcccgtggtggcggaggtcctgccggcgtgcaagggccgccagctctgcaacctggcctggtccctcgtcaggctcgggatgccggacgaggccctctttgacgccaccatcgaccggctccaggagcggcaggggggcctcctggaagcctgcaatgcgggggagctggctatggtgctgtgggccatcgcctcggcgggcttgaccttccagcacgcctcgttcttcgagagggcggccgggtccttggcggagctagcggtggggctccggccccgcgagatcggcctcattacctgggcgtacgcgacctggctggggaacgacttgaagctgaacgggcagcagcagcgagggatgggagcagggggactgggcggatgggagagctgcgacgcggtggaaggggaggcgggggccgggtgggcggcggggctgccggggcccagtgg

SEQ ID NO: 3229 - DNA, 703 bp, Nannochloropsis_gaditana; identical to SEQ ID NO: 1418

SEQ ID NO: 3230 - DNA, 703 bp, Nannochloropsis_gaditana
gtactccggtgcccgacgcgatgtaccgcgccatcctagagcactgtcgacatccccgccctccacgagcctatgcttccaaaatgcttggcttggcggggaacgtggtgcaatcatactttctggatgtggtggcgtcgtcatccgcaccctcagccttgcctgtgaaagagtttcgcgaagtcttgcaagccatgtcgcgcgctcgagacgccgagggggctgtggccctccttcgcctcctcacactccagtgccaggagaacgggggaaaagcgggtcccgcatcatcgtatctggatgagtacctctttttcctggtagtgaagtgctgttgcgcggacgcagaggaggggtcgaagagagcgagaagcacgccggcattggccgccgtggcgcccttgatggctgagatggaccgtctgcgcattcccaagtccagctttttgtacagcgctgccttgaaaggcttcgggcgcatgcagtggagggagcgcgtggaggcgctggcggaggagatgatggaccggcgggaggaggtggctcttgatacagtcgcgctcaactccctcttggatgctctgacccgcgtgggcgacttagaccgagcccggggcatcctacgggatatggcccaagcctcatatgtttccacgtcctacttaaggcggggggttgctgagtatcgtccagtcagacgcgg

SEQ ID NO: 3231 - DNA, 703 bp, Nannochloropsis_gaditana
cggtgaatgatttagtcttgtgaacactttagatgcgggaagaagcggcaacttgtgtattatgaaacaattggcggccgattaggtaacatagcttacgcggcagcaccagttcttgcagtggcactagaagcactgcattcgctataacagcaactgtcatctagataaattaaaggaagatatgcagatagggtccagatgcttttcgttgaaacgttctttttcaaccccggtcccggaacgtacggttctcgtagaagtcacccccagcatgacgaccactgccatgagtctggtctatccgaactgccagcatgcttgaaggtactggtgtcaggctttattgattgcatccgaacaatggtatcgccgccaagccccgtgcagtgtctcagagcgcgggcctggaatcgcacggagcgtaagtgggaaagcgctgacgaaacaagcatcacatcgtcggagcacacacttaggccattatatgcgtaggggccggttgatgggcaatgactgggctgtatctggcccggcctggcacgttgcttgaagtaagcgtggccttgattggtatggttccctatatttcacgacacgcaggctttttggacggtagcttgtagccgatggatgtcgcccgataattggaggtcatctctcgcacagctcatgcagcccctcacacatacagcacaccatg

SEQ ID NO: 3232 - DNA, 703 bp, Nannochloropsis_gaditana
atcgcgcagcatctcctggctgcaacacggcaccctgacgacctcctggccaccaaataccgccacttcgattcacacaaactaggccatcccagagcaccagactactttttaccacaagacaagagttcagtatcgttgcccgaaagtttgattccttttatggcgataactcatgtattcctttcttgcgaagaaacaaatgctttcttgagaagaattattttcttttcttcccaaaaaacgttttctcttcccaagaaaacttttcgtgggtggctggtcaggagatgaagaaaaaaaatcctttcttaaagtaaatatttttttttccttgaggatgaaaagctttcttgtgtagctggtcaggagaccaaggaaaaaagtctttcttcaagtagagagaatattgtttcttgaaaaaaaaggaaaatttcttcgtctatgtcgggcatgactttctgcgctaagaaaaaaaagtttctcttcgaataatttttctcttctcttcttcgccgaaaccgaatctcttgatgggtagggttgaagaagattcgcgcttcctacacctctcgggtaagggttatgggggcattccggcccatactgatacgtcaaaacattgtcaccatgtttacacttgcaatataaacagttgtcattacagaaagcttgttctctgcattggaatacctggtacatg

SEQ ID NO: 3233 - DNA, 703 bp, Nannochloropsis_gaditana
aaggttgtttcaagagtatctaaagcataacaagacgtttgtcatgcagaactttgcgtcatacatttaggctgagaaatgaggaacgcaatgaaaatcagagggatagggcgggctacgctccagagacaaatacctacaatacattgctatgcgctagaaatccaaaaaaaaacattttcttaccgcaatatttcgaaagtttcacactaagcaagaggaaaatgacatgtgcgtctttaaatctggccagtgtagggcgaaatacgtaccgcaagagcccgctctaagtcatcaagcagatcccctaaatcttgtcgagtttcaggcatgaattcaacgaccgacgggaaggctgcccccctggaattatggagatggcagcgcgtaaaaactgaagatcagtgacttcatgtgactgcccggacttcctatccgaggaagacgtcagtctccatgtagatataaaaaattctgtaagaatacgcgcgaaacgatgaaaagctcgtgacgccgtgtagttctggagggtactagtgtatttgggtgcttaagaagtgctcgcctcagctcgccaggtcggctcccacggctcccacgggagctctcgctgtccgttgcctcccttttttcaaagtctgtccgacttttccttgatccttcgcttcacatgtggtattgaattcctctgcacacaaatatg

SEQ ID NO: 3234 - DNA, 703 bp, Nannochloropsis_gaditana; identical to SEQ ID NO: 886

SEQ ID NO: 3235 - DNA, 703 bp, Nannochloropsis_gaditana; identical to SEQ ID NO: 887

SEQ ID NO: 3236 - DNA, 703 bp, Nannochloropsis_gaditana
tcacggatgacacacaagaagcgagggaccgcacagaccccctccttggcccctcccccttcaacagcaactgctttcgtggccgccgtcgcgcttctcaccctccaactcacgctctttgcgcattccttgtcatcgttacacatacgtcacacacaaacagccaatacttcctgtggacgtacccagctatggcggggaacactttgaaagacctttgcgtttgtggtaagtggagcggtaggagggaggcttgaagtttgcaagtcagggaagcgtgacggtgctcattgtgatgaatacgaagtgagcaagcgcttccgcttaggttgtacgatataagtatgatatttgtcataagacgtcacaagagcttaaagatatgtttgaaatgggaatacaagagaggagaagtctcgaagccgtgctccggcatgaagtggtagacatcgcgagtagcgtattcgcttccctcgaccggacggctaagccattgtaattgtatttttctcgaaaatgaagtgtttaggggacctccagctttattggggaataccagagatagacttgaaaagttgtcatcgtgtgctcttttctcccccctcacctaggccccaagatccttcttcccttccttgggggagcagtcgcagccctcattgccgtctatgcagactgggcaatcttcaagcgccgggctgga

SEQ ID NO: 3237 - DNA, 703 bp, Nannochloropsis_gaditana
tcctcggtaatagacatcgtcgacccgattgccgacgagcgcttggcagacttcgtggtccgctcgcaccagcgttctcactccgcttcgacacggggggagtcggggccggcgcctgaagaggatccgatcgcgggcagaactccatccgctactccgtcccagcggctgttgaccaagtacataatgtacgcccgttcgaatgtgaggcctcagatccaggacgtggaccaggacaagatcgaacggctgtacgtggacctccggagggaaagcaaacagtgcgggggcgtccccatcgccgtgcgacacatcgagagcattatccgcatgtccgaggcccacgccaagatgcatctgagggaccacgtccgcgatgacgacgtgaatgtagccattagtctaatgctccattccttccttcaagcgcagaagttctcggtccgcacttccttggagaggggcttccgtcgctacatcacacggaccacggacttcaaccagctgctcatgtcggaactgcagaagctgatgcgggacaacttgacgtatgacatgatgcgaagaggaagaaatcccgaggacgaagagcctacgctggaggttcctctgagtgagctggaggaaagggccgcagagttgaggatatacgatattcgtccttttttgcagggcgagatgtttagaggccacgggttggttg

SEQ ID NO: 3238 - DNA, 703 bp, Nannochloropsis_gaditana
  misc_feature (611)..(620): n is a, c, g, or t
ccggcgcctctgcttctcctcggtcactccaacccttgtcttcctctcctcctctgcagaacaatcgtggtggccatctaacccttacagggcgatgggggactgcttaatggtgttgcgaggggtctcgtaaccctccccgtagacccccgtgtggatctccttcttctccaccgcctttgctccctccttgtcagcctctttttgcacagtcgccacgccgctgccctccttctctcctccatctccaaccccttctcgtccttctgtggagatagagaggccagggctctctactcgctgttttttgaaaccccccagaagctcagcacccttggttatggaatcggatcgcacccgcttgtctttctcagccgctgccgcctccacaaggagctcggccgccaccaaatgcgcttccttcccttcgccgctctgcctctccttcccttcgcatttctcgccctcggtacccaccacctctccctccttcccggccgcgggccccgcctccattgcttctcccgccgcgggagccggggccgccgagtgttgttgttgttgctgctgctgctgcatgtgaagctgctgctggtgctggtggtggtggnnnnnnnnnnaaaggcttccgggagacaggcaattgactggctcgttcgcttgctttcagtgcctgctcccaactccgaccttgtgcgtcatg

SEQ ID NO: 3239 - DNA, 703 bp, Nannochloropsis_gaditana
taagcgatggagaggagggcattcaagtaccacaagtaggcgatcacttttcgcttgtcgtcacaaaccatctttatggtactttctcgtagggtctggagtgcgtggcgagcatgagaatttgtgagcgtgatgcgggtcatggcaagtgctagacacgatatgggcatgggcacctcattggcagcattcaaaaaaagcgaaaagcaatgacgaactcagtgcagccaatgcaatatcttccacaagccccgaaatgcaacattgaacccgcaggactgtcgacgaggaaatcaagagcggaggaagggcctttcgttcaaaagcccccgaatggcatgttctggcgtcgcgatcgccgtcgcgtcgctcgaccctcccagcgacgacgagcagacgatgtccacaaagacctgcactcacaaggcgggggcaggttgggctggcggcttgagtgagggcgtgtaaacaacagtgcctttgtatctcctcaatgactgttttcacgccatgattgcggcggtgtgtttttcatagggtatatttctttttttttggcgggaaggacgaatacagaataagctgaagccaccgcccgggagcagtcagcatgtggaaggaaaatggaatatacttacccacatcaccgttggtatgaactcgcacgtatttttagttgaagtcccaataccaagactttatg

SEQ ID NO: 3240 - DNA, 703 bp, Nannochloropsis_gaditana
ttttattccaaaatcaaggagcgactattacgccttgccccaattgcaggaaatccaagtgcatattgcaaccttttcgtttgtttataaaacataaaatgggatttgttgggctgtcatttgctttgtatgtacatgcatcgcaaaacgtcaagactctcgttgacgagcaagggtgacgagccgataagcaaaataaaaaaatatcgactgacagcagctttgtaccgtttttcacgctcttttcatcttacatcgtgacgaataggactcttaggttttgtgcgggcccggcgctgctttctgaggataggaggatctcagtgtagtaggtatcaattgatctaaggggatcggccaagcgatttttacactttaccccgcttgaacacgcacacttaacgtcatacatcgccccttcatggacaagccgtcaacctctctccatcttgccatcccggaccccgaagaagccgctttccttcccgtggatgttcacgtggtacccaaacgcgcttcgcatctgccgacttcctcccatacctcgagtaccaatggggccctggcattcggctccgtccatcccccacggtacttgcgtgcaccaaaaggagaaatcgactatgcatccgccatgccggacgaggtcctgcaccggatcctcacctttgtcgatatagacacaggcgtggctagcacgatg

SEQ ID NO: 3241 - DNA, 703 bp, Nannochloropsis_gaditana
  misc_feature (1)..(24): n is a, c, g, or t
nnnnnnnnnnnnnnnnnnnnnnnntcagcttcctcgtctgtcccggcgtgtttacaagagatagcgaattgaggtgttgttgagtccaataggtgttcccgacgggctgactggatgcaatcgtcgacacttgccatgatgtagaagtcgtagggcgcctcgggaagtttgaggtagggtctactgtgtgctgtagcaggaacggcaatgacggtctcgtcggcaaaataaaagatgccacaggtgtttcaggccctgttctaacagtagagctccacatggaggtctggatgtgtcgtagaggttgtaaaggcatgagatcgtatatcatgccggccgggagctgccgtccgttgtcaggaagactttgaataaggagcgacaacaggctatgatgtaatccctgattactcagccctcaggtcttgatcaaagctcaagattttggtacttgtatggatgtacgatacatagaggcatagaaagttccagtagcggcacttgcacttgccttcctcgggtgtccaaccccgttcaaccccgtcgcgcttacgtatgtcacagtaaaccaattacatggaatgcacctatgcttgcgtaccatagtatgcataatcaggagctgatgtcaccaacataagaagtaatttctcacacaagcagtgcgacttcctcagtcttccacgcatacagtaggtcgatg

SEQ ID NO: 3242 - DNA, 703 bp, Nannochloropsis_gaditana
aatgcgtatcgtcccacggggtaggttacacagcacgtgttcaaagcaagtcagcttgtgacgccgaacttgaaacatttgatgtcttgagcgataagtgatgtagggtaccaggttgtgctgacggctcctcgcagaaaagcaaggtcatgtgcgcatacacttttcatcttttcatggaagattttataccaagacatcaatttcaaaagctcggtaacggacttccgtctgattcttcgtgagtgcaacaattttttcacagcaaagtcaagacccggtgcttttaaatttaacatgcatttattttttcgaatacctttcaagagaagcccaacaaaggtctcaatatggacgcagtccaccgtgatcgcttccgcaatccaatgcctcaaaaatgcatctcctcatcgcacaaatccccccccaatatgcatacatagagctcccgcccagactatttcccctttgtgtaccacaggcgcggagaatcttccccttcagtaattctcaatcttcatatacttttgacggacatgaaagtccgcatttttcttcacgtgcattattcttcctccgtggcaatccctaggagtccttctccaccgacagcagcccccacatcgcacgccacctcctccccagtttcgccctgcatcagcccggtctctacaatcatcccgtccatccccccggcgccccc

SEQ ID NO: 3243 - DNA, 703 bp, Nannochloropsis_gaditana
  misc_feature (374)..(383): n is a, c, g, or t
ccgctgaaagaaaatcggcccgccacaagccctgcgaggccacatagtataagaaggattgatggatgggtgaaaaacatccacagtgcggcagaaagggtcctgggaacggagaaatcggttgctagattttgatgaataaccgaaggcggtagctgccgggcgtctactaatcttttgggtgacggaaggagactagtctgggaaggtagggatccacgaggtgcggaaacaggcagagtcgagattgaatgactatccactgcggattttttgccggccttgaggtgaaacagagtgttggggagaaagatagggaagagtttatgctttgagaacatgtttataataagaaaaggtgggagggggggggnnnnnnnnnnctgtgcacatggcatcggtgctctcaagttcccggccctggcggccgccgtcaacaaaggagcgggggcgagcggtaagcgagagaaaaactgggggagaaagagggaagggaggggtggaaggatgcgcggggcaagaccggaatagcgaacgagagggatggggcaggacaagagatgtgatgttggttttacaaggctgttatcccgtgaattcggtgggaatgaacgtttgcactcttgcagtgaactcggcactcccttatcctccgtcttcccttccttttaaccctttgctccctcccacaccatcagccgcc

SEQ ID NO: 3244 - DNA, 703 bp, Nannochloropsis_gaditana
gaattatgttttcagccctccgaatgctatgaggtagccgccgtatttttgattgttgaaaagtaaattgagtccttcggtgcatgaagaagaaaatatggagacccacctacactacggacggctatatttgtcttcgtgcgaaaaaaagatactttcgatatccctacaaccaaggaaggcgctggtgcttcagacacgaaccttgccgctgtacacgctggtctttttctaggccgccaccaaaactgtcgcacaccatagtaattcgtgcgcaaggcatggacatatttgtttgatgttggctttctttggttccaacttggccttattgaaggtcctggtggctgtgcctcggcacgtaacggctaatatttatggagtgaggaagattccctgtgaacattcctggcccatgtgaaaagttatctcaatggcacagatcaatttatagctacacaaaatgtcatactaggcaataagcagagtcaaactttggctacggatgatatgaaagttcaaatacggaagtgaaggagtagttgctaactttatatgaaagcagtagccaagtcattcagctaacaaataacagcaaagttgattggtcgtgcaatctttgtatctccaagttttgcttctctaatgattcccaatactcccaacaattgtcataaaaagaactgtacaggcgctcatcatg

SEQ ID NO: 3245 - DNA, 703 bp, Nannochloropsis_gaditana
gatggggcatgcgagccgctgacgttaccttgtggagatgcgtctgtctgagaaacgagctccaaggccgcactagttaggaatgacgggctcaatgtctgggtgtgagcgtggacaacaatacgttggggcaatgtgagacgacaaaaacggaaatgaagttacccttccttcctccacttacgtctgccgccgaactgcgtttggacattccagtatattaatttataacatcagaacctttcagaatgctccctgttcgtgttgtaggcgaccagtgtgcttgattaagtgagggtgcaagcgcttgagatcgatgcggccacgggctagtcgaggccaacctccctgcaagatcatgatgagacgccaaaggaggaacagacatgcttgagggcacattcacgtttaaaaagtgtaagtttataaacaaaatcatgcacaccatgtcaacaaaggctagcgtcttctgcttctgaaataggcgacgcaaaaatcctccgctcgtcgttttttgggggatgggcgcattcgagcgatgagggcaacattcagaacaataaccagcgcaacggcttcactttcttcacctcacgcatagatagaaaaagtagcattggagtaccgttgtcgtcgagcttcttccgcgttcggacaacgtgtctgtgtacattaccaatccgcactgaaaaaattcggcatg

SEQ ID NO: 3246 - DNA, 703 bp, Nannochloropsis_gaditana
accctcgtgtctgcgtctccgccaggacgagccataattgtatggcatgagaaaatgaaatgagaacgaatgaggactgctgccgtggcaaagcgaagatgcacatagatggacgtagtgcctgtctcttccgtggggaggacctagcccccttattaaatgagagctacccgtgcgcaaaagaccccgaacgcttcacttagcctgattattatacgctagctgaaattgctattattttaattttgcctcgttgttaaggtcaatgtggctggagctcagtgtacctgagagcacatgacgcatgaaactatgatactttcacactattacaacaggtcctgcgacgtcataaaagcgtatcctgcccgtccgaccagaaaatgggaccaccaagtgtgtattgatacggacagagaagtgagcatgcgagagcctgcacgctaaaaaacgaaaacttcccgtcagtcaaaaggcagcaaagcaacggctccgcttccgtgatagggtttatttttaaggcaatatgaaatagtttcattaaagaggtcataaatgcatgttttattcgcaaacaacaccgcggtacttagattctattagctcaagagcagtatagagagactcgacgaacgtgtgctttgacaataaaacacacgggataatatcaagtccctcggctttttcggctgcccaacggatg

SEQ ID NO: 3247 - DNA, 703 bp, Nannochloropsis_gaditana
atcattaacgtacctcccacgactttgccttttttgttacggatgggcttccctccccggtacatttggagacgattgatggtagcgcggtctcgcagcttcccgcctttgtgttttacatctgaagctttgcggttcgggttgtcgctgcttttggaggagctcaaagagcttcctttcggcttccccatggttgaatggataggagcgaggacgggaggttgactcggccggggctagcacaagcttggaagtaaagctgccgacaaccgcgtgccacctggtcaggaatcatgagcgtgaattgagtacgaagacgtgagtctagctcgggtcgacgcgaatgactgttgcgacgaaggcgttggacacgacttcagcctgtaggacgcgcttcttgcagtctccagcacaaccggcaccgttcctcgccgtctctctcgctcgactgcggcgtaaaattttgacgaagtccgcgcccgaattcatgcatagcccacacacagacagtggccattaggtgcatcatcgtggatttttgtaaaacgagtggacgcgcgccattgttttgaaaatatgccgcctacacgccttctcggcttcctcgccgtctggttcatttctgcgaacacagcgcctgcatttcacggaccacgaccgctgctgtcagcgtcactttaccgttcattcttacgtgtcaatg

SEQ ID NO: 3248 - DNA, 703 bp, Nannochloropsis_gaditana
atagacccccatgattgttttggaaaaatcctgcttccacacccagtatgggaagcaccgagcctgtcctttccacggcggccgtaccggcaacggagccggcggggaaatcctacacatggcaagaagtagccgagcacaacacagagaaaagtttgtgggtcactgtgcgagggaaggtgtacgacatatccagttgggtggacaaccatccggggggcaaggagatcctgctgttggcggcggggagggacatcacgtacgccttcgattcctaccacccgttcacggagaaaccgacgcaggtgcgggaaaagagagggaataagggagagagaggggaggggagaggggagtgatgcagcgcgagcgccaattggtgtcctgcggggagggatcaagccgcagatcccccgggacggctcgcaacgcatcaccctcgctttgcgcacccatccgtcttacctcctgcccctccttcccttcctccgcccctcctttcctcccttcgcccaggtgctcaacaagtttgagatcggccgggtcacctcctacgaattcccccagtacaaggcggacactcgtggtttctacaaggccctgtgcacccgcgtgaatgactactttgtggcccacaagctcaaccctaaggacccaatccccggcatctggcgcatgtgcctcgtcgccctggtggccttgg

SEQ ID NO: 3249 - DNA, 703 bp, Nannochloropsis_gaditana
cattatcttcagtcgatgagggctggtcccattttttcttgatttgcattacacgaactgatccagtgatgatatcatttttgacgagagagccatcatcggaaagtcattcttggaggcaaccatatcgacagattacttggtcttacagaattgtatcgacagataacttgttcgtacataattgtagccgggtgaatcgtcgagcttgtagtacgtcattgacttgtttcccaacatgcttcagccgcacacctggaaatctgtatgtgtacccagggtgcggaaggtgttccttacgcgcggcaacgtagtaaagaaaacacggaaatgcacactttctccgcactgtgtcgctgtccaaatgaactcgccgccagatttgttcacaaacttgctgataaagcagcgatcctgcgccacacgatcctcgctttgaggcaggattgaatgatggattgaatgatggattctaaatgccttgctgctaatttggtcgtgaatattcatttaaaagggcttcgcaacatttttaatgtaaaaagtggagttttccacctttctttgtcgtggtgtatcgcactgtcgcactcacaaaccaagaagcaccgggcaactgcaacatgacgtactctttctgacacgaaattcttccattgatactcttcctccctttacattcaggacgtcgtattacaccatg

SEQ ID NO: 3250 - DNA, 703 bp, Nannochloropsis_gaditana
acgtcttggccattggtcgacagagaggagagaggtctccgccccgcaagactgagatccatccacgcacccggcagaaaaaagaaacactcggacgcagaggaaagccgcttcagatattgcaatcccttcgcttgtttactttgggtagcgtggtgtccgcgtctcgcggggttgacgggggccactgaccaatttttcctactcgtgggccggtgggaaaggaggtcatttgacgtgttaaaatgaatacgagagcaataaaagtgccgcgctgtcgcaagcaggccgccacaatgctagcacagaggggtcaatgggatgctatagaccaaggaagccgggcacaggagtcctgatttgtgcgggaggagcaaaaagttcaaatgcacaagcgtgtcgctgagggtagtgggcgaggggggtgatagcaccgagacatgggactgcacaggccgcgacaaggccaccccaacacgaggacttcggcacgcgttcttgtaccatcggacaccgaagacaagaggaatggcgtccggtgaattgaccggaccaggtgtttttgttttcccgggacgatggccttcttgtttttatcctgaagttgagagccagggtacgtcacgtcccgtgcattgcttgtctagaagcctactctcacacaaagccgtgagtttctgacagcatgacctactgtacacag

SEQ ID NO: 3251 - DNA, 703 bp, Nannochloropsis_gaditana
attgccttcgcggcggcctccacttgagctttgtttgaattggctcctagtaaagcacccaaaacaacatccgcctcgccggcacccgacttatcatcttttcctccccttggtttacccaccgggtttccatcttcgtccacaacgtcgtctccaaacgcgtatttattcaaaatagcttctcgcccccgcatcgtcgcacgatctccttccgttcgagacttaagctccgcggcttgtctgtcttgctctgtcttcgccgctttcttgtcttgctcaagtctttcttcataacgccgcctttcctttgccttatctgcgtctatcaagctagtctccctggccgcctccgccgcgtgttttagttgatggtgggttttcaagtcaatcgcaaacccacttaggtcctcatccgtcgcgccgcctaaaaacgcaagcacagcctctactcgctcttccaggtctccagtgtcctcatcatccatcattccctcaatatagcctctgtagacgtttgtgtcgagggaaagacgcgcaagctctctttccaggtcgaagctactcgcactcgcagccattctgctgcgaccctgtcaaaggtctggcagcgtggccgtaagcaatgtcatacaggaatgtggcttatattgtaaaatacacggcttgtcatgacatatcagtgagtttaggaagcgttattatg

SEQ ID NO: 3252 - DNA, 703 bp, Nannochloropsis_gaditana
caaccctccccgttcctcagctccacgccctcgaagtcaagcgcggactccatgtcacgcccatccagcggtgccccaaccgacgggtcattgttatggttgtcctgcgcagagatgaagtccccagtcgtcttgacattgccgtcacggccccgcttctcgtcgcgccccgcgtaaccatactgattcgcctccttgagcaccgtaattgtgcggtccatatgctgttgattgacctgtcacactgtctttgagacgtcgctgggcgcgtaagagccttgattttcttcgtgcgcaggtccagacccattgacaacttggaaaaggttcgcatattaaaattgtgtagcgagaatcttccgaaccatgcgtcatgcgaatacttcggattattctttagataacaaatgtacaaaatttcaaaacgaacttcactttcaccttctcgctctttccctcataaaatctttttcctctgcctcccccctcgcttttatctcctcaggacatccccagtgaccgctagctgcacatggatttttccgtgtcggctatttggatcgggcgaataaccgattcgcatgtgctcaacaagggcgaccgacggcaaagtgggcttcaggaccccatcaccttgatcgctgaggacaagggggaccatacaattagaacgaaagccttcaggcacgttgatcagcaaatt

SEQ ID NO: 3253 - DNA, 703 bp, Nannochloropsis_gaditana
atacatacacaacagcaccaagagaccgcaggcggcggccttcaacattctttgccttgtctgcatcacaaattccattatcgtccctcctgtatccgagtatataaatgtatattgcatgaaaagcatcggtcatgaatgaaacggacacggatgggtactacatagtgttggacacggagaaatatgaaaaaggagaaaaatcacgctctacgagtggatggtatcatacaagtggacttgttgacgtatcgaaaaaaatccctaccccgtcaacacatatcctccactgcgcgaaccttaaaaacggctaactgggtcaattcaccataatatcgctcaaacaaagatttagtccgaggactctccgggccctcgccggctcacagacacaggatcctcccggccgaaaaataagccaacacccgccctaaacctgcaatgacgagtcacgccactacgtgaccattctcaaagcactcacagtccattcttgacaggtgcttgaagggcaagagtggggttgtgccgggagaatcctcgtgtttgcgacttttgcgtgacactgcaacctgtctctccgaggaaggggagaacctcaagccgcatcctcgaccccgacctagacattggttcctcctgcatttgcccaaacatctctatcgtggacagtcacgcacaaatacgacaatcagagcgaatg

SEQ ID NO: 3254 - DNA, 703 bp, Nannochloropsis_gaditana
agcaatccctgctacgccgggcatgaaagagggagggcagcatcctgaggagtggagacattggcaggcctgagcgagggtgtacagcatggaagaaaagggaagaacactggcgccgctgcgccgcttcctaggtgacaaactccaccatgtaagggggattgcatgaactgaaaaatgataggcaaataataactctgcaggtaagaaggcatcttgaagtcaagcaaggcgcatggaagtgacagtgtcattggagccttatttatgtttaaggaaaaagacaagcagaagaaagcaggcaggtaagctcgtgcactagctaccacaagctatttatgtggtcctcacacagatgtgatggagcaccggacataacagaggtcgtcatttggaatgtcaccacgggtatatcgcatgctcagcgaataacgagcacaccatgccgagagaaggggtacgagggtcggagccgctgcgtcactgtagagaagtttgaaatataatgggcgacagagccgcgcgaaagttgtcttccccaaaatttatatacgtcaatgggtgaaattagagggttacgtttgtggcgttgagagtgtgcagtggcctcccctcacatgttcagtttgatgcccggcacaggcatgtagcttgccaaagcatcggaagtgtgaggcgaacttcgagattatgaatagtcatg

SEQ ID NO: 3255 - DNA, 703 bp, Nannochloropsis_gaditana
gcgtggcacgagacaacgaccacaacttgagataatttcgtcatcggctgccagcttccgagccgagagtcgttctgactctcaagcattctttccctgaccagcacgtggggggtgaagaagcatttgggacattccctgcctttccatgtgcgccaaggccgcaggcaatttgcagcggagtcgttgaatttaattcgttaagtttgcggctggtggcttggtcgcgtttcccgaaagcttggcgaagagtttcgtggttgcgtttgggtaccccgcaggtggtgtccctgcggaaaagaataaacgaatcatcggcttgaccacctggttcatcttcactatagaacgagaggacctcagagacgtatttgtgttccctgaggagaaaattagcggtcactgtgtgatgcaccttcttgtccacaattggtcatcaccgtgcacatttttggtgacttgggcgtattgctgcgtgatgtcgcgtatgattgcggaccaatccaaatgattttttggaccgatgcatcagggggcacttttagaaaccacggcacgaggcttggtcgacagatggtatctggagagcaccttccacctgaaatccttgggtgcagatgtagcattcaaacctctcaccacgcttacatttactctcaccataattcgtgccaccaggcagtgtcgtggcaatcggcacatg

SEQ ID NO: 3256 - DNA, 703 bp, Nannochloropsis_gaditana; identical to SEQ ID NO: 1848

SEQ ID NO: 3257 - DNA, 703 bp, Nannochloropsis_gaditana; identical to SEQ ID NO: 939

SEQ ID NO: 3258 - DNA, 703 bp, Nannochloropsis_gaditana
  misc_feature (1)..(235): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgctggattatttctcgtttattttgaagttttcaagcgcatacactaatgtcttgaatggataccgtgcggatcctacctcgtgcataccgcacgtcatctctcctttggctcgtgttttttccgtgtgagttgctttggagttgcagctttgcagtaacagacagggaccaaaggaggacggcccgcacgacgtccttcaacccgcatccctcgcgccctcgaacccgagttttttttccctttttttatcttttttgcgcagtagtttgtaaatatatggatgaatgatattttaagtgagtggaggcacaaggtggagtcctgtaccacaattttcacaaaaattggcttttatttgttccatattctaaccccctggcaatcacagggccccagagtggttaagcggtgtaccgtcccattgtccaggacagacaccaggagaagtttccaggagctatg

SEQ ID NO: 3259 - DNA, 703 bp, Nannochloropsis_gaditana
tgtctcctggaaacgtgttgaacgagcacagcgcgatgcctgaggggaagcagggggtgcataccttcatcgtggtgaggaaggaggtctgaaagcgctgcaagcaaggacaggagctgcactgtctccccgtgcccctgacttccctcttccatattgctttccttacgtactgtgcgtggttgtaggatggttatggggaggcaacccatcgatatcaacttagagtgacgttggatactttcggtccaaggcaatagaaagagacatcctctcttaaacgtgtcacaactttgaggatgaaagcggccgtttcggtaagcgtagcgtccgtaatgttggcatgcgcacacaacggtgaagcgtggtaaatgacgagctaaagcatactatagggcgagcggaaagaacgcggccgcctcttgtagcacttgggcttctctggcgtcgccccgctcgcccttgcggccccgggtaatcctacgtttccaatgatgcgcatttttcctcgcataatctcacaatgtcgacgtacgttcctgtacataacgcactcacagacttaaagggccaaaaaagaaggtcgacgacacaaaagctgcctgtccgacctcccatcctctctacaccacgagcggcatctcagagcctcaatgcctgaaattgtttaatttctgatcaaatcgtctgagaagtttggatg

SEQ ID NO: 3260 - DNA, 703 bp, Nannochloropsis_gaditana
  misc_feature (1)..(387): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcacatgagcacggtgacgggcgtaggcgtgagtgaggatggcaacacgctgttaacggccgggagggaccagattgtgagcgtgtgggacctgaggcgagcctccctcagccccccgggctccacgaccggctccttccggggggcggacgtggtgaccctggtcgagaccgtgcccgtgtacgaggagctcgagggcctgctggccttgacagaggcggaggcgcaagccatgggtgggtttggggcttggaaagggagcgagtacggggggcgggcgacggaggcggagctggatagcttgcacgcgatg

SEQ ID NO: 3261 - DNA, 703 bp, Nannochloropsis_gaditana
cctcctcctcctcgtccgcatcgggggaggaaggcgatggggaggcggaggagttaagcacgcaagctacctcgtcctcttccccctcgcaggctgcgaaagggaaagccaagaatgccaagaagaaggcacccccggcggagcaatcgacgccgtccgctcgaccgctgcgtgccccgagggagggatcaggaaggaggcagggcgctcagactcgagtcggaacaagggccgttgcgtccatggacacacccactccttccacgtcgaggggctcccaagtccggaggcgcggtcctcaggaagtggttgagaaatccgtggagcaagggagggagaagagcgagagccaaggtgatgcagggactcggggaaaaaggaaagcgaatgggagtaccggacagggtcgtgacagaaaaaggaaaatcaaagtgtaaggattttggggctcatcaattgactgatgtgtgtaaagcatcttttcaaagtaaagtaatgaaaaaagtaccgaaattgtcagccacttgcgtcccaagagaccatatgaacgatccaaatccgcatcctcctccaaatccaggaccaaagcaagtccaaggctctgtatcaggacactcttgcgcgttaccgacccacattgtttgaatatttattatctgtcgatccctcctgttttgacgaggagacacactcgtagtggcgc

SEQ ID NO: 3262 - DNA, 703 bp, Nannochloropsis_gaditana
acgatggacgacgcagcccttccggtgcaaggtggccaaatagcactcttccttttcctccctactgtcgtccgtcgactggtcagcggttgaatcaaatgtcgggtctgttgggctgatgcgacgcccccacgtgtgcgcgtgtatctgccccggaccctgtcctaccggccgcaataagtgcacgagggccaacggcttgatctccccgaggcatccttttaaagagtttccaagccaagaggcgatgtcgtacacgcgcacctgcccgtcttgcgaggcaacgctgatccagccgcagggtcccaagagggggccatcgacgagcacagcggctgctgcagctgcgggcagaggacaggtcaacgcgttgaaaactgtgccagcgcgaggagggaccaaaggtgccaaaaaaggtacactaacgtggtgctcaagcacaagaaaacgctgcttcatcctttcatatgccctgttatgacgcgtggcggggggtatggctaagtaggtaaacttgcgtttttgtacaacaaaacgggtgggaaagtcagcgaggacggcgagacagggctcgacccggcttctcctccatcctttttctgcccccactcactccttgtttctgtggaaaacaagcggtttatatcaccaggacaaatattgcctcgctgctgtggtggacgctgacagcgcgcgaaggatg

SEQ ID NO: 3263 - DNA, 703 bp, Nannochloropsis_gaditana
ttgaaattctgaccgtatgagtttgtgacacgaaggatacgacttgcggagtcctctacatggaggactatcttcttttgttgcagcatgtacagctcgatgcatgtccaaggcggggatgcacagccgggggaataataatatacatacattgttttatattagacatcgtgatgagggaagaaagcatggactcctagtaggaggaggatgaaagcaaaactaattccgtgcaaaatgatattaaaaagtggtatatgtccgccaagatagcaaaactgctacagtagtccctccggccagtcatgcacgctttttgggcttccacggtactttttaatggtcccatcaaggagagtgagcagctcgaattagaaggcgctagaagctcttttctggagaggtcaggtagccggtctggtggcagctaagtcacgccttttctccggacgatgggttactaggtctttcaaacgtttgatcttgatgatgcatggcatgcggtgaaaacggggctgtgtgtttatccgcggtagcgaatacctgagactccagagatcatggatggttggggcgcagaaggaggaggtcatcccttctccgccgcactgagaagtgcttttatgtactcacatctcattccgtacatcccacagccgcgcgaataccattgacgtggaactacacgggtgatagactcatg

SEQ ID NO: 3264 - DNA, 703 bp, Nannochloropsis_gaditana; identical to SEQ ID NO: 163

SEQ ID NO: 3265 - DNA, 703 bp, Nannochloropsis_gaditana; identical to SEQ ID NO: 164

SEQ ID NO: 3266 - DNA, 703 bp, Nannochloropsis_gaditana; identical to SEQ ID NO: 165

SEQ ID NO: 3267 - DNA, 703 bp, Nannochloropsis_gaditana; identical to SEQ ID NO: 166

SEQ ID NO: 3268 - DNA, 703 bp, Nannochloropsis_gaditana
gagaggggcaggaaggggaaggaaagtacataccctgtgcctgatcggcgccttcagtccgcgccatccacgaatcggctcctcccctccctcctcccttccctccttgcgtcaggtgaacgtcacgttcaaggacgtggccggggtggacgaggcgaagcgggaggtgatggagttcgtcgagttcctcaagaacccgaggcgcttcacggacctgggtgagcgccttcccctgttttcctctcatcacgtgctcttgcccgtcattgtggcactgctctaccttcgtttctccccttcaagtgccaaccgtacctcgtaccgcgcgtttctctgaatcctccttctctctctccctccctcccctcctccccttctctttcccaggcgccaagatccccaaaggagctcttctctgcggccctcccggcacgggaaaaactctcttggccaaagccacggcaggcgaggcgtctgtccccttctactccatctcaggtgacttcctctttcccctcccccctccctccctcttgccttccttccacccctccctgcctcgcccggatggcctgtaggactccccagacggcctccacgcgcagtggagctcacccggcgtgccccccgcccggtctcttttcatcctcacggcctcgctttcccctgtcaggctccgacttcatcgagatgtttgtgggtg

SEQ ID NO: 3269 - DNA, 703 bp, Nannochloropsis_gaditana
ccttgccgacaagatggtccctgctcccgcctttcatgtgattccaccccgcatattcatggcaaattttacagcgttttcgcgattcaatgagagggcaggtgagaatattatacgcggacgcagaccctcgatgtcgatgaaaagaaagtaatgtgagggatgacccgcctcccaccttgaggaagtcctcaaattcgaccgcggaatgtcctttgaaccatatgcacatgttttttcgaagaaaagtcactgccgacggacaaatgaatgtctgcctcgcctccatgtcttggtaggacatttttcgagtctttcaggaactaatggggagtcacgcgtggaacgtttctgtggcacagcgacgaggccgacgccaccggtgcaggaaatttggtccctgggcgtatatatatatatatgtatttcccgcttttacaatttgccgtgtgtccactagtactgatgaggaaagtgtacgcttggaagctgagcctccagagtgaggctggacatttctgtggttggcgtttattaccgatttatgtagctagcgggagcgtggcttacctcccttgacgccgagacataatccttgcttttccatccattgctgaggaaacttgcgctcatcacttttcacctctcttctcctccagatcaaaagctgtcttcttcctataatcggtgcgtcacaaaaatg

SEQ ID NO: 3270 - DNA, 703 bp, Nannochloropsis_gaditana
accgccttgagcatgactgggcctggcacacgcgtggagatcacctgcaaggacagcgtgtgcgtgaccgtgacgacggagcgcgcggccaacggcacgctctcgtctaccaccacccaagccaccacgaaaagcgtgcctttcagggggacgacgacgaagagcggcgaagggatcggcgacagtggctgatattatgatggtgtcccttttttaaagcgggcgctcggcagccgccaagcggcagtgtgcagaggaagggtacaggaaaaatgtatgtcgggttcatacttgtcttatcttaaaaatgactcggatcgagagagaagaatctttgcatgtatacatggaaaagtaaaattatcgtcatctcctgatttcgtttccgagctctcgtcgtatctcagcctcccaagctgtctcattgcttttgccacagcctgccaactgcgtgttgcaatttgtcctgtaaataggcgtctgtgaagaattctggcctttcttgactttcccatttaaaaagtctttattgaaaaagtgttctccaacatggcgtattcttggctctcgaattagaaataggccctctgaggcaaagaacaagaaggcggaagacatgcaacggtcaaccgtagacactacactcggagctattcgccctctcatctgagcatggtttcaacattttctaaggctaggaatg

SEQ ID NO: 3271 - DNA, 703 bp, Nannochloropsis_gaditana; identical to SEQ ID NO: 2242

SEQ ID NO: 3272 - DNA, 703 bp, Nannochloropsis_gaditana; identical to SEQ ID NO: 2243

SEQ ID NO: 3273 - DNA, 703 bp, Nannochloropsis_gaditana
ggagggaggggctggtggacacggcggtgaagacggcagagactggctacatggcccgccggctcatgaaggccctggaggacctctccctccagtacgatgacacagtgcggaactcggagaagacggtcatccagttcgtctacggggacgacggcctcgatccggccaagatggaagaccagagtgccctcttggcctttggcgccggagatcattcgctgggcgagcacggggagaaagggaaggggcctcccaggcggaagaaagcgcgcgcgggcgccgaccggcccgtgaacttccctcgcctcctcctccagaccctggccacgcacaaagccccccatgagcgcccgctatctccccgacagatccaagcctttgcccaggccgccgtggagtccccgcccttccaacgcctgctgccgcagggccacaaattcttggaggagatcgagggcttcgcggccgacttggccgaggctttggaatccttgctggtctttctgggcgctcccaaggacgacaacctagaggacggttacagaggtctcttggacttcgatgtggacgcagtgcgggccaaattgacggccttgaccgcgctggagcgccggaaccgggacgcggtggacaccgctgaggagcgacgagggatggggaccccggcattaggccaggcttggcgggagacagtgcaggc

SEQ ID NO: 3274 - DNA, 703 bp, Nannochloropsis_gaditana; identical to SEQ ID NO: 263

SEQ ID NO: 3275 - DNA, 703 bp, Nannochloropsis_gaditana; identical to SEQ ID NO: 264

SEQ ID NO: 3276 - DNA, 703 bp, Nannochloropsis_gaditana
aatacgagtcgttgtcaccaactccagcttccatgaaacaagaaatcaaactaatcaacaatgcagcagaacgtcgcaaatacgaggatctagccgatctcttctccatcattaaggcgacagaacacctggaaattgccttcgcccgcgatgcaataagcgaggacgattacactgctgcttgtagtaagcttatatcacagttcaaatcaaccgaggcggctgtgctggcagccaagactgtggcagatgcccgtgcattcatgacagaatatcacatggattgtccgcgtgccgtggagcgattgctgcgtttaggagtgccctccaccgtgttaaacccctccgtggacgacggacgcggggatgccatcaaagtggcggagaccgtgcagtatttcatcacggccatggatggtgtgcgtttggagcaacgggccgtggacgagttgcagcccatgctcacggacatcatgacaagtctgaggcgggtccagggccttccggcggaatttctgggtagcaagaagctggaggagtggctcgtgacgttgaacgccatgcgggcgatggacgcgatcacagaggagcaggcgcggcaattgctgttcgacctcgaccaaggttacagcagcttccacgcctggctgaagtccttggactaggagaaagaaattccatcccttgtacacatgcgggcatg

SEQ ID NO: 3277 - DNA, 703 bp, Nannochloropsis_gaditana
cgctgaccatgtaggggagcacgccgtaaccccatttctgccatcgcagttggaagaaaataagccaagcaaagaggaggccgaagcctactatggctcccactaaggagcggtttacccacttccgtaattccgacttcgcgacgcgtggtccttctctgttcaaattgctgtctccatgcgcttggccagtctgctcagcggtttcatttccgtggagtttaggccagaagtaaagcacagagacggcccacagccagggcaagcccaggcagcccactacgaaaaaccgtttggccagtaggacttgagcatcatcctgtgttggctgcggtataaaggtgcgcaccattgctttgttgaaggatgctcacaacacctgagcgccgtgagatagtggcaggaagaaaatgaggcttgaagaaatgggaatgagacggagagcgacttgttgacgtgaccgggcgataggaggctggaaatgcgaagttggaacccaccttgggcgcttctttgcgagactatgcgcaatgaaattgacatgctcctgatatttctattgtatgtacgcacagctaagcgcatcctgactgcggaccacgggccttaattcagccttgaagtttgggaaatcacgtcacctgccaagctcctaccacctccctttgacttgccgttccgctattagcacaagtgcagcatg

SEQ ID NO: 3278 - DNA, 703 bp, Nannochloropsis_gaditana; identical to SEQ ID NO: 898

SEQ ID NO: 3279 - DNA, 703 bp, Nannochloropsis_gaditana; identical to SEQ ID NO: 899

SEQ ID NO: 3280 - DNA, 703 bp, Nannochloropsis_gaditana
tccccgccgctgtcgctgcgattgccatggctgtccacgtcattgaagttgaggtggctgcgacagagtccgatgctgtggcggcatctgccccccctggtggtgaaacgatcttgatcctcttcaaatcgcgcccactaggattgcccacgcgtcgtggaggcactccaatactggccaagccaacacccgcctcagtgcacctttgctcaagcacagggttgtcacatccttcctctttcccaacatggtcgtccactgctttgtcatcctctccgtgcggtggcggaaaaatggaatttgcttttgcctccgtcatcgtggccgtttgacctgtgggtcttgggcccaacgccccgccctttctactcctccaacctgcggatgtgcatccacacacagggagaaatggtgagtgtatattaccgcctggatcccgttgttaggctccctacctcccaaaatcggacccgcagggtgcgaaaaccgccacggcgcttcctcgcgttttccccccccggcagagcgcggagacgatggcgtcactcccctggtagcagcacgctcgtaggggcactaaatgtttcactcaccggacacccacgcaagtacagggaccatgggcacgcctgtgacttaaactgcctggtgtgcgttgcgtgcatcgtcgtcatcctctttcaacacacgtcatgattagatg

SEQ ID NO: 3281 - DNA, 703 bp, Nannochloropsis_gaditana
ctacctcaagaatgacaccatcgcaatcaaagatcaatgcccagtccctgctagctctgccggcagacaaccatgtcaccgtcctgtgtggcagctgtccaggctgtgtcgaggttgcaggcttatagactgaggagagaggcgacacgaaagcttgcgacaaggccacagcggatactacgatcagcaggagggagagagtgctgcctcgagacattcgggagcgtctgtagcaatgaggagactggtctcacgcgaaagctcctagactgtagcgaaggggtaacaagaagtaaagaagaagtcacgaaggcagtcttcccccctctgtcatgtgcgggattgcgggaaatgcgtcgtaagtgttgtcacacagaggagggacgaagtcccatgctgcggtttcaaaaggtcctacagactaccaacttcgctcgcgcatgttgcagactcacgcagaccagtacagcatataaaatgccaatccagcacgacatcatcattctcccacggcgcacattgcatgcgttcgctacgcgtgcttcaaaacagcgtccgacctcccctggggatataggtatgacgtactccttcctcccgcccccagcgcgtcgcatctcagcgaggtctccctctgtgttcctacacacgtcctctgagtcccctcgttcttcatccaatgacacaatacagggtctccatg

SEQ ID NO: 3282 - DNA, 703 bp, Nannochloropsis_gaditana
atgacgtaatgtagattctcttcgaaaaatttgatcctgaggtggggtcgggatgcgcgggagggctggacagcagagatgcaggacagctcggggtaattgatgtacttcccttatatttgggacggttacccattagtttcgtgacagcatgtttcacaaaaacatgatgttcggttgcgaaacgagtcaggggcgatgggacgttcccgctttggcatgtgcgagatccgagcaaccttaaagatcgaagaactaaggagtgagtataaattgagccttgtctgcaattcataccatcgggaggctgcttcgtctccgccaccgcgaggcttttttctaagcatgcttaaatgcaacatggtcgttttttgtatttattgtgtttgctttacggagtgcctgctttcatgaaagttttaaagaacgggggggggaggaggttacaaagttgaggatcgaagccacaacaagacagagcacggggagtagacagtgaaaggatgaaaacggcaggcgggcacctgtgttttgttgctatgacatatatcaagactttgcgcaattgctggctctttcataggtccatacgacaggaaagagatttactcgggggtgcgtgaacctcgcaacttgcggcacactcttctttcctcttccttctttgctgagtgttttgagccattactatctctttctcaat

SEQ ID NO: 3283 - DNA, 703 bp, Nannochloropsis_gaditana
cccttattgctttagggccgcgggggcgggaaaggagtgtaatagaagcatttgagagtttactcgaacctcaaaaagactgtagataataactttgtaacaaaattgagtaaagtaatgtattgaagcgagtaaattaccgaaaaatgtctttttgcgtgtgtttttgcttcgaatgaagagttgtttgagcagctcgacttccccggcacggtcgctcacggccatgagcacaaggccttctttcttccccccccccgtcgcatcagcatgcacctgcgtgcctatgcttccacgcacaatcccataagccatgaaaatttgggatgatgtaccgtctcgtgcaaagcatagtagagtccaggccgatcgcaactgttcatcggcaagctggatatgatcatctccctccctacagaccatcatgcatgttgtcttacgtgcctctgattatctggccagtctgcactattctcacccacaccaccgcatgattaaacagatacttccttctttgggattacagcagcattgaaaacttcggatcaggacgtttgcacgattgtaaacgctgactttttgggtgcggatagcgttggtgagtctgcccgctcctcttgaagtgaagccgcaaagcgcaacgagtaagaataactcacttgactacagcataagctaactgcggcatccgagaagcaccatg

SEQ ID NO: 3284 - DNA, 703 bp, Nannochloropsis_gaditana
aaaagacggataccctcgattcaaagcaatacccccaaaaatggcgcaccgagagaaattcctgccttgtgcttccatttaccttttttggggggacgcaaatctgtatactttatttgcttatttacttatttattacttattacctcggtaattgtttcgatgctgccgttgaacagaagcttacccggaagctcaaccttcaaccctccctgccatgttttgtgacaacacagcttgcattgggtcctttggcgcatgtgttgattctgtattgtataggcctcaaggatgtttgggtggcgtacagtgaacgatcgattggcttgtttgtcctttcgttgtaaattcgaccgcatcattatcaacatgctttgttgcatcacaggtcggtgttgcctcggaaatctcggaaggctgcatattggttttactggaaagtcatggttgacgaatgtggaagtagtcggggaacttatctttatcttatcatggcagcaattcattgacagcaatcatattcccagctcatttttttattcatgattatacgtcccaattgtgattgtcgtcttcgggcccactctccaaacgcctcgacctcgcactgcgggttcagctgtaattgaaaacgtatctcaatagtaatttcaggaagcgacgtagcggcagctcatcgctcaaggtcgatcgtggcaacatg

SEQ ID NO: 3285 - DNA, 703 bp, Nannochloropsis_gaditana
acctccatgctatcgtgtgccatggtagcgacagtgtccggaagagccatggatttgagcccgtctgtgtgttagaaaagaagtgcatgtggaacgccctatcaaaccttcttcacttccatctcttgcaacactccatccgatcatcctcgtcgagacatcgtacggttagacgttgatagtcccaacattatgtcctacatcccaacaatattcacacttgaattccaatccattaaacggtttcgtgcgttgttttgtgttcaggtaagaccttgactgcctgcctccgcttcgctctgtcgcagggaagtcggggctgaggtcttttccatcatagatgagatcttttccatcatagatgaggtcttttccatcatagatgaggtcttttccatcatagatgagctctttcgggacggcacccgcgactattgaggcttccaggcataagcctgtgctcggggtttcaaaatgtatcgcgagcccgttggatgctttgcatgagaggaagaaaggtggcacttttcatcatgcatggaatcgtgaatcataggtggcacactggttcgtaggtctatccctggccatcccatcgcctgagaatgtttgagcgatgatgggtgccctgttccgtacttccctacatccctcgcaaggtatttgctcatagaacacaataacacagaggcaagctaatatg

SEQ ID NO: 3286 - DNA, 703 bp, Nannochloropsis_gaditana
gacctcatctgttgtcatagttccaacatgttccacatccactcttggtctttcttggctttcgctgttttccttcttggatctcctcttcttatctatgacctcgcgacgtttcctgtcaagggcgtcgcgagcccgtgctagcgccgccaagatattttcggcccacgcatccatgccgtcgggatccataacacggctgtgaaattcaagaaattcaagtattttacaaaaagtaagtgttgttccttcggtggcggggcaaagcagctttaaaaagagactacctggactagtgttcgtgactgtgtggcagtcgcacgcaacacaagtacggaaagaggcaaatattcatctagatatgcaagcagtatcttcccgtatttcctttcaattttataaaaagcctttttctcatcgaaaagtcaagtacgcttcatgtgcaccccaaaccgagcaaaaaaggcagagaaaaacaccctccctacgcgcgaataacggctcatccggggcgacagctgacgtttggcgccgcgggcgacctcctccctcctctagatggtctccactaggggaagacagatattatccaccaaacaagcgtattgattgtgaaagaatacaatcaaacataacgatcaaatcacgtttataggtctggagcaagaagaaagcgaaagccttgcatgggagcgggagaatg

SEQ ID NO: 3287 - DNA, 703 bp, Nannochloropsis_gaditana
tgccgtgataggcaggagtgtgcgcacccagtgcaggcccgccgagggaccgaggatgggatcggcgaggatatagagccttccccctgtagttttaatacaagctcccgggacgaaggcgggtaagcctcggagtcccgtttgccttggttgcggtacattctgtgcgcttggtgaagctccagtgctggcgccatgcgtggttgagcccggcttgagacgagaagacagcaaggcttctccgcacgctaatacactctacagagttctgcctatagacaacaatgtactattggagggtcacgaaaaaaaggttaattgtcagggatagattacgaaacatagagccgtaagctcagtagcatagacaaggagagatcgtgtgacgtgttgagcactgcggttgaaggctcttggccttggaggggggctggatatacgtgcacgtcgaagccatgaacggtcacgctttaccgccacaaagcacccattagtccaccacacggcatatcatgtcccaaaacgcacaagaacggtgctcgcggcctccaagagccggtacaatttgtgcaacttgggtgtgattcagttaggggaggctcgtcctagccctttccgagacaacgggagctgacagcgaggaccggaaagtgcctttgcacgcggtcaaaccacaaaaccaccccgcgccaggccccaaatg

SEQ ID NO: 3288 - DNA, 703 bp, Nannochloropsis_gaditana
actaccatgtcgagcttttggttctatcttcctggtttttgatttgccttgaccttctacctccttcatttgctttagatgcatggatttttactccattttttctcttcttttaagattaaaacaaattcaggcgcggcgcaagcaggtcaatcctccctacttcctcccttcttcgaccccagtcaacccctgccatgcacccgtcatgtgaagtaggagacgtccaaaggaacaaccaaaaccctctgatggctctctctaaacaaaaccacgccttatgcgtgtcttgctagaaagtcgttcggaaagtcatcatggtgtttcacgtattcaatatcgaccaccgcgcattgtagatgggccgttcatcttcgcagccttgttgaggcagacctggatgtgatcgtacatccaggagaggggcggggcgcatgcatcgtgattagaaaaggcgcaaaaaatttcgatgagccacaggtgcatgataatagcacggcatcctgcactcagcagtacctttttttcatgcatgaggctagctggtgtccggcgcactcttcgctgatctttcttttaggtgagggtaagaggcgtcactggtacgaaggagaaatgcaggctacttgattttttcatccatggcacaggtgttcaataatctcaatttaccacgctaaacaccatgtcttggagccggatg

SEQ ID NO: 3289 - DNA, 703 bp, Nannochloropsis_gaditana
tgattaacaaagattgaggatgacagagcgtgcgtttaagcccaactgacacacgatcacacaaagaggtagaggcacatgacacgagtggggcatgggacctgcgcaggaccacgctattatgaaatcggcagtcggcttaataacttaccgaacagcattgaaactgtgtttggaaaaccgcatcgggtatgggacctcccaacccaccacccccagtgttcgctgcatggaaggattctcgcttcatggcatgacgcgaatgaacagtctggactacgtgagtgtcaactcgtaggtttcaatagcctctgccgacacccttcccctgcgtgttgaagtttcagcgtgacgaactgcagcgttggtcagcaaggcagagttgataaaacctgaagcacgtcgctaatgccgccatttcagaccacgatttggacggtgcctgtgtgatacatggaaaaatgcgtgatatcaggtccatatcgcggttgaaagggctaaagggcattttgaaagacccaaacgtctcgcctccccctcgccccctcgctttcctgcgcatggactcgtgtcctccactggtgtcttttccctcataaatatgactgcgtaaggcttcgttctataagataatcgcctcatactttctcgaaatcagtccaggcctgcctcttgttaggcaagggccgcggggttcttcatg

SEQ ID NO: 3290 - DNA, 703 bp, Nannochloropsis_gaditana
ccatcgtgggactatttgcagggaggcattcaagttggcaggcatgaaggccactttgattgcaagcgttgttttcggcaaggaagaaggcgggcatcagtgcctcgcttcgtgaagaccttcggggccacggccgagaaaatcgcaacatcgtgtgattgataggtttgtagccgctatgcaacagtgtagaatcaggatgaggcacagtatttttttttaacatgttgcaacagcagcccaaacccagtacaggagcacgccgagaaatgtgttggtcttcttccacttctcttttcctctctcctcaccgagaaaattatccctgatcacaccctaccagtacagaataagtataaacgtacagtcacaaggcgtgcgtgcacccgcacgaactaccaataaggtgagtatcggcttctagtagcacagtcatggccagccccaagacggcgtcttgcgttgggttcgcacacgcgttctgatgacgcgatagctcccttccttaaggatatgcagtgttttttcccaacatgtggcttgtccatatctgtcctactggattgtttcgttggcttgtcttatcgcacgggaggggcgcttcacttataggacgtcgcactcaagccccgttgctggacggatggcgatctctccgtccattatcacagggtctcacgtcctgaagcgccggcacgggatg

SEQ ID NO: 3291 - DNA, 703 bp, Nannochloropsis_gaditana
  misc_feature (1)..(284): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaggcgggcgtggagggggagggggacgagggacagaagggcctggaggcaggcaataaagaggggtatagcgggatggctggcaacacccaaaagaaggggcaggaacgtgataatgtagcaccaccgaaaacgccaaggccatccaaagcatcgaaaggcacattggttacttgatttgaagcgtcttaggcctttaataagcttttctttcatggttatattggggggggagggaggccgttccgagccgctcatttgctttcttctacgagctaggccttaaacagagacgtggtcaagtgcggactcatacacgttacctattatgccccttgaggccctacatccaattatcacaccgtgcttcttccaggaaaaactcatgatgcctatgtatcctcaggtggtaccatg

SEQ ID NO: 3292 - DNA, 703 bp, Nannochloropsis_gaditana
cggatttgccattagaaagcgcagccctaggtgctagatccaccacatttgtactcagacgctgtgacacgtgcctaatacccgaccatgtagcgccagcggccgtaatccatgatgatgcgaggataaaagcaaggaggaagaggaggtgagggccgcggcgtggcttgaatgggaggggcggaggagagtatgaaaccgggcgcccgctagccatgacagcaaccatgaatgctgctgcagagagccaagccctgtgtgatttgataagggtgcaaagcgtacagacgtgggctgaaggcaccgaaatgtcaaagtacaaggatttcgtgggccgcccaagacatcaacaacgacgtgcgagtggggaggcagtgccctgctctgttgcagccaattaatggcgcgtgcccgtcaagcccaccgatccatggtgcctgggtcgaccacccacatgttcagccattccaggcttgcaacgtacaacgttagtacggttgaagattgcccctcgtggacatggttgaggccagtcggggaaaaaagacggcaaggcttctctttgggctcgagcctgctctctctgacagcggaagcgagccgaggggtggagggaatactttgcttaaaaacaaaaatgtgcccgataaagccttctgaaataatgcttcgttcctgacatgattatttttgcacctggcag

SEQ ID NO: 3293 - DNA, 703 bp, Nannochloropsis_gaditana
cgcttacgacgggcgagcagggagaccgagtgctgcgtttgtcacacgggtgggaacagtggacacagcttacattgcgccggcgatgggggcacttggaggattacatggaggctatctggcggcgggggagggtcaaggctttcctatggcggtggattgagaggcagtatcgacggcgggagggaaaattggtgagtgcattaacggatgaggtacgggcttatcgccttgcctgtgcgtccgagggcgaagaagcgacgcgaagtgggaacgctcgagacgcgcagcatgaagaggataagagaggcgtcttgaggcaaccagggaaggaattggagctgtttagtctccacccacccagtcagcaccagcaggcgctcccacagccacgtcgaccccaaccccgaccacgtcttgatgaccgcgggagaggtgcggagagggatggcgatgacgttgtccgccatcggagtgagcgggtcattcgaagaaagcgacgtaaaaacatcgtgttgtgaaggagagcttcgtgtggaaattaaggacccttgaggatgtctgtggtcatgtccatagcatgcatctagacttccctaaaagtgcaagacttaaatagactgcaattaactcacaagattgatgtgcaactaaatattctcgactgacctaatgacacgtcatggaccgatatggtcgatta

SEQ ID NO: 3294 - DNA, 703 bp, Nannochloropsis_gaditana
ttgccttaatcaaattttgagtggatttagattctatccacagtaaagaacacattaaatatgttccacctagaagagctgtgttgatattcatcacgaatctgcttgggtttttggctccttgcctttcggggcctcgcttttcaaagcagtcaggaaaagctacccggcacaaacctccaaatacaaaccatttctacagaagactctacatcgtccaacatggcatgagagatttcgaagatgttttcagcttatcctatccaaccaatgtattggaatgagttttgaagtgtttggtttgtttttcttggatgtccttacgtcccttttcgggggagccttgatatcgaacgcgacgaggtgaaaggcctgatcccacgattttgtagcgaaagacagcgctattctgtgttttcaatgaatgccatgagtatgatgccgtgctcacaatgaaatctcccggtcataattagggagcacaccttacgactgcacatgcttcaggtgttggcatttgcacaggtacgttgtcctctgtctttgtcccgccaaatcttacgttcctatcagaaagcatttctctcattacgcgaccataacctcgtagagccgtcgacgtgagttagtcgagctactggacgagcgggaaaaaagaaccaagcgacaatggcgagggtggcagaaatgtcgcaaaaaaatg

SEQ ID NO: 3295 - DNA, 703 bp, Nannochloropsis_gaditana
  misc_feature (537)..(703): n is a, c, g, or t
atgcctgggcggacgtgaccacaagcgtggaccccgtcgcgcagctggtgtgcggcgtcgtctcctccctgagtcccttcgccctcggcaccgtcatatcgccgacctttttggcacaagcctacttgaagtccctggtgcaggctccgggtcgccggttcaccctcctcttggacctgctgttcttggagcggcctgtggaggacgtggtcgtctcggtgggtgaaaacaacatcaaggacggggtggaagacgcaggaaggccgcaaggcgaaagaagacctgagcgggggggatgagaaggaaggaatggttcatagctctgtgtatgattccctcacaaccggacctcgcggctccattcccaaacttgttcccctacagtgcctgctgggagggaataccaccaccctccacgtccaaggacacgcgacacggcttctgcagggtcacagtacaaaggtgctcaagcgtgcccggctcggtgacgaggccctgagcttccagcgcggcaaactccggcccaacacgtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3296 - DNA, 703 bp, Nannochloropsis_gaditana
  misc_feature (1)..(424): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagacgaaggcagtctcgctcagattgatttcgcgggcccagtgttgcatccactcaggtgtctcgtcgcctaatttgtgatgaggagggaaggatgtgggtgtgatgaggagggaggggggggacacgcgcacgcagtcagggataaaaccaacacgagcgaagcgtcgcggggaaaacccgaaacgcgtcactccagagcaaagaattgtgtacaaggctgtgctcggccattttcggacgcggacatccctcaccgtggcagaaaaccaccgcc

SEQ ID NO: 3297 - DNA, 703 bp, Nannochloropsis_gaditana
tggcccttgcggacgccgtcctgcgtgggctgtcaggacgagttcgatgtggtcacctgctcgagagccctcgctcgaatcgctttagcgacgcgctccctcacaccctgggagcaaggacccaacaatacggtataggcacgacagtcgatacatccaggggcggagaaggaacgaatgtctggcgcattcatggctgagtgcttggagggcgtatgcgacccgcatgtgtgtggttatgtcgcgtgtcgcgacctttcttgtcgtagacagcatggtctcggagcttcgcaaggactgacagcagacgaggattaaagatcgaatgtgaagcttgcttgggcacatgggattgataagccccctcgttgctgttacaaggaataactcgtgctttacactattcaggcatgggtgcaagctagccaatgttgactgaaaagattttgagtaaatatcagcgcctcgcgtgacgacaaacacggatagaggcggaaatgaaagaaaaactcgtgtacccgacagcaaaaagaaaatttcagtatagttactaattccaaaattttcctgaagtttgtcaagccctcactcactccggcgccccggcatcacccccaaaggttcctttctctcacacgtgcaaccaccctgacttcaccaacacggcttgaccccacaaacacaccctcgacgccccctcgtc

SEQ ID NO: 3298 - DNA, 703 bp, Nannochloropsis_gaditana
ggggcacgtgcacacggcgcccagtacacccaacgtgtctagaggaagcggaacaaaggttcagctactatatgtgtggccttctccctctcgttttggatccacttctaccacttctgccctcgcgtcttccctcatcctaccaggggcaaggaacacgggggatcaagtgcaccccctgccctcgctcactcctggttcacaactaattaaaataacatccatcatgacgatgattcgggtccgcttttttctacaccatcctgacttactgctccaggttgctgatgcgtgcgctcgccttttttgggggcttagctcttgtctcaggtaggtcgacagtggtcagaatgagaatggaacatgtacgctgagattaaccggagtgtggaccaacggacacttcgcttctaataatcgtacccatctgtcttgccttccaaatccattacttgcgtgtctcgttgtgctagacgaagcgtgtttcgccttttaaaaagggcgcgtattcggctctcctgacgttgtaaaatgtgacatttgctgcgaaatacccgctgagaactctagagcagaaattcgcatagatttgataaatatttaaccgataatattgctcgtcctgaactctacagttctgccaactgttacgcaaggctacatgctggctacttcctctggatcatgccagggccccacaatg

SEQ ID NO: 3299 - DNA, 703 bp, Nannochloropsis_gaditana
gtctagttttctggggcaatgaggaaaagggcaccggatggggagaacctagtcatgttgtagcggtagacggagtatagggaaagataagatggtctcaatgtcgcacaccagaaagaggagagtacatgttgatagaagagataccctgccaactcctcatcttatgacttgagtcgtcggtggtcacagtcagctagagttgtacgaaaagtggttgcgtgagtcgaggaccgctgatctgggagataggggaagtctggtgatcgatcaccacgacaggcggctttcgtcagcttcacgcgcctgcgtccttggggccttgtcgtcgatgtcgagggaggataccaccttgccattgtcaaagagagcttggaaaggcatatttgcgagtgtggatgacacatgaagccgctaggcgcctctgtcaagcccgtggtcctgagcccgagcactcgtctcctgcttcttccatggagatatcgcacccctgacttttccccgtattcccgcctccccatcttctcacttacaaggcaaagcaacttctcatctaagttggaagagtataggcgtgcctagtgtaccttttgggaggagtgttgcgattgtcttgaacaggaaagcaggcgcgtcacggggagccgaggaaggaaacaaagcacgaaaaagtctttgaggtgttcgcggcccaggcagcatg

SEQ ID NO: 3300 - DNA, 703 bp, Nannochloropsis_gaditana
agcagcaagtgtgtgtctcattttcttatccgtacccgttcaagaagaaagcaggtacggggcgcgagtgcaggggggaagttaccccgccatggaggaacaggcctcacttgcgcagacgagctcctcaacaagcaggacaagtagcgctgtggacgttggccccgtggcagaaagtcatggaacagtccttccttaccaatcacaaagcatagtggaggagccaaatcatgcgcgcatgccgatggataaacaagaggtagaggtgcgcggggctggcgggcatgctgagggagaaagcctagcgtggccctatgccgcaaccgggtgtgatgtcttcatcaatgccgcccacaaggaatccaaccttccatcaggagcacgacagaatgggaaggcgagggtctccccgccttggacctattttccaaattcgtgcgctctcggccttggagatcggaagcctggtgtgtgtccgccgcatggagtgcctggtcatccgggccgcgaatccaccacgctgcctttcatcgtgtctgcccccatggcaagcagggcagccgaacccctctccccacctgtggccccgttcacctataccgctgcctcgcctagggcagagtttgagtgcgaaggacaagaggggcctcgcgccctgggaaactcgtctagcgcgctgcagtgccaggcgaacgccaaagag

SEQ ID NO: 3301 - DNA, 703 bp, Nannochloropsis_gaditana
gcttaagatctatcaataggattgatgcttgttgcggtgacgaaaaggattatgggacgaaaactgtctaacgagcgtgagtcacccgatcgatcttgaagcggacatggacggatgccaactaagggcccttccgtcagaccaaggcacctgtacgtacccgcccatcaatttgccgaaattgggattgcgttcaactcctgacatctgcaatacccggtcgcggacgccgcatctcgagcgcacaggccgggggggcggggtcaggaaagccagggaggaggtggcgcagagggcgaccgccaggagggctacttgtcgcatcatttgtcgagtgggacgagatctccggtctatgtcaaaaaccaggtatggaggcggctgagttatggtggacgcctgagccggcatagtgtggctttgaacagagataacgtgggggcgtggataggttgagggggtgggtggcggcggctgcctggctgagcgagtcttcgacgcggcacttggctttaaggcgagacggacacaatgaacgattgaggagaagcgtcctttaacaacggcattccatctctgattcatgtacacccaacgtagtacagggcccacgataggaagttggtggctctcgcgccctaggacgtggctgcttttcgttgcttaaactaaaatcactctcacaaccagagcgtcaaccatg

SEQ ID NO: 3302 - DNA, 703 bp, Nannochloropsis_gaditana
ttacttcacaccagagctggtgctaaaagagacgcaagaggaaacattgcctagaacttgaagacccagcattaccttaaacttagaccaaagatagacacaagatttgtacacttaaaagactaaatgaattagctatgtgatattttgttggcaacacatcctcagagcctgttaaaaagaaatatcatccaggacacaaatgtaaggattgaccctgcgacccaagaagtcggaacagaatacatcaaagagtaaacatattgccacatcctgcgcacaggctgagaaaagtagatatataggtttgaacctgctctattgagacgtgctatatcaatcagagctgagttgggtaatctctagggctcgcatgtctctatacacgcaatggctggcgggctcggaccaagcgggttcagacaaggtcggagtaaatcaattgacgctaccgcaaaattaaatttttgcagaagtagaccgctttcaccttaccttttcgatgtatactaaggtggaatgaattatcttctgtttcatgtcgtaatgtttggaaatgcgaggaggctgtactagcgaaggagtgccagggaccctggcccatcttgcacttcaagtaccctgccaggatggtcagcgaagcaatccgtcaaaggccttccagtacccggcgaccgaggtatctgaaacttcattcaccatg

SEQ ID NO: 3303 - DNA, 703 bp, Nannochloropsis_gaditana
gggcttctgcctttcaatctgtgtatcttcgcaaaaacatcgtgtcgcagcaaacgagcgcactgcatatgtacaccactttctaccgctcaccttgtccgcacgaggacctacctcactctagaaaatctcttgtacggctgtggcaaattcgatccgatcagcagcacacggaggattacttccgatttattgaaggaaaagaggtatggtatgagtggaggagagagcagtatcgagttaaagaacaacaaccaatgcaattgagaaatcaaatgtatgataatttgtatcgtggacatctttacataaagttttcagaaattctcaaagtagtgcgaaaagaattcggtgaataacttgcgatggcgtcattccaccccaccatataatattccgccgcgtcttctaataattttctatttgtccttgcacataaatttttacccaggagcctgataagtgtgaccaagccagcgtgattattggaaagggtaaacttgggcaagcgctggttcagtgggggggtgtgggacaagacgatctgcttctcgggcgtgacgactgtatacccaccgtcttgactgtctctaatggctgtaccttgaatatgtttcctatctatgtatgtgtaccagagtgggaggtggaaagtgtgatccttggttgtcccaaggagaagcggaacgacttggtgttcatg

SEQ ID NO: 3304 - DNA, 703 bp, Nannochloropsis_gaditana
gggggctgaggctagggaggagtaggacactgacaggggcgcagggaggaaagctcgggccggggctgccagcaggacgacaactcccacgaaggcgaggaccaagcacataggaacagaataacaagagtgatctattcttctccgtgtccaacccatggccttgctgaagctgtaagggtttgaaaaagacgcgtccagggtacatgaggttacttgaaccacttttggtgggtataacgcgtgccatgcaccgcccaggcaagacgaaaattgagaagattagaccgtcagaactctcatgttaaatttcattttcttgtgcaatatatttttgacgttatgaaccggttatcttgcaatgtgttaccgtatacacgtaaaaagggtggcagcacaagagagatccagccaccacgccggcttggtcatcgctgctcgccaggacagccacgctactcaattttacttgccgtcgaacaccagtttgcatccatccactccctttcggcacaggctggcagtccatacgagccctgcgatgagggcatcctcgtcgggaccccctgaggcctccacctaccacgaaaccaaggtaccacgtgttctacctccccacccccccacgccggcggacccccttctgagctaccccctccctgtcttacgttctatcaggagattaacggcgtcctcacagatg

SEQ ID NO: 3305 - DNA, 703 bp, Nannochloropsis_gaditana
  misc_feature (509)..(518): n is a, c, g, or t
agctgccgcagtgggacacgactgcccggaccggcggtggacgcacacgcgaaaacgtcttaggcggcgaagtgttgaggtatgtgaagtccgctacatgttgggagtgccattatgtgacccagtctagcctcgacaagagatgactttgatgtctcctctagccctttgcttttcttcagcaattgagtcaacgcagcaagttttgaatttatcttcccttctctacagtgacgaacgcggttgatccatgcttgcctttaagtccctaggtgcctccatctcactctttcgcccgtttcctcgtgccaggaatggctcatgcgtttcgcccgcgacatagaagcagcaaatgacgagatgtcgcggcagcaagcggagagccaggccccatgcctgaccctgagcaccgaggtcctcgacttgctcgcccgccacctgcaggggtcccacggattcccggttccgtgatgcgccagttcagctttccgtagagccggtcgccctgnnnnnnnnnncgggtgttgctcgcccacgtctcctttcacctcgtgttcttgttcttcaccccctgcccccgcacgcctcccgccctactgctccccttcttttgccccttatgctcgtgactcaccgcgcacgtgtcgcatgctgcaccacttgatacaggagagcaccgctttccctcccttcgagcgcgatg

SEQ ID NO: 3306 - DNA, 703 bp, Nannochloropsis_gaditana; identical to SEQ ID NO: 1184

SEQ ID NO: 3307 - DNA, 703 bp, Nannochloropsis_gaditana; identical to SEQ ID NO: 1182

SEQ ID NO: 3308 - DNA, 703 bp, Nannochloropsis_gaditana
cctcgcttttctcgctaacctccttcaagaatcacacgaaacacatgctcacgacctcacaccccattccatcccctaggagacccaacctttcgtgcagcagatacttaatgccaccaagacgtcaagcacgcccgtgggggttttcattacattcactccctccctggctcttcctttctgccggggccacgctggctttacctcctcccgtggggtctggcattgcttttgcacgcctttcttcatggaacacttgtcatttctctgtgttttcaagatctatcacacacaaaacgtcgcatccgagtatattaccagggaccttccataagtattacctctcaggcataggatctgcttcctcctccatcttggctagtacattgtccacggccccgtcaccgccagaagacatcgcggaggccttgaaagagcgaccttggcgaacaggcttggagccggcagaagacgttgatttgatcgagttatcggcagcatgcattgaggtacgtgggattccaatctcgcacataatgaaaaacttatgcgttgatttttggctgcccaggcacacaaatttcggagcaccctcaaagcttatttaaaccatcgatcgatgaccctctctcacacatggcgcttctttttccgttccagggtaccgtgccctccgacctcgtaggcaccttgtatcgcaatg

SEQ ID NO: 3309 - DNA, 703 bp, Nannochloropsis_gaditana
tgcgctgatagccccttccatttttttaacctctggttcaagctaccaagccttttacgaagttggaagatagcacattgttcgtacgagttaaaatgtgtgatctatctaaatcttactcgtgggaacggagagcttacaattttatcctgtcgatcaggaagcgcactcataatgcctttccattttcgtcaagattacatacccggacatacgtccggcactgcccaccagtggcacttaccagcgtcttttcgaggccgggacgcaaacactccgctctatgaagccacctcgcctgcgacatgtgaataatgatatgacagtgtcactttaccaacgctctagggatagaaaactcacttctttgtgtacctaatacccattactctcaccagggatacatttgccacgcacgcatctcccttcgcatctacctgtcaactctcaaaaaagctggctatacatctgaatcttacacagcgaatattcacgcgaagagcatataggctctagtttgtgaaataagtgcaggagctcgcgggtagcaggatttgaagccgccgtagcggctagccggtgcagcatccgcagccgcagctgagggctttccccgaaggcttgcctccattatgtctagacaactcagcgccactgccttcacactcattatttctcattctttaccactgggcaaattatg

SEQ ID NO: 3310 - DNA, 703 bp, Nannochloropsis_gaditana; identical to SEQ ID NO: 213

SEQ ID NO: 3311 - DNA, 703 bp, Nannochloropsis_gaditana
cttaccttgtagctaagtaccacttgaaggagaccgacaggcgccgaatcgacgtgttgaattttggaggggcgcgaagcatcactcaaaagtactttggaaaggccaccaactactacgcacggaacgaccccattctcctggtgaatcgccgcgccatgaatctgatgcagcagctgttgaatgagagcgcggacggggaggtgatctacctgaagcacaacacctccttcgtcttcctccagggccgggcgggggatgccctcacggaccactccttcatcgggcccacctatctcatggcgcttaacaaagaggccgcagtattccgccgctcctactaccggccatactggctggacgggctcatcatagccaagcccccggacatggggtgggcgcgcttcgtccgcaagcgcgtcgccgccgccacgggcttccacaactacttctccaactcgaccttggtccgcctatattatggagaggacaaggggaggatgacgatacctcggcctcggctcgttcgaccaccagcagtgatttcagctcgttttcgagccatcatcgtgatcagcaacagcatccgcggcaccctcagccgccattaagacagcaagacgaggtcgagggtcaaaaacgccccagacacttgtctccgccctttcttgttcatggagcgaatgcctctgcagctgccatg

SEQ ID NO: 3312 - DNA, 703 bp, Nannochloropsis_gaditana
  misc_feature (658)..(667): n is a, c, g, or t
tctgacggacccggcgactgtcgaagaggccgccagggcaacgacagggagcaccgcgcctgaagcggtggtggcgtttgagccggcccacctcgacccgttcttgcgggcgctttatacggatgccagcgcagctgcagccctggtggcatgccagggtcacacacagctcctcggcaacgcccttttctctcgcgatttcatcgaccccgcctcatgcaacgcagcgtgggtgcaggtccgagagcgacagcaggaggcaggcacggacccgatggacatcttgggcggcctcctcagtcgggaggaccagggggagttcttccactcggtgggggccatgctcttcagcaacccgcggccttgcgcggagatggcgcacattgctcgtgtcctgacccgacaacgggagagtatcctggccttggttcgtgttcggttccatctggcggatggggggggctactcggctttcgtgctcagcttccaacggttgccttgcagctcgcgctacatccttccctcggccgctgtgacgccctctgtctccacacactctgcaggccaaggaccagctaggacggcaagcaacggatccacgagcatcagctcctgcacaaccggcagcaacagcggcagcgctggcgggggggggggnnnnnnnnnngggaatgtgtgggggggtagcacgagtcgccgtatg

SEQ ID NO: 3313 - DNA, 703 bp, Nannochloropsis_gaditana
tcaggacagtgcggtcaccacgcttcgagacaccacccgcgcatccacaacccccgagtccaccgcagctacagtcttttgaggctgcccgcttggagtttgcgtaattcttccacacgcgggcgatcaagggtgccatccagaagatcggtgtgcgcggtcgggccgcggcgacgaaagcatgtgccttttcatagcgggccaacgcggaggaggcctcagacgacggaggtggtgacgacgaggaggaagctgcaatgggagagcgtctaaacggcaggggtgcgtagaaaaaagccgtacatgcccaaacgcacaaaagcaaggtcaagactgtgatgccagacctggacagctggggcgcgaggctaaatgaagttggctttctttttctcctggttgacgcttctcgctgtaacgatgacggctgatttggcgccttgcccctcattttcgtgtttcgcctgtgcaccaagaaatgaaaggaaagtagcgtgcggaaaattatgccgcgtggcacctaacatgggacctttgcgagtgcgcgttctgcaaatggggggctggccacccgcggggggtgtcgcgacacaggggtgaagggcaaggcagcgaaaggcctaggtccgagtcatcatatctcaggaccgttacgtctcttttgaaagtttcagccatagtgaatcccccgcacgcacgcatg

SEQ ID NO: 3314 - DNA, 703 bp, Nannochloropsis_gaditana
atccacgttttcccaatccatagctactgtatgcatggactgatccattgcagcgtctataatctcgtccacatcgctttcttctgcttgtgtttgcgccggcgagggagctgatgggggctggctgtcgaccgcggcgagacctatctctcgatacgcaggccggcgcctatgctctggtacagatgagcgcaagtcaaatgatatttgcacagggagtaggaaaccatctaccagagacaagagcaagactaaaatcacaagacaggaaacttttgacgtgaaaggtaatatggatactcccatggcgctggaggatatttgcgagctactttgaccccctggcgaggtctgttttagcagataatgaagaaaaaagaggtgataaatatcttgatacttattgtggccttaggacacttattcgggatccactgtgaagataaaaagactgtgggaaccgagttgaagcacttccggggtgttctccgaaacgctgcttcgctcaagccctcccgcagtacctgatacgtaatactgtacagaggtccaaaactcggtaatagggccacagaaccgggctcagtccatgcgcagacatgaataatttgtatcggagccactcatcctcacattgcatcgtcttgtccttcgtacaggcggtatcattcataatactacgttgcagccggccttccaaatg

SEQ ID NO: 3315 - DNA, 703 bp, Nannochloropsis_gaditana
catcccgagcgcctacaaaaccgacaaatggacatgagccgtagggcgaatttcaaacagaagtatgaagggtgtgctctgaaaaggaggtttcttttttaatccttccgccacctcgtgcgctcgtctcaatttatcaaatgccatcgcgaagggttgaaggggccaccttcgcctacgttgatctggcgacacgtctaattaaaagaacaagaagttgaggggaaagaccttgctcgcctttgatcagtgcctcaacgaacatctcctaatttgcctctgccggtttccgtatcggtagcctggtgcaatttcttcgccgtagaagttgatattgtctcttggaaggatacgtcgaattgctgcggatcccacggtatacagatccgcaagcagggggcgaatttgtgtcccaggcagtaatcccatctctccttgaggaaagaaagaagcagcttgctgtgctaagctttgatcgaaggcttaccaaagggcatcttttttttaaagggatgtttttttcttcgagaagtcttgccttcctgctctgggtgtacacgtactcacaggcatctattgctcggttcagcatgcgttcttaagaatagttcttgtaggctgcgggaaataaagccttccgtcctgtgtccctgtccttctcactgtccccttttcacttttttcagcgctttcgattaaaatg

SEQ ID NO: 3316 - DNA, 703 bp, Nannochloropsis_gaditana
  misc_feature (326)..(496): n is a, c, g, or t
tgcacattctacttccgccttccctcctcccctccatctcaaactccctcgcttctgaccatgatcccctcgcagccagcctccagtgcctcggtgaaaaattcctggaccttctcggggtcattcgtctccgtgtgtgcagcaaacgcaaagcggccttcaaagcctccctcactccctccctcccctccctccaacaacggcccaaacaaggaatagagacgagcccggcgcgaggagagcggctccttcacgtaagattggccgttgaggaagaggaggtcaaaggcaaagacgcagacttgaaccctcacgccctccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgaatattcctttctttcgtgccgcgacgataatgaggaggaagaggacgaggaaatggaaaaggaaacgggaaaagaaccggctgacgggacggagggagatggccttatggaaggaagcgtactcggcgtgaacgggaacgccgctctgtgtgaaggaaaggagaaaaaaagcttggaaacgccccctttatacgcgcagcaa

SEQ ID NO: 3317 - DNA, 703 bp, Nannochloropsis_gaditana
atgccgtctgccttcatgacacccacatccacgggcactcgatcgccttgttgcctgccccccggcagaatgatccgataccggaaataaggctccacctcttctccaacgtattgacatatctccacctgatttgcgagcaagacagccaggcgcccgtccgccgcccatcgtatggcatcaggatgctgtagcgtatcgtacaaaacgagcttttgctccagacacgagcacggggcacgggctgctggcggaagggacggttggtccatgcggtaccttgatgaggacaaaccagcccccccgatggggaagacaggctacgaaacggtatcacggtaggccagctaatgtctgtgtagattgagcgggcatgaaaggatcatgagctcacaaagcagaccaaatgacggcacaatctaccaagctcagcgacctcccctcctgggtacctcctctcctccttttaccatggctaaatcatcaccaacgactcacacatgaccggaagcacaaaatggggatcttcacacgttttcctaaggatatggccacattctgggccctttgacgtttgattctgacttggtcggggtaacgtgtctcacgcgattcgtcttctcccccaccctcatactcataggggtatacgcctgcattcttaccccgcattttctaacatcgtttcccgtttttcgaaatg

SEQ ID NO: 3318 - DNA, 703 bp, Nannochloropsis_gaditana
tttaggtccctattttcctttcgaacatttttcctcaattatcagaggttctgtgtggtacgaagaccgcctgcaaccaaaaaatcgcatgagacgaccggcgtcacgttccaggacgctagaaacgtcgcgatgagagttcaaagagcgcgaatacgaagaaagactgtctctgaaccccgtttaagggaagggctttgtttctcaaagaaaactacattcaaagtcaataactatcagtttcaaaaggacatgaaaagtttcaaatgttcatgggggggagtacgctcaagagggccccaataactttgagacatgactatgattgctgttgtggccaaaccacagtctttaaatctctttacgataatcggaggccgtaaactctcgttttccgaagtcgtttcaacctcctctccctatcgaaggcttgaacgcccgccggccaggggggagatacgcacgtttaccgatctgcacatgtgcaagttgcaatggatgcacctggcaatgcttcgacaaggccaagacacgcactcactagcacagtgacctctcttgtaatttccttcggggacctttgttgcttctcgcattccgcacggttatttccctccacgatattgccccccctgcattacatcgaacgccccgccccattcatagggtacccgtacaggcgccctcttcgacaaaagtgatg

SEQ ID NO: 3319 - DNA, 703 bp, Nannochloropsis_gaditana; identical to SEQ ID NO: 1087

SEQ ID NO: 3320 - DNA, 703 bp, Nannochloropsis_gaditana
tcctcctcctcctcctcactggcggacggatttctttctattacaccattttcttgcatctcctccccgtcagactcctcttcattcaactcttcctcagtccgtctgtttgcggcctcttctttctggtcttttgtccatcgggccatccgggcctcaagctccttgcgctgcgctttgtttgaggccttgaccttgggttgcgtcagcgttttggttactttggctacttttttctggtgctgtcgctgctgctgctgcagctttttatgtttacccatgacgtgcagccctgtgaatgcgcaagtcacgggcatgagaagacgtgaggggtcgcttgagtggccatgggcagtgactcggaggggagaggtcgatccagtgaaaggttgcccacaactttttgatggacaggccagacacagaaaatttaccatagagagtaccacatataccatcgtaacgtgctttgtcttcacaaagtacgctgacattgccaggacaaagggtctgagcgcaggatgtatctttggccgccctcgccgacctcccccctcaggcccccgctccttgcactgacgcgcctgccgtactcacacgacaaccggtcgataggttttccgccgtagtgtacatgccgtctgtgaagacaggaggagatcacgagctttcacggcggaagcgtaaaagtacccttttgacc

SEQ ID NO: 3321 - DNA, 703 bp, Nannochloropsis_gaditana
ccctcaggcccccgctccttgcactgacgcgcctgccgtactcacacgacaaccggtcgataggttttccgccgtagtgtacatgccgtctgtgaagacaggaggagatcacgagctttcacggcggaagcgtaaaagtacccttttgacctcgcttcatgctgcaaacctttgctgcttcggttctgccttcttcctcgttgtcatcagtccaacatggtgccatctcaattatttggccaacgctttcgtgccattggtgtacagcgggaaatgtcagctccacaacttcagagccgcttcgtcggcaggcactatggggccccagctttgtgcacgaccccgtcgtgcagcacagcgtgtgggggcgatagcgatgcgcgtgaaattcgacgtaaaaaaggattactatgcccgccttgacatcgacaaatcggcctcactcaacgatattaagcgtgcataccgacggctggccctgcagacacaccccgacgtgaacaaggcccccgacgccgccgagaccttcaagcaggtttgtgaggcctacaaggtgctctcggacgccgaggcccgcaagggatacgacctggccaggggtatgcaagggtcagggtttggcagtgggggcaggcggtggactaacgtgggtgggcggggcacggcctcctcctcttcctcctcctcctcgagagggtggtac

SEQ ID NO: 3322 - DNA, 703 bp, Nannochloropsis_gaditana
  misc_feature (1)..(698): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacc

SEQ ID NO: 3323 - DNA, 703 bp, Nannochloropsis_gaditana
tgtgatgcccgaaatgacgtgcgaccagctttgatggcccgtcgacctaatcgccttgagatcatgaggaggaacgaataagaaagaaagatagaatctcgcgaagagcagtatcaagaagatatagtggtatgagtgtttcccaaaagcctacattacactatattgtcaggatttactttcggctgctaagaaagaagtagatgtagttgtgcagtaagtacagcgtgcggggtttaaaacagagctgcttgcacacatcaactatttcaataaaaacctttttattgcgcaaagaagtctcatgttataagaatacaagatcattggctttacttcaatctcattgtgctcatggttatattgacaaatatggcatgggaatgatcgctcgactggccatacaaatgctgattcattctttttttcaaaacccaactgtatccaacggttgtaacggataggccgtttatttcggctagctgtccgggtcgcctgtcaaatcttgcccaatatacggctaaaacagcagatcgctctttgtgatcaacttaatcgtctatcatgctgagaaaccagttcaacgctgctctttgcttgcatgcacgctatccagacgagacttactgctctggtcttcattcaaccccgaatcatctcataaaacggtctttcaacgcttccttacggccgacagatcatg

SEQ ID NO: 3324 - DNA, 703 bp, Nannochloropsis_gaditana
  misc_feature (1)..(626): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccggaacggcacctcccttctacatgagctcttgaacaatgacgagaggtttgtggcccccacggccttccaatg

SEQ ID NO: 3325 - DNA, 703 bp, Nannochloropsis_gaditana
gaggagccaaattcatccacatcaggtattccttcctccctcccttcttccctccttttgtttctctgtccctcccttcctcctctctttcttgtccgtcttgtatggatgcttcaagtgcctaagacttcttttcctcttgctctatccccttattcgttctgatttcccccttgctgaacatggaattggctttccatttacttgtttcatccctctctttttcccttctctcctagcgtccctccctctttccaattctttcctctttccattcctctttccgtcggatccatttttccttcctcgttatccccatatcccagtcgcgatccctacgagatctaccggtctgcccaaaaactgcacgagaagctcctgattcagtggtgcctgcaaagaccaccgtatgaagtatgtagcttccctccctccctccctccttccctctctctctccctccctccctctttcccatttctttccccatcattgtttgggagccatcctttaattctttttcttgctcaaagttttcttcctcttcctttttcccgattccgcgtctcccttttctctcacctcttttctccattctttccctcttcctcacaccttccctcccttcctccctccctccactctcctttcgcaggacaaaaactggattaatggcaataccatttctcagtttcggcgcatg

SEQ ID NO: 3326 - DNA, 703 bp, Nannochloropsis_gaditana
ccctccctcccttcctccctccctccctccctcacttcctccccgcttcaactcttgccctgcgggacacgcgaagaagcgcgggcctacgtgattgaccggcgagagccgctctttcgacgatggtaaggcacccaatggatggtgaaaggagggaaaaggcgggggcggtggggaaaaaaaagtcgaagcagagagacctcgaacgaggcatcgaagctcctctgatcatcctccctccctccctccctccctccctccaggatcagcttgtactccaagcagctgaacatggtctcgctcttcctctccttcctggggctgtcattctccgcccgcgccatcgccagccaaggaggccgcacgacctattgcatctaccttaaggaggaggtagggcgggagggcgggagggcggaatggagagactgctccttcggtgacttgattttctgctatgtcactcctcctgtgtcaggtagtcccaccagcttgtttcccctttccgagccaagggcgactttctgtcttgatggtggccgcgagtgtgatcgcgctgtacgaaagcgagatttggtggatgcttaaaaccttgtcgtgtttttccaacgcatctgacgagcacaatgtggcagaagtcgattattttgtccgcacactctctccttggacgtttttaaccctccctccttacctccttccc

SEQ ID NO: 3327 - DNA, 703 bp, Nannochloropsis_gaditana
aatttcccacaaaggacatagaaagattaaaaaagggaaaaaaaaaatagatgagcaatgctgagatttgtcatgcccgaagggttatattcgctgtaatataatcctatgatagaaacgaacggggccaccttaattcgtggtagtcggagaaaagtattaatccataaacccggcggccatcttgtcccacagtattgctgcttaacattctgcctagcttctaagatgtgtggaaagactgcgaagacttaccacgaaagcaacataagtttccgaaagtgtcgaaccctgtatatttctcgggatatgatatcgtcaagactattccgtaccacacgacgttttgtattcgctatttcggtttacgtgagctgttgcatatgaagagcgagtctatgatctgtgatttattggtcatgtttcgtccgtttccacgtcgaattgggggcttttggaagccgcgagaatgatcaggctggggtcgagcacaggtgtgtccaagcccgctgagcgatgcctcgagtggaggtcaggtccttcccaacgaaagcctgtcctccagtactttacacgccacgcgtccttgccaactggtcatttcacgatcgattcactttaactcttttatggaacatcgtctaggctcgtgtatcgattgtcaaagtttgctgccgctcctcccttgtctcctgaacccatg

SEQ ID NO: 3328 - DNA, 703 bp, Nannochloropsis_gaditana
gggggaatactatttgaccttgcacaacgacgacatgcacagcaaacgggaagtggtggaggtgctgcagcaatgcctgggtctgaacctgcagacggcgcgggtcctgaccgacgtggtgcaggagcagggggaagcccggctgcacttcgggagcctggaagaggtgcggcccaaggcgcgacggctgcaggcccggtcgttgtccgtgtctctggtcacgcgccggctgcacaagatcgagaaggtggccgtgctcctggtgcaatggctgtacacgctggcggggatctcgggggggacctgccgcctggtcgttgagcagctccagccctccactttgaaccgtctgatggtggcgcacgggcacctacccaagcccttggccacggccctccacgccctctacctcttcctgatggcggaccagtcgttcaagaaagcagtggcgcagagctacgcggacacctaccttaccgtcacctcctactacgccgcgggcatcggagtggccgagtcggccctgtacaccctcagcgtccaattcttgaaccggtccgcctttgtaaacgacttggttggccaccgtcactttctggaggtactggtgcaggccctagcagacatgatccagcgggcctccggcccctcttccagtgccacttcccccccttcctccccgaccgccgtgaccgcgctccct

SEQ ID NO: 3329 - DNA, 703 bp, Nannochloropsis_gaditana
gttgcaggcgcaacatgtaaggaggatcactggcatctttaggcttgtgcccgcccacttgatagggcatgggaagcacatcgtaggtgttccccccagcacaaccaggcaagcgaggatcatctactgactgcatcggtaaccttgagagaataagcatgcttacgaggaggtaccgcgacttgcattgctgaattgttgcgactcatgaatgctcaggctcaggaaaagatgacgacgccgtttgaatttccataagatggtgtatgagtcggtgaagtgcaagagtcagagagacgcaacctggctcctgtgtgcggcagtatgacaggaaattggacatgatttccgtaagatgatatgacatgattaaagactatcttgtcatatgtgtttcatcacttcagtggtgaaattatgagaaaaaagacggttttggaatagctcaacctgtacttgagcctccccggttacccatcatacaatgatgcgttttggcggaaagtatgcccatattcgcgcatgccatgcatttcacatgttttcatcaaaatgcacgaccatgacatgcaataggatgagcagcagaaggaggagacgcctattgcccgtcaacttgtattccctgctgcttttcctgtttactacctcgcttcctgtggggtactcttttttcactcctagagcaaattccataaattgt

SEQ ID NO: 3330 - DNA, 703 bp, Nannochloropsis_gaditana
aggcgaagttgattctttgccgctgctgctattaggtgtcgcattttatccttgttttctcaccgacccgtgacagcgcaggctggccatgtggcgtgcattgaaccatgtaaaaatcgatctttattgcacgcagtgtcggtgtcttgcaccatttacggaaagaccaaccgagttctagatcgggagacgatttcgttgcaaccctccggctctcccgcatccggttgcgatatacccatattccgagctcttgtttgttcagaggcaagtggtcatgccgagggcaagagtttgccatgacggccgatcggcgggcacgaaaagcgttttgtacgtggtgttctgtcggcatgtgcgtgtgccatggtcgtgtctggtgcagttttggatattgcggtagttaatgcggccgccccaggcgggaggtaccctcagctcgctattctttccgtctttcttgagcgactgcttcgcgagcttaaggatttgtctcgttggacggcctgtgagcctattgggttagcatacacggaaataaaagggccagtccaaggcagcatgcaaaatcttccttcttgctactctttgatgatttttatttcaccctttgtatccccgatcccacttaattggcctcaggcggcgaagcactcagcaagaggttctccctttctatggagtactagtttggataaatcca

SEQ ID NO: 3331 - DNA, 703 bp, Nannochloropsis_gaditana
agccacaaacagatttgttatcccttggtctctgtctacttttggtgcggaagaatgtggaatgagaagagggcgtggcaatagagaaagcgcggcttagggctctggcacgatcaagcccttccgtcacatgcgtgtctccgctctcaagatgactcaggccggctcaaaaaaacagaattacgcaggaaatgcagcatgctgcgccactcaagccatctgaccatccacacgcgactccgagtctcatagaaccagagcgtggctccagtgagcagcaggggggcaggccgtgcgaattgtcaccgtctcgcgcccgaacacgtcgacgagatcttcgctcgttggctgtctagggggcaggaagaggcaaagcacgggctcgcttgaaggtgcccatgggacggaaagtcacacccactgaccgcatgctcaccatgcacacacctaattttgaacaggatccatcgccatcctagaaggtggacgttttgtcgagcccatggcaaatttccgtaaagaacattgtcgtcttgctgctggaggctgataccgaacgtggaacaattcccttttccggagtgaggttccccttgttctcctccctgtttcagtcaatttcatctttccagctcctgttacattgaaaagactagcttcattgaggaaacagcaattatcccgtttttggttctcgatcatg

SEQ ID NO: 3332 - DNA, 703 bp, Nannochloropsis_gaditana
  misc_feature (340)..(630): n is a, c, g, or t
tcatgtgcacttttgatcaagcaaaacagcagcacttacgaagcgaatgtcttttttttttaaagtcactacatatacgtcatatagcagcgcgcttcaatcacgcttgccttcgcgcttctgtgatgaaagtcttcgtttatgtgtgcttgaggcatggaatggacatcttgacagtcatagtcttgactccagttataacttctggcttcgtgttgtgacagaacttctgtcatgcaatacgccatggcaccgccaggatcgtctcatacgcctcctcactcctcattcgatttttctccccttaaatccgagtatagatacgacaaaaagctcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactcgcatcggaagcatgtgcctgttggagaagaggaagagggatccgtcactgccttggacctggcgatg

SEQ ID NO: 3333 - DNA, 703 bp, Nannochloropsis_gaditana
cttcttgcagatgttctcgaacgtggtgctaggcatgaagatggaggtgttcgatgacctcctggttgcctacaaggccagcaaggagtaccgttctgacacggacatgcaggcggcggactgggaggagatggtgcgccggtacaaggaggtgacgaccgtgcccgccgacccccacgaacagcttcagttggcgattcgggcggtcttttcttcctggatgacaccgcgggccatcaagtaccggcagtacaacgatatccccgagaccctggggacgggggtgacggtgcaggtagggccgccgggagggagggcggggagggacgagtgtgccggtgaagcgcgataccttcttttgtggcatcgctggtaacctccctcccttcctccctccctctctccttccctcgctccctccccgtcacccagagcatggtcttcggcaatatgggcgaagactcgggcacgggggttgccttcactcgcaaccccagcaccggggagaacgtgcatttcggggtagggttttccctccctctctccctccctccctccttccctccctctcgacccgaccctccgtttcttgacccccgcttctcccggatccctccccgtcaccggacaggaataccttcaaaacgcgtgcggcgaggacgtggtggctgggatccgcaccccggaggacttgacaggcctg

SEQ ID NO: 3334 - DNA, 703 bp, Nannochloropsis_gaditana
gtctacgccacactggatagccacgtcgtggatgacatggcgttgggacatttgggcataaaaactgtagttctttttgagaaattctatctcgtcggagtttgaagaaatattgcttatgaaaggcaggcgaatgtagctgtgcgaatgtcgtgacatgctgcacagaaaatttgcaggtcggggaggacctgagggctaaagctagggagatctaggaggattgatccctgacaggatgaagaataaacgggagagaaagaatatgggaaatgattaaataaagacgctctacgacattccatccaaggttttcccgcaaggagccagcatgcgggcgccaagacacagtggcctgaattgggaggcatgcctaggtgcccctggggaccggcccatgtcaggcaggggagaggagtccgcgaagcccggagaagttcaagcccgggggcctccgtcccttgcccggcgcccgcgccctgaatgacggacacagaggccagatgctgccctagcgccttgcatgactgtttcgtttggtacacatgtctctgctcgctcgtcctgtagacgcagtgcacgcgaagtgggtccatgcatgtcagctgaagtagcataaatatccacatctaaattgggcctcactagtggctgctttctctacaacaacaaaaaagctaccagaccacgaggaaacctcatg

SEQ ID NO: 3335 - DNA, 703 bp, Nannochloropsis_gaditana
cgagtttgtcgcaccccgtgtccgcctccacaagcagggtacccaaagcttgatcagccacgacgggcgcggttgaaataggggcattggcggttgttgctgcaggaagtgtagttagtgggcagtgaccgggcaggcgcggcacttgagggtcctggtgcttgctgtggggggggttgaagacggcggggcagggccggaggaaagctttcgagcaagcgacgtggaggaagagcgcacaacacgaaactctccaccagcgccgtgcccgcatccggaagggggcctcttttggtctcatctgtgtttcatggcatggcatggcatggcaaggaatgagcatcgagacaaggcgacccaggccctgaggccgcctgggggcggggtcggaactcgcagtctcgtgcccgtgctgacgaggcgagcctgaccacctccccctgcctcgcgagcaagtgcctgcgtcgggcgcaaggcgagggagtgcacgaaaatcgtactgacccgtccgtctgtgtctttgtctattgagcgccggcgtcggcgtcttttctcgtcagcttgtggttatgtctgtagcccaaggcgtctcctcgactcctgcctactcactcccaacattccatgattctgaccatacttatagaggacagagctagcaaacggagcaagaccagtcaaacacgtggacgcagataggatg

SEQ ID NO: 3336 - DNA, 703 bp, Nannochloropsis_gaditana; identical to SEQ ID NO: 304

SEQ ID NO: 3337 - DNA, 703 bp, Nannochloropsis_gaditana
  misc_feature (92)..(700): n is a, c, g, or t
tcccctaccccgtccaaggcaccgtgaatcgcataccccccctccgcccccccccctcctgcttggctcttcgacacaacttccaagccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgg

SEQ ID NO: 3338 - DNA, 703 bp, Nannochloropsis_gaditana
gcaacgagcctgacgcgctggcctgaaggagatcttgtgtcgatggtgcggtttctcccttatgtatttctcttgtagactttccaactcctgacatgcttcttttttccatgtcgtcctaattgtacgttgaaaactgtaagacactttaagttgtacaaggctgaagccttcacattcaagaaacggatgtgttcttcttcacgccgtcgacgaggcaaatccatcttcaaccaaggcaaacaaccatgccagactaattcacaccctccattccttccatgcgcgtcgccaccgcgcatcacgtctcaagagatcgcattgcatgggtattgaaggcagggccaggcccatggagaggccagaacagtaacggcacggatcgccggcgaagccctaccgtaggcgctgccccagcctcccggaggccgccatgaaagcattttgccacgccctcaagagagtaacgccgggtcgtgttgggtcctgcatgtcatacatgtgtctgaatggcaatgaaaaagaggctgctttgtttttgcaaatttttgagtcgtgcgctgaaggcttcattcatcgatatgaattccacagcagctcgcctgcgggtgcctcccctcctcctccaaatcggggcacggtgcctctgtggtgactcctgctccgttctcgtgcacgcagtaactgggcaaacattaccatg

SEQ ID NO: 3339 - DNA, 703 bp, Nannochloropsis_gaditana
tcttactgaccaaccagatgaccaccaaagtcgacgacgccttgccctccaccgctccctccctccctctctccacctccctccctccctccctcgcccccaccttgggcgagtcatgggccccggcttcggcggtccgccttctcctgtggatggacggggtagggggcctggcagggcagggagggagggagggagtacagagagggggcgacgacctgtcttctctccacgaccccgtccacgtcccccctctctgtcactctacggtgtcctccctccctcctacacttccccccttttctcctgctttcaacgcggcgcgtcctcgtcttcctcccttgacattgcctcccttcttctcgcctctccattcttcccttcctccccccgcccgcgtccctcaccacctatcccatacgtgcttccccccctccagatcaatcaccgacgggcaacgctcctcaaacacccgggccagccccgggcggtggcaagctttcggagtaagcctttctcaattttctccccttgatttggagacctcttttctgcatccctcagtgtccatgtcccagaccctccctctccctccctctccttgccccaccctccgcaccacgccttccccctcctccctatgtcgccggcctctcttcctttcccctcaacacgccccttgggggtcacacacctcctcctc

SEQ ID NO: 3340 - DNA, 703 bp, Nannochloropsis_gaditana
tggcggagttccgacttttcctcctcatgctgtttctccaacgaaagcatctcctcttggaactcttcttcgagttcttgcaaatcgcgatcaaatgctttttgtagtgtgtctacgtgagcgcggtgaaactctatcaatgtatcccgttgcttgctatgagcttcctgagctaaacatagattttcttgtgaatcagtggcatcagtttccaaaatactgagcagcttatctttttcctcgactgctttcccgtatcgaatggccaaggatctaatttcttcagctgctggttccatctttggccatgtcgttgtccgttgctggagtgcggcccatttttcagccaaatcgcgattagaatcatgatgaggcaaaggctgtgttacctcaccaattcgatgttcatctatcatacctactaagataaagaaatcatgctttatttcagtcgcaagcgcatatttggatcagatacaagcgaatgcactcaaaacaaaagagtgggattgcactttttggtaacggggagacatgcgtcatcgtgttcttcggcgagccttgggcgctgccgcgaaaacgtccccgccccccggcctaacgccatctttcattttcgtatatctgcaggtgtgatacacgaatatcgaattgtcaatactactgaaaattttctagcgaaatgaccagcatataagggatg

SEQ ID NO: 3341 - DNA, 703 bp, Nannochloropsis_gaditana
gaaggattgcttcagtgggaggcatactaaaaaaatcaggccagcttacgctgcgtcctcggattcgcgcgtctcttcttggacgtccacgtccaaagcctccccacatgctcccaagaaaaccctcactcaaacttatttggatctcggccagagatcgcacgggaaacgcacgctttgtggcacatgtggcctcttatacgtaaatggccaagaggaagacgagaaagaccatgtaaaattctgccggtctgttgcagctggccttgtctgccccgggtggcgggaccagcgcctagtgtggggtcaagaaggagtggacgggagggtgattgaggttcgccctggggatggagcggcgccactcacaaagatgagggaggtgaaacgtgtgatggatcaagaaatggggtttgttcccctcagagaaggtgatatagtgctcaagaccacagagaaggctttcttgtacgtgcacggaaggcgcgtagtgggctgcgtgatcgcagagaagataaatgtagcacatcctgtgtcaggaacaataccctcaaaggaagggtctcatgtctgcggaatgcaaaagcgttcgcgaggctcaagagtgtccgggattgctgactctctgcacggaggagagggagagggcccagaggggagggtacccgcggcctcggggcagaacgagcacaccgacagcatg

SEQ ID NO: 3342 - DNA, 703 bp, Nannochloropsis_gaditana
  misc_feature (64)..(73): n is a, c, g, or t
cccaaatgtgcggtccatcgatgtaagagcctctccgttcctccctcatttgttgccctccgtnnnnnnnnnncccctgacaagcttgcttttgtccctcccctttctcacttccatcgaccttcctgccttgcaggtgctagcacgggcctttcccctcgccatgtttggccgttttctcattggtattggggtgggcctcgggctcgccattgacgcactttacattggcgaaatcgcccctcccagccaccgtgggcacctggtgtccttctcggaggtggcgctgaattttgggatcatgttgggttttgtcgcggactacgcacttctagatgtggggcctggactggattggcgcttgatgctgggcttagggatggtgatgccctccatcctcatcgtcctctccttcacggtcatgccggaatctccccgctggcttttgatgcggggtcggcgggaggaagccgtagcagtattgcggaaagtttacatgccagggagcaatgtggacggtgttgttgctcagatagaacatcatatacaagctgatttcgccgcggataaacacagcagttggcacgccattttttgtccgactccgcccgtgcggctgatgcttttggcagggattgggcttgcggcttgccagcaattgagcgggtgtgaaagtttgatatatttctctccagaattcatg

SEQ ID NO: 3343 - DNA, 703 bp, Nannochloropsis_gaditana; identical to SEQ ID NO: 924

SEQ ID NO: 3344 - DNA, 703 bp, Nannochloropsis_gaditana
tttattctagcaccgatttccaccgttgtgagggccgaacgaggacaatttcgtgcgaaacaagcacgaacgcgcacacgattagtaggacagacgagcagatcgatggcatgcggcacggtctcgcgttctcggcgaccaggacaacggagcagagggaggcctgccgagttccgaggggcattttagtcccaaaattgtgttgacacgtgaacaagtggcttgaaaagaggaaggaaatgcctgggtttcccttcgagagcgggaactcgcttgtgcgtcatcctagctacccatggtccctttgtgggggaggctgtttcgtcctaccgaatgtgtggcgctccatgcatcttctgcctcccaaaccaccaacatgagcacgcgaaggaaggagaaaaaagtggccgcaacgttctcttctcatatttattgtctcatcacaaacataggtacataatacaacaatcatgatcgtctacaaggatgtcattagcggtgacgaagtggtgagttatctctcggacccgtgtgacattccttggtcaccttcacgaaatgcatccttgtgtatcgcgccggcacgaaagatggacattgcttgacaggaacgtgtgtgccgcggattccaggaagcaaggaccgccacctcccgtttctcgcaccgttgagcttgcttcctgcatgatccttgacctcaata

SEQ ID NO: 3345 - DNA, 703 bp, Nannochloropsis_gaditana
caaaataaaatttattctaatctctacgtcttcctaatctatgcagccagtcgataggatagttggaactttttgcctgtacgcggaagagcaactagtaccctgaacgggccagtaaaatctggccagctcgataccttctctgcctcgcaacggcaaaccctcccgacgagcattaagccaaattatgcttctatccgctttatattcatagacacattgcgaccatgcagcacggccccgtgctcgtcaccagcgccgtttgcccgtggtggagtgcatcttgaatggaatatgggccggtaaagtctcgccagggggagggctcgaaaacggcgaacaggaacaggggcgaccctccttgggaatgaggagggggaaggccaggtcagcttaagaaagggcgggatctggcgtcgcgttggtgtgaggaatcgttaaggatgctcgttgcatcactcatgacgcgtgcggaacgccattatgtgtggttgtcaaaataggcagcctctcgcctacctgactgagcctaggctgtcctcgctcgtaactcgcaacatcgtgcagaaaaaagacaactcaatttcctaccaaatttacgtctacacattcttaccttcatatcttcacaggttaatatcgccgtgccacccctagacttcaagcaatgagtctgcaaccgcatctcgctttgcttggaatg

SEQ ID NO: 3346 - DNA, 703 bp, Nannochloropsis_gaditana
cgtcgccattgcacaagaaatcggagcgaaagtaggccgacgtccctcccaccttgatcaggtgcacatccaagggcgcggcccctggtctggcaatgcagtagcctttcccttccgtcacacaagcccatcccccaacggagccgcccgtggctgccaggagcggcgcgatgtcacccgagcgcacgtacacgtctgatcccgacaaagccccctcctcgtcctccccctccaccgcactggcatagctacccgctctcctctccccgccaaacccgtcacgacccgcgtccaaggtacttgccagcccgtccatctccacaccatccccccctgcgcccacaacactgcccactttctcctttcgtcctccttccccgcccccgtcgctgcttctggagcgcacgcggctcgggcgagcacccggcgagtgaccagggaagacagatccatggaggccgctgctgctcatcccagcctcggtcgcgctcagcctgtctgtgtcttcctctcccagccccgcttcgccgccagccgccaccagctcgcagtgatagaaataccgcttgtcgcaccgccgatgcgcgccccccggactggccgccacggaattgtgcaggtcgtagacgacaatgtggaccgaggcgtccccgaagtacccgcccaggtcgatggacttctgccccgcgatgttgaccagctg

SEQ ID NO: 3347 - DNA, 703 bp, Nannochloropsis_gaditana
tgtctaccttgtgatgatcctcctcgattttggcaagctgaacgagtgcctgtttttgaacgtgctgttcatggtcaccgatgccacggaggtcttcgttgtcatgacgtgtttgcgtgcagtgctagggatcgctcccgtcagtatcattcggacgggggtgggaataaatgccatcctgcttttccccctggttctggcccccttgaaagcgggcctgaatgctttgcttatctatatgtgctacggcgcactgaaccttcccttgtctgaaaccctcgtgatttggctgattggggacctgtttaccgacttcttcgtcgtatactcggtgctggtggtgcgctactacctccagctctacctgatcaaggtgaaggagatgaaaatgtgtgagagggagggcagaaaggagccggaagacgcgggccgggccgagacggcgaatgcaatcggcatgggaggcagtctcagggtgccgcatggagggccgggcgaaagctcaatgggcggggcagggcgcacgaccccggctctgaccaacggggagagtatttatcactttacgcaaacacgttacgagaacggggggtggggccaagaagagggtgacgaggaggaatcggagaaggagtggggcagcgacgacagtgaatacgaggacgaggaggaggatgaggaggaagacgaggaagacgaggag

SEQ ID NO: 3348 - DNA, 703 bp, Nannochloropsis_gaditana; identical to SEQ ID NO: 1160

SEQ ID NO: 3349 - DNA, 703 bp, Nannochloropsis_gaditana
cgagcccaaaaaatattgggggattccctgcggaaattgtcaagtttggatatttccagccataactagataaccttgatgtacatgtttaatgtgactatcagtgcgaaatgtgtcccaaaaacacaataaacggtctaaactactcttcaactatcaaattggttactcctcgaaaagatttcaaagattctggcaacatgttttggtaccgcgtgatgcagcggaacagcttcctccggtgcttgcggggaatttagtgggaacagggatgttcaacatctgagcgggtattcaagggggattctctcggaacaaggacgttcaacgtctcgtcagggacgctgcagagctgtgtgcatgttcgttgtgtagaattttcgtttgcttcccattatttatgatttcttgtttcggataagcttcagctctttgtatccttcgtcacgatgaacaattcaatctaacatacaagctacaaattttttattacgtagtatccgaatccgatctcacatcagatcctcattttaattcatgtttgggatccataatcggattaatggcaagattccttacaaacatgtgcgccgttgtacaaaaaatgactaccaaaattgaaagcccaatcacacactcatttatgtttgtaccacatctaatcacgtaaagcaaacctttcaaaaaaacctcttcaaccatg

SEQ ID NO: 3350 - DNA, 703 bp, Nannochloropsis_gaditana
  misc_feature (1)..(498): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaaaagcatccgcagcgggcggtagcttgctgctgcctccggacaaggtggcccctctgccccccttgctggggcccccgccgcagtatggtcggagcgtagccgcgttccgaaggcgggagatgatcggaaagggaacttacggggaagtgtcgcgggcggtggacaaagatactggagagaccgtcgctctgaagaaaatg

SEQ ID NO: 3351 - DNA, 703 bp, Nannochloropsis_gaditana
gtcgggaggtcgaaggcggcgcttttggataaagcggcctcacgttgacagccatcaagcttcattctttgtgctttttcgtatgaataatatgattgatatggatgatatggataagatatggatgatatggataatatagacataatagtacagattttgttgtttttgctctcaaatgctccccctctgtggtgctatcgcgcccaggccgtgagggatccgttaatattgataggcaagtcgtccagtgttgaagcaaatattctataaggagtgaataagttcgacagaatgacgctgttaaaaggtctcaatgcttcctcttttatgatacgtttgttctcacttcgtctgacgcagtccctgcacgtgagtgcaagttgcatgtaatgatcacactccatgacccacgcaaatgtcatcgacttcctgccatagttattcacggatcatactgtgcttttttttttagatttattggtagtaaacaatgccatacgaggcgaccactgatttaaatgaaaacagtgcaatcgttcgcatgaaggcctgcctatcgaagttcgagaccgaggaaggaagactgaaaggttttgcattcaagccttccccaaccgatatacttgttgttacgtcgcctaaagccggcacaacttggatgcagcagatttgtcatcaattgcggacatgtggtgacatg

SEQ ID NO: 3352 - DNA, 703 bp, Nannochloropsis_gaditana
acgaagacgcgacaaattactatcgtatatacagtgtgttgtcctttacttcctgtgttttttgtgtgcggatgtgaggggatgacgagcgcaaaaaacgtccaggcacacaaggggggtcgccatcttgccatgcgcgcatccagcgaggccggcgggcgagtcctggcacttatgtcctcgagacccatgcctccattgcgacgccggtcaccgcctgcctttggctccatgcatcaccctcccctcgccctcctagctctcctcttaagcaggcgttgaacctcgtttcgtcccttaattgggtcatgcagtgagacatcgttggctgcgaggacgaggtgcaggtgagactggtggtggctagctacagacagggaggggacgcgatcctttctcggcatgacggcacgagtgcgaggcagtcctctgtgtgtgagcaagacacggtgcctgtacggctgtatgaaggtttccgcttgtgtgcattctcatttgacgccttcttttacggcgttgaattcctagaattcttgtggggagccgtgccgctggtgtccagcacatcataccccacgttcggcacggtcattccgcttttttgactcgttctttgcatccatcgagtgtgttgcgtgcaaggaggagcgcgtcttttcgcctcctccgccccccggggctgtggcggcagtgaggcggcatg

SEQ ID NO: 3353 - DNA, 703 bp, Nannochloropsis_gaditana
acactccgtaccaccagtgagagaggggcccgtgcccgacgaagcccggtgcgttcccggttcggtaagattcgcgctgcagtcttccccatcgaaaacaaggaatgccaaaaattctttatgatgagcggtatgatgtttttcatcatctacgtctacacggtggtccgcgataccaaggataccttgatcgtctccacttgtggggccgaagccatcaccttcctcaaggtctacggcgtactgccggcctccgccctcttcatgatcctttacgccaaggcctccaacgtcttggggaagaaggccctcttctatgccacttcggtcccttttttcctcttttatgctgccttctgcaccctcatttaccccaatcgtgcccatctcatgcctcacatcgacgcacaagcgggaggcctcggcttcctcgtctctctggtcaaaaactgggactattccctcttctacattgtctcggagctctttgggagcgtgggcgtgtcggtcctgttttggcagctggcgaacgagatcatcaaggtgcacgaggccaagcgcttttatccgctatttgggcagctcgccaacatcgccccgattgccgccggtcaaacagtagtgctctcggcccatatgacggaccctgctagcaaggatcctttcttgaaaagcatccagcttatcaccgtctttatcatga

SEQ ID NO: 3354 - DNA, 703 bp, Nannochloropsis_gaditana; identical to SEQ ID NO: 145

SEQ ID NO: 3355 - DNA, 703 bp, Nannochloropsis_gaditana
ttgaatatttttccttgcatccatcaatactctccatcataaacattcacaactatgacgatgaccttcagcttgtgcccaccttttatccagcaaggtttcctttatgtcaacaagagaaaacagcatccgtccttcctcatcatgccagcaattgcatccaacacatttgatatatcgcatcactggcgctgcggcgcaagcgcggattgttcccttgctgcaggagagggctgaagtgcactggtgagcatcgcgaaggagggaggttggtgcatcgcgaaatgtttcctttataacccgagcaaatcacgaattccatctttcccaaaacgagaaatgactcaaacgttttcgttcgtttcgttttcgacatcgcaggattgctggtagatgtcaaaatgcatgtaatcaggctgatcctcctgtcccccttgatttcgtctgggagacccatgtcgcgcgtcgggataagccccttcatgattgtgcccgtgttctcaatcgtctttccaacactgttatcctggaaaataaggcatacttctctcacattctagcgcttgtatccagccaaaatcaggacatacccgttctggagaccgcagtagttcgagccatggatgcccaagcctggcttgatgcacgccgaagacaattacggacagtacaaaacgcaaattacaccgtatttacagattgc

SEQ ID NO: 3356 - DNA, 703 bp, Nannochloropsis_gaditana
caagccagaagggtgtccaagtccttttcactcacggaaggccgcagagttgacagtgcctccaggaagtggcggaactgaatgggagggacgtcggcgacagcaagtgcagtgatgtcgccagccaagcccgcagtcatgtcgcggatgggtcccatggccgcctcagtgcagagctgatggacgtctgagccgctgaaaccacgggagcgcgtcactacctgctcgatttcctgcggggtaagctggtggttgttggtgcgcaggagaaggacaattagagcatgtcgagcttccgcctctggcagcggaatgtagagccgcttcacgaaacgccttctcgccgcctcatccagttcttgcggtcgattcgtcgcgcccaccaggaggactcgcgccgccgccgcggcgctgccacagccatcgagctgaaccaggaactcagttttcatgcgtctgctcgcctcgttctcgtcggcactgcgctggcacaaaagtgagtcaacctcgtcgatgaagacaatggacgggctcatgtaggccgccagccggaagagtgtacgcacgagcttctctccctccccgatccactttgacgtgagggaggaggcggagatgttgaagaaggtggcccctgactgatgggcgatggccttggcgatgagggtcttgcccgtgcccggtggtctgaggtgtgtggatg

SEQ ID NO: 3357 - DNA, 703 bp, Nannochloropsis_gaditana
attttttttcactacatcttgctactgattggtactagtagttacaaggaatagtagcagtaacaagcttacaggctttaagctcgtttactttgtatcttgtaccgtgatattgtcagcacccattcaatatatgggttacgtatacttacactttgttgttgcatgttctgatggggattcaacgggctcgtcgttcttgaattcagccagggagttactgacatggtatggtatgtgcccctgagcagatcgaagggcgggctcggacatgcacgcataaatgcaagcatgggctcaacaagtcaagccacacacgggggctggattgtggcacagattatgtgcccacattcaactactttctcagtcgttgtcgcacggaagtggccaggttgtaacgattgactggcggatggaagcctacaagcgttcacttccaggcttaagcgttgcctcctgccttaaataggtcgactgtcactacattctctcgcttttccatttctgctcacgaattaccttgatttctatttccgtatgacgcaggtgttttgagtgtgataagatatagcggttgtacgcttgatttagtgcaatataccgaagtaagggtttccgaagagagtctgcagaactagctttagagggtgcgcaccatccatcgtctttcacttcaattttagacggtcacacccccatg

SEQ ID NO: 3358 - DNA, 703 bp, Nannochloropsis_gaditana
tttcaaaagtgatccacaggcgcctgcttgggagtgttgaggaggtacgtgaggaacgtctcgtgatgagcttcgaaattgacccgagcaagcaaattttggagataactttcagtcgcaatcgtgctgaagcatacattactccaatcaaattctatgccagacaaagcgagacgggaacggaagacaaagagaaggctgtggacagtcggtgccctcaaaacagtcggaaatgcgccatcctctttctcgactactctcgaagaccgtaagaatgcatgatcatgggaaaaaaaccacacgtcccgatccccaatcctctggatatagtttagatttaaaggaggtaattggaatgcatttgtgaattgtccttggatggtgattcctgcccagcttgactgccaagaagacgagaaccctcatgaggaaacgcggcaaaaacatggaatcgaaaagaaaaatcatcgccgcgagccatccatatgcccatgcgcgaggtccgaaggataaagcgcatgcctcgctgtgtggtgatggagaaccaggagtgggcagccagctaaatctttgcggcccggcctggcggggggcctcgcttgaacgggaggacgagcctcaaggaaacttacgtgttgctcgccccggcctctgaccccgtactttctccacggaccaacccacaggcagagatcaggagatg

SEQ ID NO: 3359 - DNA, 703 bp, Nannochloropsis_gaditana
ggacggaggacaaaggaggatggagcggtaaagcacaagcaggcagcacttataagggttctgctcaaagtcggaagcaacgggggcattcagccacgcaacctgaatcgagagtgaactgatatcaaattgaagaggagttgtgcgacctgcaagaaaaaggaacgaaccaggcggaagcggttgtcctctgcaaggggacaaggaagagagaacgtcaaaattgggcgaggcacttgcccatccatgtgactcagggatgtacgtgcctgcttccttacatccttccttagaaggtcacacagccatcctgatgacagtgcttcgtctccatgtgcgacgaatggctactcaccaacctccccactcgcgacgtgcattcctctgtacctgtaaggatctccaagacgggaccaaagagaagtgtggaacggtacgtatacactagctactcaccaacctccccactcgcgacgtgcatccctctgtacctttaaggatctccaagaagggaccaaagagaagtgtggaacggtacgtatacactagcaagttgcgaatctcatgcatccatacgtgagagtcgccagtacgactgaatgaatgacatgaatgacacggcatcatacgtgaataatagtactggctcacaacgaacactctgcttaggcctggatagattgaggcaagtaagacggtcatg

SEQ ID NO: 3360 - DNA, 703 bp, Nannochloropsis_gaditana
tggcgcccaacgcttccttctgcacggcggtcggccttatataacccaggctctcaacacgcgccagtaaccatgatggcaaacggtcgccgtaaagctgtgagaacgtctctgcggtcgtcccgtcgttctccgcgacatgcatcatttcttttcccgggggcagcgcaccatgaacctgatttgtcggtcgccgtgggggcaagctggaaaggaaggcagcatggcgaagagtgtggctcgaggaggccgaagccgtgacataaagaagggtgactgaaaacaagagagtttcacgttgccatagtctggtgctgcgtgtccgattgctaggagcgcagtcatggcgggccatgcgggatgtcgctgttgcagcaacccaagcttgtgacggagggtcgaagaaccttctcctagcaacccccgtggcttgatatcggcatacgctgccctgcatcaaatatgtgccgtatgaccaagaaaagattgagatgatgttggtttcgggagcatcggtggtacaggggtggtgagacagactagtagcgcgggcgacagcgaggttgcagctccgcctctccagtactttgaaggaatccccccaacctctttcacccacgaccacagagcgataccagaaacgcacaattgtctagctccaatcgcatcagggtagaatcttgacacgtggctcgtccaaatg

SEQ ID NO: 3361 - DNA, 703 bp, Nannochloropsis_gaditana
atcgagcgggaagacgagcgcatggaaggacaaggggtggccggaagaaaagcggatgtccttccattgattgagaaggacaaagaaagggacggtaggaacacgagaaatacgaggacatgcgagaagaaatagggcgtgggagcctgccattttctaccgcggttgcacttgatgagggggcagtgcatggcaacaggaagaaaaacgagacagccggatacccgctcttgattctccacgccggcagcccaagttacccgctcttccagctcctgccatcgaggagaagagagacgcaacgtgatgagcttatgatccgccaaacttcatatccaccccgggttgaggagcgccggttgtgcccggcgagagggcgaggctctatcaaggggcgggggcgtataccgagcttggcagagccaggaggttaaaagaatgacgctgcgtcagcctgacacgccacccttcttgggcgcctgtgtggaacggccttggatgctttcagcaagttctatggccatggttggaagacaatgctgctgcgcgtgaggcagattgaaaaatggaatgtgatgggttgcatgatcgtgcgttaagtggtcagagcgctccctcgatctttatgatgggctgccacttcgacgactagtttgttccggattccatcatcacaaatgttattcacgtctcacaaaacatg

SEQ ID NO: 3362 - DNA, 703 bp, Nannochloropsis_gaditana; identical to SEQ ID NO: 438

SEQ ID NO: 3363 - DNA, 703 bp, Nannochloropsis_gaditana; identical to SEQ ID NO: 439

SEQ ID NO: 3364 - DNA, 703 bp, Nannochloropsis_gaditana
gtggaggacgttgggggggggggaatcgagcaggtggtgcgggacttgaaggagaagctggcggactcctccctttcagggaaggccaggaagcgcctggagaaggacctgggggcggcggagcgggagcaagaataccagaaggctgcgatcaaggcctcggcagagggcggtcagtttgcctgctcccaggcggcggtgaacgagaacgacccgcaatggcagaacgccctggacattaaggtcccggacttctccatctctgcccacaacaaggagctgtttcacaactcctctctcagcatcgcccacgggcgccggtacggtttcgtggggcccaacggtcagggtaagaccacactcttgaaaatgatcgcctcccgggatttgaagatcccgccccgcatcgacgtgctctacgtggagcaggaggtggtcgccgacgcgacgcctgcggtggatgcagttatgcgggcggacaaggaacggtgggcgttggtgcaagaggagaaggcgctgctggcggccttggagcaggggcccgacgaggacaaagacgcccggttggccgaagtctacgaggcgatggccacgatcggcgccgacggagccgaggccaaggcccgaaggatcttgtacgggctgggcttcgacgagggcatgcaggtgaagcccacccagaacttcagtggcgggtggcgca

SEQ ID NO: 3365 - DNA, 703 bp, Nannochloropsis_gaditana
gtctaatatcgttgacaacttttgactcaattcactttctaaatttgccatcaaaattcctaaactatttctttgcttctctcaaaaggaagtacaaaagtgagggacggcggtggtcaatggggtatcttttctgccctactacacacgttctatctcgccccagcccccctcgccggcccgagccagaagggattgccgggacaaaagcgacaacgtcaaagcttccgctgtcttctgcgccgcgtgttgcgtaacacttcttctgatgaggtgcattggatggtgtcgtacgtgttttcgcctcctcgtccacaccatccgactgtttgtacccatgatgacgcgatcacaccgtcttcacgggttgggacactgtcgtcttgctgtctgtcaacgtgccacgctacctcgccttcgacaaagatctccatgccatccgcggccgggaatacctggatttaggcatagctcccacatcatggggaaattcggcatgccacaccgctcatttaactcctgagcgctgcaacatgtgcaagccaagcgccaagacgcccgagccacttgttcagttctcaagaggggccgggaggatcgtcgcgggcttcgatgaaagcgtctcgcttcagtttaagccccagcgtcattcatagtcacgttgtttttctcacaaaatctcatttttccttgcagaagtatg

SEQ ID NO: 3366 - DNA, 703 bp, Nannochloropsis_gaditana
gattggtaagcaacgaaaggccagcgcggaaactcgatgaaacaagtgaaaacaggaaactagggctgccgttggatttgcaggcctctgtagcgtgtcaggttgtaggatacgacactgtttcgcctgcgagagagactccgctaggattgggcctgtcggcttctctgtgcctccttttgacacacacactccacaaaacaaagatgtggtatgaacagcagggacgggggtcatcgagagcaccatgtcttggacacgacacgacccatcctgagagaaagggaggcacaaggggcagcccgcgggcggataggaggcaggcgggttcgtccgttggatttgaaattttgaatttctcggaagggagaagagacgaagggcagtcctccgcccttggcgagctccggccaaggcgcctgggacctcgcccttcaccgctggttttgggcctggctgaggggcggtgctgtttagttgtgtaatgatatgtaggcattattgttttgatgacgtgaggatgtccgagagctgttggaccttgtggagccactgttgtcccggattctgttcttatcgcggctctctgttgcggaagtggcctcgcatcattaggctgggatttgttttcatcttatatctccactggtgcatttcccaggcaataacgccacagtagaactcgtcttggtgtagtgctatg

SEQ ID NO: 3367 - DNA, 703 bp, Nannochloropsis_gaditana
aggagggcacggaggggcagaaagaggaagataagaagaaggacgcagtgagtggtgctgagggcggctttcgtgagtcgtcggtcccagcgccatgtaagcaccacattcatgcacaaacaccagcgcgtgccacacactctctctcagagcacagtaggcggctaggaatgacgaccattcgtgattcccagcctctcccttacgcgagccgcgaacggaggaggcacattagcgggcgtcagaggcgttaccgaggttgccagaggctgtcgctgaagcggcttggggcagaaaaggagaccccggacactcgaccacccacgtcgcattccattttgaggaaggagggaggacgtgggtagacaacacatggaatggtagctttattgtggatttcacttgaattttggtccctgaagcctgctaattaattgcgctgctagctctgcagcagccttcctcaagccaagccgaccttgaaggcaatttcgcttacctttccatcccacctattctttcaggccccagtgaaccacacggttttagcctaccttaaagaaagcattagtttttttcataagtcagcgtcgagtggtgaaaagcctttcttaggattggtcatattctcaaagcagctctcccgaattttgaactcagactttgactttcccgcatacaggcaggtgcatgtccgatcatg

SEQ ID NO: 3368 - DNA, 703 bp, Nannochloropsis_gaditana
  misc_feature (1)..(198): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtccttcggctggcactctcccacgcacactcacgtcacctctccccccatcttcttttcccctcccttcctccatccctcccaaagggtttggggaagaccatccagaccatctccctcctcgcctacctggccgcgcaccgcgggatctggggcccgcatctggtggtcgtgcccacctcctgcctcgtgaactgggagaccgagttcaagcgtttctgccccgccctcaagatcctcccctactacggctccgcccccgcccgcaagcagctccgccagggctggactaagcccggggccttccacgtggtcatcacctcctaccagctggtggtgcaggatgcggccgccttcaagcggaagcgctggttcttcctgatcctggatgaggcacacaacatcaagaacttcaagtctcagcgctggcagaccctcctcaccttcaacagccaccggcgcctcctcctcacgggcacgcccctccagaacgacctgatg

SEQ ID NO: 3369 - DNA, 703 bp, Nannochloropsis_gaditana
gggacgggtgtctcggcgttgggagggcaagggagaggcgcggggggggcgggggcggcgcttactgtcgataacaaggacatgtgtgccatttgtctgatggactacgtcgaggaggaaatgctgcgggagctgccctgcggccaccgcttccacgtgggctgcgtcgaccagtggttccgctcctcgggcagcctgtcttgccctatgtgtaaggcccgcgtggtcgctacctcgccgagcctcctgccctcgtcctccacctcgaccacggcctccgacatagcctccccctacgtcccttccaccggcgtcgccgcccacgccctttcctccctcctttccagtctcaatcccttcagaggccaacgcttgcagcgcctcgcttcctcgtcctcctcctcgaccatgtctgccgacgccggcgctcgacagagcaacgccaaccgctctacgcccggctccatctctccggtccttccggcctccgcgtctagggtcggtgcgagtccggggccgaacggcgtggctgctggcactaacagggagggggagggaggaacgtaccagccgccggacgatctgatcccctaccacgacatgtccgtggtggagatgcagcagcccgtggctaccacgccttccgtccatacacccgccccggtcttcgcctccccgtcgtcctcatctccgagaagaagga

SEQ ID NO: 3370 - DNA, 703 bp, Nannochloropsis_gaditana; identical to SEQ ID NO: 852

SEQ ID NO: 3371 - DNA, 703 bp, Nannochloropsis_gaditana
cgcaactaggagagacttggcaatggcaaccatacaaaatttatccctacgtggagttttgataccatctacattactttggaggagcaataatgtcagactgatatatgctagctggcacttaaagtggagagcgaatactatcccagagcatgtttggcttccggcatcaagccattcccgcagatgcgcaccttccaaccagtagtgctttgtagccatacaaagcaacgcgatcggcgcattttgccatcacttacataatgctatgcacttccccaacaatgctgaatcgctctcaaagaaagaaactggaccaaatccattcgcctctgaagtttcatcgaggactcccacgctgggagacaggcaggcaactgcatggtcggcattttcctcgtcatcactatggagatatcaccggaatgtttgaatttttgaggctcgcggaggcggaaaccggtcatgcaatggcaacacgggtgaaggtgatatgtaaccaatttgacccgcagcatctttccgtgccacgcgcgaatggccaagcctttccaacagggtcacaatagtttcaagtatactgtctagatgccgacaagtccgcatgtctcacattattccattttttctcattcagcatagaacggggcaagccgggggcgcatattcttgcattttagggcgagacacgatctcgctcatg

SEQ ID NO: 3372 - DNA, 703 bp, Nannochloropsis_gaditana
aggcacgagcatgcagatgggtctgacgggatcgggaagcgggggcctcccggccaaggcctctctcatctacgaggacgaacacatgcgatattggcacgatgccaagggccggccgctcttcgtggtgacgccgcttcggcacgtgcacaatttgaaggaactcacgggcgcggaaatgcaccggttgtggagcggagccatgcgaatcctcacggacatgggctgcgacccgaagcaggacatgcgggatatgatcctgaatgccggagtcgatagaaatcacgcccacttgcatctcaaggttcgcgtgacagggagtggctttgatcgggcgcgcgccaagtggagtgagcgaagaaatcgcttggtggatgccttgagaactttcgctcgaaagcagtcctgttgataggggggggctgtggcgagtgggccaagaagaggcacccatagaggtcgttgaagagagtatgttgataactaaaaaatgtcaatttgttaaaaggtgaatgctcaatggatgcgtccttcaattctttctagttgcttggtaatgtctggagatctcgagttagccgggaggttaaaatctcagccgttggaaggtcggttacgctccctcgaaataccactcccagccgagcctttacccacgatatattgacgtcaagtccaaaacaggcgtggttcccgacgcatg

SEQ ID NO: 3373 - DNA, 703 bp, Nannochloropsis_gaditana
agtacgctggataggacatcatcttctgtaggaaatgagaaacgctgaggggaaaaaaaactccgctctttcctccatcggccggaacggaacgtatccacgttgtggacccagagagaatcccaacatggcacgtcaaaagatcacatttttctatcacgacaacccctcgacattcttaaatcggaaattgccagcttttgcctggaccgtggaggtattcttccgtatgggccgtgcgtcatcatcgccgcgggcgaggccctccgccgctttttcctcaacgcagcgcggctcaagttcctctgatgaaactctaacctgcgaaccatatgcgtccgcaacagcacaaaatttccaacgccagtgcaggtgcattttcggaaagtcgatgcaagtgcgctaaaaccccaagtgtgccgctcctagcttgctggctacagtcgtcgcccacggcaacgtgccatatcctttcgccaagcatagaaaagagggccccaagcacacggctaccgcagcataagcattaggttacgattggaaaactaaatataagcggctgagacttcggaaaagggttggctcgtggatttctaggacgcaacagagggacaagtggaaaatcgaagaggaccgtatgaaacatcgagtaaaagactgccacacaaacgtgctgcagttgctggagaatcgtcgtcggcat

SEQ ID NO: 3374 - DNA, 703 bp, Nannochloropsis_gaditana
tcttggcctccatttttcgcgggtaccacagctcctcctccaactccctccctccctctctcccgccctccctcccgccctttctacgcgtccctcccggcaacgagccgtctccgtcattggaaggcagcgcttgtctctacgtcctcctctaccctcccccttcctccgccctcctcactcccccctccttctacgtgggtgagacggaaagcgcccgccaacggctcgcccaacaccgggccacgcacaaaaagaagtctcgaataccggagtccgacttggaggcgttgttcgttcctgtggcttccaagacagaggctcggaacctggaggccctcgtcatcaatgccttggccaggcgggggttccccctgtcgtcggaggcagatggacggagggcggtggggaagtgaggagggcagagcggggatcagggaaaggccctaaatttagagagatgtgtgtacaaaaaaaagcgagagaaacggaaagtaggtgtatgcgtaggggagtgcggggacgtggggttagcgggcgtccggagggcattcacagcaagaagcacaagtgcgagtaaaatgcggtgacagagcaccaggcgcggcccagactgcatgcggtcatccttgtgcttctttcccgagcgttcacttcctgttcttcgtcattctttccagtatccatctcccgcgatctaggt

SEQ ID NO: 3375 - DNA, 703 bp, Nannochloropsis_gaditana
aaggctgaccccctttccccatgtcctccctccactctcctcattcctccctccccgcccaggtaccagggcgaacaagcgcggcgaggggcgaggcgttattgattcccgacgagccacgtccatcataggagggacggaaagtgccactggtgcagcaatacttgaccttctgcttagaaagaagcactttttgtgcaaggagagggtcctatcgacagagcgggcgaaggaccggggcccctgcttcctcatccgcagacaatttccctgttgaaagtatcgcagcagatttcaccagtagcggggcaacatatctaaaagaaaggcaagcctgagaccagcagcaggcatggaaacacgtcaatcgacggcgagctcgtcgtcttcagtgcccgcggcggcagcggcggcgggggcacacgtgctttacagggggattatggtgcagccaatccgagacacgataaaaaagcggggcagtgttaaggttctggagcgagcggcgctgggagtggatggggtgggacggatttgctatttcaaggcggatgaagaagagaaggacgaagaggagggaaacgaggaggacgcgacacccaaacgggtagaagcacaaggggaagaggccagatccgcggcccttgcatcatcccatctagtctcctgccagcctccccctccttcccttcgcattgtcacc

SEQ ID NO: 3376 - DNA, 703 bp, Nannochloropsis_gaditana
  misc_feature (1)..(625): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgtatcctgccctactgcgctttcattttttctatcctagggagcgccgctctccttcaagctccacaacgtgatg

SEQ ID NO: 3377 - DNA, 703 bp, Nannochloropsis_gaditana
  misc_feature (1)..(388): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagagacatcggccaaaggcggaacgcgcgcaacgctttagggctgcgcatcacccgaaaagctttagcgattgacgcagagtcctgacctacctatgcaggacagaccctgtcacaacggcttcctggcgtggcgggcacattaaatggagcaaccaatgtcccgaaaaaattacgtttttacctctgaatccgtttcggagggtcatccagataaagtctgcgaccgcatttcagacgccgttcttgacgctttcctcgccgaagaaccttcggcgcgggtcgcttgtgaaacatttgccacatcaggcatg

SEQ ID NO: 3378 - DNA, 703 bp, Nannochloropsis_gaditana
gcccgctgccgccgccgtaaagcgcgcgccttcgaggcacatgtactgaacgcccggctccatgagctcgagacgcatatagacggtaaacgccaccgagagcaggccgacgaatgccgacgtgatcaggtagaggataccgatatccttgtggttcgtggacatgaaccaacgggtaaagaacccgcggttgtcttcatgtccatggccgtgaatggctgcatctgccattgagtgcctcctgctggtcaaattacgggggacacgcagggccacgaccccgccagcggcagactcaaaaaccccatgtgtcccgtcaacacataacggttttagaatgtcacgcgcgtgtgagcaatgcgccactttgaccgagatcaaatatttttgccgaaaccggttttttccgtcctgagcggcgtttggacgcatccggcgccgtatgttgggccgcacgggtgacaatccgtaatgtcacgcaagcctgacatatttttagccccaaaaatggcagccgaaccgcgctgcgccgttccatgcattgtatatggagtttgcgtcgctttggtcgcggtgaaaatgacacccggcccttgaagccccccgagccgccaactaagacttacacgacaccatgatcggtaacggtcggcaaacttcagcaggcaggcatccaatgacagatccctttgaaacatacatg

SEQ ID NO: 3379 - DNA, 703 bp, Nannochloropsis_gaditana
actcgcccggcggcgtggtgacatcgggtctgtcgatctacgacacgatgcaatacatcaagccgaaggtatcgacgctggtgatcgggcaggcggcctcgatggggtctctgctgctgacggcgggcgaaaagggaatgcggttctccctgcccaacagccggatcatggtgcaccagccctctggcggatttcagggacaggcgacggatatcatgatccacgccgaagagacgctgaaactgaaacggcgtcttaacgaaatctatgtcacccataccggacagacccttgagaatgtcgaggcagcgttggaacgtgacagattcatgtcacccgatgatgccaaggagtggggcctgatcgacgagatcgtgtcgaaccgcgccaagtccgaggatgacgacagctaggcacgcagataattagcgattgaggtgccctcgcgcctgtcctaagctggtgccaatgaaattgaaggatcccccttgccgggcattggtccggtgctttgcaaacgcaggggcatgaacgacgaagcaaggcgtgtggcgccgaaaggtatcgaatggcgaacaattccggcaatgacagtaaaaacacactgtattgtagcttttgcggcaaaagccagcacgaggtgcgcaaactaatcgccggacccaccgtgttcatctgcgacgaatgcgtcgagctgtgcatg

SEQ ID NO: 3380 - DNA, 703 bp, Nannochloropsis_gaditana
tcaccgcattgaccggctcggcccaaagtccggggccaagacgctcgcaataggcgtcgacgggggctgtccagtccatgctgttcccttgcgttggtgtcgcgtgtcgcgctgaccccggatatccggaaaacagcttcgtttggatatgtaagtttcgggttcggaaaccgcaggccgatcctgttgagccttgcagcctacctgcggttggcgaaaaagcttttgagcagcgcctcggcctctggcgcggcgatcccgtcatagatgtcgggcgcgtgatggcattgcggatgcacgaacacccgcgccccatgcgcgacgccgcccgatttctgatccgccgcgccgtagtaaagccgcgcgacccgcgccgccgagatggcagcggcgcacatcgcgcaaggctccagcgtcacggtcaggctgtagcccggcaaacggtcgctttgcgcggctttgcaggcggcgcggatcaccaggatttcggcatgggcggtggggtcgttcagctctcgggtgcggttgcccgcctgcgccaccacgcggccggatgcatcggccatcaccgcaccgaccggcacctcgccgcgcgccgctgccgcgcgcgcctcgtgcagggcaagatccatatggcttttgaaggtcatgcccctacgtgccctgcaatgcgcgctttcgcaaggaccggggatgggctatg

SEQ ID NO: 3381 - DNA, 703 bp, Nannochloropsis_gaditana
ctgcgccggacgtttggggcaggtgatcagcccgccgcgcccagccgatccttgacgcgcgcgccaaccgcaccgaaatccatctgcccggtatagcgtgccttcagattgcccatgatcttgcccatgtcgcggatcgacgacgcgcccgtttcggcgatggccgaatcgatggccttgtcaatttccttgtcgttcaattgacggggcaggaagtcctcgatcaccgaaatctcggcgcgttcccgttctgccagatccagacgcccgccctcttcataggcgcgggcgctttcctgtcgctgctttgtcatcttgcccagaatcgcaaggatatcctcgtcgccgacgccggtctccgagtcaccgccgcgccgggcaatgtcctgatccttgatcgcggcgttcacaagacgcaaggtgccaaggcgtgttgcgtccttgtccttcatggcccgtttcagggcactgttcacgcggtcgcgcaatcccatatgtgttgcatccccatgctgtgtcacaagttggccaaggtatcgcatgagccttgggggcgcaatgccgtgcggcaccctgccacccgccttgttttacggtgcttcgatcgcgtgctgcgatcctgccatgtcttgaccccaaagcggggcgcgcataggtaccgccaaagccgccgcatcccctgatcccggagaatcccgcgatg

SEQ ID NO: 3382 - DNA, 703 bp, Nannochloropsis_gaditana
catagctgcccgagtaactcaccaaaccggaatccggggcgacatcggggggcgtatacgcaccatcccgctcgtaatagccgccgccgaaaaagcggttgcgcggcccacccgaaagggcaaccccggcacgcacatttgcttcattgttggtttgcttgccaaaggccgtgttgtgccggtcaagcggatcgttttgtgcggtaaacgcctgatacccgtttctgtcaaaggccgcgcttcggctataggtcgccgtgaacggcacctcgtcgaaattcaccccctcgaccgtcagcgtttgtgcgaccgggtcaaagaccatcttggtcacattgtttgcaagtgcgtcggggatgccgccctcttcgggtgtttcctctgcgccctcgccttcgccctcggcgggtggttcgggggtgggttcgaacgggttggacccgcttccacatgccagcaggaacgctggcaacacgagtgatgccacgaaacggttcatgatgagtactgcctcagatatgtacgttttttatgtttttccaaaccgtcagcgctttgggattcgaagtcaatcttttcctatgcaccctaaaggcgaaagaagggcagtgttgcagccaggtttgcacttgatatggtagcggcgactcgttttgtgttttccctccccctgcatcttcaacagcgcttggtccctgcgatg

SEQ ID NO: 3383 - DNA, 703 bp, Nannochloropsis_gaditana
aatgggcggacgagaccggcgatctggggcctgtctacggtcatcagtggcggcgttttccggcgcttgagccgaccgaagaccccgcgctgttccgccgccaggagattgaccagatcgccaatctgatcgcgcagatccgcgccacccccgatagccgccggttgatcgtctcggcgtggaatccgggcgatgtgccggacatggcgctgccgccgtgccatacgctttggcaggtgcggattctggacgggcatttgcatctgcatctgtaccagcgctctgccgacatgttcttgggcgtgccgttcaatatcgcgtcttatgcgttgttgctggtgatgctggcccatgtcaccgggtacaggcccggtgatttcgtacatacgttgggcgatgcccatatttattccaaccatctggagcaggtgaaattgcaactttcgcgcaccccaaaaccgctgccgaccttgcgcatcacgcgtgatgtgacctcgatcttcgatttccgctatgacgatttcgagattaccggctacgcgcccgatccccatatcaaagcaccggtggctgtctgatgatctctttggttgttgcccgcgatcgtaatggtgccatcggcaaggatggtgatatcccgtggcacgcgcctgaggatctggcattctttcagcgtgaaacgctgggatcggcgctgatcatg

SEQ ID NO: 3384 - DNA, 703 bp, Nannochloropsis_gaditana
tttatttttcatggagtgatcagagtctgcagaaatgtgcactttggaaggatttatcaaggacgaaaccacacaacaatcctcgcgccctgtctgcgttgattgcacatttcgtcccgaacagattacaccactagaaaacatagcacacgtatgatgggcgcgctagagccataagcgagagtggcagtgcgtctggtggcaatgccatacagagctcttccgcctgaaggtcaggcatgttcctggaaatatggttctcccgtcatgcacaacatatggcaatatccacgggcatgtgcacgtgcccaagaacgaaaatattcccctggaagaccctattatcgtgtgctagcctggcactgcgtgcttacgcggcccgtgtgctctatttgtcttgtggtgggcgggggacttaaaacatggcgcgaaaacgccgaccagaaaaaggagacacaggaggctcgatgcccgggcttccgtgtggtcttgccatggcatctatgcgagtctgacgtccgtcctggttgccccgtttgcgtcacgcttttttggaatgatagggaggccttgagatccgcttgcttgccactggacggcccctgcaccactccatcgtccagcgtgttctccatcctcgtgtcatcggcagaaaaaggcggcccgccgagcgtgcaccacagtcaaccaacactattccatg

SEQ ID NO: 3385 - DNA, 703 bp, Nannochloropsis_gaditana
tgcatctcccttcctgcctagatcacacaccccgttgcctggggtcaggtccccacaggtatctgcagcgttatttttgacgtttgggccaacatctttgtctatgcacatgaacagggctctttctcatgtgggtttacattccggaggcctggcttcatgcaatgggcgtcacctattacccgcacaaggagtgggccctctcattaccagctttcctgtgcgtctcgtacgcgctctccagcattgtgtacgtggcattgaatctaatgagtacgccgccgctgcattcatacgagacgatcacagaccgatgggctcgaaggccgcagacatgcctcaatagtgaggtgccagggcgaagtgattcaccttcagtgccgtatttcgccgatttggacattggggttgtgaatcagtatatgtacacagacgagtgttgcgaagtgaccaacgcggacaattgaaaaggcgaaatttggccagatgttggtggtgtgtgaatgcagatgtacgggtacagcccatctggcgatattcacgaatatgcgcagatatgaatgaggtccctggaccaagcatctgacggagatcaagaaagaatttctgtgcatcgaacgtacctttgaacgcaaaaaacgagacgcacgattgccgtcgcccgatttcacttcaccatcgaagtactgtccgaacaacaatg

SEQ ID NO: 3386 - DNA, 703 bp, Nannochloropsis_gaditana
ggaagaggacgccttgcttccgcatgcgggaaacgatgacggtggcagtgtgatggaaaaggacctctcgcttttcggttgtctgcaggcaatgtgcctgcggggacttggtgcgagtctgtcactgtggaagctgtgtcacgcagacggatagggtggtcgttgacactgaaaagtagaaatgtggcggttgggaacctcttgatcatgacaatcgcgtagaagggatgctccgttgtttatctttgacatctctgtcttccccttcatgcaatcttcacggtctcacaaaggcgagcggtcttcgttgttgagaacacggcgtggtactcttacaaaaccgccttctgacatgcttggtcgcatagctaccacgttctcgcggcaagtgccgagaagggcgccgtcactcgcgttcactcgtcctactaccggtaaatcctctttccccgttatctcgtccggctactccctttcccgatgcttctcacaagctgactgatgtctagaaacgatttcgtctacctgaccaagtttgcttggtactgtctcactcgggcgtgccgccctctttctcccgaccgtccatggctttacatgttttctcccgttgaccctagacgctccaaccttcttgtccacaggcaggcggttcttaggaagcggaggcggccatggagaccatttccatgtctcagagatg

SEQ ID NO: 3387 - DNA, 703 bp, Nannochloropsis_gaditana
tttttgatggaccttgatttgtgtaccaaaagggtatcgctgtcgtcctggttgtcgttgcgatgatttccgtgcttcgcgtctttgcccctatatccatcaactaccacccttggcccatcccgcgcatgattgtgaagtgaagcagtcgtgaaagatgcatgtcgcacaggtgctcgcgatgggaagtgtgttttcttcctgtggaaacccgccccgatgccaacagtggcctcctcaggggagaccgcaggggatgaggactgatccaaactaccgtgggatgggtccacgtcggagtcgcagtgttgtgggtgagctggaagctggttgtggtgtgtgcggaaggatgaccagagtgtcttccccatgtctacggccacccgagccgcgaaccgccctccctcgtccgttctttgcttgggcaagtcaaagtcctcctcggtgtcatctcgaaccgcataaaaacgagtattgcggcttgtatttgcacagctgcgggagttttgacttttgcgaaaacgttgggagtggcataacgatggctttctgtttgcctgcgacgccgacgggaccgcgaagtacaaattggcaccaggaatatcagcaggcattgtcactgagtagtcctccgaggaattgcttcgtcccttgggcctgtgtaggtttgttttcggtgcgaaggtgtacgactcgtccaatg

SEQ ID NO: 3388 - DNA, 703 bp, Nannochloropsis_gaditana
gcgctgtgacgtggacaggtattcttgcgcgcaatgaacgcccaggggggtatgactcagtggaggaggtggaaacagaggtacgactgctactgcagggactggtccgtagtcatgaaaccatctatgtggcggaaggacggcgtatactcaatgatttgccacggatgatgagggaagctctagatgaggcgtaggaaagggagcctctcaaaccctctattttcttgtatttgtaggtgtcacatgtctgtgcccactcatgacaatttacacatgtgtattttaaaaaagaaaaaagcggccaatagctcgattaattgagaaagatggagaggtcttgctaaagttagccttggttttgaaatatgaggaaagtcccgaagatgctagcatgtgcctcgccgccgggcccgacctcaaaccattgaatgcaatcacgataaagccacggttcattgccgtacgttcaaggcatgcttatatacaccggatatagcgagcgagagcgcttagtatcccaccgcgtaccccccaaggcataaggaaaggattagggttccccggtaactgcagcctcaagttgaagctgagacttgttccaacgacggtctttcccacctatgctttctccatccgctggtcactagctatcttctaacgtgtccattaactctcttttccgttcacattttgctcccag

SEQ ID NO: 3389 - DNA, 703 bp, Nannochloropsis_gaditana
gaagcagcatggaagcatctgtcgaaccaattggggataagcaaggcgatggcttgatggctggaaggttgcgtggtggcgtcagggcactaggcgtcgaaggaggcggaagcgatgtcaaccaaacgtttaaaggatcaaacatttctgtgggggcgccgtcgtcataatcgggtttgataaggtagcgctcgtcttgtacgtccccatggagggtaggatcattttggggtgtaaaagcaccttcatcgccagataacggcatccaaccaggcgctgctgacatcattggcaccatcttaatttaattgcttaagagtgttaatcagggaaaatatgcgtgagtgatgcatccaaatcgagcatgaagcggatgggattggacgggagggagggggagggaggaggttaagcgcctcggcgagcaccgggacgggcttggccatgggacggagggagaaggtgtgctgggaggccgtagggcgcaccgtccgggagaaagttcgaagtccttcgtcctcatcatcttgtttggagcgctttgttggcagcagtgtcgcatgtacacttgcgcttgcaatgcggttgtggtacggaaggacgccatttaaccggtactcgccctggtttgaggatatagccattcgcctttcatcacaccatcgcattcgcatatttctcagaacaggtcgtgcctgttatg

SEQ ID NO: 3390 - DNA, 703 bp, Nannochloropsis_gaditana
cctgatgaagaataaagggacacaatgctgaaccgccccgccgtgaccccgacgctcaagccttccaaatcagccaataaatcgcttgagaagcatctgtctcttcaacctccatacgcaagccttgcccccacccctcgtcggcatcaggcttcagtcgtggggaaatgtgacgagggtgctactgcggcgcgggcgagaaccctctactctaaggagaagaaatggaaacggacgccaccaacacattcgcaagtcaggacaactcgctgtggacaggccttcactttgtccacgtgatgcgtggaagatgtgtggcacgtagaggggaataccaggtttgaggcctgtggtcgcacggtttcaatgagactcttacagctagtgggttcgacggagcgctgagcgagtacaatgcgtatttctctctcactctttcacttcttcttgaggccttggccgcgctcaacacacggcagtcaggcgcgcttgtacatgtggcaatgaccgcgcggaggtggctttgggcttttacttgtctaggtcgttggattgcttgtcaggcataggaccgtttgcttgttgttctcttccccgcttcttgaagctacccacagagactccgcccttcctcaaatttcctgcatacatccatgcatgcacagccaaatacacacgccattgtgaatttttggacatcatg

SEQ ID NO: 3391 - DNA, 703 bp, Nannochloropsis_gaditana
tatggtattagttagcgttatggattaattgtggcccaggatcgactgattgatacgcatttagagattcaaaagacaaagctgaccgagaccggagcaggcttatttatatctttattcgattttttcgatagcaacataagctggggtcctgcttcagattttatttcccaacaatcctgagaagtctcgctggtgtacgaacaattgaagcaccagtttcattatatttattggatgtatcgtccactgtacgcacggtaggaacgtattcaagaggacatgattccggcacacgtggatgacgccatcgtgactccccgcatgtgtcatttgggcctagcaaggattggcaagatcattagaaagaaagcaactcgggtgtctccttggcacagccctcaataaccacgctcaactagctctaatacagcttccttttctttctgcgtcaggtttaaacaacggaaacgttacaggaaaacgagtactctcaaagaagttctcagccctcggtgaggaagctccgggtggaaacaccctttttaggtgcatttaaatctttgctagtcgtctcgtttgctaaacacgtgagtacgcggaaatgtgcattctgcgtcttatttgacacaattttcaccccaaaagtccccaccaaccttacagaggctaacgcgcgatttgacaggcgattctcaccatg

SEQ ID NO: 3392 - DNA, 703 bp, Nannochloropsis_gaditana
caatttttgacagcatctttgaataaataaatctgattttcctagtggaagaataaatggttccaagaaacaattacatcgcacactctatcagtggcaatgcaagtgagattcttcctgaatttgtactcaaagtccttgagtataagtgagctcaaaaccgtcggtacacattgatttaaggaaaaggacagctgtaagatatgacgacactatgtttcccggtcttgaattggatgggtgctaaaagtattttgactacattctttcccaaactggttttccgtttaacctccccccttcggccgaaacggtcgcttatccgtcggaattttgaaattgcccgacagaaagctgcttgaacaggtacatgtgcatagggttttttgcaacaatgactgccaaaaatacacacgggacaaaatttcatgtgtatcgtctacactcttatgtaggtggcacaggcaagttttgtcagcggtcgcagaagagctcttccgaccaaccttcgcaaagcttgagcgcttgaccttctttcatcccctgtccgtctaaagccccaggatgtctacctcgacaacacgtacaactccggcctccgactcaataccgcgctcatcatatctcgacaatgctagctgcgtatttccctacatcattgattactccgacccccagcttttgaaccaaggtctccgtgatg

SEQ ID NO: 3393 - DNA, 703 bp, Nannochloropsis_gaditana
tctccgcccaatatttgttttcgcgctccttaactttccgtggtcgctttttaacccgtgtattcaagccgcttggccttgagtgattgccacgctcaccatctcgtatcgcacgagactacaacgcaggaaggagacaataggtgaatcaagtaagcgtagcagttggaaaaggaattttttacaaagcacaaatataccatgattgacatcatatacctgaatttctacgggtttgtcgtcgtcgtcgtctgattggtccacgttagaagtccttttcactgctttcttaatgggtgggagggacgtttgggagggagggccggaggagtcggatgcttgtctccgctgcctcgttgctacgccctccttggcaggcgtaacatcattgccaacattggctttagctcgcgttcttgtggtcatcgaccgctgagaaatatggcgtaaggagggcgcagagggtgacggaatggaaagatacttgcgacatcgaatcatcgctagcttcagttcttcttgagttcttccacgttgacaagaagcacaacagtgacgacgcgtcgcggttctgtatatattgcttcttcacaatttgcatctctcacgttgcgatgacacgtcatttctcaggttgtatttgcttgattgtcttcaacacttttagccccggcggtaagcactcctctcgacagacgcaatg

SEQ ID NO: 3394 - DNA, 703 bp, Nannochloropsis_gaditana
aagctggatcgagcaaggctttcccaagcgcagtccgctcctcccgcaaatccgcctcgctttcttcattgtcattgtcagcaggtacgagagagacatgcttgagggcgggtgtgggggaggtgctggaagagtgttgctttgtagagggtaataccaggcagccaggaggttgtacgagtggcggacgaatgacaaagttaggacgcggccgcttgcgaatgagcaatcgtcccaacattcgactaccacccctgtacgaaaaaaatatgtgcgtgatgatatttgtttgctacgcgtggtatgtgagaaaacatcgcattgcggccgtcgcgtatcgcccactcgccactgcctccttccatctgatccattgccatcgagacgtgcaaagacaactgcgaaaatcacgcccgccgcacgagcaaagttgaacaacgagtcgatcgtgctggaggcaaatcagagctgccgctgattttgtgaggtttaggcgaggtctttggtggtgtcgaacgtgcaaagtccccgctccttttttggtctctgtagacctacattgataatgagctttgtcaaagagccacagctgcctttggaggtcccaaacgtcttgccgacatgtcaagcatgattggggtatagagggatatatcgcagagatttctccttatgctccaactcgttgccaatatatcgtcaa

SEQ ID NO: 3395 - DNA, 703 bp, Nannochloropsis_gaditana
tcgtaacccaactcaaccatggccaccgagtccccgcacaagacaatgtcgatgcctgccaggtccacatgcaacgccgacgggtagtcgtacgcagtcaccatagagatgcgttgattttttcgttttttgtgcaacaaatccaacaccgacatttttttggaggacgcattccctcccaggggagggcgggctgatgccctcgggcccccggcgggtgccaagctttcggcaggcggagaggccgcaaaggagcgagaacactgataactatgtaacctattcttgggacgtgaaagtctccagaagttgtgccttgttgaaagccaagtattcattgaagtcaggtgcaggtactcccgctatcggtgacgcgaaaaaggttgtttcccacacgaagcggctcaatttagcgtcggtgccttacccgccgcttcgagaaggataagaagaggtagtactaaaaagtgtcaataataaaaacatggatcgtgagttgggctgcgcacaaaatcaaatgcacgccaagcctgaaagcagtacgtcgctgtcggtgctcgacgtcatagcgtaagggctggcgatgatacttgggcaactgcttgcctgtcatatgagacatttttaccacgccctgttttcgcaatctctaagacttaacacatcaacgctctggcacattttatttatttttatggcaggt

SEQ ID NO: 3396 - DNA, 703 bp, Nannochloropsis_gaditana
gatccttgaagtatttttttatctgcgtggtgtacattgctgagatatgcgatgagtaatttactcggtaccgaaaattcgtgtacttttgcatgttatgcgtgtaccattttgtaagcctggagtcaggagggtacatgggccctgccctgtgctttctcgctgctcggacgtcgcccatgatggagtggcccatagataaaccgtcgattcaagtcgaccaaaaccacacataaagcgtgctcccctcaaacccagacacgtacggggcaaaacttcctccatttttttatttgttcgattcttcttacgtttggccgcggcatcttatactcgacccagttttctggctgaagacggaaggtccttgacccttcggccttgggcttcgactcgactcactcgccgaaaaatgacgccactcaaggatactccgagtccgcccctcgctggaaaaaggcaagacagacatcagtgaatcagaggaggggatgaagccttgcggccgagcccttcccatgtacattggaatcctgcctttggcgctcggtagcgtacataaattctcaagcctcacattgcgcccctaattgtttctcgacagttcatcggtgggagaaggccagcttcgcgcacgtccgagggtcagtagaacggactatttcttcgctgcacgccttcgtgttgcgatttgaccgaaatg

SEQ ID NO: 3397 - DNA, 703 bp, Nannochloropsis_gaditana
ccaccgggctgagagcgcgttactctatgtgacacgaccctgtgagtctgctggtaatgttttgaaacggagttcgacccccgtgaacgacatgaggagcaagtcaataggcatagatgcatcgaaagagggcggagaccgccttgtgagtacacaaataacgtgggatctatggccgtgggacgggtctaataattggcaggggtctgggcagcctgaatatcttgcctcctccgcgcctcgaggagggagaggatggggagcgtcagcaccctgaaaaaaataggcttagcgtcctgatgcggagctctcaataccaaatgtaaagtattcatcttcgaaatcaagcttgtgtggacaaagtaccagaatggggtcgcttcgtgttggttagactctccttcaaatgattgtaacctcctctagccttgtttagcccggcacgcggaccaccctctcagggattaccagggcacaaaatactcagatcgacccaccacaatgtcataaactatacatttaaatcctcggaaatgagaaggtctttactggattccttttcgctgtcgaaaacctggacagtcgaatttatcggaaatggaagttaaccgccgcggaagcctcctcatttatttgactttatcctcgatcatcctaaaccgctcactgcagactcgtaggtttcattaacgcagatcgtatg

SEQ ID NO: 3398 - DNA, 703 bp, Nannochloropsis_gaditana
acacgcgctctggcggtcggaattcgtcttaggtctgggcacgaatgagatgcacgctgccgattcccgcaagatccacgtgactcacctgcggcactcccaacaaatcatagcaattttccttcccgcagaatatgttatggtagtccttcagagattgaagcccttggaagactgacactaggatcattgcgacgagaagatgagagcgcccgaacgcggcatggtaattgcgggccatcccctatgatttaacagaaaataattgccaggtgaggactgcaaaggtcgacagaactctcaaatctgagccaggccgctggcgacaagcagcttcaccgctgtttccaatgtgaaggcaaggatgtttgtgtgggtaagtgcctggtggaatgaggaagaaggacatcgaggggttggcgagtgctcaagcgaggaccgtccgctcctggcaaggcagacccccctgctcctggatccccgtggattccctcgtcttactgaccattttcgtgctctatttcgcggggggggattaccatatcctacctcttgcattatttacagggaaaatcgtccttttacggtggctgcagaaacattttggtcctcgttcgaacaagaaaaaggttgactacaggaggttgggaagcgcatctccgctattcatttgctagaaacttgaagcaaacctacttaaatg

SEQ ID NO: 3399 - DNA, 703 bp, Nannochloropsis_gaditana
acaccggacgcccccccccccgcctctgaccgaccatcagggcgcaggcatcttcctgtaggcctggcgcctcgtccgcccctccagcccttctcgcgtggacgggcagaggcagcccgtgccgcggcccgagggcccggtggatgcagaagaagaccatggtggaggtgaaggcgaaggcggcggtaaaggctccgttgaaaaacacgacaaagagccctccaagcggctggtccacgaagggcgggcggggggagatggcggccgccacgcagaggacagtggcaaggacgttgaccaagacgacgaggagcggcagccggtagcagcgcaggcgatgggtgagggcgcggctaagaggatcgagcgccatagagacgatggaggagtactgcaggacgtgggcggcgtgctggtagccgctggtggatatgggggtgagggcgggaatgacgccataggcccagaggctgatcccgaactgggccaagagaaagggccaaatgagggcaaggacgggggcgggtgccaatgtcggggcggacagcggcacatctagggcatcgctgtcttcgtctttgacgctcaggagcactcgcttcttggcccccccctgccaggcagtctccctctcttctgctacaactcgatccatgctgagggccacgcgcgctttcttgtgcctctcttcttgcaggaggaa

SEQ ID NO: 3400 - DNA, 703 bp, Nannochloropsis_gaditana
tgctgccgatggagtacaggatggacaggaatcctgcctggtaagtattgtgaaacattctgtagtagagtttcgtattgaatgggatatttatttcaaggattttcccgatttgcggtacttaagaaaggcttggagcctaaaaaaatgaaaagagaggagcatagatactctgttagtgtctagcaagactaaatcgagaatggagaaaataaacgtattgtcgaacataacaagaagcatgcaggcacaattaggctgcactttacggggagcgaagtaatttggtaaacacgcgagcactgtcaaacaggaaatgaatcgcaagaatttattcgaggccctcagattttccaagtggacaagggccgttttcgcgtctctggccgtaacggtctgaccgacctccggacgttgccgccaaaaggggagcttcctttccttggggcagcggcgcagacagcgtcaactcctcggctgcatcgcgctatttttccaacggcttgatgcctaatgaatcaggatatgctatacttataatcctgtcacatttttaggtcgcctggaagagccgtgagtaacatctagcatcttttcggcctcgccgcaggcatcatcgttcgaaggcaagaaaggcttttgcgtacctagctgtcattgcacgcgccaactgagtagcacaggatttcacacgcaacgtatg

SEQ ID NO: 3401 - DNA, 703 bp, Nannochloropsis_gaditana
atccatcaacaggggagacggcgcgaccgcaacgacaaggacgcgtattccctgctcccgctgctcccctcccgatgttcaaaatctaagcgtacaaggatgggggagcgggggtgagatgtctgtcgccaggctgaggtcgtctcggaggagtgagcgatgcgtggggtaagtgaggggcccgttgaggggcagaagcgaggagtggggcccgggagactaccacccttttaattgattttggaggccggaccggggcttagatatgccggtctattactcctttgaccctttcttgtttctaggcagcaattggacgcgcagtgcgcgcttgcgtgtggcttggggggacgcacgctgtgcgatattcttcctgttcctgaggcttcttcgttcgccagattggttttggaatcacctgtccacgcgcacgcaagtcttggcgcttagtaacgtgagaagccgttcttttttaggagctgtcggacaggatggtcgaacagactggtgtgggaaatcttttgcgggagtgttgcgggtgaccgctggccgctttcccttgatgccgtcaaaaggctcgactccttctgtttgatagcttgtcgcaacttgttgctttttcaacccatcattactacacttgctcttcgacaggcatcaagacgtttgaatatctcaagtccgggtttatctttcaaggatg

SEQ ID NO: 3402 - DNA, 703 bp, Nannochloropsis_gaditana
tccctattcctgcctctcgcggcagtgcccggctgggacatggtttgtcggcgtggctggcaagcgacagagagcgcgctagcgcctctctcagcgagcacttctggccgaggatgccatcaacgtccagcgtctcccggagccgggcgttatactcccagttacacccacacaatggcaggagccggcacgaaatgtatattttatgtgggaaatatgtgcactctctgactgctcaacttgctatacatgtgcgaaattacatcgttcgcggcgcgagggacttgatggtacactgtctcatagcagatgattgcagagctatcactagtgcaaatcaaattggaaaactcagtgtttgcctgcttgtcccctaacacttttacagagttgggacaaccttcgcaagatgtcaggtccaagtcatcctcatccacccgcggacgtcccaaccaccccatcagctgctgaacacaagtatccggctgcagagctgaaatgctcgaagccggatttgctatttacctccccgccgccttttcccctgcctttttacaagtatgtctcactaccacagacgccagctggtatggttgcggtagcccctcccaaccctcaggagaactgcgtaggccgtagtgtgttcggagctgtggctggggcgggtctaggggtgatgatgggcatttttttgggtgccatg

SEQ ID NO: 3403 - DNA, 703 bp, Nannochloropsis_gaditana
  misc_feature (435)..(444): n is a, c, g, or t
ccactgcgcgacggggtgggcggcccatactccccccaccgaccggaagggccgccgccgccttctgcctcccgccgccggctgcgacccccctcgctcccctcttgcgcctcccgttcgctcctggaactccccctctccctcctctctcctcgatgccgcttccaggtgtatcccggactccggctgcggctccgactcccccggccctccctatccctgcgcccgttctcgcgcggacgaccctcggaccgcctcctctgtctctcctcctcttcccggtcccgcccccgccgacgactacgctcctcctcgcctctccctgacaggtatacgcccttcccgtcccttttcctgtctccgttgctgcgcccgtctagatcctccacgcggccccgaccgcgctcgcctaccgccactccccccccccgaccnnnnnnnnnncagctactcgcaagacctgacatacgactctataaaccagtctatattcatgtgtttgattggacaattgtatgttcaatcttatgcgaaggtactacagcgataccataaatgcataaaaactagtgtgccagccgcagccctcgccgactccgaagcactgaaatgaggggtcgtacgtactagaatcgatcaatttgcaagactcgcattcctacattttacttaggctatattcgatcgcaaaatttcacagatg

SEQ ID NO: 3404 - DNA, 703 bp, Nannochloropsis_gaditana
ctgctttttgaaggtagtatgtgtgccatcggaaaggacgaaagatgagacggggaggtcgacatcaggtaatgtaattgaacaagaaaggctgttgctagcgcccaagcggattcaatatgtgggtataccgtctgtcgacaggtaaatcgagctcgcctgtatgcatctaactccttaaaaccgcactgtacttatttattgtaatatgtgatggctgtgggtcgatctcgggaccttcctgacttagagtgacatcgggcaatcaggctgcagctggacacaatatatcggaagtctctacgtatagtccgtacctgaagtataagcatgtgcgtgcaataaattcgcagtgacgaagataggctgcttgaagcctggagacgcggcaatttgtctttcgccccgggcgacctcgccgacccgggagctagttttagggtcatccccttgggcctcagccttatgaattacgtcgcacttaacaagtaacgtgggggaaatcggtgtctcttttggttttttaaaacagagacattgcaaacgagatatttcgtggactttttaacctaacctggacagccacggcttaaattagggtcaacgaatcaacctctctcgcatcagaccctgtcgataccgaggcttcgtatgcctgcaagtacgcgataaaggcacaccatcccactcatagtactcaatg

SEQ ID NO: 3405 - DNA, 703 bp, Nannochloropsis_gaditana
gacgcagtgtcatcaaagtcaaagctttggctaatgattcttagatacttaatcattagtagcgtttttgggtgcgcgtactggccgatgctatttgtgagtacttcaagaccagatttcttgtccttttctgaagttttttcaggacaacatgccgccccttgtgccctcctacgtatgggagcaagatgagcatcaaatactcctaactataagctttagaggtgtaaaagcagaagatattgatatatatggtaagttttatctttgcattgctatcagtaaaatcctctgttcatgcctttaattattttcggctcattctttctacctttttttgcgttcttcacaagtcgctcgcacatttttgaaggttagctttggcaaatacttgttggcattagatcttctgcatagtattgatgacgaaagtgtccaagcaaatgcaaaaataggcggcaagctgatcctcaccatgcagaaattgaagggtttggataatgaaggaatttggccaagcttaacagttcctcgtaagacgctcgacaaagaatctcttgctgcacgtagggcacatgcaatcgaagaaaggcggggaaaagagcaaagtctccacaaagcaacccaagagaagaaaaaggagttcgaaatgcaggtcctcaagtctcgcatggaaatggatgaggcgcgtagggctcagcaa

SEQ ID NO: 3406 - DNA, 703 bp, Nannochloropsis_gaditana
accttgacccggccttgcaggtatttcataacttgcaacaccttgcccctgtggtactcaaatgccttgcggcgatggtggcggagggggccgaggccactcggctcgccttggacccgggggctctggaggcggtcgtcgccccggactcctccgtgccacgcctttcctcaacagcgcctacttcctcaccgcccgccagcacagccacctctcagcgacagggtggtggggagatggaagctattgccctccgacagcggcaagtgcgcatccgggaccactgcgatcggtgggcgacagtgctcttgcagtcctcgctgaaagtctggtccctccagagagctctccacatgaagactgacgcggccacgaaccaagatctcctgtcaatagtgctgcagtcccccgacttcgcacgcgccgcggaccgcgtcatggcattgccgagcgtcgcatcgtcttccgctgcgaagggcaggacaggctcgagtgagaacaacacccacatagagtccgccggagtcagagaccgagcgcgcggatggtcaccatctggtgtgggtgcgctgtactggctgtactggttggagcttacggccatcatacgctccacgacagagagggcctcacgacgcgcgtcttcggtcgttgcggcgccttcctcattggcggttgcgccaatagtcaatagctacccgca

SEQ ID NO: 3407 - DNA, 703 bp, Nannochloropsis_gaditana
tcggatttctctcgcttttcgcctgtgctgccacacaatatatacgtacagctcctgcggcggtaccagtggcaaaccatgatgttgtgttcggaagatcagcaaccctttctccatccctcgattgctctccatccctcggttgccctttccaggcaactcgaagcacttcagctgcatgcgggagcctctgcaaaagtttcggcacttctccactagctgcgacgtcccaaattttcacatcttcagcatcagaggctgaggccatccacctgttggatttgtcgaaggctaggtcgaaaacccgctcgctatgtgcctgcggtaatgctgttgcttgagatccccctagacacatagatgaggccgtcgaagggcctcgctcggacggaagcctcgcatttttgtccctgggttcatcaacggactgtccctgcatggctaccgataatttaatgatggtgtttgcattattaggtgagaaggactatcactgaggacgtacgacccccctcggctgggcgagctagcctgaggctgatcgcggaagaagcttgcaacacacttctcggaacatgccaagagcgctaaagaagtttagtgcgcattatacaactcgatgtatcttaacacgatcctttcacattttcttccactgcctggcagagaaatcactttcaacgcggacaaagactgcaagcag

SEQ ID NO: 3408 - DNA, 703 bp, Nannochloropsis_gaditana
ctctctctcggcccagtacctctgccacttgggttctatcacttcgtgttcatatcgcgcgggaaagggaccatcgctggcactgacaacactgttaaagacaaggacaaacttcttccgatgccgaggaagatgcctggtcaaagatcgggcagtccgagtgcccggattgcttcctacccacgcttgaaacgcgctcgccgtccgcccgggcagcaacatgatgacgcagcccgcaacgctcgagaggagggcaaaggcccttggtcttatcatcccccccgcccgacagaaggacgtctctcagtcagccacctgtctggactatggataacattttcgtggcaaaaaatgcaaatcgcgaggataaaacgtgaagatacttcggaaaaagcctccattcaggtagcactgtccgcgcgagcgaggggcaagcgtttctttcacgcagtggggcggcatgacctttgcgagtgcgtacgatttaacaagaccatacacgactgtttcagatgccgtggtaccaccgataacctgcttcgcaagttcagcagtcgacttcgcttaaatttgactgactccacgccttcgtcatgtgcggcgtctttttttgggaggaggttgacgtccgctctcaaattgacgctgtccacgtggactaaatccgcgcactgtcaaactttctttaaggccaagggacatg

SEQ ID NO: 3409 - DNA, 703 bp, Nannochloropsis_gaditana
ttatttcatcctttacatataccttacttcatttcaagccatctgaaagtcgtgaaaagggacacgtgtcaactttttgcccatgttttagtagaaatgcgatgttgaagcggagagtccttgagagaggtttacgcgcgtccttctgatgccgcgagctccatgcattgtttaaacactttttttccaaaaattgccacgttttaaggaaacaaattaatccttcactcaccacctagcaaggcctggggtcacttgccctttacttaggcaatttacgcagaggttgtttgagagtgcttttggtcaaaccaagcattggtcttacatgtcatggggaggcaaggcaaagccagggaaggacgtgattaccttcaaatacgcacaatttgtaatcttcagatattgatgtatgaatgcataataacagcgacttctgaattacaggcttgaaaagctgatctattttactttctgaacaagcagggacagtagtttgaatgaatggccctctcatgcgaagccttgttttttaaatacgcaacatacaggctggatctactgccttttgggatttcttaggttgaggcgaaaagtgaaaaggtgattgacattgactgaagggagacgaacaaactccgcaccggccacgactatggcgtctacagtcagagcggctagcaagggaagtattgtaaccatg

SEQ ID NO: 3410 - DNA, 703 bp, Nannochloropsis_gaditana
gggcacagcgattctcccttttaggagtggggagtaaagagcacggcacatgcacaccatcagcccctatggacggaacatttatccatcaaagtggaagaaccatggcgtactcgtactttgtcgcacacatttccccatgggagcggttagttgtggctttcggagaccgcacgcgtccggcgacggaccgggtagtcctcacctttttaatggcagctctttcaatattgaaggatagcgttgcattcagactactttgacagatgtaaaagacttgcgaatcgacggctctttcccataaagcacaacgacctatgatccaccagccatgccccttgtgattacctgaaatgctcaaaatcaagaggttacatctcgatgaattactttaaatcttgacttacgaattcggaagtcccccgcgtgcggcggctcatgacccgggcggtgagagaccctgtcgcgaggacatgggccgggaggtcggcgaggcggaggccagtacgaggcagtcccgggcccgctcggtacatgtcacaggcacgtacctgcctcactcagggtggcatcctaccgcacactcttccatcaaaaaggctcaacgtcgaacctcacacacgtcatccccctttctctccgtagatttccccgccattcgattatatcaataggagcgcccatttctccattcagtgatatg

SEQ ID NO: 3411 - DNA, 703 bp, Nannochloropsis_gaditana
gttcatgaaagccttttctcgtcgaagtctccatttggctttaaaacgatatataatcagcctgtgagagagacattgagatttgagaagtttgaaagaaggatttcttttgtggacctagcataccacgcgtcgcgtgatccaagtatgccagggcactcctgtctgcgccccggagaactctaattacaagaagcgctcaaacagtgtgtcgccaacaacgcatgcgcgatgacaacggatgccattttatagctagatatagcacggagtgttcgagaaacagttgatatgttaggaagtaggacgttatcttgagccacgtaaagctataaagtagcggtacaaaaggaacaattaagaagtatgaggacaagccacttgtgcctttgctatgcttaaatatggaaaattggcgaagtatcatttgtgaaataattttcatgtaaatatttaccatgggcaaacatgtcacgacatcaaatggttttgtcgaagaggtgcaaaaccgaagcgtcacgagcgttagcggtttcgccggtctaacggccgcaacggtcgaggcagagttcaaaaaaatttgaaaactgaagagacgcatctcacccaccgtcaagttcttcaaaccaaagcaacatcacagattgtcgtgttcgtctgatgcaaataagacatgtaaatgggaaaacaaaattttgctttt

SEQ ID NO: 3412 - DNA, 703 bp, Nannochloropsis_gaditana
ctttcggatatagtatagtaaaggcatatgaaaaggcacaatgagtaatgacatcaaaaccaaaagcgtatctcaggagctttggcagagctttacgcttcatatatgcttgcaccgttggcattgacgtttcccttttcgtcacttctgctcatgacatcctaaagtccaaccttgagggatgccagctgcatctgtctggacacgttgacgaaagaaagaagattaaattccttgtagactctagcgtctaccgaaggctggatagcgtgaaaaaaatcaaaaaaatcatttttaataggcttgagatcaagttcgtatgaaaaagattaaaggatctacaacacaaggacagtgaaaggaaattgtgtgatctctgcatctgggaaatgcacccgtcaacaccatttcccagggatgtacactcgcatcatgtgcatccagtgatgcctatcggtcaggctaaaatcacagccttcacctaatactcagacgtaatgtggggtggatggtccagtctctgggatgggccgtccgacggacgtgagtcacatgggccgggctgtcctcggaggatataagagagggcagtcgagcacagcaaattcaccagaggcctcgaggccgcgaggccatgggccctaattgaagttctcaaacactcacgtgccaacaaaactcatagagcagtgttcattgcagg

SEQ ID NO: 3413 - DNA, 703 bp, Nannochloropsis_gaditana
aggacgccctcctggctctggtggaggcttgcctcctgcgtggagaccgtttctatggccttttcctcacgaccgccctctttcttcgacataagactgagattttgtgcctgcaaggatctgctctgcgcttatacctggaggaacttgtggcgggggggaagggcatcgcgcagtgttaccagccgtctttgtccggcactccctctaccatgacctcgacctctgcctcttcgacggctgtggccaggtggatggaggaggctgctcgagtggaccgaagcacgcctatctcctttcgggtgaatctgacagcatcggaattgttgagtcgggagaaggctgcttcgttgctcggtagcccgggttctgtgccggaatattctccccgtgcagaagcagcagatacaccagcaacgacagcaacagccatacccgcaggagcagatgcgacatcgccccaagggccggaaggggccatgataggattgcagaagggcatcggtgctgaacatcctccctctgcgtgcacccaggagcagcgtgcctacgatgttgacctctcctccctcacgcttcccctccagcggttaatcgacgctctgagcccaagagtcaccgacacggcctatccttcaccctccacgccctcctcggttggcagcatgggtcctcttccgagcagaagaagcgaccaggggca

SEQ ID NO: 3414 - DNA, 703 bp, Nannochloropsis_gaditana
cgggctagaaccagctaagaattgcatcactgagacaagacaacggatgtaggcctctgcgaatgcacacgacagtcgtctttgtggatcggcagcatgatattggtactgaacgctgcctcagtactcgcttacagtgagaagggagatcgaagacatagaggaggttgaattgcggcgtacgtctaagcaagcaaacgagtgtcagcacggcatgcaaaaaggtaacttcactcatgaagacaacatttctcaaaagtttaacatttattcccaggctcgcaaagcaaatgcaccaaatacagagcttagagagggcaagccacccgttacttcggcttccccgacaaacgtcgaaagggtgccgataagccacagtcttcttattctataccgctaccgtcccgtggcacggaatagcatgatctgggcacggcgtttgctacagtctcctcagtggcatcgaggttcttggcaccggaaccttttttatcccctatctcggctggccttcacgtcagcggccgggaatccgtctcccgaagctgccacgcatccccatcaatatcccttaaagaagtgccgtaatattggaatcattgcacatatcgacgctggcaaaactaccaccacggaacgtatcctctatttggccggggaaacgggccatgttggtgacgtggacacaggcgatacggtcatg

SEQ ID NO: 3415 - DNA, 703 bp, Nannochloropsis_gaditana
gctgcgtttttgcttttaaaagaggcgagctttttttttgttttcttttcttcttggctgtgtttcgtggagctgccagcatggttggtcgcgtgggtatgtagagatatttatccgtgacctctgccctctcttctttgccctccgcacccctcatcaccctccacctcctccatctctcaactgatgcgcttcgcgtttccttttccaggtggttgaaataaatttgtacgctaaaaagttgtctgttcgctttcatacatgatggataaaacgaacgactcctagttaccaccctcggcatccctctcttgaaccacgaccccaggtgagtgatcgtttctcctccagataaggggccttaaccctgtttcgtggcactgccttcttgaaatacctcccagatcggaaaatgtgcaatcacgaagcatccttatcattaggtattatattgaagccatgctgaatcatttttaggctatctgacgctcacttccttccttcccagactataccttccccactctgtctggcctcatcactccgtctttctctgtttacactggagccacatacttggttaaggctttcgtgatgctcggaaagcaactgaaaaatacttgacggacctgctgtctatttccctcgactttttggctcacacacgagacctcttccttcacctcctccttcagaccccatg

SEQ ID NO: 3416 - DNA, 703 bp, Nannochloropsis_gaditana; identical to SEQ ID NO: 803

SEQ ID NO: 3417 - DNA, 703 bp, Nannochloropsis_gaditana
gccggtcagaggacccaagtgcccttccagggcagaggaggatttaggctcgagcgtgtaacgatcgtagattttgatttgatagtttgacagcgcagcagccaaagtactaccgtcaacagtgtgtacacaatgaaggacgtacctagacgggttttgcgtcggaacggacgtggcgagcgtcgttgagtttggacttcactgacctcccgaccaccaaactcggatacattccttaaaagatacatttattggtctcgcagcccgatcccaaacttactcattctcgtcgccattgaattcttctgtttgcctactgataggtgtctgcaacgtggtaatttgtactttggatggtcggagcaatcgaggcgttggataggtcgctagtagggcgccgctcgtcgtggaagccatcatttactcgtctaccattccgagcaaatgatccctgtggcataaagagaaaaatatcgatacgtggtttaacattggctgatatttgtgtgagtctcaaggctgtccagatgcgccgatgtgatggcgcaagtacctctgggagcacgcgcttgaagcatccggcgatacgccattgccttcttctattcacttgggctcgcatttcttcttatatcaagaacactttggctctttgcagccatatagggagtgcccagcgagggattgtacgtccatcctcatg

SEQ ID NO: 3418 - DNA, 703 bp, Nannochloropsis_gaditana
catttttaacttttaaagaggtgtgcttgaggggactgcgtctcagccgtaaggaccaatttcctggtctcgactcgtatttctgccttccatgctttgaggtagccttagggtatctttttgatatgtaaatatcgcttctttcagtttcccttttcggccgcgattgtcaaagatggcgccaccatcgatttcactttcacacaaccccgctccagttacgacacgtatgcgtcttcactccccccgacgcggccaaaaggcatacgtgtgcgaggaatttagccggtcatagtaatgattcttaatgtttctccacccaatgcaaaggccgtgactcagaagtaccaaaacatcgcctactttgtccattcgtctatattagggggtcatgagctctggtcagacatatgtgcctcgcatgacttcatctcccactcatctccctacacgagcgataattcttttgaaaagaccatttcttgacgaccttaatgcaactttataatgcaaaacgcaggaaaacattattaccatacgctttttctgtcttatatggagatctattccattcctgttggcatacctcctcatattactgcgctcgacaagcggctccgctaaaccctcagctacctttttgggcccctggtcacttggacgtaacccacctccagcagctaaaacaagcataacaaatatg

SEQ ID NO: 3419 - DNA, 703 bp, Nannochloropsis_gaditana; identical to SEQ ID NO: 797

SEQ ID NO: 3420 - DNA, 703 bp, Nannochloropsis_gaditana
caaaatcatacctgcataaaggatcgaccatgtccttaatttctgctgtaggctcgtggttttcattctgtgtgcatccctcttcctatccattcagctttgtggattcccctacagcaacaagaggcagtggatactaaatagttggctccatttcacgccttcacacgcccactttcacgacaacttgccgccaccatataagatatcgagattaacgtcctagctaggtacgttggtttcatgagtgcgtaaatgctgttgcgatttgaatcaggcatgcgacaagagatgagatacgcaggagtcacttgcaacatcatgttgtacacccttgatctgggcaagttctggccactttgtcaatggcatagcgcttaatcgatcaaaaatagcacggggagaagaatatcgcgatcatttggttgccgtttcctctattacgcctttggggggtccacggttcacgatcgtcgagacacaccattttccctatccggcctgagcgccatgtcgtctgtgttgggctcctgttgacagataacgtaatacgtagcatttgttactttgatctgattgtacggacaatcttgtctctgctgggaacctgttgacaaatatcgtactgcacagagtatgtcattcccatcttattgctctttctttcttggccatccgcacagacccttatcagcagacgatg

SEQ ID NO: 3421 - DNA, 703 bp, Nannochloropsis_gaditana
aaggaccaattggtacgtgcggtaagtcgcaaccattcgcacccatttccgaaagaactctctgtgagctctgggttgcctcaagggactatcgcgcgcacctttctcacatgagacttactaatttcaccaattacgccatgcgtattcttcaattcgcggccttgcgcgatcctgaccacgtgcggatggaggacgttgcgcgtgctcatgggatttcccgccatcacttgcttaaagccgccaatgtgctggctcaacatggctatttgattgttatacgcgggagaggtggcggggttcgattggcccgcgatccaagcgcgatgacggtggcggaaattgttcgcctaacagagggtccgatcgaacttgtcgagtgcttcaacgctgaaaccaacacatgcccgcttattggcgtatgcaagctctctgctgctttgcagacggcgacacgggcttttatggcggaactcgaaaacgtcactatcgcagatatcgctcaaaaccggggcacattgctggcacgcctatccgatgggatggaaacctgaccggttttcgatgggactgaatgtcgctatcggaaagccctatacaagtcattcaaaaaagccgtaagataaatacgacttttaagggcatcctcttagttgtgacgttggaaccctccaacgcaacgaaaccaaaggagaccgatatg

SEQ ID NO: 3422 - DNA, 703 bp, Nannochloropsis_gaditana
ttcgccttcgtcgcacgcgaggatggacatgtggcgccccttcggcattttcatgaatattatgagactgatctttccgcgaagaacaaaggtcaattctcgtccgcgtggctgtcacgtccattcttgatttgttattcgccgggccttggaggcccgacttctcactcgggggcgttgctttggcctcagcccaccagaggcaggaaagccatgtgtgccttcctagctacctcccttcctacctgctcgaccctcggtgctttgctctactttacacgttaccggtggctgtctggtctccggcgttatctttcttctccgtcctttcggattcataaacggtccttaacttctctcatttcatatcccttcacttcatactcatcatccatttcctttgcacagcacctctttcagcacagtacaacctcctttgcactgcctttctccccctcccgaaaccctccttctttccttacattgtcctgccttcgacgcctttgcctgctctcacccgatcggcatccctcctcgaccaaccccccttcctccctcccccccccgctacctcgtccggcgactcaaccccaacgtgcgttagcctagagaccagagcgcgctaccgcccgctgccaagcttccccgtgacgttaccgcgcccactcttccctttccgttccacctctgatacctcactgcc

SEQ ID NO: 3423 - DNA, 703 bp, Nannochloropsis_gaditana
catgacgcttttgctggggttgacagggctttcatcacgcctcatgtcaaatgtcgcgccaagcttgctgtccagaacggcattcatgatcggtgtacacgatgttcgaatgtgaaaggcgagtaatgtccgctgctgtctttcgacaatcgagatgagtagaatgtgcgttaatatacgttgtgataatatcgtatacttacaatcagacaaatactctgcttcccactcactattccgaagttatcacagccagagcttcaaatcttcctcaaaacggatcacataacaccaaaacaattattcacgacaccaaagcccggtattttccacgcactgcctggcagggtgcaagctgtatgggccgcggtcggttacttccggggtatctccgaggatcgagcgagggacgctcgccctcgctcgccggcgtcccttcaacacgcagtctcgacctggaggcacgcaaaggacccgtggcaactgagcacccatcccacatcttcaggacattgtcatgctgaaaattgttgtcgacgaagggcttcgcgaccgcttgttgcagaatgtggcagctggtcccaggtgtcaagttggggccatagttggccgtcggctgccgaatgggagccggatatattgcctgctcgccatccccatccccatgcactgtgaggagacaggcaaaaatgtaaataggaag

SEQ ID NO: 3424 - DNA, 703 bp, Nannochloropsis_gaditana
gtccagtggcccgtcgacttccgtgacaatttcttgccttttctggacggtggcgtatttgtcgcgccgcagattcatgcgtcgtgaccaaagcaaaggtttgtcacacgcccttggaagctctgtcagctcactcggtgggcggcagctgctctccgcccaaacatacacgtcccggtgggaaataaaaaaatagacacatgtacccgaacacaccttgtcccacgccccagacatgtcctagggcttctctcccaggagaaaacatgcaggcttgaaaatttggctcggtcgggcatcgtttttcctggggagtgaatcaacgagtgacctgtcacccggtacttatttaattccacgtttcgcccagtcctctgggaaaaaaaaagccttcctaacccggttataccgccgtctccgccatctccgcttggatgccgggctggagggacattgattgcgtgcgggaagttgtaaaggatgcgtgcactataatttggtgcccgtgtgtgtactttttgcatgaaaatgactcgcgagcggcaatggggcgtttctcccatcacccggttttgttccttccacctcctgccaacgtcactccttagaaaccagtctttcgcctgaccgattttatccctaccaccaccgctacatcaggtacacattatttggaacacatcgggtcttcaacagccacatg

SEQ ID NO: 3425 - DNA, 703 bp, Nannochloropsis_gaditana
gcgcgaaggcggaggaagaacaaaggggcgggaaggggcaaccgacaggcactccgtccagacgaccacgagttgaataacccagaaaggccgcccaccttcgtctgttacaattcgtcgttcttcaattcgcgtgttttcaacttctaagcgcgagcgcgccatgtctggtcttacagcaagctatttttgtcctcgtgaaagcgcgttcccccatctggcggaaatatgtttcttcttgggcggcaaagaagcggcttcacatttttcttttcatgaaacaattgtacacctgatgtgtttccttctgcaaacttcgctttgtatagctcaacactatttgactgatgcaatggcttcccttttgcggcgaattaagtgcgcatctttgtgtttccttgtgccatattccgtttgccgaaagtgcttcaacatcactaatttttgaatttttttctgtttgcgagtcattgaccttacaaacatcgcgtaccaatgtcacagacaaatccttgaagctttgcgtctgaagctaatcatgccggcctcttcgtcgcgtcggtcaccttctttgaccacgaagacggtaattttggccgctttgttccctgtcgcggccttaagcttcactttacccttccgacaccgcctacgggagcccaacgatgtccatcacagctttcgtgaaaaaactcatgcaatg

SEQ ID NO: 3426 - DNA, 703 bp, Nannochloropsis_gaditana
aattctgcgctctaagattgtcccggacctcgttcgtagcttgcggtacgctgagatagacaggttgccagcatatgtacaagaaatagaacttacttgttgtgcgcacaggagaagaaaggactgtctttcctgcgtgtagcgtgtcttccgtccctctcacgagcggcgctacagactccaaatccgaagcctcgacgggcattttgtccgacttcatgcgcaccgctgcacccgaatcatgacatgtgcttgtttcatctcgaatggattctgagcggggcaaatcttgggcgtcgacagatggagagctgccatcattcgtgcaaattgtcgtgcttgtgatagggggtgatgccgtactatccacttccagagctggacgcgacagccccttctccatacacgcatcctccatggcacctgtcatggtttgagacggatgtgtgggtcgagatgaatttcggctggttttgattttgattatgatacagcatgaatgacgcaataccatattcttaacatgtcttgaacaccctataatctggaattaacccgaggtcgttttcgtttggattcacctccagatttaaagtgagtagttcaagaaagcattcaacagaccagcaagctggtcatggtcggtctcgtgtgttgaaaagggagtctgggacggccaacgtagtcatcgcccggcacaatg

SEQ ID NO: 3427 - DNA, 703 bp, Nannochloropsis_gaditana
  misc_feature (1)..(694): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgatg

SEQ ID NO: 3428 - DNA, 703 bp, Nannochloropsis_gaditana
  misc_feature (410)..(419): n is a, c, g, or t
gcctccggggtctcagctgcgtgtacgtccagaccggcgctcatcgggtcgctgggcgtgaccaccaccttcagggcctttcgcggcctcccgccctccgagccctcctgcccctctccttccttctcagccaagaccaccacgaagccccgttcgctcgtgctcaccccttgcaccaccacgtcgaccagagtctcctccgcctgggacgcaggcccggcggccgcgctcccagccgctgtcgggccagggagggtgttgttgaccaccaccgtggctgtggtgtcgatcacccccggggcccctctctccaagctcacattgcccgcctgttgctggcttacagccactgcggcggccgctcttgcagcggcagcggcgacttgcgcggaagcggcagcttccacagnnnnnnnnnnccgtggtgctccggcagagggctgcaaagggggagctggctcatttagcccaccgactgatggatgtggacacgaggcggccggagccgtggatcgcagcggccttgcacagcgacctgaagggggagaaggagagccctttgacgttggtggagcaggcaatcaagacggatcacgagcatgtcctaggctaccaggtacgaggcacgttgctgcttgcgttagggaaagcggaggcggcggcttcgtccttccttcagggcagtcggctccacaaagacatg

SEQ ID NO: 3429 - DNA, 703 bp, Nannochloropsis_gaditana
gccatgccaaagagcgccacggccatcaccttggtgggtcgcgtcctggcccagttgccggaggggcgcgagaaggccaagcgtgccttccaaagggccctgagcatgaacccgtccacggtcgatgcccttttggccctggcagacttgcatcttggggcacaggaatacgataaatgtatacatctgttgtcgagtagtttgcaaaatagtgggcatgatttcttgcataccaagttgggggaggcctatgctatcagtggagatttttcaaaggctctagcatcttttaacactgctgtttccatgaatccatcttctgcaccagccacggctgggctggaaaaactagagaagcttttgcggggggttgagccagaggaggatggggagggggaggaggtggacgaggaggttgaggcagaggaggatgatatggtggagggcacgacagactagtgcaaaacggcatggcacactagtgcagttgcgaattattgatatgcatgcaaatcctcgatatgcaaatgtaaatagactagcgcggcaggggaaggaaagctccggccaaaaaagtagctaacggataggaaggacggtgagcgcgtgcgtttccttatcggttgctttacttcactcgatcatgaccacgacgtcgcatcgacaagccacgctcactccattcctgcttcatgttacgcaa

SEQ ID NO: 3430 - DNA, 703 bp, Nannochloropsis_gaditana
ggggaggagggggcggctaggggaagggggttggaggaggaggaacacagcatgctatcaccaccagaggacatttctgacgccggcggcagacaagcggcaagcgccgaatccagtgagcgtgggttctcagccgcctcgtccagcctggagcctccgacaccactgcttcccgggcccgcggcagaggctaccgtttcctacccctgtcatcccaagggtaccttacacctccttcgtcttcccctccgtcgctccttccacctgattctgcatcgggccttcgccttcctcgtccgggaggcggtgaaaaaccccgccttactctcgtccacctcggccccgtctgagggcgacctgggccagctcttggcgcacatcagtgaagaacccctgctcgccttgggtctctttgaaatgccagtctccgtcctcgtcctgtccgccgagattcgcgcgggcctttggcggcgcaacggacagctgatgatggaccaggtgatcaattacagggaaccgcccttctgcagggtcttccgtgacatggacctcttgctggtacagatggcggcgctagcgtggggcgattgggagaaggtgatgaacgcattgttgcgacgtttccacgtctggacctggctgccgcctgccgggtgggaagacgtaggcaaggccgacgaggcaggaggtcaggggggagaca

SEQ ID NO: 3431 - DNA, 703 bp, Nannochloropsis_gaditana
ctccccggaaaaagagccttggagagctgggtccgggggaaaccaatggagaagaagggatggagggcgaggagaaagcgggcggggaggaagtattaccgaaaaagccggtgtgtatggcctgccggggctccagtgcgaaggaggactcgagtcctttgggatacgctgccttcgtccagcgctcgaacgtactgagcaggtctttaccccttggggagttggacgcctgtccgacttcctcctccccgcagaagcccgggcgacggggaaggcgaggggcggacgggaaatgcggacaggaggaggaggagggggaggaggagggaacaatcgagggagggcgaagtgcggcgagaagtgggaaacagggtggctttcaggaacggcgagaaggcttgattgtgcagctgtgtggtcacgcgttgcactatgggtgctttgacgcctactttgcctcggtggtggagtcgagcgaggcgatgggcaacttgatctacaacgtgcaggcgggcgagtatccctgtccatactgtaaggccgtttccacttgcttggtgccgcacattccagtggtggaggacgcaggccttttcggaggggtcgtgattggcgcaggggcgggtgtaattgatcggcagggggcaagaaagggcaaggatgggaataggggaaccgtcgtgtggcgattcgaggatcactt

SEQ ID NO: 3432 - DNA, 703 bp, Nannochloropsis_gaditana
ttcgtgcggcggaggagagcaccgaggggtatattcagcacagtctcaagcaatacgacatggcaatagcatgagagcacgcatggacctttgctccgataatcattcgttgccatgctcgttgataaagagtgacttcccctcagcctgtctgaggtgctagttagcatttaagtcttctattgcgcgtttagaaagcattgaggaaaccagctcttgacttccttgtccaagagaatgtgtcttcctttaatatgtatgcacgttttacatgcccttcggtgggaagtcaaggaacctttacacctaaaagcgcacgctcaaagcgcccgacgggaacagatcctgaagatcgaattacccacatgccacagtatacacaccacactgtccgcgtcctctggctttgtaggtgcatcgaggccaaaaatgaagcactttatgcccctgtccactttttggagtccggcaaatctttttacaggccctttttgcgctcggagtatgtttgtggtgcttttcaacccaccagtaccacgctctgtgacaatgtcctcccgttgttcccgagatatacaggtgctgtccggtattctgtcgcacaattactcactcaagccctttcaatgcacagatttataaaagataagagaaacgggtctcagtcaaaaaccgcgcagcccccccttcattgtcaaccatg

SEQ ID NO: 3433 - DNA, 703 bp, Nannochloropsis_gaditana
catatgaaggggtgggaggcgtgtactttgatgcatgtgctcctcgagtccccaacaagctggttttggacgaacatttagcggctgcattttgggataaatccgaggaagcgatccaacacatgctcgtcgaaccctcagaagacatgtccacagaagttgctgaggaatgagttcagaggcgaagatgtggtatgtggcgtctgtaactctgcaccgttttagagtgctgcaaagaagtaccatgatacgccaagattgcatcgtagacgtgctctgtcgaaaatttatcacggaagtcttgttataggttttgtttgatgaatatccttctagctacaagagtcaagagggaggttaaggtttcgctcttctgttccctctttatgtctatcgcctatcaatcaatatgtacgcacatataacataatataatatacactttctctgcgtcgacgccggaagagatggcaagcttggtagcaggctcggattgcgtagtccaaattttaaatttagcactgggccttaactgacaacaacggccgagctgaagctcaacggaagacaactgtcggtatgggcttgcgcctcagaaagacttgcctgcgccaaaccttattatgcctgtatacccgtataaattgcttgttttgcaagcctttgaataattggaatttttcggtgttgattgtttcggcta

SEQ ID NO: 3434 - DNA, 703 bp, Nannochloropsis_gaditana
tgtcaacccctcccacgatcagcacaatgctggccgttcatggcagtagggcaaatatcagaaattggattgcgggatctattgttgttgcctgcttttttacttgtgacgcactgaccgccgcatcctcgaaccggacgagccgttgtacctcccgaatttatgattgctttaccactccgacaaccgtaacacaggaacgaagcgccgtgccttaataatggtgcagtatggcattgatccaggtgctgaaagtcatgtaggtagtgcaaattgcggtgataattccatggtggtggccgtgcgaattcgacccatgtcgacgaaggaaatgcagtctggcgcgcaaaagtgttgtaaggtggtcaatgggcgctatgtgatcatctcaaaagcagggattgcaggtcgctatttgagatcgcagcaaggtgagtgacaaataatgccctattaaatgccttacgagaaggagccgtgtcgccactccggaggtctcagtatgtcaaaagcatcaggccgcaaacatggtttcctccacgctgcctgtgagacatgtaggctgacgtgatgatttacacacagtcaaatttaatcctttctatttatgtacataccaggatcatctaacgaatacgccttcgacgtggcattcgacgcagacgccactcaagccgaggtctacgagcaaacggccaaaatg

SEQ ID NO: 3435 - DNA, 703 bp, Nannochloropsis_gaditana
catttgcgtggcgcaccatgtccgtgtcggagcgccgaggcgtggtggtcgaggtcgtctgcgtctgctaggggaaactgctggcggagggatgtttggcacaggcgcgaagaaattcatccagcaatgttcttccctgtgaggattggaacaagagcgtatgtatctgagatgaaatcacgtgtgatagagagatcggagcagcgatttattccgttagcggggcaccacagtcagggaaaagtctcaaatccattcgaccactgtactctatctgcttcccaaactcttatccggtctaaacatagctctatctgtccaacgcttcatgcaccccacgtacacgacagtagaaaaggatctctctcatgaaaaggcttccttaagaaaggattgggccgaacaagcatgggcctgcggcagaatttgaattggaatcaacttaacgggcaacggactttttttggcgtgactaggccttcgcgaccacctgtcctgccatcgtgttctttattgtgccaagtatcttggacacgcagaacgtcgaaatatgactcaacttgtcttgaacgtactacgcacgtatcatgagacaggttcttgacactttggcctataggttgcttcttccctctattacgagccagtcttcgctgtcacgtcaccagagcgcgtcagcgaaaaccgatcaaaaagccaaatg

SEQ ID NO: 3436 - DNA, 703 bp, Nannochloropsis_gaditana
ctcaagcttgtcttcatttctgaaatctttctaaattgtcggtgctattccctgcgtgtaagaggtctgccaggcatctcgtgcgcgctcccggcttctgacctgaacaagcgaaaaattccaaaatccaaactgcataagtcaagcgcacataaaatactttgctgaacagcaataatttgaagttcgcgctcaatcaaagttcgtaagacggaagaaaatgggcgtgttgcctgataattcaacttccctggctattttggggggcctggggcttcggagtgctggctggatccggttccagaagattcaaaagaccgagatcttcgcagaatccgacctccccccttgcccgcctccggctttgaatattaagattgattttgcagcaatggagtggcttccgaagatcacaatgaactaaatttgaatagaatctatgattggagtagaaaccttactttttaatcacgaatctgtcccgcaatgcttggaccgcatcagggagaggggagcatgggccaatatcccgaacattcggctgttcatgcatcatccagcaacgtgctccgctcctccaattcctattcaatcagtttggaagagcgtagagtgcaagcgatgctttgcaggacatgctcgctttctaccttagtatattacttcactcactattgatttttacgtgtcacgacctgtaggc

SEQ ID NO: 3437 - DNA, 703 bp, Nannochloropsis_gaditana
acctacgttggacaaagagctcgagagtttagcaggttgggaaacatcggtcggtgaaccagtgtcgagaatctccagaaatgatcggcagacggagagtgctcaatcaatgtacacattatccctccacacctccgagaaattagattccttgccttgcaggacagtctgaccgaaattttggtacacgatggagagtttttgggcatgggtgtctaattttttccactatttgttcctgagagaacggtcaggtccgtccatccggctgaagagcgggcgggcaagatgatgtaacaccaacccaataattaccacgattgatcgtgatatacaaacatctgcacacacacaaaaaaatatgaaaagcatgatgtcgtgtggtatggcaaggaaatgctcacagaaggctgtatgtgttggcaataagctcaagatagtccggcgtttaccatcccttgtccgacagagtctgctcgtcttttgtgtcgttttcctcgcccttcacaaaacattttagccgtcttggaccaaaatgtactgcaagattgagaatagcacatattttggttgttactgttcgcttgcgtcggttcgaagagcattctcgtatgtctgacgtataaataaatcgtaaatcattcaccatgtccccgcattactagccgcagttttaagttgagcaacgagaagatctctcatg

SEQ ID NO: 3438 - DNA, 703 bp, Nannochloropsis_gaditana
cgtcttggaccaaaatgtactgcaagattgagaatagcacatattttggttgttactgttcgcttgcgtcggttcgaagagcattctcgtatgtctgacgtataaataaatcgtaaatcattcaccatgtccccgcattactagccgcagttttaagttgagcaacgagaagatctctcatggaatccacaaatgggatcttaaaattcttgctttccgaaactcataaagtggccatttgctcactgctcgacataccgaatacctgtgaggtaaggcagttggcaggtccagtgtgagtaacaatgtgtcgctgttttagaaagcctccttgaatatctctcgtcacgagccatgctaagtcctatatttcttattattgatgcgaggattcttcgtcaacccaaaaacccacaaggtcaatctgtcacaaaagcaaatttgctaagatacgaattgcgacacgattgtgcgaaaggcattttggaaggctgtatcggtgtgcttcaagctttatgcaacaaatagcaaaactcctttgcataagggttaagttcagggttgaggttagagttgaggttaagattaggaatatgaatcatgacagactcgtccgtcgtcttctgttcctcttgcccttccttcttatctccacatcttggggcattgttaaagcggttaggcttgaaatttgtcaactatg

SEQ ID NO: 3439 - DNA, 703 bp, Nannochloropsis_gaditana
cagagcgtcgaggcgacctcctctcccggttgcttgggaaatgacgtcaaaagctgtgcgcgtcgcacccgtaaaatcctcgctccatgtgttaagcaccaaaggcagcgcagatgcaaatgatacggcaggatagtagacaaggacacccatgattgcgaataaattcatgggcaaaaacctatttaagggttcaaggggagaccccgtctcgccaaagttggttgtactccctggagccggcacgaaacaaagcgatgaagccgatgggaccaaatcagcgcgaaaagataatcacaaattccctcttcgacaaatttcctgggcgcatgaagggttctggtcatgaggagttgaatgtagtacaaacaaaataccacccgaggctgtttgaagaggaaacagcggggctggcgagccggatgcagtgggcacgcagaccttccacaatgacatggaggaagatcacacccccgagaaccctaggcctttctgcttttggttcgtatcacctctcgactctggtctgagatgaaatgtgaagggcccctaagtcgccagagacccagcccccctagccccgtgtccaccatctcaacctcccgacccccctcacaggaaagcacatacagagagatccttgtaggcgcacgtacacacacccgcgtcccagagggagccggttccgccatatctttggatg

SEQ ID NO: 3440 - DNA, 703 bp, Nannochloropsis_gaditana
  misc_feature (272)..(281): n is a, c, g, or t
ggcacgtcctccctggttccatcgtctcaaaaagtgcacgctccgctcggccgtcccacggcctgcctccttctccaagagcctctcacgccctagcctcgcctcccgctgtgggttctagaaagttgcgtccccgcttcttcctttccaccctccctgtccctccgtccttctcgactaccaaaaggtgagcttcaccacgatcaacaggaagaccgccagcaagggtatcaggtgtaaggcccgtccccgccgcctccgctctccctccnnnnnnnnnntcccataaccaaaggcatgcgaccgccgtacagaccgacaaagtcgttcagacactgccctcggctcttcatgtgcccgagctgcgtccaactcttggtggagatgcctgcaaggagggcgggaaggaggaagggaaggaggaagggagggagagacgcaggtgagccacctgcccacacatcgacgccgggcaaccgccagccctctctagatgcatcccgggggcgtgaacaagcgcaacgcttctggacacgacaagtggatgataggcaccacgaccgacaaacacatttttgagcgaagcaagataacgaaggggggcatagggtccacttctcagggagacgcccacccacacaccatccagagacagggagcccctagtcctgcatgcacctccgacttctccaatgccctacca

SEQ ID NO: 3441 - DNA, 703 bp, Nannochloropsis_gaditana
caagctcagagggcactgaaagggcaagtctgatcggagacggcagaaagtagagatcttaatgtaccttcgggtgagaatgtggtcgtcgacgaatcgtaacgcctcgccattgctgcgaaaaggctatataaactgtaaattgttgaatatagggaaactcgcgtacatgaaaacgccaaggaaaggaggaagaagcatttcgtcttccatgctttgagcgagcgggcaaaaagcgaagcatcaagacatccaacaggttgaaaaccacgcagcctcgcgtccacccagctgcaccaagctgttatgcacatggaagtgcttgaatcgtgatcaactacgccatcggacaggctcttatacttgcttttgttgcaagtcaagcaaagaggagcttgccccttcgttccacgttttcgaacccttcctttaacgtttcgtacacacccaaaaaaatggcaagaaaaagggaatttggcgtcccgagaatggcttctgcatgtactatgcaaaatatttgtaactgatgtcccacggggtgtttgctggaaccacaactattggaatgcggacttttccaaccacgttcgttcacgcaccctgtccgagctctttgacattttccatgtccatgttataagaatttggcatcaaataacaagcggctaatgaaaaatatatcgctgtcccatgtgttcagggt

SEQ ID NO: 3442 - DNA, 703 bp, Nannochloropsis_gaditana
aactttgttttcgacccattgatagtctgaaaatgctacatttccttataccggagcacgtacgtcaatttgtgcagcttcgatcttcaaagggtagccatccaccacgcccttggcggtattgcggaggacattgtggctgaggaggcgcatcaggcgggacgcttgtcaaggcgaagtggtaatcgaagtgggtcgttcctgtcgcgtggaaaaggcgaaaaggtgtgacatacatcacggagaagcataaattagctgtgacagacaccgcaggctctccattacgttgggccccgactcctggtatcataattgctgtttgtcgggtgccggctggagcctctgccaccctgattctctgaacttccactcaatggaaacaaatatcttcgcagccccctattcacacatcatgggttcatggctggcagtgagtgaggtatatcgaaaatcattttttctgggtgggaataacaacacgcctcgccaaccgttggcagcgaaggtattcctcctaagcaattcttgcaattatgtctgcctcagtctagcaggtagtttaaataggaatgaaatgcacacttccatcccccctgcttttttaaataagacaattattttcggctttttccatgttccaatcttctttccacacagtctttttacctggaaagcttccacaggggagaggagggaaatg

SEQ ID NO: 3443 - DNA, 703 bp, Nannochloropsis_gaditana
gcatgggccgtggagtatggctcttttaggatcggatcctttggttggttgcttacacttgacatgtacttcactggctttgatcatttaatctaccacctatgacagtcatgttttttctcgcgtcgtgataaatttctcacagccgcaaaagagaaatatcaccgcgcaatagatggtgcgggttagtcagcgcctcactcaaagtttaatgcgcactcggccaccaacatgtccaatatcctaccatagcatcgtattttcactttaaaattcagtggcccttcgctcatggctgtacaacatagataaaacatctgcatccgacatcaccgtggggtgagagtgagcagatcggatcgagccgccttctctcgatccgacagagatgatgactcaccctactctctttccgcagcacaatttactccgccatgccgcttcccaaggaaggccggcgggcgtctgtatgttcgggtgtggccactgctaccgttaatgaaggcatggaaggaacttgctcggtgtctactgcacattttcggctccctttttactaccccacgcggctggcgtggtcgccgcattggccctgtccacatggttttcgcctggtgggaaaagaacactagtttgttccggcttgtttcgtttcgctccgtcctggcactgatgatgtcccttacatctttgacacacaaca

SEQ ID NO: 3444 - DNA, 703 bp, Nannochloropsis_gaditana
tcaatccatcgaacaacatatcactatttaagaacactatacctcaatataaacaatatatacaagctataggtatctttttcaatcatttcagctgccctaaaaattccctgctcgggcgtggccgacatggaatccaaatttgaaaaaccgttactaggcacacttgccacctgactcccggattactacgaccgtactaaggataatctcacaaaatagacctacgcgacgacaacaactgaaatctgagccatgaaacgtcatgaggtatcaattcaggagctctaaggtcgatgcttaagcgctttgttgcttaacttttgaacttctttgcaaggtgtggtcgacatgagtgcacggtgaacacttccattttgaaacaatagccaaattcctgagtaacaggggtagactataaagtaaattcgaggaaagacgaacaaggatatgggttgagagtccgtgggtagtaatcgtagagtgctgaattgtgcttgtcagggtagagcgaacaaacgccataaatcggcattagaaaacacgtctcctcatataacacatctcatgtatccagacacgcatttcgaacgttgatctttcagcaggaaatgcatctgttccttcctgctaactcagggaaatagattccaggatacttctgggcaacatcctcgcaagataacctcgccgggataatatg

SEQ ID NO: 3445 - DNA, 703 bp, Nannochloropsis_gaditana
  misc_feature (1)..(81): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnngacgagcccacactcatgaatgcatgcagaacaagagggtagtctaggacaatcacagaacgcaattcaaaggacgacgcagtccaccactaaggagcgtcatgtccgtactccggaggcgactagttatctcgttcgtcctcttccgacgacggcttctataagccttgacctggagccaagataagtccctggccagataaaaacatccctttcaaagcataagatgccgtgacctcggtacattttattcctgtccagatattgtaccccccgggttgtctatctccgccaaatagttttggcggcttggggcggcggaaaaggagataggcttcccgccaggcccatatgccaaacggaatgcacgtcttgtccgaaggcgtaggggaatggtgggggggcaccgtgccggtggcggggtcggaacgtcgaggccttttttctctcgcatggtcgtttaggagaggtattatgttgttattaaaaatctgggtgtcatgggctcggtcttaacctgctttatgtgatgtgctgatcgctttgcctgggcgatgaatggaactcgacgctgacttcgcctccccgcttcttgtcttacctacgagcagccacagtcatg

SEQ ID NO: 3446 - DNA, 703 bp, Nannochloropsis_gaditana
cttggtcttataaatgcagaggaaaagacccgctcgtgtgctgctgcagcatatgtagaggacaatacattgatcatcacatatatcgaaaggatccgcgtcttagatcaaatttcggcaagtgcaaatagcatgcaggataatcttgactttgcctcgtcgaaaaaaaggatgaggaaggtttaccgtcaaatgtaagaaaacagcagcagaaatggacgaacttcaagcaacgtcatcctcaacaagagagtggcgtcatacttcaaggaagagtccacacacgttccggcattcttctcgtaaaatgacgacgaccgcgacaccttgtgttttggtgcaggaatcaagcaacacagtatctgaagtagccctcttgagctggaggtgccttcattactgctttgttgttttggtcccagttcgtatgattagcaggaaaacgaagtcacatccggctcatgatataaatcccgaagtgtcttcagatactgaggcatagatgtcgatgtttcagacgtaaatcctttggcatcgatctatcaccagccgtatgccggtagccgtaccattcggccatccactcggacagccaattcaatgtcgaatcagcaacatcaacttttgggtgttttccaccttccttttcctaaacctaaacaccttagcaacccgtagtatcccgaccacaaagcgaagaatg

SEQ ID NO: 3447 - DNA, 703 bp, Nannochloropsis_gaditana; identical to SEQ ID NO: 381

SEQ ID NO: 3448 - DNA, 703 bp, Nannochloropsis_gaditana
agtgtgaaggagagtggattgcagagaactagagaggcagaagaaaagagtcgcgagcgagcatctaggtctaatttaaattatgtctccggaattacaatctctaagttgatcttccattatttgatttaaagtcgtcaaattgtggttcaaggcagagcgatcgccctatgtttggagaggtcatcaggagatcgggcggaccatcacattggttcgctctgctcctgtaggcagtgtatggtatccgcttcttccaacttacccaggtcatgggaagtaacaatggcgttatagactttcaacgtcaaaatatcgagctgtgcagatacggaagtacaacgggaaacagacaatgggatatagcccagccccctgtggcggcggcacaaaaatgttttcaaaatttcaatttcaacggaaagccgttagcggcagcttcccaggtggatatgggcctctcagcctgggggcgccggctccccgattgatatggaattatggagtctattacctttcattcatgacctcaggcacgctattatgatcggtatggtaattgaacaagctgttattgtcccttctgactcgatctcattctattgccagcttacttttactaaaccaactgctatacatccgatttctctgatacatctccactgtcgcaaggatcagtgcattgtcacagtgctaaatcatg

SEQ ID NO: 3449 - DNA, 703 bp, Nannochloropsis_gaditana
catgatgtctgcttgggtcggacgctatctgtgacacgggaaggacattggaggggcgggaaggcagatgcacgcaggttgagggggactggcgagttggagatgttctcgtctaagcagggattcacatgcgttcacaagcccagagcataaactgctgtgcatgcagtgcgtgccaaaatcaggacagtcggtgaattggccatgccgagggctggcttgcgtgggcgtgtcgtccttgtctggcgtcggattaaactcagcacgtggttgctttgactcggagccggcgctcgctcccagcgacggcttgacgaagacgaggcacatggaaaaagcacgccaccgaaacagggcccagcgcacggcgtggcacgcgtcgatgccccaatcatgatttgacgacaacgcgctctctccctcgtcgcatgggcttgggatttctccgaccctttcaaagaaacggacgaagctttgtgccggctgcttgtgtgaggaggaagtagcaactacgccctcgttcgcttgctcaacttataaaggtttcaaatcattcccgtcctctgctttcgacaggcatatggcgatgcgtccaatccttattgcttttcttcttctggtgctattgcccatgcaaaaagccttcctggttagggcagtgccagccatccctgtatatcaacctcctccaccctgctctatg

SEQ ID NO: 3450 - DNA, 703 bp, Nannochloropsis_gaditana
cgatgattgacacttcttcaaagaagcctatctctctgtccgtccgcggctgctggccctcctggacgcggcgaccctgggggccttggaaggagggcgggcggaggattgggagatcctcctcacgggccactctctgggcggggctttggcctccctgtgtgcccacgacttgtcctcacggtacgcagggctctccctgtccatgtacaattttggcacgccccgcatcgggaactcggccttcgcccgcgcctacgaagagagcaacggcgatagctaccggctcgtcaacgagaacgacgccttcgcccggttccctcgcaacctgcacccgacgctcttcaactacgagcacgcgggcacgaccgtcctcttgaatcaggcgactttcgcggtccaggaggctgcctcccggaaggagaaggagagggccgacgtgcctcaagagggggacaagcgcgggtccgaggcccccggggggatcatgtccggcgacaaaatcgggccgtccgaggaaagtgcgccctcggtctccgcgggttccttggagctggagcctctctttttggaagcagaatggcagcttttgaatgcgttgctcagcggggcagccctcacgtcgcatttggaataccggtacttcgaatctctctttgctgcgcacgtgtcgtctcaggctcagcaaggaggagaagggcgc

SEQ ID NO: 3451 - DNA, 703 bp, Nannochloropsis_gaditana
cgtcttgaaactcgcattgagggagcaccgtttgcagcagcattggaatacatagctctctaatttaatcgtgccaatattattgaagagaggtttatattgcgatgtcgatgattgacacttctttgcgccccaaatgcctcggcctggttggcgtacgtaagtttgaattttcgaaaatttgaatttgagccaaggcgtgcgtccagggacttctgcggacgtttacctcctcgtgcgtccacattagagtcgagaagctcagccgctgcgaacacttctcgaattcctatgcccacgcatattgtcaacaatggatcgatgacttaatcttataaatgggttgcgcggcctagcaaatgcaaatgcgtccgtcagggtttggccttgattttacgcaaaaccaggaggaaaagctcatagggctattccctcggtttattcaccgaagtgcgctctctttctcacacttaaaacagtaatactacctcagcaaggcaaaatgctccgaatggggagttttagcggtggtcggcggagcagtcggcgcaaatcagcgtcttcgcgtccgacatccgtagattggtgcgcccctttggccagccttgaagcttgtctgaccgagaaaactgatttaatcgatgagatgaaaaaagtactgcccattactgtccaagctcctggcattgtggcaattggaatg

SEQ ID NO: 3452 - DNA, 703 bp, Nannochloropsis_gaditana
tatcatgtcggcataaaaaggtccaaaaaatgacgcacaaaacagtccacttgttttctcctgtcttcgtatgacatgtatgtgcagattgactttaccactctccgagtgctctgctctcgaaattggaagatgattggacgtatgcacaatacagcccacttttttcctcttgttttcgtatgacagatatttacatgtcgactttgtcgctctccgagtgctgttgtcacttttgacgtcaagctattgccgaaaaagaagttgcgaacccgaggcaagttcaaatgcctcccccggggtcctcgggtttatccttttgagtgcgtgaaccgggtttatcatgaatttcccgatttaacggccacccaaattccgccgtccctccagacactttttctttatctatgattggatgtgccatggtcaccttttcgacttagaagaatgcgaatagagcccaaacgcattttgtggcattcaagaacatagtatgcatcagagaaagcttgtacagttttctaagtgttgggtggacaaatctactcgcggaccctttccgagcgccgtcgggtcgggtccctccgtgcttccttccctttcctgtgctttcgttgacgaaacgagattatgtagcgtcttttattgtataaaaaagtctacaaactattttaagtttgtacgtacctattgaccgccccaa

SEQ ID NO: 3453 - DNA, 703 bp, Nannochloropsis_gaditana
gtcgaaataggtacgctcgaaaccattttggaaatgtttgtgctgatcatattgcgaacaggtgcagctcacagatggtatccttaaggggtacttcgttaattccttatcttctaccgaaatcttgtcgtgatgaggcgccaaaattatcccaaggtgatcaggcaactagattttctctacattaatattgcgttggtcctgctattttctgtcaaatatgaagtcatggctcctcggcccataggacaggagggtaagatttcgatacctttcagtggaatgtgcaagcctcgcgacgtggtcatacctggcgcagcttatggggaaaatattttaataacttgcattctggaaaaaaaaaggaaatccgaattaaagacaagctcacgggttcacaaagatttcaccatccaccagccattgcacgggcgaaagagcttcaacagcgagttttgcgacgatatatgcagacgaaaagtttctatccctgggtgagttttgtgttccaggacgtcatggaaagtcgttatgatacgcgcatttgtgacgaaatcaacagtcatgtttttctcttcacgcggagtgagtataggctgtcctggggtaaagcagaggattttatggctgactggattgcgtggcttcagccctttgttttcactcatcggcacccccccataaattttcttccagaatcatg

SEQ ID NO: 3454 - DNA, 703 bp, Nannochloropsis_gaditana
caacggaaacgcacagcggtagcatgcatggctgaagcggtaaaatgcaatcatcgcttatgctgccttctacaatctcattttcgggggtaggctatcgagaaagtactctgaagactctcatggaagtctaaacaagcaagtccaaaggaagtcaccttgctgtgcgtggtcgattgcgcatctacgaacgcgccgtgcgtgggttgtgcatttaatttcatcgttttggtcatgtagtgtctgtctgtgcctgatggtggagtttgatgactttcctcacgtcaatctgtaccacattctaggtaatggaacgtacttgtgttcgatggaaagctcggatcgggtgaaggcctttcgtcagtggaggggatatcaacaggacatcgcatatcatgggactcgtgtggcaaaattatgaccggacaaaaccttatctaccgtacctttacatttataatcttgcagaaagttaatgctgacgaagtgatcaatactggtggtccttaatctcgcccgcccccgcttctagcctccccaccccctgatttttaatcctaagcaaatggcggccacacgcatcgaagcttacagagtggaggcggatcaactctatgaatcgtaccgatcactgaccctggctgaggttaagaccgtggtggaacatttgagagaaaaaatgcgcatacatattgtcaagatg

SEQ ID NO: 3455 - DNA, 703 bp, Nannochloropsis_gaditana
  misc_feature (1)..(689): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccatgcactggt

SEQ ID NO: 3456 - DNA, 703 bp, Nannochloropsis_gaditana
  misc_feature (494)..(503): n is a, c, g, or t
atcgaccagggccatcgactgcgcgcgctcacgccggcttcaatcacccgaaagagcgaggagggtgccatgatgcggaggcggaacgccgtggccaggagggaagggtggtgggcgaaggcgcctttcacctcatcctcccacgtagggggcaggagggtgtcggcgtggaggaacaagaggatgtctccattggcagcggcggcgcccaggttcatttgccgggcgcgaccggccgtgggggcgcgaatgacgcgggcacccaaggcacgggccactcgttccgagccgtccgtgctccccccgtccaccacgatgacttccacgtgggggtcgtggattttgagcttgcggcctgggcttgtccgagcagagggttcctcccggttggaagaggacggcgtggtgcttggtgtcggcgtgctttcctgtgggaggacgggcaatatgtgaggggcccgggcggaaaacatgcccgcgtgcccgctcccccnnnnnnnnnnggacgacggcggagctctggtcgcgtcgggaaagtatccaggccaccgccgccctgaccaagaagaacacggaggagttcttggcctaccggttcttggagcccgggaaagccatcctggaggatttgatcctgaacaagcggcagcgattgacggacgaaggggccatcacggacgcccaagccagcttgcggaggatg

SEQ ID NO: 3457 - DNA, 703 bp, Nannochloropsis_gaditana
agggaggtgtcaagcaagtatgtattcatcctttccaatcaaagcagctcatagagatgtggttcgacgtgacgatgcccctccaggccggaggaaagtttcgcccatacagcataaggccacgcgtcgcagtgctgaggagctcgaaggcgggcatgtttaatagtgtgaaggattttctctgcaaactttaagcgaacaagttcattcattggacgaagagaatctaaagaatctgatatagttcatcgtgtgttgccatattcttcttttacaccccgctgttttgatcgcggggcttccgcgagatactttgtattctaccaaggtagccaagcggacaacttaagtgtggacttcaaaatgcgaccgctttcatccacttcaatcacagatgccgtgagcgaggcataatcagagaccctcgagccaggaaaaagggccttaaaatagacgaacgacgaacaatcgtcattcggcgatcggcgatactaccacgccctcgccctaggtgcggtgccggggttgcaaaggggcgaggagcacggagagggaattcctcgggcatgtgttatggtaggggacgaagcctgacgttatctttctactcggttgggatccgtaggtgcacggagggtttcttgtctcctcgcgatctgaaaagcaggacgggaacggacgcccacatcttctgttgcccatg

SEQ ID NO: 3458 - DNA, 703 bp, Nannochloropsis_gaditana
cttttgcatgcccctcttcaacttcttcgggctcttcttcccgatattctcgcaaccagctcatggatgcatggatctgggttgcatgtaaacccaacgcgttggtcattttaaaaaaagaatcacagtaaggtaaggttgagacgcagtataactttcaggggggaggtcgacgtcgctgaagaggcctcccttgccagaagatgatttgccgtccatgcacgctcatttcctttccacaagcgcctttttcgacgaacaaaacgcaagaagttgacctagaggtcccattctagcgtacccatctcccatcatgacctgtggaggcctgaatggactcgtattgcgaccgtctttgggctggggaccctagggccttaacgtaacggatgggcgatgattggaaaggcgtgaaactgccgtgtcccagtttcgtgtatcaatttgtggggctggagggaccaccgcgaactttgtcgtgacctgtagctgaggacgatgagtgggtgtgaggagagcgtaaaactgatcctaggtctctttttcttgaacttatacaaccggaacagtgacctgcaaagtacaaggatcggcatcgttggccctaacaaaaagtgtgataaaacggtgcaaaccttctccgttcctcttctttgggacactatcgactgtctagggtgcccttatcttagtagaactcatg

SEQ ID NO: 3459 - DNA, 703 bp, Nannochloropsis_gaditana
tgtcatgatggaggatgggcaaatgatggcggattgggaggaactgatgctgttggagggtgccaaacctttgagggactacatggattgtctttccttgtcgcagccggcgcccagggcgtcgactctggcgggagggagggcaggcgccgaagaaacctctctgaagtacggaccgatgtcggggcccgcctacataatcacagacgatgcccccgcgggccgcgtcaccctggacgtaagctgtctcttgcatgcagtgccagagcagcccccgtcctccccctcctcctcccctttccctcgatccgccccccgccggctccccgccttgaaggacccgaggcactacgcctgccacccaccgacctcccctccctccgccattgcctgcttcggtcgcatcgccccccttctcctggacgctgctttctccctcccggacctccttcctccttcctcctctctcccgaggggggaggagcacgacttttccctctactcgaccgcgcagttggagatgcaagaagattttgcagatctatgcgcctttcacccgacggtacacgatggcgacacttgcctcgcgctcctgagggagtaccgagaattttcccgggaaatttctcggggcggggacggccacccgaagaaacggctgggaggaaaggcccgggcgggggcggaggcaaggggagagatg

SEQ ID NO: 3460 - DNA, 703 bp, Nannochloropsis_gaditana
atggaactgcgtgaaaatgtagagaacgacacgacgtattgctgcgaggaccatattgttgtcgcgtgcaatggtacgaccaaccaaaactggtaaaggattaaaaaagagatcaccttggaactcgccaggtactacatgcctgttctcgcttccagaaaacatcgcccacgcgtatcttgaccgctaataagaagtcatgttccgcaatcacagttgtgactcgtcttgcagaattacaggggagatgggatggaaaagtgaagagaatggcagcaaacgacaaagaagaagaaatggcgctgtcgatttcaagctgccctccctgatactcctactcccggtgctgcagctactccctcttgtcgcatccctccaactacaacattcgacatgtctccgctcctctctcaccgcgatttatagcgccagcagtaggggctgcagggctagtagtagcaccagcatcaagagtggcagcctgaacatttttcccgccgccgttacctcctctgcacctaacctctccctacccaggaccctcagccagattgaaattcggcgagcaactgtcagggatttcccggccatagctagtactcgcaaaactatcatcttcgtgcctaaacagggcggtggaaatggtgcaggcgttgtccgccgggcattggaaaatgcaagctcccaggaagagcgggagatg

SEQ ID NO: 3461 - DNA, 703 bp, Nannochloropsis_gaditana
  misc_feature (1)..(52): n is a, c, g, or t
nnnnnnnnnnnnnnnnnnnnnnnnnnnnnnnnnnnnnnnnnnnnnnnnnnnntgacccggggagggagttgaactccatagtttccacaccttcaatctatctttgaccaccagtgttgccacgcccgtgtttcaggcttgttacggtactctccacgtatttctgccctccccgcctcccggaacagaaaaaagcaggtaccgtagggcacacaagtccgcgacgttctcaatgtcaatgctggggctggaggtaaaataattatactcgtccgaaaaagcgagtatttctcccaaatcccgtaaattgagaaatcctctggagtgaccctgcatgtgttcgagaggaaggccggaataatatcagtgaaattggcacggtaaggtgcttagcaaacggactcgctcatttctaccgccccggtctggcgaccaccacgccctcccctttctgtccgcccccaaaagaagaaagtaagcgcacgtccgcgttagatgaccgagcgtggcttaaaaccatgtaaattgcacgtgataatctaacaacgaccggtttatcgctacatatttgtggctttctggtggtatcctagcgtctcacttcgcttcttttacctcctccctgccttccgctaacttaggactctctcacgcttgtatcaccatacacggtggataccgagctatttggttgaccaagatg

SEQ ID NO: 3462 - DNA, 703 bp, Nannochloropsis_gaditana; identical to SEQ ID NO: 795

SEQ ID NO: 3463 - DNA, 703 bp, Nannochloropsis_gaditana; identical to SEQ ID NO: 783

SEQ ID NO: 3464 - DNA, 703 bp, Nannochloropsis_gaditana; identical to SEQ ID NO: 787

SEQ ID NO: 3465 - DNA, 703 bp, Nannochloropsis_gaditana
  misc_feature (628)..(703): n is a, c, g, or t
atggtgcgattcgtactttttcctcccaggccggcaggagcatcgagggacgggcggcattttcttcgacgacttggaagcgcttgagggcgggggggaggaagcgggggaggaagcgggggaggaaggggtagaaagggcgcgcatgttcaccgaggcggtcgcccggagcttcatgcccagctacctgccacgtgagttatttgcctttgtagggcttttccccttttccccattcaaagctttttcgtccttcctgttcttaacctccttgttccttttgtattgctttttcagtggtgcggaggcgtcgtgaccagctttttgacgaacgacagaagcagtggatgctgttgagacgaggacgatacttggagtttaatcgtgaggagggtgggcgttagaggggggaagggaaagaagtaggctgagataaatcggagagagaggggaagaggagggaaataggcagaagagaagaagggagatgatggaaacaagttagggaggtatcgtgacgattaagattggtgggataggtaaagcgtgaataagatggtagaatgttatcgccaatctcgagatttcatcggacaagatactttatatatatatatatatatatatnnnnnnnnnnnnnnnnnnnnnnnnnnnnnnnnnnnnnnnnnnnnnnnnnnnnnnnnnnnnnnnnnnnnnnnnnnnn

SEQ ID NO: 3466 - DNA, 703 bp, Nannochloropsis_gaditana
acgtggtattcctctgtacctttcttctccctgtgggtacccgtcgatatatatggatgccatagcaatggaacgggtggcacgagagggtgggacacctgccaaaaggtctgtgggacctggatctggttgctacacgcgcgcgcactgggtaaagaaacacgaacggagagacattttgcacacttcttttctttttgtctctgagctctcagtgtgagctcaccagtgtatgtgacatcacttcctagaggtcgtcccccttgccctcgtcgagctcgctgctaacttgctgagggcgaaccgacggtttttccacgtaacggttgaaggggattgggcgtaacgcgaaacggtttcccccttccacgtgaaacgctcggatagcgtaagattggtttatacctaagtaagcatgcattattatgtctcccgactccaatgcacggcattcgttttttatttgccgctgctgaacgtaaaattgcttgatagaaccacatttgtatctgcaaatcatcttgaaaacatgtacgcaggacttcgaagtcaacttcaattagagatcatgtgcccattcctgtcaagatcctcactttattcctgattaatgtcttgattccaatttttaaccatcaaatcgagcagattcacttccacttctacaaagtaccgtaaaattaaccatcccacttaagaaatg

SEQ ID NO: 3467 - DNA, 703 bp, Nannochloropsis_gaditana
tcttcaccaacctcgaccttcgacacgttcgcgtctttcattactgccatccagcgtgagatcatccagaccattgaggtaacttgcgccgtatgaaatggtctcacctcagaccacgtggtgggaagggaaagacatgttttgcgatctggtatcacaccaaggataggctgagagcattttttatgtcgtaatccttgttcctaagtgagccgtcctccctccttccctccgccccttggtcacctccatgatcatctcccccctgtcctttcctcctccctccgcatgacataactagacagaggacggaacagatgtcaaatttttatgtgatgaatgggagcgggacgggggacgaagccatggggctacctgcgtattggaagggggagcattcatcgagaaaggtgccgtcagcatatccatcattcagggaaagctttccgcggagagggctgcttcgatgagcgccaggtatgcccaatttctccgttcttagtccttgtctccttttccttttctatctccttcttgctttttgcatctcgatcttgcgctttctgtctcgtacaatccgcacatgggcccatttcaccacccgcctcgttctccctcgctcgctgccgcttccgcgaattcctccctgcctccttttcttcctccaggggccgggacctgggcgattgctcccaaggagatg

SEQ ID NO: 3468 - DNA, 703 bp, Nannochloropsis_gaditana
tcgatgataacaaccaccgaatgccaacaaaagcaaactgttcacgaaggggacaagcaggaggaggaggaaaaatagacacaagaaggggcgacgcagaagaaatgtgtatgatttacgctgaaaattcttgagctcattcctcagcgcttcttccaaggatgcctttaattcaagatgaggacgtaggagacaagagggaggaaggcaaaagcaatttaatttactcggaacattggaggcgagatcgcggaggaagcaaagaatgcatgaggctagatgcaggacgtaccagtttcccatccaaccaatggaacaccctcagcagtgtctccattgtcgacctgcggcatggaacgaatggtctatcagtgggagtgtatttattggacggcagaaatgcgttcccaagcccctaattttccagcgacgccagcgatggcagagacggcgaagccctcgcagctccctacgaagtgcggtacgacatcaagtaggcaggagaatgactgatcacaaatggcatcaattcgaatgtgtgtactgccaggggattttgtggcaggtgtgaggccttgcaccttccccgcttgtcttccattgaagcggaagtatttgccattgatccctcgttttttcagcaagtgttgaacaatttcggaacagatacatctccaccgggcacagtacgggctcacatatg

SEQ ID NO: 3469 - DNA, 703 bp, Nannochloropsis_gaditana
gggggggggcgcgcgaacggagaggtgtcagaggacgagggcgaggacatggagttggaggaagaagaagaagcgctgcccctccccccgcccccacgaccgccagtcccgcctccgcgcccggcggcgggggaagaaagagggccggggcaggaaggggaggaggatatggacctggacgagggcgagatcaaggtggtgtcctcctacaagccgcgcgtggcggccgggggcggagcggcgagaccggaggtgatgctggacccggtaaccggcaaggaagtcccgatcgcggacgtgggcgagcacatgcgcatccagttcttagaccctcggtggcgagacgagcagcggcgggctctggagaagaggaaggagtcggcgctagcagaggggggggacatcgcggccaacgtgcggagcttcgccaagaagaggacggacatcttcgggacctcggaggaggaggaacggcagatcctcgcggaccaggaacgtttccgagccagacaggaggagaatcagcgcatgatctggcaaggtggcacgggggggcaggggacgttagggccgggcagggcgccggggccgtctccagtggcctcctcagagccacgcccgggcttcccccagcaaaccaactccttcgcacagcctccagccccggcgccttcccaagctcgaggacccgtccccccggtat

SEQ ID NO: 3470 - DNA, 703 bp, Nannochloropsis_gaditana
atgcccactgcaacggagcgtacgccagttactgtatcatgccataagtcgatcacgtgcttggcacctgcaggactcagccacacccaagaccggtgcacttcgccttgcagaacattagttctcagcatcctccttttgatcacttgacgaggatcactgtgggagcttggaagacgtgaaacccataaaataaattgcgtgtatattcttaggggagcctatctttggtcatctgctgtaggttctcgagggacatgattaaccctccacgatattaaaacgtaaccagaaaattcaagatcattcccctctcagtgtttttatgcatacccttcggccaaaaatgttgttttctcgaacattttgcacggcagagatcctgctccttacctcacttcgccagtcttgttcggacttgaggtgctatgcgccgctgtctctgccctccctcaaccctctcagctgtagggttctggcaatctttcctcccggctcctaatgatagagaagatgtgatacgggaaggggcgcggtaagcatgtccgtagtccagtcctgggagggaggcaggcagggtagaagggagacagcccggccgtcgcccaggttgagaggctttcgccgaccccgaggctggtcgctcgcccgcggtctcacagcgcaatactttcacaatcctccacacagtaccacgagaatg

SEQ ID NO: 3471 - DNA, 703 bp, Nannochloropsis_gaditana
ctctttgctccatggcaaagtggcctggggcctgcgcatccacctcgcgtgcgaccaggacggcgatcccgtggacttcggcaatcgttacacttccattattatgggtcttccccgtattctcagagaactcgatctgcaggaggggtgcatgggaaatgagccagatcgttcacacattacgtagcgcaagtggatacgtttgaaaagctctgctcacatgtcgctgtcattcatccatgcgtggacatattcaatcatccggacttccaccgcagttgctgttttgttgggcgaagtgacggatgtcgagatattcgacaacaaaatatgtgttttagtaattttccgaaaattaaaacgactcttcatagaatatttgctgaattgatcaatgcttgtatctatttcatcccacagaatggtcggctcggtggagcttggggccaccaaatccagagcagccagtactggttccaccaacggagctcagcgggaaggccacgggttcaaatcattactggaggcttgcaataggatacaagagaaacaatctaacaaaataagtagcactacaaattgtccatctacatcatcttgtgggctgccggccgatggcaaagtcgagacaacatccgcttccaagaacccagatggtcccaagggagaattttaccacccgcttgagaaattctcacggatg

SEQ ID NO: 3472 - DNA, 703 bp, Nannochloropsis_gaditana
gaggggaaggtcgacgccatcatattcctcggtggacggagaagccttatataggagagagaatgaccggtgataagggaccgaagagcgttcataggaatcgcaattgctatgccctccagtgtccaggatccacgaagaagtcattgtatgtttcggtaccatttgatcgagtctccgccccttatgcccctcccttgtagtgattagtccgaagcaaaatgtagaaactcgcttcaattttcctatgatattctgctattgggttgattgggagcatatgggtgggcgggtcgcgccgcttgagccatgacgccttaatatgcacctcatcgcttcactgtcttaggacgtccgttgtccctggacttcgggtcatcgggccccgccatctgcgctccgtcgaaagtgcagccgcgtatgcctgagagagcggttgttcggaaaaaaatcgtgagtttgggcaagaatgcttttgagttgggccatttcaagccagctggcgattcttcagccagggggaaaggtgtccttgtaggggagggaggttaatattgcaaagacggcgcaggccttaatatttacagacggcatcaaacatcaatcacacaggcgcatgatggcttgtggataattgctacattcctggagaggagaatttcagcaacggcttgtcttcccgagctcttacagttctatcatg

SEQ ID NO: 3473 - DNA, 703 bp, Nannochloropsis_gaditana
aaattccggagcttgagtgcatagagggacaactgagggagtccggatacgaaagcagagtgtcgttttcatcgtggggtggactgtaaggcccccaccccttgtcaacaacacgcgaccagcatatgacttctgctaagattccacaaacttgcacgctgtccattgcacgagacgatgacactattgagagccttgtccactcatgcaagggaaaaacagagtggctcgatcccgactcccaggagccacacaaagccctccatcgggcccctggcactggccgcaggccatgcccgttgcttttctgcctttgttctcactgattgtctgcactctgatatcaagtcacggctgacatacctttcccgcaatttctaaccgttgggcgcggcattcgtgaatccgtgtgcacgatcacgcagtgttttgctcttggacttggtatttctccttactgcgtaagccaccttcctcagcaggctcctccatcgattgacctcaagtcggaggagcatctatgtggaaatgaatgcaaaactgacccttcctccacgctttatacagtatataacttcaaactggttggttgcgcttggctttggtaggtagcgtcaggccgaacacagtcaaggaatatactttcaccatttacctcctcgcccctctagcggaccccaacgagtttgcgttttaatccatg

SEQ ID NO: 3474 - DNA, 703 bp, Nannochloropsis_gaditana
acgtcacttcaacgtcacgcaatcgcgagcactgtctttgccaggctcatgcgcatatcatgtcttcgctcaggttttacatggccatacattttattaaatgcactacatgttgacttgatcggtagcaccatgtcttctgttccctgcctcctttgcgtccgccgggctcctcagtacgaccggcaaagctgcaacagcggaatcggagcaacaagtggcagcaacgcgaagaataagagatgtgacgaccaaaaaagcaatagcacacataattggggcctatttctgacagatgacgtgatagaagggcagatcgtataccgagggagctaccagcttgtaaatggtacgaagggagagaacgaggcgaaatcatacactctacattcttatgttaatttttcttccgttatctatttcctccatactataataagcgtcttcatttaatttcccatctatcatcgcggttgatggacatttctacccctattcatatgaccggcacaccacccgccttccctcaatcgctggatcgtccaaatggtgtttttttcatccttcccgcggcgctctaatgaatcactcatgcagaccttcaacggtcattaaaaaagtcgataacatagaagtagaaggtacagaaaagaccagaaaaagcaggaaaaggaggggaaaggacgacataggtgaagcgatg

SEQ ID NO: 3475 - DNA, 703 bp, Nannochloropsis_gaditana
acgcaaccgggagcgttttagcagaactgtcttcctctctgaccgcagtgtaggacattttgatggtcattcgcaacgaatggtcgggcgaatctcggagatgaacttgtggcttcgtacgacgcaacctttttacctctccatctggtgtctcgtcaccgaaagggaaatcgtaggctcggacatattaagcaggtgcccggcaggttgatggaatgtccgtgggactctgaagtgtcaaggccgcagtgcacaaattctgcctcgtgcttcttgcgtgtttgtcatgtgtaaccaacgtgatgttgtagtgtttctaatctgcacgctctcagtcgccggatgcgcttgagcctgacatccacgtgccaccggcgtcctttctcgcttcccactagccaccagaaggtttgctatcctgtattcattatatctttcctccccatgcacagctgcaactaagatctccacaagagaggcttagtcgtcttcaattaaccgactgatcccccgctatatccggaggccaccgtccaagccctttagaaagctggcagcctccctctccttcgtgccacagcaactcttcgttgttgctgccatcacgcacccaccatagtattacatcaattgagcgcctcgatgcgcattcttgccagagagtctcttggccttaacgacaaaatcaaccttttcaaccatg

SEQ ID NO: 3476 - DNA, 703 bp, Nannochloropsis_gaditana
ttttcttcctcgggggagagtcagcaaaggtttgcaattccctgcgctcgggccatctatctgtctcgcgacgggaaattcggacgggcgcgctccctgtgtccacaatttgtggcaccccccctttttcgttcctgcgtcaagtgatgccatggatgtgcccctggtgcacacgagtgcgtcatggcgtggtccgtcatggagggatgtgcggtcgaagggggagttggaacagtttttggtgtcctccgggagcttaaggcttaccttcctttctacgcctgtgggttcccgaaaggcggcagcctaagtggcaaggggaacccctcggacccttgttgcccagcaggcatgttgcacacgtgtgcaggaacatggtcgtggcctgctgtgacgggcggtgtggtgcatttgccatggcgtgaagacagctgcgtgtcctctgacacctcgaagggcccgccttcggtgtcctcgattcactgcacaggcgcccctgacttgttccagcggcgatccatacaatgctctccactcacaaatatatttattgacgcttacacttgcctatcccaatcgacaggactttgattttgttgtcggtttcggcctcccagagaatggcaagcagttcgcggcaatagcacctgctctgtctgagctctctgcacaatcttgaagcaaagaaccgcaccagagcatg

SEQ ID NO: 3477 - DNA, 703 bp, Nannochloropsis_gaditana
cccgtggacgcgtgctcgtcaatagacccatatatggagggggatgctgctgctggggctgttcttggtcttgttctagacatgtgcaactttagaaaagcttgcacgcgggtggttgcgtcctgtacgtggtttatttgaaaccagtaataatcctgaagcagggcgcgtacgacttccacaagtcgatgttcccgggcacagtcgcttaaattcaaaaagagggaggggagatatggcctggttctgagtgatgaaagtcgctactacctctctgtggtacgaactcagagtgtgcacgcctagagtcaaaccacatcaatggtgagtgagagacgtacgctgctcgatccgatagacatccctattcaactccgttaaaaaaatcaagtcgtccgccatctgcgtgggttgcggtcacttctacatttccaagacttctaagggcacgccttaagcggcggggaatgcccttgagacaaagcgcgtgaaaatattgtgtatcaaagtgctggcagactcacctcccgaccccgcccccctccgactcggagtcgccgccgtgggcgaccggcctcgctcttccgcatgaaaacccccacatggaatacacccccgtgccaagccgaggagttgagcggggattatgcatgtacaaggtttggacaagttcgttgacctcgtcgtcttttctgtttagggg

SEQ ID NO: 3478 - DNA, 703 bp, Nannochloropsis_gaditana; identical to SEQ ID NO: 665

SEQ ID NO: 3479 - DNA, 703 bp, Nannochloropsis_gaditana
atcccccccccccccaatctgtaaatactacatttgcttgttcattcggccatccgcatttcttctgtgcctgttaacattttttatacattcctcttacgccttgcgacatatcatcatctctctttgatgtacgaggtcgagagacctcaggcgaatgcggcgctggaggccaaaatatgatgcccggaatagttacagcacatcaagtcatccacatgtttttaaaatacgttgaaaagccatagaacatgcgtagaagctccagctctcatttgattgtgcgcaaggacggccagccctttttgtatgtggggcaagagacagcaaaagcgtcacgtcacgcacgttggagagagtgttctcgatacttccatggaacaatgtgtttttgtaggatggcatttgtatgacgacgaagtgaccaggtgtctggacaattgcacgatctttctgtgtgtagtatacagcgccatgtttggggatttagcagtcatttccgtcttgacttctttccaaactcataccaagcctcaccgatttttccttgaaaatcgtctcgcacgccgcagtctcatgaccacaagccgcagcaatgaggagtgggtcctggcgtcctaccccgaaggtgtgcccacgcctgacaacttccgtaaacaaatctgcccgatgcccgtgcccggtccttcgcaagtgctggtca

SEQ ID NO: 3480 - DNA, 703 bp, Nannochloropsis_gaditana
  misc_feature (1)..(561): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcttgcctggtctctagctaccctctcccaccccgacggcgacctcctccccgtcataaactccttcattctagaaatgggcctgggggtgctctcccttcctgagctcgcgacgatgacttgggcgttggcaaccatg

SEQ ID NO: 3481 - DNA, 703 bp, Nannochloropsis_gaditana
ccccaccctcatcttcccttcctctcggtacattcccgctgcaaaatacaccatgacaaagcgagttcaacctacacgacagcatccttgcgtcacgcctctcctccctgcggcctgtccctttgcttctcttgcgggcactagtttttgtcaaaggcgtgaagcatggcaatcaaagggcgttaaagatactcgggcgagggcgagatgttgcctctagacgtgtcgagtggctccaggcttttgggatctccttcggtccgaatcacctgcctgggcccgatcgcatgcctggatagtcatatgaggatgtgcatgctttttgctgttgagatcagaggggagccactcttctcgagtaccgttgacgacgaatttggaggtggccattcatcccacctccgagctagccaagccggccctggtcgccttgcccccctttcaagtcagacatggccttcttgtctcatataaatccgacaaccagaggataatatcataatttggaggcattgcacgtctagatgtgtcaagtgtcgatgcggagggcggcgttagcctggggtctatgcctgtgtctgcgaccgttcttgtgtatcaagttcagctacgcatgtgcgctaatggcatgccactcctctctcaacgtcttgtctcatctataaatctttcccccccactgaatgaagtgcgtttaaaaatg

SEQ ID NO: 3482 - DNA, 703 bp, Nannochloropsis_gaditana
agggactgcagagtggcccgagaatgccgagataggaccggacaacacgatatagatagacccacacaaccgacatcacttgcggagttcttcttcggagcccggagaaaaatggccatttttctctgacgaagtgtaagaaggtgaaggtgggtggaaatgggtgggagcatgggagcacagcagaagcgggcaaatttaacgcaaaaggatgccaaccaagggcgcccggcgtcgagcccaaatacagatttaattcgatcgatcttgtagttttacgattttcggctagtctaccgtgttctgaggttagggttagggttatatttgtatatatatatatagtacggttttcatttctggcgatcgtgtgctccgggtctagttgtgttcactgcaccgggggcctctcggggccttaaaaaccatacacagtccctttaaaaaaatatcctccctcacaagcgacaaacgtcgtgccagcgagccttgggcttggcacctgctcatgccctttgcagctctttaaaatgagccggcccacagcgtgagaacggggattttaccctgtgtgtgtatgatggtagacttgaaagtcatgaagtcaacctcctcctagtaggagtagctactgcatcctcgcatcaagtaatctcttctttcatccttatccgtctcgacactgaacagacaggcttgaatg

SEQ ID NO: 3483 - DNA, 703 bp, Nannochloropsis_gaditana
  misc_feature (1)..(407): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggcggcgcatttgaggcgggaattccgcatctgcctccggaagatcttggcggagctcaagaaagacaaacggtgagtgctccggtacctctcctttcccttctctcccccgcctccccgcccctcgtacctcctccttgactatgcggctcggatccaattcctccgaccctgtttccttgcctcctttccttccctctattttccttccctctatcccccctcccttcgcgcctcaccctcctcgtccctcccatccctccgcccttccctccacaccaggtactcgtatt

SEQ ID NO: 3484 - DNA, 703 bp, Nannochloropsis_gaditana
ggatgcgcccgctttgttgtccaaggagccggggagaggtttatttcgcacggtcattggttgcggggggagggggtagacgatcacgtccacgccgaccgttggaacatattgtaagccgtgcaagggttcattgaaaaagcgacgaatgaagcttgttttgccaaccgcggctccgcccacaaggagaattttttgagtaacttcgagctgaacgggaggaagtggattcataagggccaaggaggggcgcagacgggccaaaagctcagtgtccgcagaccatgtgtatataatccatttaaaaagtgctgtttttgatagatgcattggaaaaatgagggtttcgtggcattcaaagggaagggaaccggaccaggaggtgggctgaaagtgaactccaggaacattaaaacatcgtatgcaacacgacgattactttcctgtctcctaaccaccacaagtgcctgtataaatgctccgtacatatgtatccgtccgtcgcacacccttcccaggcctcgcggagtgacttccatgcaagcaggggcctgtctggccgcctgggagggtctcgctaagaaaggaaagcctcgccagcccattccatgcacatttcaacctcgacctcttctaacaagaacaccccattcacacgctcattatcccctccataccctcttatacagcaggacagtccatg

SEQ ID NO: 3485 - DNA, 703 bp, Nannochloropsis_gaditana
cggacaatgtgctcaagtgcaccccgcggggttctgagccccgaatctttcagaaagtttcggggcaaccgtttaaaaaccgtttaaaccgtcgaatgactggacccgaggcatgacgagcatcacgcaacgaggatgcggcgctttcctgtggcctttattccccccctgctcacatagactatggaacggagtgaaggtgctggatggaccatgcagtttgaaaataaagtgtgccgatgtattcacgggagattcatcttcctgtccttgcctgcgggttggccgtcagcacagatcgcgaaatcgaacatggagcgattgcggactttgtgtgcttcgcttctcctggttgcggtcctaccggctgtgtttggcccaatggagggcgaagggcgagacggcagagcaacgatgtagtggcggagttgtggtgcatcatttgcaagaagccggaatactagcctctcaagccttacattcgagaccgaggaaagatttgtgggggaaaagtgccttcaccgcttttggttatgtttcgtgctgtgtgtggtggcgaggcatgtttcgtcccttcgcctcgcatgtcacgctcctcatttgtcttttatattacgacgactgacacgatcaccattttacgcacaggagtgctcctttcgtgtatagctagcttcataaaggcattccaatcgcagaaatg

SEQ ID NO: 3486 - DNA, 703 bp, Nannochloropsis_gaditana
ggatctcgcacggagagtaagctgagcgtcctttttccctacgtctctctcctggaggcgatctccgcagagggactcattattttctgtctttctgtctccatagcagagaaaaatctttgatttggacgggtcccaaggctccgttatccttttatctgactagtcctcgagaatccctcttaactatcctcaacaagacactcagcagctctcaaaagcccgggatgaaaacgtaaggtttagggctgtggattttaacgcactattctctagtgtatcgatcaagcattgttctctagtggatcgatcaagttgatatataaacacccaatacctctttcggacactgcgcgtttcaaaactaatttcactaatcttgacttgtattctttgtcgattaatctgaacaggccgatgatccgtaatcgattgaattggattctaggcttatttctgctagtatcagtatcacaaacgcaagaaatttcccctgtgatccagtgcaacacggggtgggagattacccccgctactctgataggagtttttccaaacggtgaacttaatggcgccctggtgcctgcaagtaattcttcttccaatactgttttttatgtggatggatggaatatcttcaatgagcgagttcaactgaatggaatatccactgtgggaggacaaccgacaccgaacgataata

SEQ ID NO: 3487 - DNA, 703 bp, Nannochloropsis_gaditana
ctctgggagagggtttcttcactttctgcctcttctgcagggtccgtcacggactctgttgatggagttgagtcagcattactaccctcacttgcgtcagtgccgaaagaatttgctgaagctgcctccaatgcccctcctcggacgttgaggagcaaggggaggaggcaaggtcgtctgaattgtggagacaaaggtctggtcgtggggatgaaaccacatcccccaggggatattgagggggagcatattgctgtggtacttcctgaggtgacagaagccaaagacatgcacgggatagagagggagagacaggtagaggaggtggtggcgaaggcagggggacttgacctccccagcccagggagatggccaatcatgcaaaaccgaaacaccaggcccttaattttccctttgctccaccggaaaggtggatgcctccgttccattcctcctgggcctgcctgtgtcgataatgcgcaaagtatattgggtgtgtgaacatgttgccccacatcacgggtttggacaagtccgtttgctgcacggagttggagaccatcgcccgagcctcgtgtccttcaagactgagactaaacgccgatttccccatgatttcgacacgaattgtgcgcatacgtacaggtggtgtggagtttgtcttcctcctgccagcttggacgcattgtgaagggcccaaatg

SEQ ID NO: 3488 - DNA, 703 bp, Nannochloropsis_gaditana
aggtatgcgcgcggattaacagtagctttcccagtcggcgacgtgctcgagtgtgacaaccgctaccagagtcagagtagtagaggcgcagattcttacgctacaagcgcgtacatttttggcaatgtttttaatcctagggatttcgaaaggaagatccgcccggcttgtgagactggaggtagcaaaatcaaaaggcgggcttcgaccccgccagacaggataaagcaagccgcttcaagcgccgcgctgatgcctataaacaatatgaagtaacgtacatcgcccgtcattttcgacaggtacaaaaagaatggtaagaagcttgtccatagccctgtccgggctcttccttctctttgctaccacctgcagcgccttttcacctccctcccagcatgcgtctccgtccacacgggcacccgcccctaccacttctaccccgcctcccatggccatggaaagtgtcggaagggctggggcggtgtttggacagctcggtggtgcgttggcagcgttgggggtgctgggtttgccgtctcttccagccggtacgtgaaatatatgccggggtcgatggaggaacggtaggaggcatgtcgtcgcaccgtccatcgacctgctctctcgtcacttttgccatgtttcttacctcgtgacccctggtttcccagtggcggccccgcgtcagctggagtacatg

SEQ ID NO: 3489 - DNA, 703 bp, Nannochloropsis_gaditana
cagagttggatgcaaaagacagagctcggttgttttgtacagctcatcaacggccgttgcctcccggcttttgacaagtagatgcgtagaattgtgaatttgcatgaaccatccaaaggaaaaagatgccgcaaagtacgagccaacctatttctaattcgggatacgaatgctatgcatcattatttgctatcaaccttctcccagacataaatattgaaatgaggctgctgcagaacataaaacatgcgtatcaaagtatgccaaatcacatgacgtaatcaaaaattaaaaaataaaattaggaaatcaaatgtgtaggaatggagagtaatgccaggtagagtacaagtgttgccaaatcctcagttttccgaaggagcatgtcgccatacttcaagttcggtatctcgtctcccaacggtttcgagcttcacccggtcatggtatcgatttgtggtcgtgtacactgcatgataatccgcgcacaggtctctggcaagtttcaggcgtcctgagatctagtgatatggtgctgctttcgggatcctgcgggatagaaaaacctttttagtgaggattcccagagaggaatctcctctcagcctccccaccgaattcaaactaccgcctcctaattttctatacttcgcactgtgtatttccttgtcataacaggcgtagtggagggatagacgagatg

SEQ ID NO: 3490 - DNA, 703 bp, Nannochloropsis_gaditana
ttgcgtctgttacttcccctctcgtctaggggggcccgggaaggtgggtggggaaagaaattaggtgatgcgagcatgcttctgcaagcgaccgagcgaaaaccatattcaaagcccagtctatccaggactgcccgctcagcgcagaaggcgcacgtgccccatgggcacggcgggcgtgagaaaagagcaagctgggggaggggcggggagacgcgaagggggaggatcggttcgtctgccttttccggctcgagtgaaaacgcctggtttggggcccgcctctgtggcgtgcgcgcgggatttggcatactttctatgcctgcatgagttgatggcacacatttgagcgcttgaacggatgttctgggcctcgttgttaccgtaaaggctaaaggagtactgcgggtggtcaggggccctgctcatcatcatgcgcaaagggtcgttcatggccttggaccacagccatcctgtgctttgatttctcccgtcccgttgtcttcttgcacaagctcctctcagccctgattattttttattcacagggcacttgccccgtttgccttcaggttgccttgttcagtgcggttgcaacgtgggcaagagtatcgaaggccgaggccctgcttgtcagcgccccttcctctttgagacagtctctttacgcattccgcgataagacggtgtagagcggacaatg

SEQ ID NO: 3491 - DNA, 703 bp, Nannochloropsis_gaditana
  misc_feature (159)..(699): n is a, c, g, or t
ggaggagggaaggataaggggggggaggaagaaagaggcggtcgggtttgttttcacggatcgctcttctatggggagaagggaggtagaaggagcgggagggagggaggaggaggaagaagacgaggaggaggaggagaaggaggaagaggaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgg

SEQ ID NO: 3492 - DNA, 703 bp, Nannochloropsis_gaditana
ggtaatcccggggccgctgtcagtggcctctacatactcgtcggaccgttaatattcaaaaagccgttgaatatcgtgaaagagatctcggacacttgtcagcgcgccattttgataggctttcagcttttcctttcgtgtaatttgctcgatggcacatgctgacgcagatttatattttaatcatcagggatcctgcatagcacttcagaacttcgcgaattccgatatagcatggaaggctaacctccgacggttggacaaaaagtaagtcaagacctacgggcaactaagtaatccaaaattttctgcaaagccatggaaaaggaaggtacgagtccgaatatatcgtatgtcgtacaatgcttgccctcggccacggggcttcctcttctttagagaaatgtgctcatgtactaagtgtaataatggattgtggagtgaacttgtctgtagggcctcaaatcaggccttggccattgtgctatggtacatgatttgaaaggagacttcacgtgtcatagtatgatttatttacccccaacttgacgcgcagattttctttccggcgacgatcgcttcttgtcactgcacttggatgcgaagaagagggaatttaaagctgctggaaggcgagaaatggaacgcgcttatgagaaaagaagctatttcaaacctgtaattaccccaaaagctgctagca

SEQ ID NO: 3493 - DNA, 703 bp, Nannochloropsis_gaditana
ggagacctcaatcctgccgaaattggtcttttctgaagcaaattctagaaaacagacagacgttacagctggctccgtgatattagggaaaatggggtcgctcacttctacttggtcatacggggcagaaagggtgggggacgtgcttgcggcagtagtcaaaagcagcacggttgttgctgcctttttgaacacatggcgtcgatcgtcacctcttctagcgggcgctgcgcttaaacttatgtccctcctctgtttaagtgggttgggtaaacatacaaatggtgtcctggtgtgctttttacttctggtacactccccggtccgaccccgtcgactgcccagcactcttcatctctcacctgtcttggcccttgcacagttcctaagaaaccctgaattaccaagctggccatcagaagcattgttatgcatagacagctttgcgttggtcgcatctctgtttccaaggagggtttccagcgtgtcaaaaaatggggcagaacggtcaagcggcctcgccaacgacaaaatcgcttgtagacgcgaggtcgagacccgttcagtctaaaaggcatcagtcaatgcacgtttgacaatcattgccgagaaatttacgcaagggcacgctccttctcctccagaaaatatgcagtcccgaggacgggttcgcgtccttctactggtgatgcttttcaccatg

SEQ ID NO: 3494 - DNA, 703 bp, Nannochloropsis_gaditana
aaagccctatgtgagcatctaaggtgctctgaacgtttgcatcctctacggtccactccggcaggagaacagcagccaagcccaaaccccaagccagagtggcaatgatgaaagttgccaaaaagacgcgtttggcagtaatttgtttaagtcttgagttaggagacagccacgatggcgagcaggttgacaggtgctgggaaggtcgcggcatgagcgcacctgcgagaggtttatgtggaagcaaagcccgggctgcttgtactagaggaaatgcaatgacagggaatttttcagctaagcaaaaactgtcgtgaatccggagaaattcagacaagtaattatatgtcaagatttgagtttggattgctcagaaaatatggacattatgttgggggtatgcgtaggcaaccttggaagagcttgaaaatttgaaccgcccgctctcgccgaccgagccgttaatttggcggttttaaccaacacatttgactttggtctcggttgccgtttcaccgagcacgatcgatgaggctctattttaggtcatatcctcggtcctgaatgccttttccccatgcgtgacaccggcaatctacataataaagactgaatctgactgaccgtctcgtatttcatactcgtatcacggtaggaaagacttgtgcgcctctgcatatcttcaagaactttaaaacccatg

SEQ ID NO: 3495 - DNA, 703 bp, Nannochloropsis_gaditana
gaatcctccaggatttcttctaatcttagtgtttgcatatcccgattgtgtcatacttgctaaaatcatgtcgctttgctgccgtgtcgaaaaagtatgtggatcgttgcagtgcagggaatacgtggaagcaaccagcagttaaatcaccctgcagagtaatttcggcggtcgttaccttttcaggcatggtcatctaacatctctttattttaattattcataagctgccttgaataaatttgcacgaattaggctgtgttaggatctgaggacgtgaaattatttcgaaccagcaagtccttgtgctgaaggccatccaatctttcatgcttcactcatacaagcacattctcaacgacaccacaagacagactttaagtcacacttcagatatgagcgccatcaagaaccacaatgtttttgccaccaaccatcaatctttcggcgcccccacccgggcaactgacattgtggagatggaaagtctcatgtcgctcgaccagccgtttgaatcgaaggtcatgccgcgatgggagcgtaagaagctacaaaagcttggctctgcggccggcgcgggcttggacggtgacaagacaggcagccacgaccggtttatccccaaccgttcgggtatgcacatggacaaggcgcactacgcgctctccaaggagaacccaaacccacagggcgacgacgacaa

SEQ ID NO: 3496 - DNA, 703 bp, Nannochloropsis_gaditana
cccgggcaactgacattgtggagatggaaagtctcatgtcgctcgaccagccgtttgaatcgaaggtcatgccgcgatgggagcgtaagaagctacaaaagcttggctctgcggccggcgcgggcttggacggtgacaagacaggcagccacgaccggtttatccccaaccgttcgggtatgcacatggacaaggcgcactacgcgctctccaaggagaacccaaacccacagggcgacgacgacaagaaggacgactcggcctccttggtcgaggacagggccatgggggaggacggcatggagaaggtttccaagcaggaggcgtcaatggtgcagaagaaggagtaccatcaagccctggaggcacagcttttggacggggaaaaagagcaccgcgtcctggccttccgaaacaaggcacccttaccaaaggagggtttccagaaccacttacaagtactctacactcagaacaagggcactgcgcccagcagccttcgcagctaccggcatatcccctccgcgcccgaacggatcctggacgccccagacctgctggacgattactatctgaacatcatggactggggtgcctccaacgtcctagccattgccctgactcagacgctgtatttgtggaacgccgccacgggggatatcaccgagctgatgtccgtacctgacgcggacgactacatcac

SEQ ID NO: 3497 - DNA, 703 bp, Nannochloropsis_gaditana
ctcggtatcgtttccggtcgggcccaccgtaacctcttcctcctcctccgctgcctggcggtggcccgtagttcccggccgcatggtaactcatctcacgggcctggcttagagtttggtagacgtatgcatggacaaaaagtgagacgtggtgggatgaatgaccgacctggatggtggcacagaatgccattagttgttgcatgcgggcaacaagctggctactccaacacccgaagccagccttgcttcccgtccccctccatctccaccaagactcgcccatcctcgtgaggacaccattgaacccccctcaattcggaaatggtaacgtagggcacgcaaagaaatcgagggtgttggagacggtggaggtggcgggtctgggagggataggaggccatcgcgtcacggaaggtggacactcgttcagagagggaggctgcagcgatgaggtctcgcctctttttcctgctgcatggaagcaacgagcaccggactggaaagggtagaggaacctgcgggtactgcgcacacagcctaccctcctcaagcttctttttattgcacacttgcaggtaagctggttgtcttctcaagtggacacgcatttttgcctgcaggaggtattgttctggcaactcatcactcttgaggaagaacgataaatttttgtcaagaaaataaaaccagtttggcaatg

SEQ ID NO: 3498 - DNA, 703 bp, Nannochloropsis_gaditana
tcattttttatagctattcgcgcacaagtatgccgcctgattatcatgtgatgtcggaacttgagggtacatgacaatgaagctagcctggcggacagctcaacaagttccagagtaaagcctttcctgagcgagttgcggcgaagcagctccgagccgtcacggtagaagagaacctcctgcccctcgcttattcccaaaaattgagttatcaatttttgtcgagtcactgcgttgacagcaggacactgagacagtcatgtttcatttttttttaatctggataacgatgtatctgtgagaacctcttgtggtttcaaattatcgaacacatttttaactttttcacggtaggcccatgctttacgcgacgtgggggaatttcttggcttacatttcgacgaatgacagtatcattatactagccgtcaaagatggtgttgagagtccggaaacaatctttacgttgcccaatgtaaatcaagggtcgtgcgagagagattctttcgcgtctgcattaccacgtctctcactcctagctgttggcggacgtcacgtagctgtctgtcaggaagctcagagcgaaaggatatcattttactctttcgaacaaaaaggagcatcaaataaagattcttttaagataagttatcctgcgaatgtactgcaaatctgcctgaatgaccaatacgcggcagtacgc

SEQ ID NO: 3499 - DNA, 703 bp, Nannochloropsis_gaditana
tcaagatgccccgcagatcggccgcacgaaaaggaaaaatacgtacactagtcgaaaagatattttcaaattggagcgatggtttgataccggtacggcttactctttaataagctgcttcaattaggttgaaaaatttcctctctttttcatgtaacgcaacgtatcacgcgcaacaaaacagtctatcagacacccgagacgcatttttcgggaattgccatgacagatcatttcctatttctttacgatcatgattgtggaaaggtacgccttcctctgtctttttgtcaatcgtcgtcctcgcactcacttcaatcctttccttaaaactatatattcgtagatacaccttttttcactgcacgcatgggatttcgtgtcgactacagctgtccaacccctttttccgtccatcaaaagatttttcccgaacaacttgggtacacgtgtactgatatgtgaccgtagggaagtgtgctatttatacaatcccgcagcgtacactgcggactgcttatttcttcgtcttcccgactttcccacgggtataaaagtgtctcaagttgtctgggattcagtcgatcgtgacattttgcacatattggatgagacgagttacctccacacgtatgtgtacttggcggttagcatagcgggtccgagtcttgtaaaggtaggtcatctcgagatttctaaagaa

SEQ ID NO: 3500 - DNA, 703 bp, Nannochloropsis_gaditana
caggccacgtggcgtccctatttggtcggtattcacacgctgaaaagctattcttggcctcgtcgcgcccagcagctgccgtggatttgcatcgagacctgctgcaatttcgacaagcattagaattggctcactctgtcgccccacaagatgttggtgcagtggccttggaatatgcagagcagctcgaaatgcaacagggggactatgagggggcccttcgtatttatgaaagagcagaaaaatggcttgctaatggctcaataacatgtcatcagtctctcatgaaatgtaaaattggaagtacccgatgcacactacgtattggccatgtaaaaaaagggatggacatggtgctatcattcacagatgaaaaaaacagaaaatacggcatgactgatggcagcgatcaatccgtaaaaaacttcatgtgcgagtgcgcacgtatcctggagagtacgaaagctactaagattgacgcagcagcgttatacctgcgtgcgggaaagaaaaggcgtgctgcttgtatttatattgaagaaaaggacttcgctcatgcggctccgcttgtggaagagcttaatgctcaaaagctgcatggcttgtatgcgaaagcatgcgaagaagacgggaaggacgcaaccgcaatccttgcttacgaaaaagcaggcgatcgtgacaacgtcattcgattatgtctgct

SEQ ID NO: 3501 - DNA, 703 bp, Nannochloropsis_gaditana
cggtagttaatagggcacattgatccgaaattgtagcgtttaggggggttcagatttttaaaaaggcccattcccttctgggaggatgcgacgacgccgctgtcgctgcagcccttccctaaagacctgccgcggacgcaccaggcctcacgcagatcaactacccctgcgtgtacatggactcctgccgctttttacatcgaatttgagtcagattttctccctgtgtcgtgccacctcgggcgcgcagtgcgtgttctttatcgcttttgtgtcccagcgattccctctcacacagaccttgctcgtgcctattacaagacgcgcgcggcagatgcacggagtgcatccgactcgtcgctgcagtctcgtagtgtctttgatacccgtgcattccactgattcgcgaactgatgagatttgttttgcgcatcctgttgtctaaagcttgtcttgccttgtccgcctgtcgcgacgtcgagctgtctgccaagcgagtgattgttttcctactcttcattcataaatcttatgtctgaaattaattacataacatttgctcgatcctgggtgaatgacgtgcccctacatcctattctcgcattgatccaatcttctactatctcttcagatcggctcccatcccgcgttgctcctaccgacaaaaacaacgactgcccgcacgcggacgaacatgccaatg

SEQ ID NO: 3502 - DNA, 703 bp, Nannochloropsis_gaditana
tttgagtctgctgtccagcgccctgatctatgttgagttgcccgcagatcctccgaattcgaccgagccgaggaaatctgtcacgcttgtctaaaatggtaacggctcgcgactggcccataacaaaacctgtcgtatgcagtgggacaaccataatgcaaaattgggcaaacccacctccatgacacaatgcacatcgtaattgaatgattctattctatgatgataggattagggatagaatactgtcgcctattggaaatctgcatatgaaaccaattcaaggccaagtcatattttctttaattgacacgggttttctgtttaaattacttccagacagcaatcaaacaacatcccactgacatcatgagggttgcagtcaccctgtttgcaacagcgattgtgttatcggctcctgtgtctcgagccttcatctcgtccaacgtgacaaattcgaacgatttagctgccggccagaaaatctgcaagcccagggttttgaagaactttttgaagtgtgcgtacgtccaaaagggggactcagccacatggcccgatctctcttcttgcgaatccgtattgggggactgtcgtgggtgggtataccacggcgtaaatgttgacgagttagtcggcaggtcctacctcagtgccgcgggtgtctccaggaaagcgaactttctcggttactacgcatatg

SEQ ID NO: 3503 - DNA, 703 bp, Nannochloropsis_gaditana
ctcctgatgaccgttccgaccgcggctgtcggttcggcccagctggagatgaagaagatgatgatgatgagtgtgatggaaaaggtaccctttacgcaagtcccttgccctcccaacactctccagctccttccgctccctcccacgcttcactaagaactcgtcggttcatggcacgtatgagggaatcgacatgcattaccacttaattgtcgtcaagtatagagtttttggaagggggggggtcccagaaagtgattaagcagatggagctcgctaccctagcgtaggaagttctcccgtggagagactacaaagaagctctcatgatgacgctgggctcgcttttaggcccctgcgacgacgaatcataaagcctgtgatgccctggaattcatggctctctgtactttggttgtggagccacaccttgtgatattgctcgcaacgtgaattgctccgttaggtatcgttacaagcagatgctgttagcgaggacctagaacccttcagtggatggaatcgaaatgggagaccatgatgccccgtcacggactcattttctttacaatgcggctcatctactcgttgagaagctcctgctgacataaaggcgcattactcatatgaccctccacattttgtagggtgtttgagcacgcacaacgcaagcaggcgcgggagcaccatcggaggggacatg

SEQ ID NO: 3504 - DNA, 703 bp, Nannochloropsis_gaditana
aaatgaagcaacgagattcaattaaagcatctttctcttttacaagtttcgatacatttattctaaaacaattattttggtacgcatttgtgaggtgtgatgtgtaatggaagtataacaggtttaacgggctcatgattgtagctgctaccagttccgcatacttggcggcgtcttagaagctcttaggcatacagaaacatgtgaattcatatcaaatctaaatttgtactgttttccttacttcgattgtaccttcgcatgtccaaaaggagagcgtttttgtgtcgtatttgaagtttcttctcgtagtggtcatggtcacggccgcatcgcccgcccggccgccttgaagcttggcgacaagactagtgagcaacctcaggacatggagaggggagaaacatgccatatatgtaatgtttacatcgggaaagtatctctacttgtgcgaggtgcgttgacgtctcctcaacgaccttgaaatatacatggttgattcaaaagatgcctcccgccccgatttctttctcctcaaaacgttatgttcacattagggcctggcaggtcgaaagggatggcgtttgcccttaagaagcgtcggacatgcaacgtcgacgatcgcgttgcttcagaagcatgcgtgctggcattttcgaccccacgcgtctcgcgctgccgcttggcttgtcgaggcaggatg

SEQ ID NO: 3505 - DNA, 703 bp, Nannochloropsis_gaditana
acgcatacgaagtcatctacctcgcggccctcccttcctgggtgcacgcctccgtaatttttctctgacctttgtcattcgaggcttcaataccacctcaatcctacagcaacatttgatgcatgcatagtatcggtgtagacctgataataaattctccaaagctccgtggtctgtattgccaggaaaccgcttctccgccaccttcccgatcctaagccgatccgatcctttcagcgacagaacagcgaagcgactcggaaacatggaaaacccataaggcatgaaaaccatggcacttgttgttcccgacacatccacgcaaagccgtgttatgttgtatgatgtacgcacggcctggatggcatgtgctctgcgtcacgagggtattcgtattgcggcgttttacgcttggaagggtggtacgtggggatgctgacgttctttggtatccagcgcagccacgtccccgccccattcgagtcctaccgcaacttatactcagcaaccctcccgacacaaatgcgggagcgcttcagtccctcccaaccttttatcatcaaagatgcgtgagtaaggctcgtttactggtgttcctgatggatacgagatcgatgaccgagtaatgatcatcctaagtgctgctgcccctacctatatgccctcatcgcccctaaaccacatgacagagccaaccaagatg

SEQ ID NO: 3506 - DNA, 703 bp, Nannochloropsis_gaditana
gcgggagatggggcaaacgctgcaacgcagctttctcgtctttccctcgtatgcaaccatctctgcatcgcaaacaagcaccatgcctgtgtcttgattgcagggttgaatcgacacaggcatttttactttgcgtctcgtgcacttcgtttccgcctcgtaactgccagggaacgcacacgtccaagcccgttgagaacctaagggggggaagaaacaagccagccatttccacgaccatcgacatgtaaaagaaaggctttgccatcgagagagcatcactagatagttcgctctatcgagtgagcatggcttgaatgcacacgcgaccaacacaacagaacggcgtcttttcccaacacagcacgcctgtggtgtgctcggctttctttggcatcctcgtaacgatcgagaacgaaaacaggcgagtctgacctcaagaaccagccctattctttgaaatttgccgtggatatgtgtctatcatgccttagtgcccttgctatctcgctaaaatgtactcgtagcgtgcagggggcagcaagagacaagggggggtacggcgggatttgctgcttgaagggactggacgaagcgtgctgtgacggagactcgccatgggccctcgctccttttgcgggagagcagcctgtcctcgtgacaccgttacacacacagattcacgctttccaccacgcttaga

SEQ ID NO: 3507 - DNA, 703 bp, Nannochloropsis_gaditana
  misc_feature (1)..(293): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatctgtatgaagaggtttcctaatcataaattgtcatcccactcattccctccattttcttgcaccccattcggaatattctcaccgtttccttcctagctgacagtccccgtctctatctcgtagactccatcgctccctcctccttcctcttctgcactcacatcctgccttctcttcttaatcactcccacccattcttgattgcccgagggtcttctcctcgttccctggtatccatgctccctctttcttgcacccacccttggtctgccctatcccccctttctatagtcgcccccctccggcttctcagaggaggtagtggggctctggtaaggccgttgtcctaggctctctcgaatgaagatgggaggaatgtggctcccctgcttctggtagcacatg

SEQ ID NO: 3508 - DNA, 703 bp, Nannochloropsis_gaditana
ggcagtcacgtctcactacatcaccgacttttgtcttttgaagacagaaaaacaaagcaaatcatccacagcattcatagtaactcaaatcaatgcttgctcggctgcactttcttttctcaggtgatctatggggaaggagaatcgatcagtgctaccaagcagagactgtacagggttattgcatgcaatcgaataccggtgtctcaacctctggaaattaatggtcgaagaaactcagcctttaaaacatttgaaacttatacacgggggatgcaagaaacattttggacgcgcatcatcggcaacacggataccccccaaaggcttatttttcagtatgctccgcgtcggagtatctccaagcggaggcggctgggtacaaagcggggggtggcgatttataattaaaaagaatgaagtctacgcaagtcctgcgatactagtttcatgagtccgtagctcctttgcttgatgtattcttgtaatttaaaaaaaatgcaaatcaccttcgtgatgtgtaattctgaatgtactcccgcaaattttgtgttgtcccgccgcccgtcattttcaagatactcacctatcacacgttaccgtcctttaccgctccacctatgcacaacacacgaaaaaggaaaggtatcacactctgccaccatacatgttgtctggcacccgccgtgctttttcccgcagg

SEQ ID NO: 3509 - DNA, 703 bp, Nannochloropsis_gaditana
  misc_feature (230)..(239): n is a, c, g, or t
tatcatcttcccgtggatccgcgtccggaagatgctcatggcgcagggcaagggcgtccgagagggagaagagggagggagggagggagggaaagaggcaacggtgttgttcacgttgcagaagacattaagggacgagggtgttccggggctgtacagaggtcaggacgttctctcccccctccccattttgtctgctctgctcgaatcctctgaaccctccctccctnnnnnnnnnntcgccctccttcctttcctcccgccggaccgtcatctcgtcatattctggcacgtcgatgtcgttgtcgtcgctgtccccaacgagcaacaggtgcgtgagctcgaccgtccagatggccagggcccccgtgtagggcttgaagacggggcggaggtgggagttcgatgcctgcagcgaacgtgaaaggcaatgggtgggaggcgcgtggggcgcggggaacaagggcggaggggatggggaatgcttacgacagagagtaatagaaaatgctagaaagcaattgagacacgaaactggacaaggacaaaggaaccatggagagcgaaagggagtgggggaaaaagacgacgggctgcccctctcaacccacttgcaacagcggcgaagctcttggaccggccaggaccgcgtgatacagcggcgaggaagagggaggacgggctcttttcaggtacgcgctgt

SEQ ID NO: 3510 - DNA, 703 bp, Nannochloropsis_gaditana
agacatttcatcaatatgagccttccagggcgctagtttcggcacgtacagtgttcagcatataaacgaattcgacttttggcactgttcatcacatctccactaaacctctgcacaagcctggcgaaaatgatatttgaggtgcattcgatgacgcgtgagttgattgctcgggacgaggagtgtttggtggtcatttactttgtgttccaatcggtgtgtttaccacccaacactatccgccccctcaagcttcaagcagctagcctccttcctccaagccatctccctctttttatgccataacttgaaaaaattgtcgtatctcaaccacacagggttatcaaaggtgatgcatcgccttgtacaggattctttgcactgcctgcgtcagccgcgttctcttttcggatctctctaccgctggcgtcacctgtcccctcctcccctctcctcctccactcgacaaaacgacggcacaagtccatccgatgaacctcatccccaagacaatgacgcaacccctttgccttcatcatctttcaatattgtcgctgccgacgccgcaagtcacagaccgactcgtcggtttaacgtcagcactggagggacagggaaaaatagggaggagggcgggcagcccaaagtacaagtgtttcgcgatttgacccgcaatcgtgatccttcatgggaacgtgtaatg

SEQ ID NO: 3511 - DNA, 703 bp, Nannochloropsis_gaditana
ccaacagaaatagaagcgaaaaggttttcctgtctatgacacgcaaattccctccacattaatcaataaacagtcaaagactctgaaattgacctcagcagacaatgaaacgacaagacgcagttccccagcatggagcgaggcactgctgcaacccgactcctgtgtccatctgcctggggaagctcgaggatgctcgtggtgtttcgcgtaccgggagggctcgaggaccttcgtggtgtttctcgtaccgcctggctggctccttgccgttagcctgtgggagtttcaaatttagcttttctctcaggtagctcaacggtcgcttctttttttctggcgtacttcgtctcttattccagatgcaatccctttgcgtttgcgccgcatatattgtgcaaaggaggcaccaaaggcatggcccatacttcgtgtacaatttgaacctatcgaccgttcaaccgtatccctgcacgccctgattcgtcccgcgctgaggccgttgaagcgttcctccatctggaatcaagagccttgcaataaacggccgcttttccaatttgcttccgctttgtgtggctttggccttgtgctcgatgtccatgtcgtcgctttagtcacttctgcgtgctcacatgtttcacgaacgccttttcacaagattgactgcagatctaccttcctaaagctaataataacaatg

SEQ ID NO: 3512 - DNA, 703 bp, Nannochloropsis_gaditana
ccttttctccttcggtccttttccggtacccatcctagcgctacgctcagggtcgccggagcttcatccgctgccaatgatgccagcatcgacccagtgctcactgaaagcatgcccgcaagggtagcggctcgagaagcagctgaaatgcccagaagccgcccttgcaagaactgcgaggcggagagagtgagaaggaaggtaactccacccgcggtcaacctactggccttgagccagtcttcttgagagaatcgccactctctatcggggtactttgtcatttcaagtcgagactctccttaacgactcgaagagttgaggaaaaagctgcaggggtcagaaggcgtatcgaaaacgtcgtgtctgtccgggcgacactcaggcaggaggcccgtcgggactgtgacataagtgtcaccagtcttcctgtccaagctttagctttgattgcattctatacaaggaaaataagagtgtggagacgtcaacaaaagcgtggaaaacttggcgagcgtctttcattgcgtccaagcggctgtatcgctgcctgtaaggcgggggcgaggggcagaccgcacttgggtcacgcgcttttcagggattaggagcccggcttcagtatttaaagcgatcaccttactcatcggcttgaacgccttgacaggacacattcgagtaagctttcatcttcccggcaatg

SEQ ID NO: 3513 - DNA, 703 bp, Nannochloropsis_gaditana
accgccaacacgcctctcctcttggcgtcgtagccgtccgccctgaaatacctgaatggctgtacccgctttctaccaggtaccgatgcacaaggatgttcacctcgtctgtgttgaaagacatgcttgcctggggctccacggagatgaagcagcgaagggaaagggaggaaggatgcacaggagagggccacgaaggcggctacctcacgcctaaaggacaggtcttgtatgacaacacgcttgataacggccacaccccacctacgccggtgtacagtcctttgactgcagccactgcgaacgggttttcctcgtatgccagttggcaggctttgtacctgtgacagagcggtaagtgaaaacgaaccaaatgtgatgatgacgatagtaagcatgctgtactatttgtatgtccacctggcaccgtgccctcctggaataatcgcttgccaacatgggacactcagacaccatgtactgtcttatagaactcggcgtccgtgaatgctcctctatgtctttcgaattccatgttaaaccaaggaaaggtgagggccatgacaatgctgatacggtctcgcgccatcgccggcggtctgaaaaattaagttcatatgacgcctgaacgtgttaagctctcgactggccctgcgtttccaggaactgaatcgcgacgctaatgctacgtatcccacctaga

SEQ ID NO: 3514 - DNA, 703 bp, Nannochloropsis_gaditana
cactaacacactggcattttacccgttcacattttatttgctcggacgggagcgcgagactgaccacctgattcggatatgtcatcatgctaccaactttgtcaaataactgttccttcaatccatcctgtccggcgatggtaggcgatatttttaatgttctttttgcgttgtccgaacgcacttttgaaaagctactatcgaaacgctcctccagatgcgacaaagcgatacttttggctgccgtcgatgtgttattgcacaaatcttcgttctgataacattctagaccgatgtaatagccacacggacagcgtgtagtcggctttaaatatttttggggtttaagggtgcgggaacgttttgttggcgcttgccactttccgtttttccgtccgcccgtggtctctcgccgacacaaaatgtgacacgaagcattctgttcccccttgaaaatgaggacacgccttgcactgaagctgtgagccatcgcagagcagtgacatctgagaagtttggtgcgcaaacgggggcttgtgtctgaaaaataaggcccttagaagtctccttcttcagcttgaaggacggcatcggccgtcgcttgtaggctagcggaatgtccctatcgccctgtctatggcaccagctcaagtaccgtttcctttctccctggtcagacaaacagcgcttcagttacaggatg

SEQ ID NO: 3515 - DNA, 703 bp, Nannochloropsis_gaditana
acttaaatatgatggccagcgattgaaagcccacggtagaggctgcggtgtcgcttgcatgtgagtgggtacaagccagtatcgcacgggtcagcaggaccgtgtctatgcggatgaacgacgctcttgtaaaatcacgaaagggctggtgctccacctctagagtccaagacaatcatgtcggaggttttgtttgggtgtctttgtgccaatggatagagttaacgtagtttcagcccttttttctgctccgtgttggtgtagtcgcaggaccgttaagatgaggggcaggaggttgttcgagagcctatggcccttttggtgtgacgataaatttcaagcatgacagtgcatcgcctttctggaaatacgtctgcttcattcagtgagagaatgtacatgcagactgtcagccatggcctttgggatttttggctttctttcgtttgaaggcggtttgactgcacgatcctgatactccttgttgttctacatctaccactttcatgtgtcaccatctctgtcctgccctcgcgctcattacacaccttctcttttcaaattaatccttgcaacatccacatttaggttccggctcgggcggggagggtcctttcgttctgccactggcggtgcaccgctcaaacagccctcctgactgagactcatccttactgagaggcgtcaaatcccctttgtgatg

SEQ ID NO: 3516 - DNA, 703 bp, Nannochloropsis_gaditana
ctttttgtcgatgatccatgtggaatctcaccccgtagcggacactcatcaatccctgctcctggtctacttgggtggtgggtgtgaaagacacgttcttagttgaaagagaggcaaaaggcacttagtcatgtttctatcgctgtcctttttggcgtgccgctagggtcgcctgaggcgcaggggagacaaagggcaacgccggggtcggggaaaacgaagtggtcaaatgtcaagatcggccgtgcttaaggcgacatccgcgtcaacgtgcattctcgggacattgtagatgctgtaatgattcacttggtgcgagacagggctgcatttgcgggtgaatcgtgagaaagggtgggtgctcgcgtggattcagccttgagacctccgctagcaccgacgtaatccatcgaggcactccaagcccggtaaaaatatgcacaagctttccgtgttgcattcttacgttggagtgaggacttctggaagagtaaaggcttcacgcttggctactgcattgaaatggtgactcgtgtttggctaaaagtgcggtttcgtagctattatacgagcatcactcctccgttcctgccatggtagctccctctcttcttttctctccactcatgtctctgaaatcaaccctaacgactcatagggtcgtctcatacttcctgatagcagtcttggcacggtagcaatg

SEQ ID NO: 3517 - DNA, 703 bp, Nannochloropsis_gaditana
gctgcagcggggaatgcacgtggggaaatgcgtcgaccccggtcgtcgcataaagacgacgcgaatgtgatgaaagcgaggacggtaggagaagagagcgggtcaaatggtgccggaaggaaaagaaccgagatacaggaggaggagacagagaatcaagaaagaagtaggacgggcgtgcaaggacgcatgcacgccaactcttggtcacgaacccaggtccaggagcggacggggcgtaaccccacttccgaaggagcggtaaaaattagtcgtggcgggattgagtgttgcgttgtatggacagtgtgcgtggaaaatgtactcaacgcatgggattaagcgaggggaggcgaccgggcccgactactgggtgagaaaaagcggtgggtggccgaaaacgcctggctgtcaggctcatgtgggcgcaggaattgaccgtgtgccgtcaatgtgtgtgcgtgcatgctggtttgcgtggagaccagtggaagtggttgcatttttggtacctgccacgaagaagccagagcgacgagtggctctgagaagccccctcagccaccaccaagaaagttgtaaaaccttccagacgccgctcccatttacgagaaggtcctctcactatcatacaccgtgtattcataaatcacagaagagtcgttggttcctggcaactgctctctagttttcgtccagcatg

SEQ ID NO: 3518 - DNA, 703 bp, Nannochloropsis_gaditana
  misc_feature (1)..(615): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgtccccgagttgatggcttcttggtacggcaatgagactgccgccacgattgacatgtcctactacgcggtgcccggccacgatg

SEQ ID NO: 3519 - DNA, 703 bp, Nannochloropsis_gaditana
tccttgtctagctacctgaactgcactttctgagttcctggaaacaggttctgtcgcgtggaagggacatagtacataagagggggctgcttgccaagaagacaaggatagaggaggttttcgcaggtcgcgcaccatcgaggacgatgataactgaaaaaaatctccgcacatcccgctgctggacacgccgctaggcaaaggaaaaaggtctggtggtcagatctcgtttaatcctcctcgttgtgcaagtgaaaaacagccttagtgtccaggtgcttaacaagtcgctgactgaggctaccgtcctcgctcaaatggtgtacgtcccgtggacatgtaatgcggtacctgcaaagaatacgcagccttttgattaaaaatctcgattgaataaggcgattgtttttggggcctcctacagttgttagagatgcgtactttcgatttcatccccatcgttggtgctacaacgaaataatcacggaaggccttgaaggcgccgcgggggtgtgtcgtgttccatttagcgcctcagtaatgattgcgtacgccccgaaccttctgggcattcccacgacagcgacctcgctgtggatgcagataggtaagcgcgctgatacaagaccctgtgcgcgtaaggacgaagcaaaggccctttggacacgcttcctcttaggtttcggttgccttcgtccccatg

SEQ ID NO: 3520 - DNA, 703 bp, Nannochloropsis_gaditana
  misc_feature (518)..(527): n is a, c, g, or t
gcagtctttgggccacaaaagtgctttattttttgtttctttcagtgttcgggttgagactcaactcttcttagaccgagcatgcgcgtaccattgtcagtaaaatccccgtcatctgcccacgctctcctcctttcccatccacatcaatacagcaccgagacagagaaaatagacgccgcaccagacgttcgtcaagtccaacctgcagccgcgcccgatcaagccttcaatagcatgccctgggtcgaaaaataccggcccacgtccctacaagacctggtggcccatgaagagattatctccatccgtaagtcggcaccaggacggaggctccgtcttggcgtcagtgcccgaggacctgtacgatctcgcgcctccctccccatcaaattgatctcgaacgtgtcgctttctccacctggcttcacacgtcccttgtggaggcacagaggcgtgcatgcgctgtcgttttgcatgtttggatggatccctcccaccgccccccgtcccccctnnnnnnnnnntttgcctcggactatcaccaccctggtacaatgtgcgttgtgatctcctctctgcttagattgctgtccatcatcctgggcgacagacaatgaggatgcatcaattcaaaaattaaaaattggttgaaagaaggccttatccgctaccttccgtccttccttcttctccatagatc

SEQ ID NO: 3521 - DNA, 703 bp, Nannochloropsis_gaditana
cagggacgcatgcgcataggacggggagagcggacgcatgccagtagaaatgaaggagaagggatctccttgtgtaccatgggtctcaaaatgtcaataattgataaagtaagcatgaagtcaatgtttattgttcatgggcagcttttttggacccgattggttaacctggaaataaaatacgttcccacacgaagggaaagctggtcgaaggtctctggtgtgagaatgtggatcatttcaagagtccatggccacgggaataataaggcacatgtgcatgttttttaataagatgggctgcacctggatatgcacaacatattttgatcgcgcatgcgtatatatcaagcaggggaggaggttattccatccatacacgagggatggggaagttggggttggaaaagtacgaagcaacgtctgctttgagattgtctgcgtacctgagagtgtgattaatcccttcgcaatctagctagtagatttagttgcatggtttgaatcgatggggcgtctgtctcaaaatctatgcatacgatgtacacgtaaaatccccgtcgtgaagcgcgtctcgtacgtttttgaagagcgaatcgcaacacttccatcccattttttctctttgaaagtacaacgtgagacagttctatccgctcttcaacgattggaagtaaaggggggcgagtttattcgtggtatg

SEQ ID NO: 3522 - DNA, 703 bp, Nannochloropsis_gaditana
gaaggacacatcgccgcggcgaggcaacaagggagggaggaagggaaggaggaagggcggagggagaaggaaggagatgtgcagagactggaaaacgagcggaagaagttggaggaggaagtggcgacactaaggggtaaaaccgacctgagagaagaggaggaggggaaggaagggcagagaaagcgggtagagaggctagaagcgcagcaggaagaaatggccgagacgctcaggcaggcgcatgccgcccctgcggaggagaaggtacggggggagaaaaggcaagagaggtggaaagcgggaggggagacgaaggaggcagatgtggtgggggcgagagggaaagaagagaagaaggaggaggacatgggggaggaagggatggagggagggccggcggaagtgcgtgccgccttggacaggaaagtccaggagctcgaccatctccgaggacgaatgaaggtctttgtggaaaaattccgcgaactccaggcacaagctcggggtctccaagagcagctcgtcacagcagagcgggagaaagaggaggtgagggagggtgggagcgagggaatgagggaagaaatgctttgcgccacgacaactcctgtcttggggtgggcgagggattggaggagggcggacgggtttgggtgtttctccttggcaattcaagatatttctccccacgctgcagatg

SEQ ID NO: 3523 - DNA, 703 bp, Nannochloropsis_gaditana
  misc_feature (1)..(613): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacccgtgcctccgttctggccgccgccaatcccatcttcgggcgctacgacgacttgaaatccgcagctgagaacatcgacctcatg

SEQ ID NO: 3524 - DNA, 703 bp, Nannochloropsis_gaditana
agatgacggaggacgagaagcctcgagtgtcgtggtctttggactgggcatggaggcgggaaaagaggtatttgttcgtgtacggtaggtccacattgctgacgaccagatccgcggggaggacgtgatggttctggaggcggacaccgcgggtgcgtagtcctgggaaaagtgcggcatcggagaaaggaagagggaaagggaggtgaatgatgatgatgaggtttgtttttgggataaaagatgctgtccgcaagtgaacaactcgtagccaccttccccgaatcctttccctccacaacggtcatgcctgtgccagcgctttccacgagtatctcggcaacgggactgtcaaatagacagcaaacgccgtttgcctccacgagtcggaggagctcacgactgacctgcagtaaggggggaacgcacgaatagaggtcaagaatgttaaagaaagggggcggactcgtggagcgtgaggggctacccagccactctaggaccctggaggcagctcagaggcgcagcaaagggaggcataaaaccgaggtcgctcattgagaccacgtctatgtcgctcccccattcctgaacccgcccgatcctatctctaatcctgaatctctcaggcgtgagaattaacgactgccaagattttaagcgtcgttgaacaaagtgctcatacctgtgcgaacccgcccaa

SEQ ID NO: 3525 - DNA, 703 bp, Nannochloropsis_gaditana
ccaaattgctggcgtccctcgaaaaaagtctacaacgctaaggcacgcatagccatcgtggcatcgatctttattgagaataaatcactgacatacggaaatggctttcaatttgttgtcacgacggatgggtaagaaaggttactctttctcgtgtgggagggcacatacgtcagccaagtcttgtactttcttacatccctttccacgagggccaagagttactaaacacgtaccgtaaaggaagcaaaggttgagggcattgtaattgtaatgaatagaacgcagcaggtcctgtgggcattcatttagtgagttagattcgttgaaattgaggcagcattggtttgcggagtagggacgcgcttcttcaagaagcttttgggatgagtcaaaaccattcgaacatgatccatggtacagaaatttgatcgtgcagaatttgatcgatgagtaggccgtctacagcgtggctctcttgtcatctgcactgcatcagtcaactaagtaaagaaaagttttaggacccaaaaaaccttaatttccgagtaggacaggagacgtcgctaaaccgacgtcgtcagtccctaagcatgtgttcctggtgtatacgtctcattgaaataattgaaacctttcaggatgctaacgacatcttacgtcgtgcgtacagcacaattttcttgcaccttccacagggatg

SEQ ID NO: 3526 - DNA, 703 bp, Nannochloropsis_gaditana
aaaatcatgtaaacttttctagaagaaattgtgcattgcattaccaaaaacaagaaacgaaagtttcggcgcattgtatcttgatgtggcatttgaaaatgaagcattacttgccgacagtagtctctgcctgtacgagtaagaattttcactccacaaaataggaagcctcatgcggttcaggtaaaaacagggaaccagaaatgtccacatcttgcagctgcatggcgtcggtttgggggatcgagtacccaaacaggttttaaacaccgacccaacacattttatgctggtaaaatatacaccatgcgagcgattaacattaaaaaggtgagggacaaagcttccccatgcttttcccgggggcctcggtatctccgggaacgaaacgcttcggcgataccgaaaaaagcgagtacgtacaccgcgaccccaagcagtaattgccggcaaccatgtgccaggaaaatgcctggttgcctgcgcatgacgaatgatacggggggaatcacactcagaactgaggaagccatgagcttcaaattaataggacgcggttgtattcgacaattagtggctatcgaaggtgcgcaaggcgcttaagtaactcttcatttgttctgaaaggatagatctgtaaaataatctcgaaatctgtgtacatccattattgacagcaataacaacaagtgcgctcagcatg

SEQ ID NO: 3527 - DNA, 703 bp, Nannochloropsis_gaditana
cttaatccagcaggacaccgcaagccatgaatgatttattgcaatttcacgacgtcgtgttcgcacacggatggcgctgcgttttcatggaagttgcggaactttccatcggtgtcctgtacaaattatgtgaccatattctcaggcgcctggagaaaacagggaggcaggttatcttgatggttaatttttacctctatgttttttacattttacacatgaagcacatgtgcatatgctttacaattgtctgggtttaggattgagtacatgcaatattaatgggagaacatgaatatatacatatataagatcagatacatgtatgggtattaatttgcgaaatgtgcacgagcacaacaaaatataacaaaagtaaccataatgattttaacattgaaaatttgtccaaacaatcagtataaccttagcagtacgcagtcattaaacaataagttctgaacataggtgcgtgccccgtgaaacggacgattccgacaagagccagatgaagatcggatcgctcgccctccgcttgaacgcccgagtcgggtcggaaccagggctacttgcacgccctctttatgccattcccggacatcgacatgcacattctcgcattcataatcacagttctgctcttgtaacggaagcggaccggggtgcggtaatttcccgccttgtttcggcgttcggaagcatg

SEQ ID NO: 3528 - DNA, 703 bp, Nannochloropsis_gaditana; identical to SEQ ID NO: 988

SEQ ID NO: 3529 - DNA, 703 bp, Nannochloropsis_gaditana
gaatgactcacttatccgtacgacctgctgcttattccttacttatttgtgtgtcgtgcaccctgtggagtaggtggtggggtctggcattgaacatggccgggggtggaaggcaaaagttgcacttagacgggccgtaaaacctgactctcttccccattgccttcggaatagacaaaactgatctgccaacacttatactatcattctcgctccatttaccccaactgtatgcaactacgtgtgtgtttttaatgtcaacgatcaggtagtatcttcccttacgacccaccgggacctctgtcgccgtcgggcatggcgcgagaagaagagtgcacgtaaaaccagactcacagggtgtgaaaagaacgtcgcttccaaataagatatgaccacttatacgcgcgaaggcttccatacagagtgttcatgaagggcctcgccattgatgcagtccatagacttgccaatgctgatagaataggactttccacgacaagctccaccaccactgtggcgaacacgaccacaccgtgcaatcagacgctctttctcttcacccgtgcccccgcgcttttctctcggcttcatcgctcacgtccattgtgactgctaccccactgcacagaagagatttgcgggcttatcgaagtacggaagcgggttcaaagggagcagttcttcccttgcgaacgtaggcatg

SEQ ID NO: 3530 - DNA, 703 bp, Nannochloropsis_gaditana
ccaggtctttgtttgctttgcgcggggaaaagggaacacatacagagggaatgactatttcttaatgattacctttgatagcacatgtagtgcgcatactggacatgcctgggacatgtttcgttgctggtctattcttggtggcccatattacgggttaatggaaaagaatccttcgttgattgtcacaaaaagacattccttttcccttacaaacagctgttaagtcaccgtaagtgcattccatttcccaccctggaccccttctcggttctaagcgcgacacgaagcactttatatttgcgagttgccaggccccccccggcccatatgaatatgatggaaaaggacccttcggtgggtgagggtggaccgcagtacgaggctccatgcccgtacttcggttatggaagcgcgtgggaaggatgtgcgtccacaagggatgtgggcatgtccttgtcatcgtcgtcgtcgggtgtgtttttttggatgcgtctctctcacgcccgcacttttgctcgcagcaagcagggagggtatggcacctcttgcttgtatcgctcgatctcgatcctgtttgttctccaaaaaataacaagctgccagccttgtcacctggttgacatggcttaagatagtgaaggagtatctaaatgcgcccgtgcatcatttcttgctatcggttctctgtgcattcatcatg

SEQ ID NO: 3531 - DNA, 703 bp, Nannochloropsis_gaditana
  misc_feature (1)..(652): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcggcggaaggatggttcgctcctcccaccgatcgaggtgcacccttt

SEQ ID NO: 3532 - DNA, 703 bp, Nannochloropsis_gaditana
agagcacatcgcccgtggatttcatcatggacttaggtgggtaagaggagcagccggcaaggatccaacgtgcaggggaaaaacttacttagggctttcccttcggcgttgaagtgtccgattgtacatagcatcgatcagtctgccagattaagcttctcttttcgtctttacgctccatccgccagtgaacatctccttcgtcaaggatattgaggccaatggtgaaagctcccttcagaccgtccaagacctcgaacatgctgctgccttattccgcgcctccagctctagagatgtggagccggtcattaaagtaaggtgtaaaaaagaggaggaaggaagggaaaagaggaataaggagagcagttttagaggatgcgatagataaatgacgagatggagaagaagaacgggattcaaagggtggtgaagagacataaggcaaagaagagaggcaaaaacagagggagatgttgtataacataaaagagaatgagtgcagttggtgagaggtgatattcgcaggagatcaacgacaagagagtggcgtcaaccggcgggtcaagtacatttcatcttcgactaattcttaatcctccctccataatttcttttcctattgcagcccgttcctactttggcccctcgcaacacttcgttgctcagtgacctagcggaaaattcattgtttgatcgcatg

SEQ ID NO: 3533 - DNA, 703 bp, Nannochloropsis_gaditana
aacccgcacaaactacatacataactggacaacgtaccgcgcgcgggggccaggagggcatgacgcacgtcacgcgcgcctgggtggtaattgtggggattgcgtcccatggttgtgcgatgtccggggtcggagtctcgccgacgccacagacgcacgtcgaatcctccataatctatctgtcttcgggggggggcgcgtttctgaccgactttggtgcaggttttctggtggagaaacctaccacatgtcatccatctgtcggttttgtccgcgtcataccgcgcgaggcccatggtagggctcgtttgggttactttcaggggagaaaggcgtacccgcaggagaggcatagaagttcaagtacttttcttataggcgacgggaggacgacaaagcagtccagcctcctgaatgttgttcgcgttttcatgcgccgaatgccacggtgatgttatggctccactttccatgttcacggactaccaagccgcacgatcagtgtcgtggcattttgggtcctggtttttccttacaatatcaacttccctttttctattcaggaaaggcgaggtggtatcccacaagcaaacccctcatcttgccgtcgagacgagtttattccttcatcaccgcacacgtttgctcatgcacgtgtttcacggcaatttgtagaggttatttttgagacctaattttcatg

SEQ ID NO: 3534 - DNA, 703 bp, Nannochloropsis_gaditana
catgcgcttgctaccaagggaaaagtgcttcgcctgcaatagaaagcggaagtcagatttggctgacatcgagctacatgccattgcagtcgagaaagtgcgttctacatcggtttgcagtgtcggtgagacgccgccttcgctagcgtcgagtggagtgcttcggccccgacctgcccgcgtctctgggtttagcatcagcttcacgttcatttgtttgaaatcaggatattcatcgcgtcgctcactcaaacaggagacatgccatcgacaatccgaagtacgtcgccaccacggagcaatgaaaacaggaatggaaccagtttatggcgtctggtacgtgacacgtaactataacggtcaggggggcacggccaggggaaggacaatgtacattgcgcatccgcagcgtccggtgcgataacatgcagacgcaccgaattgtgcccgaaatgagacgtccgctgaaatgccgctcatccgcagacgtgcagagtcgtcgggacggtgaaaagcagagctgcatgtgctggattccgaaatgcttagacgccgccacaatgcgtccttttattcgttgtggggatgcttcgatgcaagtcaactttatctagagtacacaaaatcatacagaggcattgtttgacacgggatgggtagtgaaagcttacttcgtgcttgggaccatatagcgacaacgatg

SEQ ID NO: 3535 - DNA, 703 bp, Nannochloropsis_gaditana
gctgccagacgagaagaaaagcgaggcaacgacgtatatggtttgatacatcgcaaacacgcgcctgtgcgagacaagaacactgaaaggcatgcgagaatatgcatgaaagattgccgcctccttcgccgcaggtaatgcgggccaggccgtggcacttttaaatgtggtactcctccagcaacctcgcacgcaaggagggtcgtcacgatcgatccttaggcccgatcgaccccaccccgatgatagaccactaatcagcccctgcacacatcctccatcatcctgtcgcccggcataatctatcagggcacgtgcagcaggatcattgggagcggccaggtgctggaggtgttttgaaagactggcaccgggttgaggacgagcatgctggtgacggacagcacttccggggaggctagctggcctccacaaagacgaaataccgtctcccctagtatttcaccccgaaaacacatcacgcttacctctctatttgtttttgggctcctatcgtgtctggtactcttgccagtagaggccatcaagcgtgcttccacccctgccggaaacaaagcctcgcgaccgtccccgtcccctcctaacccaaaaaccagaccgaccgacgacgaaaaatctcccagcccgcatccacccttacgccaagcaaaaagaagagacacgtgtgaaaaccacaggtatg

SEQ ID NO: 3536 - DNA, 703 bp, Nannochloropsis_gaditana
  misc_feature (1)..(566): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacgggggatggcgtgaacgacgcgttgagcctgaaagccgcagacgtgggcttggcgatgggaaggtagggacaaaaaagaagggataggcagagcaagtggaaggaggaaggaagagaggggagacagctgatg

SEQ ID NO: 3537 - DNA, 703 bp, Nannochloropsis_gaditana
  misc_feature (1)..(612): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctccttaccagactgttggaggcctccacggcggggagcactcgttccttcctcccgtcagtacggaagggctggcccctccggcgatg

SEQ ID NO: 3538 - DNA, 703 bp, Nannochloropsis_gaditana
cacttgaatttgtgaagctattgagtccttccaccgtcatgggcacctccacaggaaacttaagaacggcatcagaaggtgggctggtatattattcgcccggtgggccattgtggccccgcaaagatcaaaatacgcaaccccagtgttcctgaagtgcttgtcgtgcgcccttttgtgcaggcaacgtgagcaaacgtcgagaaaaatgcctgaaatgagaccaacacgattcaaatcgtagcaaagaattggtgcctgtgtttttggaggatttgaccgcgaattttgtcggtttggagaccctagaagcatccaatcacgcttcgcggggcgggaaaagacaccactttgggacatggcaggcctacgtagaggggtgactgtccgagggtagagatgatcgatcattcgttcgtgtatttccctcacttcttccttcctaccctctcgccacacagggcgggatctaaaggttggtgcccccggacggccgtcagggtgaagtcgaaaaagcgccgtctcggaatggatttgtgataagaaccgcctgtactagcgtccacatctcgactgtgcaccatttttgatcgtcgactgttaggcgtgtgatcgcacgtgactgggagccgcgcgaggcgtgagggaaatcaggcttttgatgcaacagactgaaagggcagagtgaggcacatttttcatg

SEQ ID NO: 3539 - DNA, 703 bp, Nannochloropsis_gaditana
gcagtgcgtaaggggtggtgtgaataaaaaaggctttctttgcctaaccaccgcaggatgatcagaaatgcctgtctcgaccatccacaagcactacccacccacatgcccacgatttcccgctggcttctggagggcaccggttagaaattcgcccatggtgcacatcagcttgaaagtgggatgattttgcgttcctatgtcctttccagagaccagcttgcattttgaatgaggttcccctccgaggaagatgccgcctttccctccctcactgttcgatcacttttctttcctttgacgccaccccgtctagcttaggacaggtgggtgacactggccaagaatacggtgagtgcttaacaattatggagagttttagtttgtttgaacgcgtggtggatgacagaggtccttctacccattaacctatgctcggctgctggtgtgggatacttggggttgggagcgttttcaagcttgctagctccgcgacgcgtgtagagactttgccatggcattttgacagtatttttgaggcttctgtttctgtttttttcctgtccccccgctctgcagcacaactttgagcatgcccgcgacacggaatggggctacgggcagccaagtgacacgccggtcaaagacacgtcacactccggccgatggaacaacgcctgcagcggacgaggtacaggaaatg

SEQ ID NO: 3540 - DNA, 703 bp, Nannochloropsis_gaditana
  misc_feature (623)..(632): n is a, c, g, or t
cgtcctaaacattcccgggtccacggccacggacgcccccatgcgccgagccaggtgtcgccgaactgtcaaggggtcaacggctcggaggcttcccaacggaaagcgtttcaacacggcgaggaccaaaaggccgatgagcccggccccgaccaccgtgacgcgctcgcctgccaacggccgcgcgtcctgcacaagggagagggccgtctccaccgaagggaagtacacggcgtcctccgccgagatacccggaggtaccacgagcaagctactcgccgccaccacggcgcggctggcgtggggggagaaggcgaagactaagggcgccgcaccttcccctcctccttccctccccatcaaccgctcccggtccgcgacgtccgccccgcaccggaccaccctaccgaccagagcatagccgtaccgtaaagggtacgcgagggtctcccccgccatgcccttgatgttcacgtccacctcccctgcctcctccccctgtgggatctcgcctcggtacaccttcagctccgtcccgctgctgatgagagaacacagggcgtccacttccacctcctcgctgcccaaggccggcttttcccgccatatttcctcccggcagnnnnnnnnnncggaggacgtgggggagtttttgacccggatatatcagctgtgtaagtggacaccggagtgcaacatcatg

SEQ ID NO: 3541 - DNA, 703 bp, Nannochloropsis_gaditana
  misc_feature (1)..(627): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatactccgtcagtatctgtgagaaaaaaaggcaacaggcaactgatacccgactgaagtctccgtgtccagtcc

SEQ ID NO: 3542 - DNA, 703 bp, Nannochloropsis_gaditana
ggtatcatagcgaccgggtcttcagacggcgtattgaaggtatggtcggtgcatcgccctgcagtgggaataggagggggaggggcgtaagccaaaaaccgcggtaagttgaaccggtaagcttgcttcagctctctaggggagaggctaatgaaagccccgtgaggcttcaaagagtcaatgtctccagcggagtaggtaaagtctttcgggcggaacttgcagtgtcgcgaaggtgaaagaaacaagttctcaactgggaggagttctttgtgtcctcttcattccgtttttggcatcgaagacataaaaattggacggcaatgaccggagagtatttggtttgttcaggaattccagtaccgggtgggcttcaaccgaaccttactcgaaaagctacccggcccctacgtgccaagccacctgccaagaaattttacacacatgagctattttcaagcagcaagccgcgacttgaacgaatgtatgctagggatatacagctcgattttggtggagctgccctgatttcgaatcgtccccaaggagttctcctttatttgctcacatgtaattacttcctgtgcagcttgctgagagacgcactacttcattttaccttcatgtgaagccatcgtcctctttaaaccacgctgtcacaccgtctgcaacgtaacaggtgtttctggttacgtgcatcatg

SEQ ID NO: 3543 - DNA, 703 bp, Nannochloropsis_gaditana
cctcccaccccgccggtgctggcggggtctccgtgcccaacattcgcgtgagtgcttgcagatgcagtgggatcagaaaaggtagaagggagagagttgtgttcgccgccgtcaaatgctttgtactctctggctttagccccctttatggagagggcgggcagggggagggacggcataaaacggtcggttccactagtcgttgtgacaccttttgcgcctcctccctttgctaccacttaggaaaacatgtgaaagcagggagatgggcaggcaaagcctggcaggaacagggggcgagagtggtaacagaagaaggaagaggataataatgagcgaatcaaattagacggggtcgagcttcttattccgagtaaagtcccttatgtgatagtgggcacgtgcaggcatgcgtctcccggcgcaaaaggggcaatttgcttggtgattaccatttaactcgcgcactccttgcgtcgtggcggtggaaatcctggtctatgaagtccaagacacgctaagcagacactggttgaggtgcacaggcgacgcaagcgatcctgctgcccaattaaaacctgcaacaaactctactcgtgcccgcccacacacgcagttttgtcatcaaagtgacatgaactgaccactgacacaccaacacccacaattacgaatttagacgttcgaacggtgcctgtcgatg

SEQ ID NO: 3544 - DNA, 703 bp, Nannochloropsis_gaditana
ctcaacttctcaagccaatttcctactcaaatgtcttacgaaaaaccatatagccttcaaatcccaaagaaatatgcagcttacgacgtgctatagccctagcatgggtcatgaaatgcttcattccacctgagggacaagaggcgacgtaaaacctccctgttccggcattgttgttcgcccgtgtataagaaatttctttaaaaggatcttttgcgctcaccaagctccatctccacgtaagttgagagttgttgtgcgcaatgtttcgattcatcatcaaaacaattggtgcacgcgtcgctttccatcgtcgttcccatgagcgatgaagcgagggcaaacgagaggtgccgccggctttccataaaccacaagtcatgtcacaaatgtcagcaagccaccattacggcgcctatttttgtcgaataagcgttgcctgcatccttgcaaaatttcacggacattgtttttctgacaggtgtcatcattatatttcttccagcaaagttgcaagaaggggcgaggccgcggtgcatgcaagctctctcctacagcagcacaaaaagaagaaaccggcgaggcatttactttcctgggatagtcccgtgcttttaacaccgagtaaaggaggcgtagtaggccgttcaaggatcccaagcaggaccggaggacccggtgtagcttctatagaagcaaaatg

SEQ ID NO: 3545 - DNA, 703 bp, Nannochloropsis_gaditana; identical to SEQ ID NO: 870

SEQ ID NO: 3546 - DNA, 703 bp, Nannochloropsis_gaditana
catttgccacttattccattatattttgaagcctcatacgtgatcagaaggaacgccgcatatttggatgggaataaagacgatggtggacgtgaacagacatggcatggcaataaggccagaaaagccgccgaaaggcacaaggaacgttactttcaaattaagagggaggaggtttggcgcgtaggaaggtaaatgagtcgcaagaaaaccggtcgagccttcgtcttttaagctacagcttgggaaaggttatcgaactctatcctccatgtgtgtacgtgatgctaggtgcacgttaccttatgaaacagccgtcaacaaaggaaaagcctccacacgatgaacacgggcataaatattcttcatgcccatggctctgaagactgtatgaggtcaaaaaaagccaaaaacggagtatgtctgtatgcgtgtgcggccatgtgcgtgataagagatggagaggagagtcagtgcctcagcttcatacccctatatggccttcaaagacgaagatagagcaagaggaaacacagggcaacgactcaaaaaataaagtagaacctcgtggaccatccgatcgagatgatcaaccaggatgatggccacagatattgatacttgcttgtctacaggaccttaatggtgaatctccataaacttcctgcaaacgcaggtttactcatacctactgtgtatatca

SEQ ID NO: 3547 - DNA, 703 bp, Nannochloropsis_gaditana
gtcaaggaagtcaaacgtcaggggagggataggccaagcgaggctcagaccggggcagataaccggtaaaagcaaagaggcgcggcagacaacgcgagagagcacaagccaacaagctaagtaggagccgggagggagaagctaacagggtgtggattcttggatgttcaaaaccaaaggtgtcgcgtacctggggtggcgaggtccactgccgtcaaaggtgggcaagaggaagcatttccaggttccaaggcctcccgaagttctcctgccttgcggtaccctttccgacgcaagacgcctggcaggccatgaaggacaaggaggggttcgcgtgaaaaaagaaagaaagagtgagttggccttctggtggagagtttacctccctaccttgcatttcaggccaaggcaggtcgtaggtaaaaagtgggcgacgctttcccaaaggcatgcccctagtttgttgctttgtcggggaattgaaacgtgaatgtggcgttccggtgcgttgaagccgggtaagttggatcgtaaaccatcgaggggggagggtaatcagaaggaaaggaacatgccagcgacttgccagcgattcgacgactgaagaagccagaacaggaagagtatacattcatccccctcacaccttgtgatgttatcgaggcatttttccacacacgatacgcagggcagcgtgaaaatg

SEQ ID NO: 3548 - DNA, 703 bp, Nannochloropsis_gaditana; identical to SEQ ID NO: 321

SEQ ID NO: 3549 - DNA, 703 bp, Nannochloropsis_gaditana; identical to SEQ ID NO: 322

SEQ ID NO: 3550 - DNA, 703 bp, Nannochloropsis_gaditana
gggcccgcaagacgcaggtcgacagggtctacgacggacaggccctcggagggggatacgcgaggggggggcagggaggacgccgatgcaatcggggtggagggggaggaaggagaggggcgactgtggtgggccgctgcggtggaggaggaggaaaggatttgcttgcagaggttcatggcggcactgaatagggaggcggcatttttcctgctggatgcgcgcaatgccctgcccgcgctgcgaaaagccctgcgagagagtgggatgaccggctcaacctccccctctacctcctgtccaccctcctcctcgaccagtccgctttcaggcctgcttttggcgcacttgctacgggaaaagacgcctttcagccatgtggggcaagtgttgatgaccatgcttttccgcgagccgtgggtgccctccctggccctccttccctccctccgcaccctggtggatcggatcgagcagggcggggaggaagaggacagggtggaagaaagcgaggtcaggcaacgcgcccggagtttggtgctgcagcaattgctccatgccccttcctcccccctgccctcaaccttgccctccccaggcctcccccagggcgtggttgacctcctgcggtccctcctcttcaacgagctccgaggccgcaagaggggatttaccctccttccctccctcctccctctcttgg

SEQ ID NO: 3551 - DNA, 703 bp, Nannochloropsis_gaditana
tcgaaggtggggtaatttgcgactggatcaaaataatacaaacatacatgcatgaatttacaaaataactacttcatgcaggcattttcacgccaatgtcccgcgatcgatttctttgtttgctgtttttccctacccgctaagcgatgcatcgatgggccgtagctgccaatcgcgggtgagcaatgtgacacaagccggataggaagttattttatgcatatcagatcacaatcttatcatgaacgtagtacacattcacgcccccgagctttaccctgatatttcatgcgcaaacaacatcttgtttatcctttttatcgggtcactcaagcgttccaagggtgggaggttgcttctcgccccatcttccttacttggagtgccccttgcgttctacaacaccccaaaaaaacagccacagataccgcgcaggcgggatgctcattgtgtatggtcgagtatcgacaattttttgttcctataggcttggatcacttaaaattcgtaaagcggtcagcatggttcatgtgccaccacccaccaccacttcaggatactgcctggcgttcgtagcccatatactcacagcactttttccctctatcttttctcttttcctactgtccaatgcttaattgcagggagatagggtcgtacaacaggattgatagctcttccttcgacgtgagacgtggtgatg

SEQ ID NO: 3552 - DNA, 703 bp, Nannochloropsis_gaditana
ccgatgacagcttgtccaaaccgtggtccatggatgagacttctcttcatttgtttgatatctttagaaagttggtggagaaaagaaggaatcagataaatcacatggctgctttaaaaacgcagtacacgctgcttcaacctcccctccttctccgtgcttctgacttagtgatagatgaaggatattgttaaaagaaacatccaactctctatgtcgcacagtacaactcccaaattttactgtccggctgccatgcagtagaattcactcctacgggatatttgtcgctctcaaaagaggagagccgtctcgctcagagcaacgggcacccgccgatattttctttgcgtcatttttctgtctgaatcaatgtctccgtgcgtataccatagaaacaggcagtctaccaaaattagtatgaagcggatgctggcacacgtgaggtacatgatttcttgtcgtttcctattgtttgtctgtgacaaaattattttgggaaagtgaggtaaactatccgatgcacacaacaccctgcagaggaatttatcagaggactgtactgtattggtttcaacgatatcgatgagaatggtcagtttttggtcccctttcttgcctggcgtcttgctttaaagcgctacgtatctccatttgaccctgatacacgccacggccttccgccgtaccacatatgcccaga

SEQ ID NO: 3553 - DNA, 703 bp, Nannochloropsis_gaditana
ggagcgagagtcaacgtgcagtcttgtccccagttggaggtcttgcgtcttgcttgcagctaccttagggcctgggatcttagcgccctggtgcagacctgtcgtcatttctaccagcgggagggaggcattgttgaagaggtgcggccggcttttcccaccgccttcaccccctcactttcctactctcgtctttgtgctcgtctcaatcctttgatcatttctggcctacgtctttcccccctacccttgccctcttttcagatcgccctccactccatggacctcctctctgtctcttcctcccctcctctttcctcttcctccggccctggcgcccctcccacccttgcctcctcctcctcctcctccaccctctcctcctctggggctgtttcgtcatccaaagacaagaggaaacggctgggatctttgctggaagccctaaggtaattgcatctgccctgtggggaggacaggctgggaatatgtcactttcatttacctcctcccccctctctcgcccccatcccagcgatcctccctccctctctcttttttccccctcacccattcccttaaccttcgtccccttctctctcgccaccatcccaccgatcctccctccctccctcttcctttcccctcatccattcccttaacctccttccccccctctctcgccaccatcccaccgatcctc

SEQ ID NO: 3554 - DNA, 703 bp, Nannochloropsis_gaditana
gctaaacttagaataagagaacttgtttagcataagggatggtgacggatgccgtctttccctcttccgcttgtgccaccatctcaaacctgtcttggcatgacctggagatcaaaggtagcttctgaaagggggacagggagggaaagggagaggctaaagagcgaaaaagtaccatcgacgacaacaagtacggtagggagggaaggagggaaggagggagggaaggagggaaggagggagagagagcaatcacattcaggtgagatcttaagacgtttgtcaaaggtgacgtctaatctgcatgtggccacccattttctcgttgctcttctcctccctccctccctccctttctttcgtcctccttgtcaccctcctgtccccccttcctaagtttcttcttttcacccttattattatcttcctacctcctcgtaggcctgctctcgatcctctcctccgtttgcgggctcttctctcttttttttgacgggaagctaaaataataggtctccgtgggggatactacggctagtcttccctcccgccctcccctcctttccttcccctcgcccttctctcttttccctcctggaatggagggagatcgagagggcctcaaaaagaagagagggatgcataagaaaaggaaccgagacgtttttatggagttgcacgctcgatctggctcccaggggag

SEQ ID NO: 3555 - DNA, 703 bp, Nannochloropsis_gaditana
tgctataacagaaatgccaagaaatatgaagtataaaatagtgacagagttttttcgaaaaacaaattttagctggcaaactacgtgaggtaccaatattggaagagcgcacgaagagaaggtacagagtggttgttacggagaactattgcggtactaaaattggaaaagcgcacaaatagtaggtaccgagtggctagaagaaagaaaaacaggaatgaaatcattaaagtgcatcgatactggcagcaggtacggagtcgatgtggctgcagtacggcaatcggcaaagcgcattaaaagtaggcaccgccagtcgaccgttacgctcaacgtcgccacgtactacgtattagtatgggccaatgtaagtccaacaccgtggcccgattgcacttctcatcaaccataggcttccccttggtagctataaattgaagcctcgaagctttcgcatgtgtatgttcgtattatctcatgggattctcccatccattctctttctatcacctttttttccagccaggcttgggaatgtaagtggtcagattcggaagtctaagtgaagcattttaagtacatcatcgactttcgaatttgagacctataggctaataaatgtcgcgaaaaccatcatccacggcactagcacagcatgaattcaccttaccctttccgttggctcagcgcccttataaaaatg

SEQ ID NO: 3556 - DNA, 703 bp, Nannochloropsis_gaditana
gtaatgccggtataacccgaaccagctgaaccaaaccaacatcaagcaaatttgatgagtagaccgggaggtgaaataaagttcgtgataagataggagggcgcaactgccctttggcttagagcccactttttcgtttgtgtgtgtgaccaggaagcgggtcgtcagtgacaattttgacactttgcaggtctgttgcggcctcgggatgatagctgacggcaagcgaagagacatcattgctctcccgttgcattctttaaacataaccccacccacgacatgttcttatcccaccgctaacgccccagggaaggcaatggaaggtgcagaagatccaacaatgggcgacatagtcgcgtccgtcatgttgtttgacagacagacatccgtgaagcacaattcgcggggaaatgcacggcttgctgaagccgcctcggagaatgattttcaaaagggagctcaaaaagcggtggaagcgatcgcagctccaaaacttcccaaggcaaaaaaaggggcgagcgttaaaatatcctgtgatggttcggctgtagataaagaccgtggggtggatgggggggacggtggggaagggtccgtgcggccaaccaagtcaaagctagcttgtaagatatcaccagaggaagccccaaacctgaagaatgcgacaacattacggcggattgaagccttcccaacaatg

SEQ ID NO: 3557 - DNA, 703 bp, Nannochloropsis_gaditana
aagtcatgcctacgaaatcgagccaggatactacttgaagcaacacgactgctatgcccgttcggacaattgactatgtcacagagtgtctgtctgagcctaccagcactcgagctctacgacaaacaagacttgctcattttttacaagcttgtagcgcattaattattgaacaaatgccaaggagctaagaaaatagtggaaaattgagtcaaggctccaggcgcgtaaaccagacggaacaaggagagacaactcaaccgcaacaagaggaacgagaggaaaggcagtgtggtgaacaaacatgcctgcatttgtactacaagaagcattaccaaaaaggacaatttgaccctcagattcccactatcaaccgaactattcacaatgtacgtgcagggcacgtcgaatatagcaggatcggcgtccgcagataccgcagtcacgcatgttccatcggagcagtaatcggtttggtagattgcgctcttccggcagtgctgccgcagccgacacagccacggaggagcatgaaattgcttccgcctcggaaaaagtgacgattttggtatgcggtgctggtcccgtggggctgacggcggcgcttgaatgtgcacggcacgggctgcaggtcaaaataattgataaatccttgacgaaagatccccacagcaaagcttttggcattcacgcattgacgatg

SEQ ID NO: 3558 - DNA, 703 bp, Nannochloropsis_gaditana
gttcctgcgattgtgcgaccaaagtacggtatcagatgtcctatctggagatgccgattgcttcaaaggacactagtcctgctcgtcttcgttctttggcaattttctcacatttcctgcgccaatgaggttccatcggacgatgcaacagaggacagtactgccttgcccggtgcagcaggagtagggaatatcactgaccactcgagtcctagccctactgatgatgtggacgcactccctccgacccttgcaccacgcacgactcctctagaagcagacaatcctggtcctgttcctaggtccggtgcgctggattctttcacatcgaaagacagtcacaaggatcgtggaaaggacaaagataaccaagaggaggagaacgaggacgatgaggaagaagaggagaacgaggaggaggaggaggaagaggaggaggaagaggaggaggaggaggacgggggagacgcagaccaggaggaggaaagtgacgaggaggacgaggagagcgaagaagatgaagatgaaccggcatacaagcggtggcagaggcggcctgggcacacctaccaggtaggaccgaagcagtctcttgtggcccgcctcgctgccaaggtcttaaatcaaacctcctcctccgtctccctaccttcgacaaatgcaaccgtcgtagcaccatcgctggtaagagcactgaagactt

SEQ ID NO: 3559 - DNA, 703 bp, Nannochloropsis_gaditana
caacgacgcaaaagcgaatgagaggggtcggatatctcgtctagatggctcgtcctgaagccaagtagcctatacccggcatatttcccttgagactcctgcatttctcgtcagacaaagaaacggggggtgactgactttgtccctcgctgacaaggaaatgagctggcagctttgttctgaaagtgggccggaagcaaacggtaaccccacgaacctggataaccacgccccaaaaaaaaaacatacaagacaaagcccgacgaaaaaccaggtcgcagtgcaggacagggtgtcgatgtacgaaccggtgaacgtggccccccaggtgcgggtggcctggcagggagaaatcgtcgcaatgaagggtttggcagctgactcgcccgcggcagtccacgccgtcactcggacccaaaagaaacactggaacatggcctcgcgcccggtgctcgccggctgcaggtctgttggagaggaggaaaggaggagaaggggtcgtgtggtgtatcgaaggtatttggtcgtggctctggctgttattgatgacgaaactgtcataatggtgtatcgtatgtgcatatcgcgggcttcgccctgataccggcaacagattctctcccatggccctcccagacgccactagatcactgatacccccttcatcaccaacattacatgctcagatgccatattgctaatg

SEQ ID NO: 3560 - DNA, 703 bp, Nannochloropsis_gaditana
catgggagctttggactgtgtcttgatctgtctccgccggctcaccctcttcgcgtgaatcctctctcttgtccccaatacgtcctgtggtagcacttgcccttttatggccccttccaggagaaaacgcttctggtgattggacgaacccttgcatcgccttcgttgccctgtatggcgtgcgtacacgttattgtcttccatttgaaaatcatacgagaggtgaaatgaacgcaatgttgcatacaactgcctcacgcattagtttcctcgtccctcagaggcgggctttggctttggcataaaaacggcgactgggacatcgacaccccgtccgattcgagcatcacgaaatccatctcatttcctatccatgcaagacgtaaggggccatctgtttcggtcttaattgctttgcgagccttaccatcgcctcacgaacgtgggagatgggaccgcctcgaatgcgtcggcatcatcgtgtacgctcctccacgtcctcttttgcttgtgttctaggcatccttgccgcaattgtgcccacatatgaccattatgtcgatcaatgtcctgctttactcgcgcgcgatagtctgcagcctctgtcaggtggcaatgggctgtgctggagcatgcaatagtgcgtttcaacctcccccccttcgctccttcccgacacgacgtgaacgcacaggaacaaatg

SEQ ID NO: 3561 - DNA, 703 bp, Nannochloropsis_gaditana
ctaaatctcgtttatagcggatcatgtgatcaggcagatatccaccaacaggtaagctgcaaataagcacaaagagatcgacgtcattatggagtgattcactttacgggttaccaaatatcaaaagattgacaccttctcgtacgaaggaggagttctttggaatccggagaaagtacttagttagccacgacgcacgtgatttgtttcaagaaaaagagtcagaggccttttgaatcctgcgacagagttcatgtatatcaagaatcgcaaagtgtgggacgcaggacgcagtggacagtgcaacggcgtaaaagcggcaacgcctcttctcgctaactctcgggtaggaaaatcccgaggagcgctgtcgggcaagacgtgcatgcgctgctatgactctaatagcttccaaatcgcaaagcggctgacgtgacgctgagtccatcaagcacatcaatcacttatgtcttttggggatctttttccaacaaatacatttgctgcacacaggtttcaaggcggcggaggaggttggctgcgctatcctttcggacatcgttttcctgatattgcgtttctcagtttccatatgccctcgcctgatccgacaaatcaaaacccagtcaaagatgcagctctttctcaaggacaaccttctcttcgtacggcgcacaccacatggggcggctcgtacattatg

SEQ ID NO: 3562 - DNA, 703 bp, Nannochloropsis_gaditana
tacggtcgtcactttgttcgtctcgcccgaagacgcgcaagtaatttgcatggactcatttcctcttcctgtggcggctggagatcttttggaagtcaatgcaccatacgtatatttttcctcgtcatcgatccccagtccccccactccgtccacccccccttcgtcgcttatttttgcgcaaataatgccaagttttgccggcttgagttacgaaaatttctctctccacgccaaatcgtgcctcaaggcctttcacttccaattgttttcgcaagactggcacgcggctcaccaatctttgagaatcatctttcctcagcggcaacccgatagcaaggcgggaaaaaaatgccagaacgaggagcccaacgaccacaaccaacaactgcggaaagaggggaattgtaagcaacagctactctgcatctggcgcaacatggctcatctctctttacggaatcgtcgcgttgaagtcgccgagcactgtttaagctacatgggccacatccgaggtgtgcatgccgttcgagaagctgtatttagcccctctctttacccctcccttccttccttgacctcctccacgtgctctacggacattccccttgcgatggttgccatccagcttggcctgctccaggaagcagctgctctttacatccgtgcaaaacgtttcgatctcctcaatcgcatgtaccag

SEQ ID NO: 3563 - DNA, 703 bp, Nannochloropsis_gaditana
  misc_feature (307)..(695): n is a, c, g, or t
gctgtctttgctcgtgttgtcgctgctgtagttgttcctggcgcttgcgttgcttttcgaaaagctgctgcttcttcagctcgagcatttcttcccgggcgtgcaagagcgcaatccgatgtccgtccaacatgggtaagcgtcgcaagtctttttccgtcagaagaatcaattcctcgtgcaagttcaggccaagccggtcattgaagagccgtacgtacgttgtcagcaacgggtcgtccagggaccaaaactcgaacaaggtaaaaaggaagtggtggagctgggggcgggatgtggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaggag

SEQ ID NO: 3564 - DNA, 703 bp, Nannochloropsis_gaditana
gtagtgcctgattgcactccaatggggtggagcacatggcccgcccccttgaattatttgtacgcatttgtttaggtacctttcttcttctattggccagctgtactcaatcctgccgcgtgaatttcatttcatgcgtgcttctgtaccgttggttgattttttagggtcttgtggcacgttatgctgatgcttatcaatcgttccccgagtgctgagaaggattctagtatctttgctgccttgcttccacccgttcatgagtccacgcgtacgcaaaattggtgtggcaggtatcacagcatggtcatcctttgagcaacatatcattgtcatctactctagacgtccatatcactgtgtacatgtgtatggagctagaacgtcaatttcccatggccattccgagaggttggggggagagctcagacgtgtcctcgaccggtccgtgacttgaaggccaagaaacgatccagtttttggataagttacacttgtacggtcatatatctatccatccgtgttacaaaacacggtcaagcgtttttatggattgacgcgcacgaaaagacaccctgatagccttgaatggcggggcccatctccaccacccaaagctgcccacagcctcatccctttttctcgcgctttcatccgacacaccagcatacttccacagacataagctttcatctcaagcatg

SEQ ID NO: 3565 - DNA, 703 bp, Nannochloropsis_gaditana
caccataggggtgccctctggccacatcatgcgcagggggccgcgccagggcagtatctcattcgttccacttcgcgcgtctccagcgccggtcacgtccaccgcggagggcgaggaggggggacttggagggcccgtgaattgtcgcatgacggaattcatgacccagaccattgtcatggtttttaggacttgctgtataagaccttgccagtcaatttgaggccctccgtgtctgggagcatttggcccctcggcgccacgagcagtggccgcacctatttcagccattcttgctgtatagctatttaaaaaccaaggaaagagacagaaaggggacaaaaagaggcgttagacttgttcggaggcacttgataaagcacttgaaaaggcagggcggaagccagttacggtgtcggcacgtgttttgacagcccttttcacgaaaattgcacatgctgttacgcgtcctggcggccaaaagcgtggacttttggacagtgatagccgagtcaaggtatcactagcctgtcgcctagtgcttcttcagcgacagcacacgggaaattgaaaatgggaaagggattaaagcccacaccaggagtggaaaaaagccgcaccaccgcatcactatcttttgtttgccatggttttccatctgtatgtgacgcttttgccatgacccattccttgcacattaaga

SEQ ID NO: 3566 - DNA, 703 bp, Nannochloropsis_gaditana
acgagttccatatatgtagacaatgaatggaatttcggactttaaaatatgctgtttgtgcgcaactgtctgcggcccacaagaaaggcaagtagtctctgtgcgtgcgtctttccttcaaaagcaacgagcgccagagagagagagagagaggcccatactcggtccagccgcgagagcgctccgccgacacccgtgtcgatgtggcacaaccctcatgaatgcagtgagtggccttcaatgcagccacaaaagtatggttgcgggtatcttggttgtttcgaaagtgtcgtttcttttcaaagaattattgacgtcaaagcagggggcccacaggcgtggaaggcgggaagacgggttgaagggggggcacgagaaacaccccttgaaggaaagatggacgagaaacatcatcacagagagagtctccgggacgagaaacacccgccgcccgaacgtgagaaaaggcaaagctaggcctcccctcgtccatgcccaggtttgtgattttttccacttcgtagcacgtttcgcgaaagggagtgttacacgtgtacaaaataccatactttcggatgtgttgcttatcattgagcctctatcgttgacttacaccaaatagggatcatcgcttcattcacgtaggcaaagcactttttcttgttcatcttctccgcaaccaaagtcaccaaagcaaactatg

SEQ ID NO: 3567 - DNA, 703 bp, Nannochloropsis_gaditana
atgttcatcaaatatgactttttaaaactgggccatacagaacccggaacgtactagcaaatgctcatcgcacgatgattggggattcatggcgtgtgatcatgacacttgaaaacaatgcacgcgcgatttgatatatcttatgacgggctcaatttcttattcgaaattttgggatgtagtaaggatacatatacacagcttcggcagcaacgaaaatcaagcccttggatggaatgcaatgagtgaatcgggcacacctgccgttccagcgacagataggtcccaaagtgatattcaatgcccagctaggcctcctttcgcgttgtctatctcggactgcaggcaggcccatgagaaagatcctgcaaggcgcttgtcctcgacactttccacggtaaaccatgaagctgaacaataccttaaaaacgaacgccagggcgtgactatccggccgacgtgctgcgaaagactcaaacaatgggcgaccaccgtggttgatgtacgcattccctccattccaatttcgcattggttacccaagtacaattttcgacggcagcttgttgacgatttgaacgcaggtttagcgtgtgcaatcaccttgattcctcagggaatggcatatggagcccaattaggtgttcctgtcattcatggcctttactcagcgatatttttcgggctggtgtatgctttcatg

SEQ ID NO: 3568 - DNA, 703 bp, Nannochloropsis_gaditana
cttgatggccgcttcggcgatagacgtgggatcgcctgtgctctcagacagtaaaagcaggctgattgccgtcctccatttcacattcctggtggggttcttgcaattgggcttcggtgtttttcggatgggagctatcgtgcactacgtctcggaacctgtcttgacggcatgcagcagcgtcggcatcgtcatcacggtcatctcccagctaaaatacatgctggggataaatgtgccatcctttcgatacaccttccagacgctcaggtacatcactttccacctctcttccacaaacccttgggaactcctgatcggcatccccgttttggtccttgtctccggcgtcgcggcttggaagaaacgtccgcccacgggcaccaactgggaccggttcggccgccgcctggccatcgccttgcccctcctcgtagttctctactccaccatcctggcttaccacttgtacgagcgacaccacctgcccatcaaactggtaggtcgcctccccacaggctttcaaaccttccccgcctgggatctccgccagggggatctctccaggtatgccacttccggcttgaccgttgccgtcgtctccttcctcctctcctattcctgtcaaaagtcttacgcccacaaaggccggtacgaggtcggggtcgaccaggaactcagtgccttaggtctgagtaacatg

SEQ ID NO: 3569 - DNA, 703 bp, Nannochloropsis_gaditana
acgaatttgaaaacattgaaaatgaatatctcagtgctgaggtggaaagcacaagcgaatgagcccgaacgacggagttctggcggggtccccaaattgcggttctgcatcgaactaaattttgactcgcaagcctacgaagggcacgacaggcgataagagtaattcataccctccatagaaatcgcttattgttttggaaaatacatttttggtctggacaagagagactcaggttctaacgctcgggaaaactcgccttctccacagtagaaccgctcctcagattcacgctagatgtggctcatgttgatgcatcctgctggaactctagccgacattattttcgaggctttaaaacaagaagtacagtatttcctttggtaaagagcgtcgtaagaaagtctttgtcatagaagacatggtcaattagaagaaggttcggttttcgctcaacgcatccatggccctcttctacgagtaatggaaaatgtgtcgggtcacttccttggacaaagatcgagcgaaacttgtaaggtcactaatgactttatcttgcgtttgtattgcaaactatatcctggtcgtgtagccgggaattgtggtcgagctgagttctgtctcgtgttcaggtgccccaacattacccgatcatgtctcagttctgttcattcctcaatctccatgcagagcacaaagcatg

SEQ ID NO: 3570 - DNA, 703 bp, Nannochloropsis_gaditana
caacgtgacgaggaacgttcgtgcacccgtggaccgggagacacgagaaaggccgtcgttgtagtaaccatgcaggctttcagaagcatcccagcgatgccggccatggtggcgcggtgcatcttgtttaatgcatttaatggataaggggggtggggaggttggttgcagggcaaactttgtctgcaatgagttgacaggcccaaagatgtcgcactctacacaactattctatccgtggacactcaatatggatctcccatcaaaggacagctttaccttatttttcgcgtgaaataaaaaaagatttgtccagctcttttccatcggcttggtggatcgctcactcagaatagcacgctgtgcccgagcgatagtccattttagtattgctttatgggtggggtgggctcagtttaaccctcgcgactatactcactcgttacatacacgtccatgacgtacctctttggcgtggtgcctcgctccacagagtcagatgtggacttctccatgtcttacctgctgtcttcaatttttataccctcccacgttgtccacttcagaagccgacatcagcctctttatgtgtggccgggcccgttgttcttgctcaatatctgctgtggccaccacatacggcgttcctggagggcgcatatacagagcagatcgttttcggccccggcataacctgcaccca

SEQ ID NO: 3571 - DNA, 703 bp, Nannochloropsis_gaditana
cggaatacagggtgacctacgacaatttaagtatgtgttgacagcggtgagtcattgattatgatttaaaacattgtcaagcttttaaaatgtggctttaatgagattggtactcggtagtctatgatccctaatacgagaaacagatcggaagtgtcgatatgatatgaaaccttgcgtagcacttaccgtagagattgtgcacaacttttcataaccatctagatgtaagttcttagagctaaggaggatcaaggcgtctgatttaaagaggaagaaaaagaactggtcagaaatggaagaagaaccgagtagacgtatagttgaaatctcatagagaacacttagcgcaacgatgcttgcctcatggagagaaccacatcaattaaaccctcctatctggttaaaagcggattttcatagcccctttatgatggcagtagagctccataggtgtgtaaagcgctcgcacgccataagataggtgacgaaacgacgccgtttccgttactcctccgcctaaactttttttaaaattcaaatcctgattccaccgagtcagtgacagggaggtatcttgactatggaagtggtctgtgccgttaacgcaaggccataatcgcgtaccctacatgcactagtacacagagtgttggcacatagagtgtggcacccccctctcactcggtacttgttatttatg

SEQ ID NO: 3572 - DNA, 703 bp, Nannochloropsis_gaditana
caaggccataatcgcgtaccctacatgcactagtacacagagtgttggcacatagagtgtggcacccccctctcactcggtacttgttatttatgcctcctcccgccggtctcctggcttgcttcctcatcatagtcatcatggcaagctcaaggtttgctcatgcttttgctgctgcaaccaaacctcaaccgaaggttcgtgattagattttcattgttcggacaagtcctcttatgtcaagagggttccatgcaagataatcttcgcttttgtgatgcattcgttgctctcgattctatcctaatccataacgctctcgaaattaccttctcaggttcgtttatggaatagcggtacctgtccttatgctcaacgcgcctggttggctcttcttgagaaaggcgtagaatttgagcataagatcgtggacctccaaaataagccggaagatttcgtcgaattgtatgcctcgctgcaccctgatccgagcgccagggctaaggtgcctattttagagcactgtacccgggatcttgaagaggaagtcccgccacccactccctccacctttcctactgtttcgtctctttacgacgtccaagtcatcgaatccaacgtgtgtgccgagtacatcgccgaggccttccccgaccagggccactccctgcttcccacccgaccacctgacaaggcgaacatg

SEQ ID NO: 3573 - DNA, 703 bp, Nannochloropsis_gaditana
tttccttccctacattccatttcactcgccattaatcttctttccctcctgcctccgcgcctcctcctctttttccctgacaacgaccccgagacactcccgagtcttcttcctcgactcatttcacccccacccgtccccttccctcccttcctcaggctatccttggctggccaccctacttctacttggcctctggatgctcctgtccttgaccttggtcaaagagcaggacctcggccgccgcctgctggggtcgggggggaggaatgggaaaaagcacaacggagggcgaggagagcggcggagaaagtcgaagggagagagggaggaagaagagatagaggaggagggagaggaggaggaggaggctttaaacggcgggaaggaaaagagagcggaaggtccgggtagtttgaccggcaaggaggtaggaacggagggagggagagggaaggggaggacggaggaatttaggcctgcgcaatcgagcaccaccctcactccctgtttcgtttcttcctttcttccttcctaggtcaccgtgggtgtggtgcaagaaatagtggacatggtcttcttcgtttccttcctcccactcttgtatttgatacgacaatgggttttctagcccgcctctcagaccaggacaaaagttaggaaagtcatcaaatggagacgccgtgtagcaagcttatgtatg

SEQ ID NO: 3574 - DNA, 703 bp, Nannochloropsis_gaditana
agtttagaacggattaagacagtgtcattatactaggcgcatccgctgtccaatcatcgcatgggctgcgggtgccgttgccgatcacatcagtgacgcgactgcactcgctcggccaggcgttgccctcccatcgccccagaccggatctctttgcaacactgaagtcgacaaattgcgcaaagcattgaaagcgggtaattcttacgagggttgaatactttgggaggcgtttaactgtggtccaggtctcctgagtggacatcgacctcatgcctgactttggctttcaggtcaacccgcttgggaggaggttcttgcgtccatgtcatctcctttggactgtcacattcgtaggaacgggaacggtccaccaagagacggcatgtatatatagctgtgaaggataggtgcaactttggatgatgatgttgtcattgagactcaaagtgatgactctttatgtattgagttgctgtagactccagtatgcctaccttcaaccccgtttgctgctcgtcggcccctttcctagagtttcttttgaatttgatgaatcatttctcgacatttgtctattcatacacaataattctagccataggcgtcagcatagccttttgacttccaagaccgcagcagttgacttgattccccttcggaagatcgtgattcaaagctttcaagagtctagtacagcatg

SEQ ID NO: 3575 - DNA, 703 bp, Nannochloropsis_gaditana
ggaaggcaagaccactagagccggaaagtccgtgtggaaatgaagcatgatcccgatcgcttgaagcgtttttcccaggcccatttcatcagccagcagcacgcggccttgagctttgattccaaaagcaatgccatctcgttggaagggcataagccgtcggtagaattgatcactcaacaagctggagcgaaacgcgtccgagttgggctctccgcccgacgcaggtggtacggacatattgaaggcctaccgaagtcgtgattcttgaaaaatgggagccacagagcgtctttgctgtgacatttatgggctagcacgaggcggcatgtcccttgctcagaaagtaaactggttcagagggaagcaagcaggggaggttgactgacgaaaaactgggtacatgcatcgactagagaccactgacacgacaatatttattaaaacagccaggattgtgaattgtgctcatacatcgatcttgatatcgtggttatcggcctcattttccttttttttttggcgacgctgcaaaagcatcatttatccccggctggcgagtagcggagtcaccagagaggtcgcccctgaaacaggtcttattacctcatctcagtccaagcacgcccttcccgtccacagtcttctttcgagaaatttttggctacatcagctagcgaaaaaggcatttgaacgtctcatg

SEQ ID NO: 3576 - DNA, 703 bp, Nannochloropsis_gaditana
ggcgatcattgcagccaatagccgtggaggacatgggggatgacacgcgaggaatgaggttgggaaggtgctggtactgtcccacgtgccgggaggcaaatgcaaaggacgcgacggtcggaagaccaaatacggcggttgcggcaacagcagtgacagtaattctgcgtttattctggcaacgtcgaagaagcgcggctgaataaggcagtgacataccagtcctatgaatggctgctgctgtagggaggctgccggtgatagattcgtaataccgaggagttgacgggttattatgctcgtgcaagtcgattcattctggcttcaaaccgatgaacttttgtaaaatatcgaatggaagattttctgtagcgggcaaagtacatttgatgttgagcgtcttgttaatattttttccttcctcccaaaaaaccaaaacatgtcgccaatgctccccagccgtttcctctaactaacaagcatgacatgcattcgacataggcagcgtgcgccttaccgtacacgacaaagtgctctcctccctcttcaatatttgcacaacatcgcctttgcaatttattggcaatcgtctactgaatcttaccgccgtcccgcgtattttttggctgcaggctttctatttatgctggtgccgccctaccacggtatctgtcctgttgctgcacagtcgtaaccttaaatg

SEQ ID NO: 3577 - DNA, 703 bp, Nannochloropsis_gaditana
tttggtaagcacccaaccacggttctgtcatgcttcaaccccggggctctggtagtgtgaaggtgactaagcgggttagtcaccgggaaaaaggttgaaacaagtgccttgtctgtttttcgtgttcctgggagagtgttttcagcgggggggccgtcgaggcaagcgatcgcttcgcttcctcgtgcagagcgcatgttcccgctacttcgactttgtcaacatctctgaggggactttccccccgatgtaggacagtagtatcctgcatgactttcactagaccatgtagacagttgttgattcaggtcgaaatcgtgaggtgttttttgagtcacaggaaacgatggtagacctccccactcccgtcggcgttcaagcaggatattccgtctgatacttgttgcaatgtccgcttatatcgtgccaacaccagatgcagaacccttctgagttgatcatacatttttgaatcttaaacgttgttagagagtttttgtagggggctctgtggccttatcgttggattattttgcatgtaaaaacctgcctcggtcctctgccgtcgcccctccttcaagcttcctcccagccgatgtgagagcgtagaaagctttgggaaaatcacaaattcattcgtggtccgcggccaacgcttacgcttccgtgcattttaagacaggtcctgccagagtttgggatg

SEQ ID NO: 3578 - DNA, 703 bp, Nannochloropsis_gaditana
gggaaagggagatggacagaggggaggagggaggtcagagggcaagggggggagcgataaaggaaaaaataacaaaattaatgagcgaagggaagcacattggtaagagaagggacgtcaaagaagggggcatgaaatgcgtggctttaaagcgtcactcgacctgtaggatctggagccggtggggagggtttacggtggaggaaggtgcctcgccatgcatttgctgcgatattgctccacccgtgcacagaacctggctataccagccctatgaggtcttgtcgtcttatatacgcaggtgtgggcgcttttcccactgcaaccaagtcgaaagaggcggtcctgtgggccgtggctggataagttccaagaaggagaaataacagcaataagtcgccacaccacatcctctcaatctcctttccatgcataaaataccctgcacccaccactccaacacatttccaatttacgggggcccctcgtggtcctttttcacgactttctgggcaggtttcaattgcttttcagaaacctcgctgatatatagccccctcctgcctcgtcccaaccggcgactcaccacgacgtgtttatccacaacatccctcaccccactcgtcccgcgacgtccgttaccttgttaggaacggcactcacacgctcatgttccatgcacacgacacctggcagggcgatg

SEQ ID NO: 3579 - DNA, 703 bp, Nannochloropsis_gaditana
ggaggagggaagggggggaggaggtgcggccgggtcggggaagtcacgctcgtccagacccttggccccgaagacttgggcgcggttcacgatgcctttcttcatcaagatgtcctgggtgcggggagaaggcgcaggaaagaatggcattgtatgagtgtggtggggagagggcttggaattgagaacacttcgggcccgaggaaagggcctctgaatacagacaaattaggcaacaacattggctaacttgcgaagatatcattagtataggactagccatgtcgactgtaggcaaggacacgatcagcgaccccaaacactgcgcaggcgccggtcttttctccctgtgggggcacgctcatcccctcctcctcctcctcgccccttgccctgttgctcacctcccactccgtggtttcccccgagtacgcgtacgacgtggcgccccggtcgcccattcttgtgtctgtcctgtcctagtgctgtgtgtgagtgcccgtgggtgttagtatacattgccggcggtgggaaaggagatgaatttggagccgcccctcacagagaacgacatgttcctggagagtctcctcgctaacctcgtgcccccctccggacgatatttcgcccgaagccacgcaccctattgacgtgtgacgcccgcacgtgttcactcaccgcgctatctcacacgtcccagatg

SEQ ID NO: 3580 - DNA, 703 bp, Nannochloropsis_gaditana
ctgccattctcaagcaggcaaagaaaaaagactttcgtggctaatttcgaggaccatcatcatgctacgccctctcttgctcctcccgcctcactcgcggtctccacgggcatcaacggcacttttccgccgactccaagattatcacacctatcgatgtccctctcccttcgggctttctctggggatggccacatctggagaattgtcttctctctcggtacaaaagaatcttcgtccagcgccggcctccttcctcttgtcaggacgaaggcgggccttttccatgcctcctggtggaggcagttcctgggtgagcccagatgcagtgcccaaaggagaaaatttaaagaaatacagtcgaaatctgacaaaagaagcgatggatgggaaattagacccggtgagcagggcagatgggttggcggtgccgaaagcgtcttgttcatgtcgctctcttgatcaaaggctctgtcttgtgtcttaattccacgtctcgagcgggagtgaattgccttccttctttctctccacaacgatattctccggtgttgtctcgtgtcatttttcccgggccctggcgtccggtccgggttcgtttccccatggtatccattcacactgcctgcccctcagcccctttctctgtcgcccggcccgtgaccgaccttcccatcaatttattgacactgccttttaggtg

SEQ ID NO: 3581 - DNA, 396 bp, Nannochloropsis_gaditana
tgacaatacattgccttcctgcacgacaacaatatactgcatgtctacgtgttgacgacacatatgtgtgtatatatatctatacatatatgtgtagatatatctatacatatattgcctgtctacgtgttgaccatatattgcattcctctaagttgctcctgaaagaaatgccgctgcatccgctgtgtcgaagggaaaagaaggcgtcccacccatccgtttccccgcgccaccgacaggatctcgaaccagacctcgtcctcccccccgcctttcctcccgcctttcctccccctccctcttggataccatatcaccctcatcctctcctcgcccgcgatcaaatgccgtccgacggtcgtgtaggcaacagatcggaagagcacacgtctg

SEQ ID NO: 3582 - DNA, 703 bp, Nannochloropsis_gaditana
aaaagtgacaacaagttcattaaacaaagtaataatggttgtagtgaaaaggagggggggggattgaatcggtatacagaagaagtcatctctcgtataattgctggctcacagcaaattttaccacataagcgtcgaacatgaaatcatgtgttattttcccatcccctcctcgagtggatcatacgtagaatacgataacaattttaaggagtcgatttaatcctccattggaactaaaagtagacccactatccacttttcaaaaattttccgacgaaagccgtcacgcaatctcaaacaaatgctgtctgtccatttttgctgcattatgttcccatcgaaaactaccacgcacttctaaggaagcagcgacgaccgagaacttcaatctcccggcctaaggtaattcgccgccgcgtctgaactcacgcccacagagacattcaataataccatgtttatccctttgtattgattcgcatagctcttgatttgaaagatgctcggtgtgaagccagagtaaagtatttctccacatacgtatcaacctcccccctttgctataaccaatatactgctccaagcattgcaccacttatgacaacgagcaaagctgttgctgccgctgctggctccgttgctagcacacgggatcatggcattctacttcgttctctttatcgcgcgatgagcagacatg

SEQ ID NO: 3583 - DNA, 703 bp, Nannochloropsis_gaditana
ggacgtgttcaattgcaggacggatgacggtaaaatttggtgattaaatcaagtttttagtctccataaatatttccgtcaacactttgtcatttgtacagggcaattcaaggctttttaaaaaaatgcatttcacttcggactgggcgaaagagctcgagcgagctcccgacctgcattgatgccaaggctttcacactttcaatagctgatagacatggcatccgtgtttaacgacctttcccacacagaaaagaagcatttaagaatgcacgcttcaaatttcacgtcggaaggcgagtggcccgctattcttcagaggaggtggagacgttagagagagggacctaaaacatcacatacacgaatcatcacagtcatcatcacaagaagggaaatacacggggtacctaaaccatcatatacactaatcattgccctcgtagacaacgagtcgtactcttgctggcttgaggccttgagaacccaggtccctctatctcgaggatgtgctgtttaacatgtgcgaagaagtctccatgagattcaatgcttgattggagagtagcaccgcagggatcgttttaaatacatcctcggattgctatggagtgctcaacctccgctaagcactaaataaccctaattttcattcctgtttctctcaccatacgtcaactcacgaagcagtgagctaatcatg

SEQ ID NO: 3584 - DNA, 703 bp, Nannochloropsis_gaditana
tcccggcgatgggtacagaggtatgaccatgagcattatagaagaaaaggcgaagatataaaagacacgcaaaaaaggaactaatgaaaatttacaatatagatgaggtgaacagcacatacgtgagcttcttatcgacccgcatcccaccgtcgcgacttaatttttacaatttgagattgtcaatgtgtgatgcagaaaatatcaaatcttgatgtcatctccgagatagaaaatgtggatcgagttcccgaatttaaaatttatcccccagaaaggaggcgactgaagtttcaaagggtttcacgtggccgttatggtgcgatagcctcttcgaaggggatgctgaacgagagggacacacgtgattaaagccctctatgttcatgatatttctgccatatagtcatgttgactctgaatttgacgttttaaatccattttcagtccgttttaatgatagcggggggtggggaggttagatgtgcgatacggaggagagcaagggtgttggtcgatgtcgcctctgcctttattaaaaatgcaaattcaagtctgctatgctttcattcgatgtaaaaacattatcaatgtaatgtgaattgaaaacgcatgctcgcagcctgacagcttggcgtatatcttgttttttttctcatggtatgtaggattacggggacctgttgttgcggcacccaggatg

SEQ ID NO: 3585 - DNA, 703 bp, Nannochloropsis_gaditana
gctgttgcctgttggccagcgtaatagatcagagcacaggtacgtggcaataaacgagtatgcctgaagctccttgataaagtttgtatgcatgcttttagggtagcaagaacgcttgtgatactcgttttctcccaccgatgtcgctgcgcccacttaatatctcctggcccgaccttaggtgcccttcctccctctctcttcgctgtctgtcctctgacctcgctgttgtttccgtatttttctatgaaccaatacaggagcaggagaaagaacaaggaggagcttttcatcggcagcatttgcgccaccaatacggccgacttcctcccctgttcctccgccctcccagccctcctccgccactccctccacccccccctcgtcccccatcgtctctagcgcaggcgcttccacttcaagaagaggcgaaagaagatccttcatgtcttcttccacgctggcgttgagccctcctgtctcctctaccaccaccagcagtaccagtagcagcagtagcaccgtcagtagcagcggcagcagcagtcctgtgttggagcctgagcaggccatcgccttatctgcccaagtggacggaccgatctcatcccagccttctccgtcctcctccctctcctccccccccgccccttcctctccctccaccgcttcctcctcttcaccctccgcccctcccaccatg

SEQ ID NO: 3586 - DNA, 703 bp, Nannochloropsis_gaditana
cgttcgaagccaatcatcgtataatcatcgagcttcgcacgtcctacaaggtaagaaggaggggaggttggtgctcctgctgtagttgtcgcagcgactagcagacgaattttgaagaaattactgactcaagctacggaattaaaataccccgcctacctctgattcgcatcccaacatagactagtgacaagcagcgtcaacctgcagtcgccaaagaactcgcaggccgcactaaagcgagggcgggggggagggtctggccccggtccgcggggacagacatgtgtgcctcaaaccccccatcgccatccactcctttaccttcggcctcccggggcttgatctcgagtgcagggtcgtgggtttcttacgggaataatgggatgaccatctgagatgcttttttgggggacagagtgagacataggacggaggaaggagcgtcgaggggtagatggacggctggaaaggctccagactgtcctccccttcgttgtcttcttcttgggcggagcgcccaccatcttgtccttgtggttcgtcaatattcgcagacgtcgtcgtgagatttgtgcactgctctggatgaacgtgcctcgttttcaaggacgagactgcaatggtcattaaaagagcgtggggagctccacctcatgaccctttttctcctccctcccctccattcccctaaggcaggatg

SEQ ID NO: 3587 - DNA, 703 bp, Nannochloropsis_gaditana
gccccctaactgaaggtttgattatgattttggtggtaaagggttttcgtgactaaggtttaggcgcatggtatggctggcgggatctctttatttaggctgggagggtacgtcccaagtggtgatggcggtgttctgaagcgataggatctcggagaaagacagcgtatgacacgcagcctgcttcaatgccttaatttagaaagagcgtgtgggcgactggcgttgagttggtgaggatattttttggtcattttttgggggcggaaaaaggccttcgttggaaaggctcttgacacttcctccgggaagcgctcacattgatcctccgaatgcagaaagttccatttcgtcgtgaggatacagctgtcccaccggtttctgtcactcttgtcgttgcaagcactttttccatgggcgacgtgtccccattttcttgttattgcgatgaacacaagatcgattacttggctgagagaccgcgcatgcttcgcctttggcatagagatgactgtagagggatggacgatggtcgatgagctagtgctagccgaagtgcaacttgccaaaagctactggtatcatgcagaccgtccagagcttgttgacccatgcttttcttaaatgacactatttctactcttcacagcgagtcagaaccctacttaacgtaagtgaaaagggcagcacgatcacgcacatg

SEQ ID NO: 3588 - DNA, 703 bp, Nannochloropsis_gaditana
gggcagcacgatcacgcacatgctgctgtacgacgatctctgcaataaactcgaggtatgttataatgcaagagcaaggagggcggtggggtcgtctccgtacctggcttaaatgatcacgtccttttcttacgctcccacacaccttcagactgctttgaaattccgcagaggcacgctgtgaaacagggcggaaaccagcgcaccgtctattcatctgtcgtcactgggattgccgctgtcttcactagcatcccatcgagatcctggaccccacagccccgtcatcctggcgaacatcccctggacctaccacgcccctcaaggttcctcagccccgccctccccccttccccgccctacttctaccaccgccagccctgtccctggccgagatggtgcgagagtgggacacgacggggttgcacgagcgtcggctgccgccccagacccttctggtctccacagccagcgccttgtggaccggcgtatgagcgggagcaatgccttgtggaccggcgcaccatctgcaccattatcgtcgccacgtgaccacaccacgacggcagcttccacccggtgtggccgtgcttgtaacaaggaaccctggttcttgctggaggaagctctgaggccagcaggagcccgtcctccggccaatgagtcccatcgcaatgctgtgctcaggcggcattcctccatg

SEQ ID NO: 3589 - DNA, 703 bp, Nannochloropsis_gaditana
ttgcatggcccaggggggtgcttgttgaggttggcttcaggcttgtctctcgcttctcgcgattttcgtgccaacccctgggaccctcccccgtggggttctaggagaaatttccatggaaaagcgtggatgcaaggcaaaagatgcctcgcaggttggtaacgtggggagaaatgtgccgaccgcgaaggttgtggaaagtgaagggcgttgatgggttttttccaagctgtgtcatatcggtcttctcgtgccgcgtcgggagatctgatcgcttgcacagcgaccttagcaagtattcctgtttctgaaaatcaaaaatcgctcgcgaaatggcaaagccttaccccattcctacatcaatgtgaggaaattatgtctatggttggattgattttcatgttgtagcaaacgtggcgcttatcggtggtataggatccccccaaccagcctcctcatctccttgacctgagtgggcctgagaaatagcagtcgttttttttttccccaaaccactgtccaagttttacatggcaaggatgactaactcgcgtatctttttcaccgaaattgaggggtgtaagccaagtactttcgaccacatgctacctgggagcgcgtcatacttaccttggaccaccctgattttccctccatttttctttttaggaccagtccggccccttcccccccttttgtcatg

SEQ ID NO: 3590 - DNA, 703 bp, Nannochloropsis_gaditana
tgaaagggcatcggagagacgagtggacggaggaggaggtatggttgggaaggcattgatgaaaagaatctgggaaaacaggatcaataaccaacaggaatgagcaggtagacgtgatgataaccataaaatatttttcgaatgcgtgcctgtccgttggcgtatcatgccctcctgttatcgtgaaaaagaggaatatggtgtcaggagattacattagcatgagcaatgaaacttgtgaaatagataatacttgatttgattggcctggagagtatctgtgatattcaagcccggcaataatgtttggaaaatagtgaaaaatagggctgggcggagcgtactttgacacccacagatatcattttggcctgcgctgacaggggataggaataaaagtagcatgacacattagcttgacttaatgggaggttcgcgctcgacacctatattttttctatctaaatttcgaagacttaattgagctggcgaggttgtacagcaggagataagcacaggaggcaagaggcgtgctcaagtgaaagactgtggacgggacatatttcctcttgctccctcacttccatcatccccgccggcaaattcggtcatataattgcgctcacacatatacctcgaaacccatctatcacacgtccgtcgcagcagccgcgtgaatagcccctttgcggagcgtggtatg

SEQ ID NO: 3591 - DNA, 703 bp, Nannochloropsis_gaditana
taccaaaaccaagctggttgtggtggacgaggtcattaaaattggcaagcagggtagcggtgaaaagacggagcgtaaggaaagggtgggaggtctgattccgtgtcgagtgctgctttcctaatggcgcattttgaatttctgcagtgcagaaaatgtcatctcataaagccacctgagagaaaaaatgtttttaagccacataattcatggaacgaaaagaaatgcgtgggggaaatgttggagtacggcagctttcacctttcgggcacgtttttcgtggcactctctgttgtcttggcgattcgcgtgcgatgacattggtaagtgacaaaaccaggtgtcgtacatccgtcccatcggtggtgccgtgaaacatggctgcgtgagcgcacagaaagaccccttttgagctttaagcttttcatgtccagcgaaacgaagggatatatgagtttttggccagagcacgcgcgtcgacattccaggcccatacaacgtccaccactgtcacaagtattacgtctgtgcccgtgtgcttcgcgtaaaaatctcgggcatcacaccgtctggacaccagaggtgtagaaaagggcttggattgttctgtgaaaggtatcatggagccttcgactgtatttactcgtcctttattcaaatgcagaaccacccccagacaggaaactttggtatcggtagaatg

SEQ ID NO: 3592 - DNA, 703 bp, Nannochloropsis_gaditana
atttgctcttgaccactaaatcgactttccgcagcattcaacactacgtcttgatagaaatgatgatgaagaactgctcgtcagtccaggttgtgcttggagagtggttcttttcttgcagggcaagatgggatggttgcagcagtctcgcgcgtcgaggcttcaacttgccatttattttccgcctttcttaaagtcatacttatgtgttgtttttgtttcagttagtgcggcacagtctttctagagtagagtatcgggtggtcagacgtgcatcgtgaccttttgcacgccctcgcgcgcttgttttacaggtaagtcttacaactggcagaatatgctcctggtagttagccgaagggcctccaggctacaatgtagaataagcattagaccgcgattcaaatgagatccaccagcatcaatcaagctgtaaggtgcacatacgttgctgatatcatactgaaggcgcttcatgggcggacttgaccgtgtgtttatttataggactgcgtctggcattagagcaggcaatcaaagggaccatgttcgccaacccagtgcgtctccatttctgtgctaatagccagattgagtgtgaatttccattgaccataaatcttggctgcgattcctgtactttttgctaaagtgccgttcataattttacccgtcaccctcccctcctttctcaggcgcaatg

SEQ ID NO: 3593 - DNA, 703 bp, Nannochloropsis_gaditana
  misc_feature (393)..(402): n is a, c, g, or t
aagaggggtagacgctggagggaggcgaagggcaaggacggtctcatacttccttttttcctccctccctctgtccctgtctgcctttcccagcaacaacagcgcctggaaccaacgatggttcgtcgtgcacacccacgagctctctccttaccatctggagagggaggacgggaggggtggagggaaagcggatgccattcgggagcgggagatggcatacgcatgggattccgtactggaggagggagccggcctggcggggggcgggggcggggaaggaaaggaaggtagactaggagataatgagagtgcttggatgtatttacgcggatacctgagggaaacggggtaccgagcatcgggctggcgggagcggcttgtgaacgcggnnnnnnnnnnaaggggaggaagaagcgggaggggaggaaaaaaatgagacatacgtggctgcatgcaggacgctgagtcttccacctcctcctccccttccttctccattctagctgctcatctctacgagtacacgctcctccttcctcctccttcctctccctcctcctcctcctccccctcctcctcctcctcctcctcctcctgcctcctcgcccactcccgcctcatccccgcctcccacgacccgcgactgtgggagttcccacaaatcaaccagaaaaaggcgggaaggaagagcaggtttatg

SEQ ID NO: 3594 - DNA, 703 bp, Nannochloropsis_gaditana
gaacaccaggtcaaagccaagtaagaacgtggatgaaagaacaaacgttggcattccgtttgaccaacatctcacataacaccgcaaaaaaagggcgaggcgacgtctcagggtgtcatttgataagaaaagggtgtttgccgtgtgacacgcgaaagatcgactttttacgcgtcactgcagcggccaggtgtcctcttcttcccttcgaggccttcacgcacaacacttgtcgatggaaattctccatattatacacagaaggcgcacatgccggtgtcaatttcctttgtcctgggttttggtgcttggcgagggtagggggaaaaagcacgatcgggtttggacagcgagtctccgccctacggcattgtgtatgccgtcgtccgcgcgttcacgcgggcatcttttgtcacaatgctcccatagatgacctgtgctgtgtttcatggaattgtagttgccgtggtatatctagcttggcgtcttggttacgttctgtggctattattgacataccgtccccgaatttgtgctacaggtgccaggccgcctctgaatctgcaagttgtacagtcttgtaacgccttactgcgcatgataataccgatttcgatcctcgtttttcatttcatttaagaccggatctactctattgcggaaagcaagcaacgattaaattttgtagagtgctttggagatg

SEQ ID NO: 3595 - DNA, 703 bp, Nannochloropsis_gaditana; identical to SEQ ID NO: 84

SEQ ID NO: 3596 - DNA, 703 bp, Nannochloropsis_gaditana
  misc_feature (1)..(695): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagggt

SEQ ID NO: 3597 - DNA, 703 bp, Nannochloropsis_gaditana
ggacaggaaaagtgtcaaaatggtaacccaactagggagagagtcggtcgggagggtgatggcaacgtatctgcattccaggtagaggacggagatagcactggaagtcagtacgagagcgatgaggaggattacagcgatctccatgtaaacacgaatcgcctggccaaggcacatttgtacgtcgatgatgatgaggaggaagaagaggcggaggcggataaattcgatgaaggggtggagtaagttgctagagtcaaggaggaacgcgtaagtttccctcctcccacaacaatgtacatattggaacacggctataaagtactgtgcagtgacaagagtactgaatgaaattggaactctcaatggcggaagtttaagttcttcttgcatttttttccttccctccgggtcgtgcggctcggaacgctctcaacgtgtcggcttcctacgctccactttcctctcccttccaagtacttaacgcattgtacgctgtcctgcatcatcaaagcttctcgtggcccttgtatcaagagggatgccacggaagtgtgtcattcaggtgtcgtgcgaaggtgcaagaacctcaaacttacctgacacggcggtcgctggctaccatcaaacttccgtattcctctcccctaggagacctcaactcaatcgtgttaccatgtcatctgatttccccgtcgttaac

SEQ ID NO: 3598 - DNA, 703 bp, Nannochloropsis_gaditana
gtggccctgaatgatggcaggagaaacttgaatcgggagtgctcgtcgtctttgtaagacctggctcaaaagcagcatcaaaataaggagcggaaggcacaggcggggaacaccgctttcgcccctggccaggaatccgtcggcctggcgtatccattctacaccctttctgccccttgaagtatgaaaagaagaatgaacgtgtggataatgctggtgtgggagggagaactcaacgatagtaactccatgtatgtccaaggctttcggtcagatggaacgtaagaaggacggggaggaaagactagataatgaatgatccgaaggtcgttatcacatccaagtctcctcctgtacaacacacaactccaacagccttcacggtcttgccgtgcccgcatccaccgtgcgatggacagggatctatgacgtggtgcttgtacgttttaatggtttgtgtcggggctgcgcaagatttagcgacacggacgcgactgagaatctgatatctctcgtcctggaaataaaacgcgcccaacacagctttatcgacgtccgattgcccgttccttttccgcattgcagatgacacatacgggagtcgtaagtggtgcggcagacacgtatggggagtaagtagacacatatattaggggtgcacgtcaaacgccgcggggcagggggcggggaggtcattgggatg

SEQ ID NO: 3599 - DNA, 703 bp, Nannochloropsis_gaditana
  misc_feature (148)..(157): n is a, c, g, or t
ttgagtatgggggaagaagccccgcgggcggacacggactatttcgacaagcgggtcgtggacgcggcggctgtgcgggcgattgaggaggaacgggaggagaacaaacggtgagagggtgggagggagggagggtttggaacggatnnnnnnnnnnagggaagcgggggggaagggcaatgaagaaggttgtcagggtgtggaagaaaacgcaggagaggaaggaggagaaagtggcgatagaagtgatgaagaaggagaggaaagaggaggaagggaaggaggagaaggcctgatggggagaagcggggggggaaaggggcgagaacaaggagagggagcggcagaagaggaaagacaaggaggagggaaggaaagtagcgggaaagaggagattgtggtggaggaggcgagcacggcggcccctcctgccgtggaaaatggagcccacgcagatttgacacgcacccccccggcctcttcttccctccctcattccctccctccctccttcctctccgactcttcgtcctcctcccacccctcctccctcaatggtcctggcacggcgcgcctcccccctccttctgccttcgcccatctcgaacaagtcgcttcccagcacttacccccaccccgacctctgtccaaccctccctccctccctccctccctgcctttggtccggggcctggccgacatg

SEQ ID NO: 3600 - DNA, 703 bp, Nannochloropsis_gaditana
  misc_feature (402)..(411): n is a, c, g, or t
cacgcgtttcgagcacaaccgactgctggggccatgctaccggaaacctacctgcctgacctgtcccttccattgtgcacaggccccgcatgattggaaggcgcgaatcgtcgacgtggctcgagtctgcatccagaaggaggtgctggagctgtcggtggcggaattgctcctgccggaggaggcgttgggggatctgaaggtgaggatggggccggtttaggaaagggaaagagggagggaggaaaggagggaggattgacgaaggggaaaaggctcgcagcagtggaggaggtttcctcctggttgtctgcccgtcgattggagcgtcgacatccatgcatggccgcggggagggggtccggcaatccgaggcggcagggagggattgaagacgccttnnnnnnnnnnggagatagggccatggccatccaccctctttggggctacccagcgctcctggggcgtgcgcaaggtgttccatgccatttaatcgtggtatgtgcgttgatggtgggattgtggacgtggaaggtgcattttggacaggttatagggatgtacggataccattatgcggccccttcctcgctctttcatggtaacactggagaagttctcttcttcacaattctctctgataccggagggcctcatcgcatgtccaatacatttcccgacacgctttaaacagtctaccatg

SEQ ID NO: 3601 - DNA, 703 bp, Nannochloropsis_gaditana
ggagaaaatacttttttatatttccgatcctttcacgactcttgtacagtgtcagcagaagaccctttttttcgtgtaagcattactgaattacctttgaaacaacatggttgcataactgtttgtgtcattatatcggatttcaggctgtgccttgaccgtacaaagagcaaatctcatgctggatgtcgcattgaaagagtttgcactttgtctgaaactcttaaacattcaagacgtaagtagaccaacgacggcatcactatccctcaagctactcgatattaaaaaaaacacatcaaatgtgccgttttattcgggcatttaacgtccaaaattcagggttaaaaatggttttcctttggcatggtggaaaaggaagtaatcgtgtggaccgagagcgtctttttcccttgtgtggctctcaccaccaccattatgtgcacactgtcctgtgcgattttgtgtgtcggtcgtctcggggtcgggaggaaggaatgcgataatttgcgtctagttaatggaatggtcaggggctgtgaccggagggatggatgcactcgtactatttgcatttcttccagccatcgagagccccccccttctgctatgtttttttctctaggctagcgagagcgctcaccgttcctcctaacatattcaccaacccaccatttacatcagtccaagacattgtaccatg

SEQ ID NO: 3602 - DNA, 703 bp, Nannochloropsis_gaditana
ttgcacttgaaaaagtgaaagttaacaaaaaatcgtctcccagccctaaaatccttgggggcatattttcgatcgatggcattgaactccacaacattatctttatgtctgcacgacacgaggatgtgtgtctgtggtccgatttgaccaacatttttggcgggggctgtaaagaaagtgtcgccttcgcccttcttcgcccgcggtcgctttgcttgcctgaaatttggcaccatcaagagtccatcgggtgcatcggcaatcggtctgctattggcgtggagaaattggagcgtttggcctgactcagtgctaccaagggaggtgttactttaaatgtgcctcaaacagagtccacttccgaaggtggcattcgaatgagaggcctcgggcccatggcgcgttagcacacttacctgcttctcctttaaggccatacagggaacattccatgtttattttacgcatgatcatcacgacaatgtcatcgcttcttcttcctgacagtaccgtgatttctttgtcctcgggtcacctatttctattaatcatactacccaagcgtggtgttctctgacaaatgcgcagcactgatgtgcgaaaaaggaattgtgtggcactcacaccaatctctttatcacctttcgtcacagtagataaactcgtcccgactgactttttcgggttcgcgacatcaagcatg

SEQ ID NO: 3603 - DNA, 703 bp, Nannochloropsis_gaditana
tgaagatgcgccggctgatcgcggtggatgaaccacgccacatgctggaagaaattaatgcgtctgcatttgaagaggttgtgagtattaacacaaaaatagaccatatgtagagcaaacgagattttcccaaatcagtagctctcacacgggcgtttccagaagttctgaagatgcgccggctgattgcggtagaagaagcacaccacatgctggaagaaattaatgcgtctgcatttgaaagggttgtagatattaacacaaaaatagaaaatatgtagagcaaacgagaatcggtagccctcacgtgggcgtttccaggagttctgaccaatgtcttgagcagtagtacgaggaggttgacgacttgaataattacattaaggcattcacaacgcagagttaccttccacaaaaagagaccacgacttttgcaatcaccattgttgtccgacatgaaagctgcccatgggacatatttgcggtaaaataattttcctccccatcttgtgatgccgataagaacaccgtgcgaaaatgaaaaaaagaaaagatgacgtcatagcttttcgtaaccgttcccagtttagtaggcgttcgcggcaccatggcagctttgtggcttggaatgcctctccgaggacactggtgacatcgtcagggcaggattggatactttgagatattcgtcgcgcagagcatg

SEQ ID NO: 3604 - DNA, 703 bp, Nannochloropsis_gaditana
ttcgattgagaggagtatattatggtggaagaatatatatgggaggtattgttggtttttaatctttataagatttgtctttttagtatgaaagcgctgttgtgcaaacatctctgttcacattgcgttctaggaagtctttcctgacttcaaaagtcctttcccggaacaatgacggaaaatcggagtctcgcacgcaagaaacgaagtgaagatactttatggcagaccgtactacccctttaaatcaacaaaatgaatgaacgttgtgatcaaatacatgaatatctacgtgtcttaatctctattcaacagttgatcgttcgcttcgtgttctattatcttgtcaaaatccctttgttttgggtggtacatgattacctcgcccaccctccactcactggcactcgtttctcgaccgtcgagtatcccgcccttggtttatgctcggggtatcataaaaacaaaagcttaaacattaccttcttaagttcattccatatggctggcgttttggtccgattgaggtccttgtcgacatgtttctcgtctctggcggccctattatttcagttacttgaacatttccgcatgccgggtgttgagctgtattcgtcatcttatcacactcatgttttttaaaacggtacaccatccttctcctgcctcaggttcttcaccgcattcacgaagtacgaccatg

SEQ ID NO: 3605 - DNA, 703 bp, Nannochloropsis_gaditana; identical to SEQ ID NO: 1142

SEQ ID NO: 3606 - DNA, 703 bp, Nannochloropsis_gaditana; identical to SEQ ID NO: 1140

SEQ ID NO: 3607 - DNA, 703 bp, Nannochloropsis_gaditana
  misc_feature (348)..(651): n is a, c, g, or t
cctcgacgccatgtaccagtacttgcgtcaggcgtcggcgtcggcgtcggggacttcgagtggaagcatgtcctccctcccgccctccttcccttcctcgtccttgtccgcgtcccctttcatggcttctcgcgcctccacggaggatggcattggcctggctccttctggggcggagacgaagaagaaacgggcggggaggaagggcgcagggtcgtggaagcaggaagccgccttgtccaaggtccgagactttgtgaccgcgcatggcttgcgggagaaggtgttgatggatctggacgtgccgaaccgaccgaagctgaagcggaaggagttggtgggagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggaggggaaggagagggcgaggaagaggcggtgggagaggggaaaggatg

SEQ ID NO: 3608 - DNA, 703 bp, Nannochloropsis_gaditana; identical to SEQ ID NO: 122

SEQ ID NO: 3609 - DNA, 703 bp, Nannochloropsis_gaditana
  misc_feature (93)..(102): n is a, c, g, or t
ggagggggaggaggacaaggaggaggccaggggccgggaactgcgaaggctgtgacgaagcgcgcacagaaagcgcaaggtcagcagcgtcgnnnnnnnnnncttgtgcgtgcccctccctagggcccccgccggcaaagcctccttgacgcccgaggaaaggagacgctgcttggaattcgtccggcgcttggccagcccatatttcgccagggacttttgccacccggtgtcggagctgcatccggaggtgtgggaagaggtgaggagggagatgggttcatcgggcttgtcgggaaggagattcttcggcatttttcgggatttgtcggcgctgtatctttcggggggcaatattacatgagcttgtatgcatgtgtgttgttgtggggggctgtgcgctgcatcgaggtgatggaggaatccatggcatgctagaggccggcgcggaaagcggaggatcggacgctcttttttgctgtctggtgtgccaaaagagtcatctttcaagccgaagaggattccagacctttgccttattcttgcggcttttctcccgggtgccgggctcctctttccgatggagtctctcctcggctccggccctcgggggtctcgcgaatcatcccgctctcactccccacacataaccacactcctttcccctcccactcagtaccgacgcgtcgttccccaccccatg

SEQ ID NO: 3610 - DNA, 703 bp, Nannochloropsis_gaditana; identical to SEQ ID NO: 1095

SEQ ID NO: 3611 - DNA, 703 bp, Nannochloropsis_gaditana
  misc_feature (1)..(387): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgcttgtcctttccctccttcgaatctccatacgtcgcccttcctcccccctcgctttttccaggcacaggatgagtacgacaaacaccatcgctggcttcactgtgagctagcggccgcgcgcgccctccgggccaagcacattctcctcttcggccaccaccctctcttcctccaccgcgatgacgaggaaaacgaggaaggctacctaggctcctcctcgttcaggaccaaagcgggggaggtaatgaccatccctaatacctactttcatatcccacgggcgcgacgagagaaggttttggaggcgatg

SEQ ID NO: 3612 - DNA, 703 bp, Nannochloropsis_gaditana
atttcaaagtttttaaatcgatcgctcatgcctgtaaaaattggactttaaacccccacaacccctttcactaccagtgcttatagtacgtggtgttatctcgctcatagtggcggctcagctggaagccacccggatgtacaactcgtgaggagcttaacacggaaaccgacggagtggagggaagcgcatcgaaatagcatgtgcttgtgaacacagtgaagtgaaaattgagtaatttaagcttgctccttcgactgacttctctggcgtgtttctttttcacgtgcaaccacagcggagagcggacctcgcctgcctcagcttcacggcttcttccctctggcaaggtgagtgacgacaacaaggcatgtcatacgcgcacagtgattttatccttggcatatatgcagaaggcattggaatgatgcgtgtggttgagatgagaaccccgtgcaaggacggaagcgtgcaggaaagcttctggaaagcgtgacctcaggacatggctacaatactgacgccagcaccaggcagctggaacaacgtcccacacaggaatcatgttgatcattcaacccttttccatgctccgaattcgatttatggtccgtcgacgcattgcattttaatcttacatggctttcccctccctccctccctccttccctccctgcttctccgcttcttcatgatgtagatg

SEQ ID NO: 3613 - DNA, 703 bp, Nannochloropsis_gaditana
ctgtggtcagttaaaaatcgtcccaatacccaacgcactgcgacggtggcaatgggggctgcgtttcgttttgtgcgacctgaggacaaaacagcgtccccacagcgagtagtacgtcacgctctggggccaccccccaaccctcgacaagttccatagcgaggcagggggttactagtgcaattaatgcgatcaggtcacgatatcgccggtgctgggcgtcatgaaaactaggatgtgtatggctaggacatgcatattttagaaatggatgtcggcttttttgacagcagcaggctgtgaatatactagggcgtgctgaagcgatgtgtcgagacctcggtcgtgccactacccgtccgcacagaaacttctcgttctgactagaaaaccttgtcttgatttcaatcatcagtcacgcggcaccgtgcaaaggaaagaacctaaaaagcaatggtggaagtgccccctccggcagccgcatcttcagcgtcccctccccctattccccttcctatcgcatccgcgtcaatcgaccacgcgggcatcgcagccaaagcccatcctcctgcctctcattcgactcccggcacagctggcacactctccaatgcaagcaattcctcctgggtctgtcccagtaatcgagtgtatcccggtctggtcaatttatcatcgtcacctaaatcaggggatgcagcag

SEQ ID NO: 3614 - DNA, 703 bp, Nannochloropsis_gaditana
tgggcgtcatgaaaactaggatgtgtatggctaggacatgcatattttagaaatggatgtcggcttttttgacagcagcaggctgtgaatatactagggcgtgctgaagcgatgtgtcgagacctcggtcgtgccactacccgtccgcacagaaacttctcgttctgactagaaaaccttgtcttgatttcaatcatcagtcacgcggcaccgtgcaaaggaaagaacctaaaaagcaatggtggaagtgccccctccggcagccgcatcttcagcgtcccctccccctattccccttcctatcgcatccgcgtcaatcgaccacgcgggcatcgcagccaaagcccatcctcctgcctctcattcgactcccggcacagctggcacactctccaatgcaagcaattcctcctgggtctgtcccagtaatcgagtgtatcccggtctggtcaatttatcatcgtcacctaaatcaggggatgcagcagacacgacagggtcttgcaccgactcctctcagccattcactcctttctttttcgccaccttagctgacacgcaattgggcgccatcgacaacaacacaagctgggaggaagaaaaagttctctgtcgcatggcggtgcaaaaactcaataatttgaccccacggccccagttcgccatcgtctgcggtgacctcgttcaccacttccctcgcatg

SEQ ID NO: 3615 - DNA, 703 bp, Nannochloropsis_gaditana
cgcttttcatttccccttcgccctagcacctctgttagaacgtctcaattgtaaggaagagatgtattgatggtgcaagcggtcgatataggtgtttgatgtgactaagaatgcggcagtgaaaatagggatgtgatgaggatgataaggttaagcgcgacgtccgcaagaaattgtgtttctggccggttggggtgcctgcgcctcaatgcagtggctcgatacctagctgagtattaataacgaatactgcatggtagcgtgcagtcatgaaaaatgtcccttcaatgattgcgggtcttccacagcacccccaatcttttcaggttcctctctcattcatcccctttctcgtcctggtttccgaaaaataggtgtaaaggacaagaagcagcagaacagggcaagaaccttgaagttaaaatcagtaaggagcagcgtacgcatcgagggatcgagaaagggtaccagatgccgatggtctcgcggtgttgaagcgcgatacggcattccagtgtaggaaagcggccaagataacgctgacagcggtacaggagctgcacctcgcagtaaaaccagaattcccgtccagaaagaaatcgctgtggaagtagcaaacagtttcgggccctttatcccttctacctacggcgcagcacctgctcacttcctaatcgcgacccgaaacgtctccagtgccatg

SEQ ID NO: 3616 - DNA, 703 bp, Nannochloropsis_gaditana; identical to SEQ ID NO: 60

SEQ ID NO: 3617 - DNA, 703 bp, Nannochloropsis_gaditana
ccctccgacttggtccgagactttcctcagactgggccccccatctcctccgccttcattgacttcttctcatggggcatgcgccgggaggagggtatccatgtatagttccaaacactgtgtcaatctcattgggggccgttacttgacacactgtcgccctaaagcctggaggacagtccaatgtctggggctatcccctctccctccttcccctctccgtccctaccttccctttgtcaacatcagtatatacatgtgtaagtccatttgtacacgacacgttcctcccaagacttgcaagcaacgtcaatccctcgatgcaccacgtcgcatcgcgactgccgccttgggcgttggcattgtggtttgtccaaggggtgcatgaagttgactttaattgcatgaccgttgtccatgacgcggagacgtacctccgttaatgctgatactttttgctatgcgaatgggcgggaagccactggaaacatgcggggatcatgcgggcatgatggacaacgtaggacagaggacgtgtaggggaatgcacggtccttgaatacgtagtttggtattgtttttttcaagtcacgacgcattcgtggtttcagagtcgcgacgccctcgccgtcctcttcaagcagttccgttcccctacattctttttgtcacactcacccgtcgtccacacacgtccattatg

SEQ ID NO: 3618 - DNA, 703 bp, Nannochloropsis_gaditana
tcgaccaaaacgttttccagggcatgaaaccctgaaaattgaatcttcttgaaatatgttacgcccctgcaataaatgctttcatggaagaaggctcgtcgtgccgttgtacctgtgtgtcatagcagggtgccaccgacgggcccgcgaaggaggtactcagaggagtttggaaaaattggagtcgtgtaaccacacaagccgtcaatcaaccaggcatagacaacttatacataatggtggtaaaatagatatttgttcttcaactagctttaaaaaaccacatcagcctgcaatcacaacagcataatatttcctagtagcacgggcaacgccgagctgtctgttgcatacggaagccatttaaacctttatatcccacgttggctgcgaaaagaaagtcatggtccaacatacccgaaagaagcaccacaatcataccaaaaccctgcgtctgtgagagcttttgctggcacgtggagaacaaaagccgtaaaaaaaaaaaaacattaaaacggaagacgtcgaaaacctcatcctgcgtgggaggaaacggagggccatcaagcgcccaaaccccggtattgttgtccccgccttcccacttccctgcttctttcatctgtcacagagaaaggacgtgaaggaaggaaaacgatgccaggacgcctttaaattgtggccggctcgttcggtgtcgatg

SEQ ID NO: 3619 - DNA, 703 bp, Nannochloropsis_gaditana
ggggctggcgacctcccggcgtgcaggaggtgccgatttacgtttcttctctgctttacggcctttgcccatactcaccaccatcctcgatctccgaaaatgagcatttccatcaggttgaagagatgtcaaacgttgggaccgacttttcggtgcgaagggcttgatgaaggcgaagctatagtggcagaggaaggccaggaccaggggcaggaggtagttattcatgctaatcacaatttgatacctggcacctgcccgtgcatggggaaaaggatgatgattccagaacagtcagacatgtcctccttgccttccaccttttctttcaaggttttggtgtttgcggctggctggcacggggaagggcggggggaggtcgcgggtcttgtggaccgagacgaggaccgggacgaggcagggcagggcggaggggcgggctgctcgcgtctccctttccaacaggaaagcgttcttacgcgcggccaggacccgcacgcctacgtcgaacgcgcattgtcggttttgcttttaagggagatatagcggctagagggcatggttgatgcattgtccgtggacgcgcagccgggatgcatgaatcccaagcatacatctagccagtgccggtaaactagcgcaatcattctcaatccgaatgccgtccttctcatactacagacgctaagtcgcctacaatatg

SEQ ID NO: 3620 - DNA, 703 bp, Nannochloropsis_gaditana
cgagttgcccgcaataattaaacccacaacgccacacttgaaaatcaaggccgtctggaagcacagtgcgaaacgacccgacgagtgacgttatatgtcttatttcacgcaagcactcaagagaattcacggtcctcacttatttccgtctgcccctgtgtttctccgcccgtcgtcttgtcccgctattccctaattgcttgctgttggcgctcacttagcttgtatcctgaccataagcccgcgcaaacacgaacatatactccgaatacgaccacaggcacattataagacttttgcgtgattcaacgtgccgcattcccacttccgtctttactttcaagacaaatggaatcagatcaggtacgtgcgttcgagatactaagagaccgcttctgacctcgaaaaaagggcgtgactgttgtatgcaattttttcgtcgggagattgttcagagcctcgtcaaatgtgcttaactatttggagtagatcaattttgttaattggagattctttcaagattgtgctgtcccatgccccacttactcgggcaaatattcctatcagtacagagacagtcgtcgtagtcattaaccgaacgtggaacggtttcagactagattgagtacactttgcgagaattcatttctgacaagggcactttgtctcatccgttcttgttcttcttatgtcttacatcatc

SEQ ID NO: 3621 - DNA, 703 bp, Nannochloropsis_gaditana
gtgggtcctctaatcacctgcggctgccggctttggagactgccttctccaccaaaacccagacgaagctcagagtgtcgcgaggcaagtcctacgagggggagcacttttcgcttagctggacgattacactgcaggtacccattaaaaatcccgctgttggggagtctccggataaagggctatggagcttgctccgcaaaggaagaagcaaggcgagctcggatcctccccgtaggacgaagaagactatcttggacggtcttgtggggagggcggagaaagggcaattgatggccgtgatggggtcctcgggttgtgggaagacatccttcttaaattgcatttccatgcggaaccagagttttgtgggtaacatcttcgtgaacgagaaggagatcgacgggcgctacttcagcctcgcgggctttgtgcaccaggacgacctattcctccccacagagaccgtgcgcgagcatctcaccttccatgccttgctgcggtgtgacccctgcgtccgcaaagacctgcggctgaagcgcgtggagactttgatcaagaccgtgaaccttgagcacgtgtccgacagcctcttaggcggcccgggaagcttcattcgaggcctctccggcggcgagcgtcggcgcgtttcctttgctacggaactcctttcagaccccgtcatcatatttgccgacgagtt

SEQ ID NO: 3622 - DNA, 703 bp, Nannochloropsis_gaditana
gatgaacgcgaaattctgcactgattcaattttgttcgaacaggtatcatgcagcgacattcagattgtaacacctaacacgagtgaaattaggcgaccctccagaagtttttaggcacgatggagggagcgagaatgattgcctgtatcgcgacgaatcagaagaggatttctctgtttcatcagggcttttctactttttccaaaggaaaattataatatcagcgccataaattaaacgcataaaatgtcaaagaaataaatgtcagcgcagtagcatgggccgagcgaggacttgcccgtccggtctcctcgcttcaacttcgagcccttgtcgcgtacgcatgtacgaatgtcaagttgaacaagaatactggaccgagacaccgtgtgttacgctcgacggatgctgtcgttgcgtacatattatagcggaatctgccaaatttcggaggtggatggacaacattgctttgggcgtgggcgtccgcacagccaaccccccacagatgcagccgaggggctcgcccactggctccaaggggaaaggggaattttcccccccgcactgatgatatggaatgtccgcatgagttgatggattatgccacccaactaacagggaaacatgtgtaaacgggtcatgacatcacgaaagcgggagttggacgatgttttgtccctgtgcccaacacccggcatg

SEQ ID NO: 3623 - DNA, 703 bp, Nannochloropsis_gaditana
gcgtttggcaagagacgaaatgatccgaaacggtgtcaatggggtgtttccactgcgttcccgtctaacttctcagactccctcgcgggtgcatcccctcgctgtttcgctgcccgacactcttacacgttgtacgagcccatttactggtcagggggccatttgcacagaagaatcgtccagattctaccacatgtatgtcgagtgctccagtgaagagccgtcttgacctttcctgagctccaaacccagcaccttccgctctcgtatcacgggcaaccgcggaaggtacgctctgtccatgtgaccacatgctgttgaacatgagagggcacctgaccattcaatcaccgccacaattaggtttttaaaatctccaagtagccgctcgaggcgttgtatgcttcagataggtcgtcaacggactgaaaagaggcgagtcttcagtgcttacctcctccaccgtcccaaacgtctcctctttctggtgggtgtagtatgcttggcacttgggtggaatcaaacgacagcagtatccatggcttcccgaactgcatttcttttccgacatttgtcgctgcttccaactccttcatcagcggcattgcctccccacttgccttggggggctctaccaaccattacccccttcagctcttcatcttcaaagtctacgcaaatatctccgcgaactccaaacatg

SEQ ID NO: 3624 - DNA, 703 bp, Nannochloropsis_gaditana
atcgttcaaattgcgaattccgtcgtctcttgtctacctccccgatttcagatggaaaccagccctgggggtgccagtgctgttttccctccactctcatctacacttgaggaaagtggacctgaaaatgttacaggtggggagtcgattctacctcctacgtcatgcccccccgtgttgccgccacatggaagttttccttcctcaggccaagcatcctcccactcctcttcgaccacacttccacatcgctgcgtcctggaggactttacaaggtgcagcgaaagtcacctgtggaagctcatgatgtctttctacgatcgaaaaggtgtcgaatcttggtcgcaggggatcgtgccacacttcattacatgtaacgcttttatcgggagggcgtacgcccaagtctttcaaggttacttgcgagactgtgccaagaaggctcgtgaaaatggacccgtatgttcggcattggatccttcagaaccattgtatattatagagctgggcgctggctccggaaaattcagcttttttatgctcaaagccctggaagagatgcgggagctgctggattttcccttcgagaaaattgtgtacgtcatgacggacttcaccaagaaccatttcaacttctgggagacgcatcctggactgcacaagtatatagcgcaaggctcgctggacctggccatcttcgacg

SEQ ID NO: 3625 - DNA, 703 bp, Nannochloropsis_gaditana
agtggacctgaaaatgttacaggtggggagtcgattctacctcctacgtcatgcccccccgtgttgccgccacatggaagttttccttcctcaggccaagcatcctcccactcctcttcgaccacacttccacatcgctgcgtcctggaggactttacaaggtgcagcgaaagtcacctgtggaagctcatgatgtctttctacgatcgaaaaggtgtcgaatcttggtcgcaggggatcgtgccacacttcattacatgtaacgcttttatcgggagggcgtacgcccaagtctttcaaggttacttgcgagactgtgccaagaaggctcgtgaaaatggacccgtatgttcggcattggatccttcagaaccattgtatattatagagctgggcgctggctccggaaaattcagcttttttatgctcaaagccctggaagagatgcgggagctgctggattttcccttcgagaaaattgtgtacgtcatgacggacttcaccaagaaccatttcaacttctgggagacgcatcctggactgcacaagtatatagcgcaaggctcgctggacctggccatcttcgacgcggtgcacgactccgtgatacgcctcagccacgcgggcactgtcttggccccgggctcagtcaagaatcccatgtgtctgatcgcaaactacttgttcgacacgctttgccacg

SEQ ID NO: 3626 - DNA, 703 bp, Nannochloropsis_gaditana
aaccatttcaacttctgggagacgcatcctggactgcacaagtatatagcgcaaggctcgctggacctggccatcttcgacgcggtgcacgactccgtgatacgcctcagccacgcgggcactgtcttggccccgggctcagtcaagaatcccatgtgtctgatcgcaaactacttgttcgacacgctttgccacgacgtcttccaggttgacggtggcgtactcaaagaggggttgatatcggtggggtccaagcaggcgcaggagccagaccccctggatcccgagatcatcaaacgtttccacaacctcttccagtaccagcccgtgactccggactactacgcgcacacgcaccaaccggcccaccgtccgggacatgccccaatgggctctcccccatcctcgagcgagcccttgagcgctgggacgaacgggtcctcggaccgggaagactctctgcacctgggccggatcctacactggtaccgcgattacttcgggcgtagcagtacgggcgggtccttcctctttcccatcggggccctccgcgccctccggcgcctcctcgccttcagcaatgacaggggcttggtcatttcgggcgacaagggcagcaaccaggcggagcagttccgaggcctggtcgacccgcacatcgctgtccacggatccttctcggtcatggtcaactaccacgcca

SEQ ID NO: 3627 - DNA, 703 bp, Nannochloropsis_gaditana
caaacgtttccacaacctcttccagtaccagcccgtgactccggactactacgcgcacacgcaccaaccggcccaccgtccgggacatgccccaatgggctctcccccatcctcgagcgagcccttgagcgctgggacgaacgggtcctcggaccgggaagactctctgcacctgggccggatcctacactggtaccgcgattacttcgggcgtagcagtacgggcgggtccttcctctttcccatcggggccctccgcgccctccggcgcctcctcgccttcagcaatgacaggggcttggtcatttcgggcgacaagggcagcaaccaggcggagcagttccgaggcctggtcgacccgcacatcgctgtccacggatccttctcggtcatggtcaactaccacgccatcggcctctacttcatcagccgggggggcttcgctctccacaatccccaggaagacgcctctttgaaagtctcggccttcgtgctcagcggccgcgccggccctccggaaagcccgtcagaggattccccccctgaagctcactcgcccgtgaccaccaccacctcctgcctcgacacctccccgtcatcctgggccggccccaacgcggagtcggagggcgagaagcgggtgcgggcctttccctgcctgcgcgccgccttctcgaccgccgtggatcagttcggccccaac

SEQ ID NO: 3628 - DNA, 703 bp, Nannochloropsis_gaditana
ctcctcgccttcagcaatgacaggggcttggtcatttcgggcgacaagggcagcaaccaggcggagcagttccgaggcctggtcgacccgcacatcgctgtccacggatccttctcggtcatggtcaactaccacgccatcggcctctacttcatcagccgggggggcttcgctctccacaatccccaggaagacgcctctttgaaagtctcggccttcgtgctcagcggccgcgccggccctccggaaagcccgtcagaggattccccccctgaagctcactcgcccgtgaccaccaccacctcctgcctcgacacctccccgtcatcctgggccggccccaacgcggagtcggagggcgagaagcgggtgcgggcctttccctgcctgcgcgccgccttctcgaccgccgtggatcagttcggccccaacgatttcttcgtcctgcagaagagcatgaaggaggactccccgaaccccacgctcaaggcgatagtcgcccttctgaagctaggggactgggacccggacgtcttctacaagtttcgcgagaccatcctcaatcaagtccccaccgctggccagaagctgcggaacgacctgtgccgaggcgtgccccgggtgtgggagcaccactacatgctcgatcgggacaaggacatcgccttcgagatcggcagattctactacggaatccgggaat

SEQ ID NO: 3629 - DNA, 703 bp, Nannochloropsis_gaditana
aacgaatgagccctaacacacttacaaagacactgcgggtcgaacaagggcaaatctagacggcgcacaccaacggatctgtgaacgctcgtgccaacccaaagaattggtttccaaaataaatcatgaaaggcaacggggtgctgtccaaaggcaatgacatttcagcaccaatcccttcgcctgcctggctagtcaacgggacaagagcggccgcacgcccgaacgtgagagaaagccggcattcccggacgccggcgcgcgcggttcgtatcctctttggcgcgtgttgaaatttgttttccctccaacattgagttcactccacgtcaaggtcgtctgcttgataacatgtgtacaaggccctcggacggcgagcagggtcccggcgttggcgttagcgagctttgtctgtcaaacccaacgccttccgaggcgctggacgcgtagaccatccgccctggaaacagcggtgaccaaaccatcttttccctgactactctctcgcaccatgcctgtcctttgatgcgagagcaggaggcggtcgcttctgtcgttgctctccaggcattgccctgtgcctgtcatatcgacttgtttacgaacgcgatcatcaagcgacatgaaggccgcggagcatgaggagggtgcggacacttgaactgatcgcttcctttccccaaaccaatcgttctcactgaca

SEQ ID NO: 3630 - DNA, 703 bp, Nannochloropsis_gaditana
  misc_feature (368)..(420): n is a, c, g, or t
ggatggtgttctggacctgggctagcgtgcccgtctgataaatctgcgacaggtccgtgatcacttccgggggcgagccttcccccgggtcctccttgcgcaaaaatgtgcccacatagtagtgcccgtagtcgtttttgattgaggaaatcgcttcaaataccttggggctggtaatattcaccgcttggaccaggccgggaaaaaacggacggcgcatgatggggagggccaacacgtgaggatgtcggggcgcgttttctcccgcgcccacttttgcgacggcatcgagtgtacttgcttcggcgccgctcatagggcctcccttcgtgcgattctctactacgaccacgcggtccccccccccnnnnnnnnnnnnnnnnnnnnnnnnnnnnnnnnnnnnnnnnnnnnnnnnnnnnnttgttgaatcgtttaaaaaaggaagcgcttctgccgagcgttgtcttcaatttcagcaagaagaaatgcgaggaatgcgccgactatttggggtcggaggacttaaatgccgccaaggaaaagagtcaggtggagccaagggagggcgtagggaaaaggggagggtggagggaaggagggaggaataaagggaaagagaggggtagagagagggggggtggagcagggataagatgactgaagcatcgctcaataacacaacataccctatctatggtaggtg

SEQ ID NO: 3631 - DNA, 703 bp, Nannochloropsis_gaditana
tcgtgcttttttctgacaatgtccctgtgtggagacgaccgccacaccacgtaaccctccatggtcatttttacgcatttactaacgtgatcatgcgcattcacgcctggaaacctgccaggacatgccttcatgccatatcaaggtagtcttgtcggcccgttgaaagctatcggggaatatttcgcagggggatcggggaactagcccagacccagaatatgaatgtcatctcatgcacccgttggaaaccccttcgtgcaccccacaagcgtttatacgtctggacatatgcatgtgaaggtaccttgacggtgaacggtgggttttgggtttggtagagggcggaatggagggccaggggcgcacggcgcgtcggggagcgtgccaacacctcggaaagagacttctcttttctacttaagcctctccaaattatttaaaaatcccgccctttgtctgaatcaacgagaagacaacggagagcgaacgagagcggatgcctttggttttgggacggtgttcttctctttgggttaccgtcacgtggtgggcttttgtggccacggtcatttaagaaaggcgacataaagcggagattattatataaatctgttccgtccaatatgccgtgccctcgctcacaagccgtgcggggaggtcaagcgactgccttggatattgggactttatcgaatacatg

SEQ ID NO: 3632 - DNA, 703 bp, Nannochloropsis_gaditana
ggtgctaaccacgtacccccctcacgagcgggaggtaatgaagaggagatagacgacgtaaaaaatcgtgagaaagggcgaatttggaggaggcgggcatgcgagatataacgcctctgaagcgtggacaacatggtacggctgtttcatgtgcaagggagaaagagtggtgtgtataaccggtatcaagatggctggggggtcccgctggtttttccctgacactgaagtcttgccccctcacaaggtatgaggataggaaaaagaagcaccttgccgccccggaaatttgtcagaaatctgacgcttaaataacattcgacatatatcacaggattgtgacatatctaatacagcttactctgaattcggaagagcacaagcagcgttcgtctgatacaacctctcatcaggagacgagcatagccctttgacatcacaattccatccccccacgcgcatcaagccgtcgaggtagcatccctggaagtaggcaagcaaagaacagagcgttcaaaggcctctctggcagtgatccgaaattatgacccctccatccacttcaaggtcccgcgttgaggccgtaagaacgcggccgttgccaacgaagttatcttcgcacgctggtgggacttttttccctgtccatgcacctcttctcaaacggcgcgtccgcaagcggtacctggatcagctggtgatg

SEQ ID NO: 3633 - DNA, 703 bp, Nannochloropsis_gaditana
gagacacggggcccacgattgtaaaaagccaattggtaaagaaaaataaaaataaagactccctcaaatcatgggagtatgattgttggtttgttgttgtgggttgtagcaggcatgaagaatttagcggtgccggagtttgtcatggacggggttctgccactggcatgatagtgaccgtgggagtcaataccacacgtttcaacgagatccaaactgcaccacaacctaacgtcctcaaaataaattcagagacatgccttcctattttttctatcgttgcttggttttttcccacgcgttggaaggctatcttggagcatacttggtcaggatcgtagcccctcgctttttaacgcgagcgatgaggaacagaagcgttttccctcccccgctgccctctttcatccgatacgactggctctcacacattctacgcatcgacctccacccgcacgtaccaggagaagtggaagaagaaggaggggtcaagggagtgggccgccaaattctgctttgttgtcgctggcatcccgcaccccccgcgtagggccttaacgtgccgggaaacaggcacgagcaccgagaaggaaggaagaagaagcgaccattgacctgcatacaagattgaattacaatgttagacgacaacaagaagattggaatgggcctgcttggcctaagtttccttttcatctccatg

SEQ ID NO: 3634 - DNA, 703 bp, Nannochloropsis_gaditana
tagatcgtctcatggcttccattctttcatttttgattcgagcatgacttcagtggtattgcctccgtttcgacggtaagactaatatgtctgcgttagtgtgagcctcaccgaggacccattgttgccgtttgcaggtgttgaaatggtttgagcatatttcaagtacaactatcgagcaacacttgaatcctaaggcatcatgagttcattgacagctgaaagtactctgcagactaatcgagcccatccgggggaggttcactcagcctaaccacttttcatggtacaaccatcaaaacttctgagtcaacattttgactgctccgtccaaacaatgaagtgatgggatttaaataacaggcaccatcatgaatgattcagttgccagtacgctggggcgggcatgtcttaaagtcacgcctcctcgttctggcccgcacgaggaaatttccggctagggggttgaagaaaaagcaatctctttttttttaaaaacagaccggtttttaaaggctctaggtaccggcctggcatggcacttgccgacaacacaggacttgcgatccctttctcaaaaagcggctaatgtctgctttgtgagcatccagccgcctgttgttcgcggaagtcgatcattttcggatggttcatcctcacatgcaacaataccctgccgcttcatatactaggagtcaccatg

SEQ ID NO: 3635 - DNA, 703 bp, Nannochloropsis_gaditana; identical to SEQ ID NO: 623

SEQ ID NO: 3636 - DNA, 703 bp, Nannochloropsis_gaditana
ggctcggaagctgtttgaccgggggggaggctgactttcccacccgcacattccccccacaccctttaacctcctcccttttttgcccaccctgccgtccaggtaccaaaccctgcaggaggcaccgggatgattcggcgtgggccagggagggtattgcggaaatccttgggtttcaaagcccacgggcatgtatttgggttcaggaggcgacttttatcccgggcctcggcggaagcaaggggaggagaggtcttggtgcgggacttcatccgggaggccctgtacggccccaaggacggctacttcaccaccaagggcgccaacatcatcatttcgcctcctcccgcggagcgcattcctttcccgacgctgaaaggctactgggactaccaactcgccctggacaagctctacaagagccggccccaggcctggatgacgcccgtcgaggtcttcgccccgcactactcgcgtgccatcgcccgctacatcctggaggcgcacatgaaggaggaggaggaagaggggagggggcaggccggcggttttgaaagaggagaggcggggaaggaaagggcggaggcgggacggggagggaaggagggaccgagggaggacgcgcgggtacgaaggagccacgaacggccttctcctcgggcagagcatgcggattcagcggaaaaggcgagaattctgtgca

SEQ ID NO: 3637 - DNA, 703 bp, Nannochloropsis_gaditana
ggttcttgcgaaggagttatcaaggagaagagtactgcagccggggtaaactgaactagaactcgagggtggtagtcgagaagatttaaaaacctcgcacaagaaaggacccgtgcctggcaaacgacagttcttccgtcagtatgtacgcgcaatcgtcacgtctggcgctcatggtggacacgcaggggaatagccttggggggtgtccaagcaaaagcacgcaaaggagggaaggaatgatggcgatgctgggcgatacgccagcgaggggacgacgcacacacacacaccgcacacacacacaccgcacacaagaaaggaccttgcgcagcaaccacctggcgtgaaggtggggagaatttgtgtgacgggtacgtgcatgggtagtgggggcggtgcgatgggattttggtcagtggtgtcggttcgattcgcgtggcggcatgtactcattaggctctcgtccctctgtccatggatcgagtttgacttccattgcatgccaacaatcatatatatgaagccctcactttacgtcgctgagcattcctttggggcctttacctcggcggcgtcattaacgcttcagacactcttgtattgtgatgatgccatcctcgacctcctcctatcccttacagtcttcagtcgtccaatttctttacataaataatctacagaagaaaggacggcgataatg

SEQ ID NO: 3638 - DNA, 703 bp, Nannochloropsis_gaditana
cacacacaccgcacacacacacaccgcacacaagaaaggaccttgcgcagcaaccacctggcgtgaaggtggggagaatttgtgtgacgggtacgtgcatgggtagtgggggcggtgcgatgggattttggtcagtggtgtcggttcgattcgcgtggcggcatgtactcattaggctctcgtccctctgtccatggatcgagtttgacttccattgcatgccaacaatcatatatatgaagccctcactttacgtcgctgagcattcctttggggcctttacctcggcggcgtcattaacgcttcagacactcttgtattgtgatgatgccatcctcgacctcctcctatcccttacagtcttcagtcgtccaatttctttacataaataatctacagaagaaaggacggcgataatggtctatctctccaaatctatcagcttgaaagtacctttgagtgatcgcttctgtaatccacggcatttgaattcgcaaggtgagatgtagtgggagacaggggcaggaactaggcgcgcaggcgacgggagagagaggttttccgaccaacgaagtttgcgtgccaaaccaagatcctgtacactggagctgtgtacatcctgtgcccgatgatgatatttggtctcaatggccccttgacgacggcaggatcgttgttcccctcctttccaggcgcagcaatg

SEQ ID NO: 3639 - DNA, 703 bp, Nannochloropsis_gaditana
ttatcactcgacttgagcttgcacttggcagggtagtaactccactagtacgtaacacgccatgatgctgaaaagcaccagacttggacaccaacatggaagacgcaagcaccagaaccaagcagggtcgccttttcagagaagtacgccgccgtctggaccagggcatgataatttggtggctattgacgtggtgtggacgtggataatgcataaataagaggaggtttgctgctgatggcgccaaaagggctagaaacagcacgaaacgttatacgctccgcgctgtcgacgctacattgtcatcagcctttctttcgatgtcctgtgggtggtttttaagcacagggagctaaagcaaactgcagcgttgggatgctgacccagtgggagaatgcgctgcaacctcccccccttacattagaacgtcgcggacacctttctagccagacaacccagcctcccgtcattgaacacgaatttctgtgcgacgcaatgccacagaatttggaatgtctccttcttctgacatgcatggaaaaaatggaattcacattttggtacactcattttaaaaccaactcattccttattcgtgcccttcgcttttccacttagagcagggtgaaaatagcttgacgtgtatctcagtttccgcaggcgcgataaagacaggtgaaagtcttactcttttcgagacatg

SEQ ID NO: 3640 - DNA, 703 bp, Nannochloropsis_gaditana
tatgcctcgttccccgacgtcccttgaggcagaccgaggcggccgtgtgaggggaaaaatgaaggtgcttcatgggtgagtcggaggtgacgttgtcggtgtgccataaaaagatcgccatggtgagacgctgagttagatggaggctgccatatacgctcatctagcctctagcttttctcaatgagtgcggcatgaaaattaaagcaatatggcggcataagacatcgtcccgggggagtcgccatgagcgatgacttgcaggctttcgaccacggcaaggacgagggaaagctttgctgtttgttgccccgcgatgccgcacatctttgcgcccaaagcttactcacgacatgtgcgaatcgacaggtacgccgtggtgaccgtaacttaacattgcattgggatatagtgctttcatcgcagcaagaggcagcggcgtttcttcccctccggccgccctgggtcgtacgatcacatttttggtttggaaggacgttcataaagtctaattacggtgagaggattcgaagacactgagatttggctagactatgtagcccttgccgtggttgagattttataaccgtgaggaaaccctgaaaatgttgtgtggggcatggctacatcgagccgtccttgacctcgctgacattcgtcatcgtgtgccgctctaatcccttccaccctccgacttaagatg

SEQ ID NO: 3641 - DNA, 703 bp, Nannochloropsis_gaditana
  misc_feature (1)..(685): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgggggaggcgcgcatg

SEQ ID NO: 3642 - DNA, 703 bp, Nannochloropsis_gaditana; identical to SEQ ID NO: 1358

SEQ ID NO: 3643 - DNA, 703 bp, Nannochloropsis_gaditana; identical to SEQ ID NO: 1356

SEQ ID NO: 3644 - DNA, 703 bp, Nannochloropsis_gaditana; identical to SEQ ID NO: 422

SEQ ID NO: 3645 - DNA, 703 bp, Nannochloropsis_gaditana
ttggtgcgaacaagcgagaaaagactgctgcgcttgagggcgtctgcgagctaggtctcacgtcgactctggaggagagttgcacaggcgcaacacaaattaagcgaggcaggcatggcctattaaaggcatatcgctgggatgaagagcacaaatcaattacgctctccgcattgcgccatgaccatgcttttaccacgtccatggctccgtagcctgctggtctggatcctctgggtgggcacggcggcggcattcacacgtttcgacagggcgagggctcccacattcccccgccgtttgaccaccctgagagggttttctcccgcgcctccgccaacacgcagacttgcttccgagtccgagcaaggccctgtccagacaagcagatcccattcccctcttctaattccactggttttccaaactgtaaatcggctgacactgccactttgtagcctcgtctgcagcatcctcccgtcctcagcgctagctctttctcttcctgcctccgccggagccacaggcacggccacttcaagcatttatcaagaaagtagcagcagaggcactgatattgacacgaccctcctctcctctccacgcattgctgcccgcgggagcggccaaacctattcgcaggccatggcttcggcggatgctcgccggatccacgacgtcaacaaggcgttcgcccggcatg

SEQ ID NO: 3646 - DNA, 703 bp, Nannochloropsis_gaditana
caatcgagcggttcctgagactcaggtgaaaagaacaacctcttttcgatgaaattcaagctaattcgtcctccccgttggcttggcgtggtgacacggtctgttttttggtcactcccccacccgccttgaggggcgtcgatcctgttcgagtccttttcatgactttgaccaacccgggccaaaaaacgccagcgccctgcgcactcgtgaacgaagcctatctgcaggttgcacatttttgaggggtttcgagcgcgttgctcgtcgacactgttcccttgcttcttttcgtgatattttttgcctccgttgggggctgttgcctctttgtcggttgcttgccgttccaaggagaagggccctcccggggaaaaaaaaactttcaaacagaacacaaagtaccagcacgttccaatgaccccaaagacccaaaatagccttcgttatttcagtcgtgcaaggaaactcagaacgcgtggttcgtattgatgttttcagggtgttggacgcgtacggtcgactcgatctttccacgcattcctcgtggagtggtttgtgtcgactgaacttttttcggagttgctgcccctctttgcggcccctttttcgaatgcactacgaaacccatttgacgtttatctgcttcctgacgccgtaatcatacagggatcgcagaagccatctttttggcacgaggatg

SEQ ID NO: 3647 - DNA, 703 bp, Nannochloropsis_gaditana; identical to SEQ ID NO: 143

SEQ ID NO: 3648 - DNA, 703 bp, Nannochloropsis_gaditana
ccccatcattttccgacgtaagctgtccgcatcgcttcttcgccgtggcagtggagggtaagtcacgaaacacatcctgcagatccaacaaaaccccatcccccaccgaacacgcacaaacaacgggtggaagtatcggtgccatccagcacactgaaaaaaaatcgacttcccggttgccattgtgtcgcttgcccgggggggtcaaaattttgaaattcccacgcttcttttgtgggcgctaggggcctgctatgccgtcggcaaaccacccgtacacatggcagtcacatttcaccgcgcccgcctaccggggcgtggccccggggacaatatttgttggacgctgctcgcgtgccgtggcgagcgtggtgccatgggtggggaggagggggggcgtggggcaggcatttctggtgttttctttggcttgagacggggaagaaaggggcagaagacacgcttcagagagcggaggaggataccttcatatcttacatttctctattctccccgttgtacctgcacacaggcacatcccttgagtggagccagacgtgcagcctcgtcatcgaacacgtcgaggtcgagaacccctgccaattttggggctcccccgattggctacttcttttcgacgtctcttttcttcttttcccctcagtgaagacgccttctgtggttccaagtttggacaactatg

SEQ ID NO: 3649 - DNA, 703 bp, Nannochloropsis_gaditana
gttcacaaagtgatacgggaacgtaaactttcgaacatctgtctgctctcagaagccgtgataccacatctccggcgtcgaccgtggcgacggatgagtgaaaatagaccaaaacggtagacaagtgcgtgcgcattctcaaagactaaaatacacggaaagaatgtcgcaaagtctcccatttgggactgcgttggttctttaacgcgcaaattaccgcacaacatgagaagtgctccaaatgccgtgggaggaggactcgcacaagctttcaacaccattcaagcacaacaatgcgcgcaaaactttagcaacaagtgacgagtacatacatagatacactcttgcttgatgccgggcgcctctagcgggtcatatcaagctacgaatcaagctggtgtgcaaattgcaccccatttgtgttgagagcatacggaagggcactcgaaagcatattaataagccgttcccaaaactcgattgggagacttactgacgcgaagtaatagaatggaaatggcacgtccggaaggggtgctcctcctaaagatggaaagcagccatcggggggaaagatgactactaatagggtgacccaacagaggaaaggcgagcttttttcgaagaagaaaagatttattccatttgttcatgccgtggcctcacggatacagtcactataacgcttgtaccaaggacatga

SEQ ID NO: 3650 - DNA, 703 bp, Nannochloropsis_gaditana
caaaaaagaaaggagtaatatgggacatttcacgcgaacggtaacgcgactggaaacccaagctcacgtggaaatatttcaagccgttgccctcatttaaaggaaaatgtagcacggctccatgattgaggatgcttatcctcggacactccgacggcccttcggtgcgaacgccctcactgttagagctgtcttgctcaaaatattgacgctgccgtgcattgtgtccctggaatagtgctatatatttttgcaacgcaaagatagatttgatttggaacacgcacgtgttcaagtgaaaggacagggtgacgaacgggtaagcgactgttccaaatgtggcacgattactgcgatgcgagctattcccatgtatctgcaccataccggctgttattttgggtgatgtacgattaaaagaggggcggaattttacggattatgctcttgattgtgtgtgcgaattcttcatttttgtccctcgtatctatactaggccttctcatcttcgtatcatacttcgcactcattcccactctgggaagcattcaataagccttgcgctaatccaacgagtcatgtatccacgtggcatttgtgtgcaccgatgttttattcctttagtaactcatactttttgccatcctcataaatacatagtaccccacagacttcaactatgctgtaccggaaaagcgccatg

SEQ ID NO: 3651 - DNA, 703 bp, Nannochloropsis_gaditana
  misc_feature (1)..(358): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagactatcgggcattatcatcttggcgactttgtgaaccgctttgtccgaggctccctggtgatgcagcctaaggaaggcgaggtagggagggaggatgggaggggggacgggaaggagggagtggttgagaacgggcgagtcatttttaagcacgttgtggaccggaaaaggggggatattcacacgacgataagcagggggggaaattggttcttggatgtgtgtgaaaatcactgctcatcgtcccttcctcggttcaccctgtcctacagagggagggtgggaaggagggcgggaaggagggcgggaaggagggcgggaaggacgaggaggaggccatg

SEQ ID NO: 3652 - DNA, 703 bp, Nannochloropsis_gaditana
ttaaagtctctggacacgtataatacatgatgccaaaatcagataaggccaatttgcgggcagccctccaggcttgagatgcggaatgaagaggaatagtatatatcagggagtgatatttggtcgcactttagatcatgtgtaacccgaattcggacatgtcttcagccagtccatcgcgagttatgaagtatgtatcaaattgtgacaaagacttgtaagttgatcgggagggagaaaaattggaaaataaacataccggcacccacacggacgtgtctttttctgtagaatttcttgcggggttgaaggctcatagatcaagggaaggcaatggtggaaccttagaaggagacgagtgtcggagtatcatccccataccctcgaatgtcaataaacgtctccgagcccagtctccatgcgaaaagctcattagcgatccgaatgattcttttttcccctaccaaaatggggcaatgaatgtttatcagaatgctttaaacatgcgaaatatgccccccaaaaaacatagaggaggttttttgtgcgatttcaaattgaagtcggcgtctcctttctttggttgctgttgccaccgaacaaactcacgttgacctgatttgtttcaatacgtacgtcaaacacgcagaatagagataaatgtactgataacgaggagactatgtcacattttagggatatg

SEQ ID NO: 3653 - DNA, 703 bp, Nannochloropsis_gaditana
gttccggaagtccgtcctctggcacatatgtgtttttccacgcaacgtctttctctgaagcaagatgaagaaggggaaggccgcgtatcttggctcgctgtcctgcagcctctcctttcccctcttcttataagagcattgtacgatgcgagcgacactttatcaggactgataaatgacaagtatgaagattgttgcaggggaggtggatgcactaagatgcagaggatgggcgcgacatgaaccccgtcttttctttttccctcgttcacgcatgctcgtaaataacgcacacacgcgtggccaccgtgtggatagccaagactcccgttcaatgctatgttcattctaatcatgttcgtttcgatttggagatgtagtgtggacatcaggcggcctagtcccgtccctcgtatggtttgctagtgtgctcctggctcggaaaggcgcgtggacgcgtgcttggctagagttttcgatccttgttctatgacttttgacaccacgcgggaggacgagccgtccaaagcattaaataaatgaaatctctaaactgaagaggaaatgggacaataagcgccgacccgatgtctaagggggtttcgaggatacgtcgcagtgatgactaaggcgtcaatgctccatcgcactttttagctcacgcactccccacctcttatccatctcacagatctacaccatg

SEQ ID NO: 3654 - DNA, 703 bp, Nannochloropsis_gaditana
cagggcggctcttatgtcagattcatatctccactcaaatagaactgaacgctggcttaaagtaagcgaaaggcttaaaattctagcggggcagacgcgtttgtatgctccatgtctcctcctctcagcactggtatgcctgtgcacaagatccaatcgggaagccatcgcgaccatggcagaccgggaaaagctaatggaaaagtttcaattttcacgaccgtggcagtcgcacgattggtagacaggaatgttttgtcagcaatcacaaaaacctcagtcgttgaatgtgggttagcgactcgccggactacgtccttcccaccggctcgcgttactgtggccaaacgtccgccgcaatgcgaggcaattcaatgctttctgggacacgcccacgctccaaatttgttggaccttgtggtcatcgtgtgtcctttttcgaagaattcacgcatcgctggatttcttttttttttaagtgagccccgatgtgcgccctaccacgcccccacgtcccaccctttttctttcatacgtccatttcttgcttacaatctccatcctggcctttatttttcaagactttcatggctattcaacttcgccgcaatctgatatctatctcattcaatcctctgtcatctttttttcaatcgttccgctgaacagttcaacctcccgcctcttccacacagtaaatatg

SEQ ID NO: 3655 - DNA, 703 bp, Nannochloropsis_gaditana
ggttcttgtggaaaggtctgttgcatggttgacccgcattgcatgggaagcaacgaggtgccgtcttctatcatcgttgtttggcttctggaagactcactagcatcactctccttccagtaggttttcccgatataggatgcttttgtcgacaggacggcagtttacacaatgggtcggggttgtctcgagctcgactgtcagtatattgaggggaagcaagcgcagcttgggtagcttcacgacgcctttggcctccatgcggcctgggccacatgccgtggatgggcgtaggcctcacggcaacacgagcaagacaagccttacacttacccgaggatggaggaggggtgtatcacgagagcctgcgtgcctctacatgggctggaatcatttttgggtgcgtttcacaccacataacagaggcagatttgcctccctttccagccaagctaggtaggtaggtgcttgggagaatgatgtgcatgaccaggtttgttccttctcaatcatgaaagaccatgacatcgtacttgtcttctccttcttaatgtcatgctgccattggaaaacgatgttgggaaatttggggaaggaacaacagcctcggaggctacatatctaagccattatccctatccctcttgtcgcgcacattcaaatcagcccacagtcaaatctgaagcaatccaaaaccggaatg

SEQ ID NO: 3656 - DNA, 703 bp, Nannochloropsis_gaditana; identical to SEQ ID NO: 100

SEQ ID NO: 3657 - DNA, 703 bp, Nannochloropsis_gaditana
gaggccaggcgtgaggcaaaaccctgctgtgtcgcacatttccaatgtttgatataagtgtgcacgaactgaggaggttatcttaattttttttgaaacaacagtttatcttaatttttttggaaacagatacgcatgcaattaatgattgacgcggaggtagcccggaatgaggaataatatgcctcacagatgcataatagaagccttgccaaaccggcatctgttcgtgagaatcgtgagaatcttagcacgaacaaaacacgactgacattcctgaaacatgcgcgttccaccagctcagataaaataaaagggtgcttacacaaattctgttgcaaagacttatttcagtgccacagcctcctgccatatgcgtgacgtctcgtcttcgtcccgctttaaatcgcgctcgctgatctgggtacgaataaaatgccgtgggaacagatcgggcgttcctgggaggaaagagacggcgagcgtgggttttgttttgaggtttttcccgggcatgtgagaggctttcctccgctgtcagcgacggagcctccggctggctctccttgcctctttgaggttgctgatattctcatcttttccccgtgcacacaatatagagactccataccgcccagtcaacatgcaagtcctcccgtgtgtcttcacgttagtatgtgcggtgcccgctttcgcttttatg

SEQ ID NO: 3658 - DNA, 703 bp, Nannochloropsis_gaditana
cgacaagaggagggaggaaatgacggggctggtggtttaaagcgtgttggtttttatcaacatcgaaagcttctaaagaaccaatctagctgcatgttgctccctcttcgggcgagtacttcccttctctgttaggcgatgggcgagcctgagtgatgcccataggcacggagtatccccaacgaaattcacgacgtgtaaatcgagattgcaggaggtgagggtgcggggggcatggcggtgtctaaagctgtgtgacacacggaaggctttagaagctgtcgatggagacttccgggtatcctggtgcaagcttgctgtgatcctgccaatgagccaggttcacaaaggcaaacttgaaggggtgtgcagtgtcttgataacccatcaaagacatgatacgaggcatttgtttccatatgaccctgtgccctattcagtcacatctcccgtgcaagcgcaggcacatgcgaatccctctggtgcaaagtgtgatggccgggacgcagccactgacgtgttggaccatgttgggacagggtctgcatcaccgttctgttatctcgagaatcttgctacctcaatgaggaaacgctctctgacctcttcgcacaattttagtccctaacactctcttaacgtatcactcacacattgtgacacagacgtggaaatcgacttcaggcgtaacactttcgcaatg

SEQ ID NO: 3659 - DNA, 703 bp, Nannochloropsis_gaditana
ggcggtacattcgaatttgacgccatcgatgaaccacggaggcggagggccagtcggagggtcaacggtcggcaaaagggtaggaaaaagccgggtagcgacgcgaggactgtcggacaagaaaagtaagaaggaatgtcatgactacaattaataaaactatgaaggttccggcacaggatgtgtttgagcgtgaatgaaagcatacggcccaaggacgggaggggcgcacgtcacttcaaggaattgcttacctgctctttaggccattaaatgcggtcaaacgaggagaaagctgatgctgtgaccttgatattgagtatttccagctttgtgcaacaaaagggatgcgccagccctccactatggccacccaaaaaagacccagcgccaggatcgtagggcagagaaggggcaagcaagcagggaaaaaacagcccggccgcgccttatacatgatcagacgagccagaacgacagtcctgcggggaaatggaggtgttattgcaagtgtgtgagacctttcccggcggacacggccactttttatgcggccgacgagacaggtgaatataggaggtcgctgccgccgactgctgacggatatgaaccacattcccagcatgagatgacgccttacctacaggagggggaggtcagcacactaatgccacacgtcctatctttcacaggcacaggcatg

SEQ ID NO: 3660 - DNA, 703 bp, Nannochloropsis_gaditana
gcattggttaatgcttgtgcatggagaccacctgtaggccatgggaagtcagtgcgcgggaatgtcgacactaagagctgagattaaaataaaacgacagggttcaacgaggccgtgcgaaacgtcagaaggaagccgcacatactcccacacatccgctcatacgccaacgggaaagtcgatggatgttctcacgcaacaatgctgggtcttttggatatattttcatgacataccaccccatggcttgacttcctaaaactccgctatcgccatcgcgtcgccccctgctattgccattccgtccgcatttgtgcatacaagaggaggaatgaggcagaagaggcatccttgatcagtttttcgcaacattcgaataagcagtggtgagtccgtggcaactcgtttttcagctgaaatcagcgcgggtagcaaaatttgtaccctccacttgacgttatcgcttcctgccaaaccctgtccctcaagcccaggaagggatttggaactgcatgcgaaaatctctcaacgtctgcttttctgcacaattaatgcgtaggtctggagatatgccaggtcctgtcccccctcaaggtgaagacgaaagtgaaaaggcaatggagacggccgcgttgctgacagctgcagcagcggagcaatgggaggctagcttagcacgcttaaaaaatgaaattaatcgatg

SEQ ID NO: 3661 - DNA, 703 bp, Nannochloropsis_gaditana
  misc_feature (1)..(692): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacagagac

SEQ ID NO: 3662 - DNA, 703 bp, Nannochloropsis_gaditana
ttttcaacatgtttttataaaaagggaggggggaaagccgccggctacgttcccatccccctcccttcaaaccacttcaacacaaagtaatatccaggctcgtacccacccgatttacgtttgtgtatctcgatggcatcccccacaacatccttccaggtggctctcgctacgcaagaaaggagcgcatggccacggggtgttggagggggcgtggcaaacgaaatggcacctctctccctcctttattaatcctttccaccttctttgcagcgcagctcttacccagcctcggctttcatccgcgttcgttctttcataatcaccatcaaaagcatcgacagccacacacaagatggacgagcacatatgcgacagtttcgacagcaaccgtggggctaagcggcccccctgcccttgtttccatcccgcaaccccttcctctccctcccacccttctccccgatgtcgagcgcgttagggaggcgggaggaaaattgcgtctgcgtggaatgtccttgtcggacatcactaccctcctcacgtatttgcaggtggaccccgacccggcccagaaagcgtttgccgtgtttaagtggctgtatcatagggatttgatgctttcaaactccatattcgaagcagctgcctccggaacgaattctgccgcttgctgcctttcccgacggctttgccaggccct

SEQ ID NO: 3663 - DNA, 703 bp, Nannochloropsis_gaditana
  misc_feature (636)..(645): n is a, c, g, or t
tttcgacagcaaccgtggggctaagcggcccccctgcccttgtttccatcccgcaaccccttcctctccctcccacccttctccccgatgtcgagcgcgttagggaggcgggaggaaaattgcgtctgcgtggaatgtccttgtcggacatcactaccctcctcacgtatttgcaggtggaccccgacccggcccagaaagcgtttgccgtgtttaagtggctgtatcatagggatttgatgctttcaaactccatattcgaagcagctgcctccggaacgaattctgccgcttgctgcctttcccgacggctttgccaggccctggacgctgttaccaccttggacgacggcctccgccttttggagcgtaaaattgccggagacgggacgcagaaattggtcatgcaagtgaccgacggaccggggaagggccaggcagtggaggccgtgctgatccccatggtccgagggccggagcaaaggccccgctttaccctctgcgtctcctcccagagcggttgtgccatggcgtgtgccttctgtcacaccgggaagatggggttgttgacttcgttgacagccgggcagattgtgagtcagtgggtgctggcgcggcggttagggagggagggannnnnnnnnnggtccgaagctccttcatgccgatcaatcgccggtaccccctctccagctccctcctt

SEQ ID NO: 3664 - DNA, 703 bp, Nannochloropsis_gaditana
cagctccctccttccctccctgcgccggcacttccccctccctcgagctgcgacgagcaccggacggagggagcggcggcggcgggggcctgtggctctggagtacctgctcttggcgggggtgaatgatgacgagaaagacgccgagaggctggcagcgatgacggaagggatggactgcgtgatcaacctcatccacttcaactcgcatgaaggttcggggcaaggagggggggaagagggctgaggagggacatcattgctttgacccctccaagcaatgttctcacccccccttcctccctccctccctccctcggcaggcgcaaactttctgcctgcctccccggacgcgatccgatcctttcgacgcattttgaaggaccacgggcgtctctccaccgtccgcgagtcgaagggtgcggaggaaatgggggcgtgcggacagcttggtgatttgagcatggcgaggggtaggagggacggagggcgggcaggggatgacggcgccgaggcacaggcatgagatgtaattgtatggaatcatacaggagtgaccgatccaatcctttggcgcacgctcttggcttatgcctttttagagccacgtcggatgcgtgcgtacaggtggatgtcatggctttttcctttttacattcccccatctcgtcttcctccctcccgctttctacattcccggcga

SEQ ID NO: 3665 - DNA, 703 bp, Nannochloropsis_gaditana; identical to SEQ ID NO: 55

SEQ ID NO: 3666 - DNA, 703 bp, Nannochloropsis_gaditana; identical to SEQ ID NO: 57

SEQ ID NO: 3667 - DNA, 703 bp, Nannochloropsis_gaditana
tagactcgacgaggatgagcgccaatacagggtccatgtaacagcatgcatacaatcccgtgaggattgccgaaacacccatatgaattgataaataattcaaaagcactcttgtgagagctgattcacaaattttattttatcagacattttttagacaaaaatggaaaccaaagagcggcactttttctccgccagcctcacgcccaaaaatcagtgaaagcatcaaaaaaagcaaacgtgcacgcagagatgaacacagatcgcaaagaggcccaacagtgtcgacgctacgcgttcagcttaatcagcggaagaaaaaatgaatagaaagcatgccaggtacatgggccggaggtcgtgcgtgttctgacacgaagaaggggcgtcgccacctcttcttctacacacgataaaccatgtttcgaccaaatgaagcaaaagttcatgctttggcgcccttgaatcaaggtatctcatcaatcgaattattccctatcccattccatcagaatatctcacgcaggtgtatttaaacgattgtaatatcagggcatctaagttcaccacgatccatcataaagcgttcctccctcctgcatcaagacgactataaggcggttggtttcgcaccggcagcttcataaaaaagtgtcttatgccaacaacacggtcaactcataatggtcattatcgtacaatg

SEQ ID NO: 3668 - DNA, 703 bp, Nannochloropsis_gaditana
tctgccgtcctccccgttcctcccgcattcatggtatcttggactgattctgagaagctccttcggttttgtggagaccggggagtgaccatcctcctgaaaattgggaggaaattaacacggagatgagctatactttctcccgccggtccgagcgccagtctacacagcccgccccgctgagtgctgtgagacgccgcgattttcaatttaaagcaggtaaagatgacaagataatctcactcgagactgaaccgatgctcttgaccagaaaatttcggtcgtcccgtctgaagaacgatggaccgaggcatttccattctctggcctgcggtttttgaagttttgtcgtcgttggcgagggggcatataccccccctgtacgagcccgcgcggcacctgtaacagcgtcccaggcccgctggggccttccacctaccggtgctgacagtcaggaggagattgctggagaataggcttgattttacgcacacggtggcaggcatggtggtggtgccggtgggagtgtcgcgcgccaagacgggagcatattagcccgacggcttcaggacttgctgtatcgagcttgttggaggatctgtctaccggcacttagcaatgctcatgtccgtccgtgaaacgttaaagcgcatggacacaagaactcaaacaggaaggcaaaggaacggagtcagggacattt

SEQ ID NO: 3669 - DNA, 703 bp, Nannochloropsis_gaditana
gcagctcaggccatcgcatgcaaaattttaacgataagccggacatgtcctggcaagataatggaaaggaaagcacttctaaaccagaaaaagagaaagaaaagactgagaagtgcatttgcaaatagaagtcgatctgaaccaagtttccgctttgattcttaacctgaggcacatttttccagcccatcggaaaataggctcgtcccgtgcgcattctattggaaaggaaaccaaaaacatatctcgtgcataattgaattgattaccacaagggttaagaactccagctgtggtcagcgggcgtatggtctagtggcttgtcctaaggcgcatgttgagcgtgtgctgcgagggcaactggtgtatgattctcctttagggtaggagaggtccggcgttcaattcgccgttcgcccccattctttttttctttggactgcgacacttgtggcgtggaatttgtctttcgttttcactcttgaggcttggtgtatttgtggtccatgctgttttattcatttttggctcatttttttagaaaattaactacgcagagtatggggcaggaaaaatagagtcgttatcagacaaacatgctaggatctggcatgacatggatgccctggataacttggctttcgtacccgatttactttatgtattgtttcttcttcctccatattcgccataaaggcttatg

SEQ ID NO: 3670 - DNA, 703 bp, Nannochloropsis_gaditana
  misc_feature (417)..(426): n is a, c, g, or t
taaaccttttttcacacgtcacttttaagatggcccatattgtcaagcatcagatatttggggagcctgtggacgtgacgccccggtaagcagaggcgcaagggagggcgggatgaagggcgggttgagaaaaagaaaaagggggatacgggaggtggatgggcacccctaggctctttttcaggcacccagtcttcaattctcaaatgggagtgaagaagtagggctggcctctccctcgcgatgctccccatttcagaggtccacaacgtcacctgtcgttctctctcaacccccccctccttggtgacccttccaaccgcagtggcctttccttccggaataatacgtttcggtcctgcgacgaagtctccgactatttcaaagaacatttcagggatgccgtctccctatctnnnnnnnnnngcccatctctggtcgattacccggtaagatgctccctccctccctccctccctgcttctatgccttcctatccatccatgcaaaattttgatctttctttcctctttgtctctttgccaatccattacgttccagactcgacgataaatgggaagaacttcaacgacgcaaatccttcgctttggcacgcttcgaacgtttttcagccggacatcacgggtacctcctccctcctttcctccctccttttctcccccactcttttgtgccggtgtct

SEQ ID NO: 3671 - DNA, 703 bp, Nannochloropsis_gaditana
ggcgtcgatgggatcacgagaaaaaaagtttttccgggggcggacaaggggaaaagcttcaggggctggcgtgcagaaaagcctcccgtgtatattaatacctttttttggaagggccagtcttacccgtgcgcaaagtgtccaggggtgggatcaggtgaaaagcgcgtgattgcgggactgggcggtgtattgcacgtcaatagcgtgcgtggtattagacttttggtcgtggaggacacttgggtaacactcgagtggaataccagggaggttgctagcactgagggaaaaaatcgacaccatgaaaaaaaaaaagattttatcacctcactatattgagaaaccttaagcagtccctcatgagatagctttttttgcctgggcaagttaaaaacgtgaggtttggtggttaattgccttgcagacgtcgaacgattgtgtagagcattgacccctggcaatttatcgtacactttgatgacctctcagcacccaacgcgttcctcattcatccaccgattgacagggtatgagacgattcttgcagggaagttagaccaagtaaaccatggacaaggctgatcgaaaaaatcctgcgggagagacctgatatcaatagatcacgaactcagcgggtggacgaaaataattcaagtggaaaaatagggacacgaaagaaaaaattgcgggtagggaaatg

SEQ ID NO: 3672 - DNA, 703 bp, Nannochloropsis_gaditana; identical to SEQ ID NO: 1328

SEQ ID NO: 3673 - DNA, 703 bp, Nannochloropsis_gaditana
ttctttgccccctcacgtctcgggattcattcaagaaaggcttaccgataccagaccttgccactgccgcgggtggcaccatcgacacattgtcttcctcatcctcgtgcaccactgggaggtcttcctttccctccctgtagaatgtccaaaagtcgagatgcggaacgcggtgtttttgagaggtgctcgtaagcccactccaaagtgtgcatgcgactccatggttacaatcatgccacggaaaaaagaacttacccaatccgctgatagcctccacgcagcaccatggccctcgcagcgtccctgcttgacgggcgctgatggcaagggggggtataaattcgtgttgagtgcgtcacagggcgtccaggagacgaggcgtaaagcgaatcatcgccagggaagggatcgagaacttccctgccttgttggtttcaccgcccgtcactggcgtgccttggcttttaaagggctttcctacatatttttgcacgttcttcttgtttgccagttgcctcccaaaatttcacttatcatttcgaccgtcctgtcttgtggaggaattaatccggctctctcttcatctttttacatcgcagagagcggaggtcattctgcacaggtaatggccgcatgccgcataccaacgagggggaggtgtcacatttcttggacaggtaccgcactttcatcagcgtgt

SEQ ID NO: 3674 - DNA, 703 bp, Nannochloropsis_gaditana
gatggggaggatgcccgcggcgtccttagctacgcggcttggaagacatacccggtgcgcgtgaacgggctgccgggagacgcgaacgagggggaggtgatggcggtcttttcgaaatacatgccctacgacgtggaggtcctgcccgtggaggcgtcggaggccgcggacgggaatgagggcgggactcggggggcctatctgcgctttgcccggcgcatacagggggtggagtgcgcgagcgagatgcaggacgtgagcgtgcgcaacaatgtcctgcaagtgcgaagggcctgggagaaggtctaccccctgctgatcgaggcagcttcgggggaggggaaagttaccgcggacgagcttgagcaagtgctcgcccctttgaagaggatgaaggactcgtccctcctcgacgccgagctccttaaagagggggcagcggcggtgatccggttcgggagtcagacaggcgcggaggaagggctgggcgtgttggaggccggcgcggggagcgggaggaggaaagtgcggccggcgtggaaggacttccgggtggacgtaagaaacctgccactggaggtgacgcaggaggagctgcgcgagatggttcacctgacgaccccctccaaagtggcggtgtccttgcccgtgggcggccggtaccggacgggaagtctctcctttaccacgcgggaagaggcag

SEQ ID NO: 3675 - DNA, 703 bp, Nannochloropsis_gaditana
acttattggccaccatgcacgaccaacagagggcatcataccatccccatctgatggtgcctcggtcgtcgccacagcatcgccccgaaatccgtatcgtcacagcgcgaggctggagatgcgctatttgcgacaatttcttgcgttatccgcattcctttttcaaaaagagtaggtctttgtgctcttgagtcgattccttttttctgattgctttacattctttatcactttttacttcctctttctagagcagacgtttgttccaaggccaagatgaagacaagattagcggcgcggcggtcgtcacctctaagacacatacgcctgatatttcctatcctaattattttcgacctgcagattgcggatactgttagcgggtttgttcttttaaagccccccccccaatcacattctagttacctgcggccctcaacctcttcaaaggttccaccgcgtcaaccgtgtgttgcgcaagccatacgctccatcaatcttcgtggtatcgcaatattctcattaggtcttaattcttacattgtcccgggccctgacaactctcaagacctgcgggaattcgatattccccagacggtgacggagcctctcccccttccacaagctgtctacgtctttggtggctacaccagcaagtccaaggctcgtaaactcatccgcaagggacaggttcttgtcaatg

SEQ ID NO: 3676 - DNA, 703 bp, Nannochloropsis_gaditana
agtggaccacagatgggtgcaagctgcgggctgcagggaggtataagcgtatactgggaagccacaacttctctgtggagggacggcgacggagggccttataaccggagcttccaccagcctcaaaattggacgcgggagataagttgaccgaaaaccgtacgtcgaaggcggtaaaaggaaaaagacggcaggtagcatcactcctagtaggaggggccacggccgtcgtgacctccccccaggccccatggaggtgccacacagagccagagtccagctggaaaagacaaaggaaacagtggaaaagcgctctgattacttgacacgactagcgagcgagtaagtaattggaaagaatgagagctccgggcaccttgaggctattttcgaccgccccccgctgcttcaagcgttcatggcttgaggggcttctagccggaagtctcgttcgttccacgccccgcattgagaggggctatacccacgctttccgatcctgttctctcatgcacaatcacaaaattggcagattgccgttgcaccttccatccatgctgtcgccgcggtgatatatcacagatcgtggaggggcgctctatcattagccgacacaaccccctctccacttcggagggcaacaacaatagcattgaccgggtgataaacaggctcgcgttgaccggggtacacgatccaaatg

SEQ ID NO: 3677 - DNA, 703 bp, Nannochloropsis_gaditana
gcacacgagtaccaaggagagcccacaatagacagaaatcctccaccactgtgggatacagctatcttatacccctgcctgcgtgtgcatggtggagatacagggtttcgatgaggcattgccgtcgtgggggaggtcagaccatggcgtggatctgaagcccttctctgcctctccagaccgagacacatttcaccgtgatgacccaaacatcatggacgtggcagatggatgaccgtccacgtgcggcgtggcgaggcacatgacgcatgccgtagcgtgggcaaggtttttgatgacttctattttagaggtgttgtagactttccctttgcccctctctctcgctgtttcctccatctctttgtcgagatgcctctcgcgtgtgaaaattggacacgaaggggccgtgcacgtgcattcaggggtgcgacgcggatcatcgtgtgtccgtgatgtcggcggttgcctgcaagacctcatattttttatgtgttggccggcttttatcttgactgcgtgcgtgctgtcgcaatctcttcacaagaaccaccccccctgaagtacttcctttcttcccctcctccctcccgccctccctcccttctctctcacgtacgttccacgcttgatttgcatttccccctacagcggtgaagattccaggatttctcttcctttcagccaacccagctccaccatg

SEQ ID NO: 3678 - DNA, 703 bp, Nannochloropsis_gaditana
gcccaaaccggttaggtatcctgtcatttatggagtcatcatcctcaccaataggtttcacctcccctcccccaaaaaggggggagaaacctattttttccaaattgctttgcacattaatataggtatttcttggcaatgatataccccacttatagttgcaatcaagactattaggattgttaatggagcatgactgggagaatggccatcccgctctgtcttggcactgggcaggtatttcggagaagacacgttgaagaaaaagggcgtggctttggatcaagaatacttttgataacatattttgaatgtcgtcgttgtatgcgcacttggcattgattgtgtcttcgtcaaactcggtaggatcgcaaaatgaggtcatctgcatgatgacagtggcttgagaggcgtaattcatgaggaacgcggcgatataacggtacctttggccgaacttcatgaagccatcccacttgtgcgaaccgtcctccacattcctcaaacagttttgaaaactgtcgacgttgctcgagtgatatacagggggcgggtactgatcatagttcgtcccctcggtcatcctttgaggtctatccgtcacgcggcacttgttggcgttatcgttgatccagttgacaacatctatgcgagaattagtcttgccggagacggtgccaaaccatttgtcataatcggcatg

SEQ ID NO: 3679 - DNA, 703 bp, Nannochloropsis_gaditana
aaattgagcagtctcccaacctcactgctatggctttaagtaaagatactggcacaagtgtggaaactgacaggaggcgcatgctgaagcccatgaacgacgtttttgacaaaacatcccctactcttgcgtgcgatgatgatgacaacgcttgtgtcatttattcccccgagcgaaatctggaagaagacaccgacgaacttggttctccggtagtatccccgcccctttccccgtcatctcgaggcatccagcagaccgctgcaataggtagacagggaaagagaaaagattcctatgaaaaaggcccttctgccttttccctcgctcctgttgcagcttgcaataccgtttcgggctttcctgccccgaccgccttgcccgcctcctcgctcgcttcctctgtgcctcgagatccccgtaagcttgcgagggagaagatcgcgcatcggactacggctgttaaaaaagttgatttcctcttgccaaatgaagaagactcaggcgatcatggcaaacgcactacttacatgcgcagccatgtacttgaagccataagggcaacgtccagacagacctcttatagtaaatcatgccagcactgtcaaagtcagctatctacgcttcggtgtgggaagtgtggtaggtgcgagcattgctcttcgatcatcttttgcaagggtgccgagaggcgaagccgtct

SEQ ID NO: 3680 - DNA, 703 bp, Nannochloropsis_gaditana
aataccgtttcgggctttcctgccccgaccgccttgcccgcctcctcgctcgcttcctctgtgcctcgagatccccgtaagcttgcgagggagaagatcgcgcatcggactacggctgttaaaaaagttgatttcctcttgccaaatgaagaagactcaggcgatcatggcaaacgcactacttacatgcgcagccatgtacttgaagccataagggcaacgtccagacagacctcttatagtaaatcatgccagcactgtcaaagtcagctatctacgcttcggtgtgggaagtgtggtaggtgcgagcattgctcttcgatcatcttttgcaagggtgccgagaggcgaagccgtctgacggagatcggccatgtcaatcgattgagtgaacggatggatagggctatttgggacgcatttaaggacgtgaagaaagggtttgaccccattttggcgttagttcagcacgctggagtgagtgtcaattttagccggcccgcaaagggcgaaactgcgctgatggcggctgctttccatggcaaactagcaactgtcaaggagctcttgagtttaggcgcagatccgtgcctaaaaacagctgatggtcatacggcatcgacattcgccaacaaatacaatcacaaagagtgtgcagagttgttggcgatgcaccctgtcgcggttcccgcccagcgagatg

SEQ ID NO: 3681 - DNA, 703 bp, Nannochloropsis_gaditana
aaagcatacgatagcacggtcagcatcgctagccataataggatgacttaaaaagctatggagtcaacaatcaataatggtacaggttcatgtgactgtttcctgttgcattctagagactgcgggatggagactttctttgacctgtccccgaaaaaaaggaagaggactgtaagatcttgtgagttactgcccacgtcgataatcctcctcgcagatgcatttttttactttctaatcactccagggcctgcacttgtgcatgcatttaaaaggaattgaaaggagtgaaaataagcgatagcggtgactgccgcgaagcaaaggcggacgatttacccaaaattcgtgaccctgttctcggaacccccaccaccctctttcatgagggcaaccgtcaccatgcatataacgtatacaggtaccaacagcacggacgaggcataatttgaactgtggaggcgtcagaaagggcttgactttcattgtgtcgcaactccgccccgtgactgcctccccccaaaagcttccgtgacctcatatcgccgtctcttcacaacctttttaaactcatacgagtaccttacgattgcacaccacggaacagtatcatatgccttctccctatcaaccacctcgctgggcgcctcctcgcaagcacggcctgcaaacccctttttccagagatcagctgggcgcaatg

SEQ ID NO: 3682 - DNA, 703 bp, Nannochloropsis_gaditana
cacggaacagtatcatatgccttctccctatcaaccacctcgctgggcgcctcctcgcaagcacggcctgcaaacccctttttccagagatcagctgggcgcaatgattttatatcccctcctcacaacggtacgcgtgcacattaggatggggtagtcaaaaggaacaaatagagacgaaagaatatgaagtagcaaaaagaggtgtggagatagggctatcaagggatattccgtgtgtgtcaacaagcctctggaccaagtttgaagctagaagaggaccatcgcgtataagaatgtggcgtgcataagggcgcgtccatttctctccgggaggctgtgtcttttccttcacttctccagcgcatgaacacctgacgaggatgcctgttcattggtccgttcctcccctcattcccaatggttcctgtacactttcctcgacacaccccgtccctctggtacggcaggccttttacgttattgccgctttctacctccccgacgactacctagcgctggtcatggccacatacacggccctagtgctaatatcagtcttttgctgggcttacatatctctcaccgaccccagtaagccgggagggatcccctgcccgtgcatggcttacacacaagcgcactcccggtactgtgcttcctgccgaaaatcggttcccggactcgaccaccactgcctatg

SEQ ID NO: 3683 - DNA, 703 bp, Nannochloropsis_gaditana
ttgaagctagaagaggaccatcgcgtataagaatgtggcgtgcataagggcgcgtccatttctctccgggaggctgtgtcttttccttcacttctccagcgcatgaacacctgacgaggatgcctgttcattggtccgttcctcccctcattcccaatggttcctgtacactttcctcgacacaccccgtccctctggtacggcaggccttttacgttattgccgctttctacctccccgacgactacctagcgctggtcatggccacatacacggccctagtgctaatatcagtcttttgctgggcttacatatctctcaccgaccccagtaagccgggagggatcccctgcccgtgcatggcttacacacaagcgcactcccggtactgtgcttcctgccgaaaatcggttcccggactcgaccaccactgcctatggcttaacacctgcatcggtgcacggtacgcctgcattgagggcagaggaaagcgccggggatgcatgtgggtgagcggggactgggtgcttcgttcgcctttctaatctacacttttcgacccgcctcccccttccgccacaggaactactttttcttcttcctcctctctttggccggcaccctccagtttgcgctccagagcctgatcagcatccttctcctcacccactggctcaacaccaccgaagaagtacccgccatg

SEQ ID NO: 3684 - DNA, 703 bp, Nannochloropsis_gaditana
ctactcagtcactcatccttgatggatgttagacttcaaccgttcaaccgttctgaaggcgtcactcctgacagtatgttgttcagcatgctacattacctgagggcgaaagacaaatgcgttgccgctgctcataaacaagaagacccaaagagcaaccaatagttggcaggatgcagcaaccttcatgttgaaaaggagacaaggcaagaacgacgaagcaaaagcggttctctgaggaagcagggggataacgacaggaagggatgaaggtgagggacaagatttacaatggccttcacgggacacctgtgcaataaacatgcccaatccctactaatgcaccaaagtgccgtgtgcatctcggcacggcttcgaaacaaggaccctgcgcatccaagcagaacaaaagcctcttgcctcccggccctcctgcctgtccagcaacggctgggcccatgtcccttgttcttcgcctgcactgggaggggtcacagcgtctccgtggcctttagaaatcacgagaaccacctactgtgacaatgacagcaaccacaaaagcatttcaggtttatctgcatgagttgctctccaaattgttacagctatgtttttaagtactgctgaacctccacgctgcgcatgacgacatacacatactccttcacttctctcacgtcgctttacagtgggcagcctgatg

SEQ ID NO: 3685 - DNA, 703 bp, Nannochloropsis_gaditana
gctgttaattccctaaaaacaaggctgaagttcagcaagccagtcatgaccacatcgccacgcgacattgccaaccaggctaggtctccgtgtcagcctcaaatttactacccttgtacacttccacccgatacgcttccatgctgtcacaaatcagccctgtcgtctgtttgtcctgcctgttgttcctgaatggaacgagctcgtttcgttgttcttttaacacacgtccaacgcccgacaagtaccccaatgcttcaattcaccattttccaatgaagcacgctgtgtctcatacatgtaacacaagccagcttgtccaagcgattaacgttcgcttcatgacaatttgtggtttagttaggccgatttcagcaggcgcctgatcgccccagacggacatctcggccctgtcgctcgtgggactggctgggagcacccgaggaaattatataccgcgtcacttttgaaggaagtggaagaagactacgaacgctttgcatgcgcatccgtgtacacatttacgcgtgtaagcggtgtccgtttctcgtttgttgtttgcttatagttcgacggcggccaagttgccctcctcgtccatctcttcaacccgcttcctgcgcactaacctgcttatctcccctcttactccctcccttcttcctcctttctactttttgatgcacgaccgcaggaaagaatg

SEQ ID NO: 3686 - DNA, 703 bp, Nannochloropsis_gaditana
gctaggatcaaagtgggagtggcttaaaggggtcaactcggcaagcacatgtccaccaatttaaagaaatataaaacacaagcatgcagtatcttcaataaatctcggagtgaaaatatgagtaaataatatgaagcaacgaagcaagtcgttgacgaatgggggagtggaaagtattccaatgtcgctcctcatcctgcacaacatatggaggcggagaaaagtccttcctccggatgcttcagtagattatcacatcatataattcgaatttatacgcgcgagacgaggcactcttttcatttcattcctgtcctcgtttctccctctccctaatccttcatcattttcccatgagagcaggcatattgaacccttttcaattttctttgatgtaagaatgtatttgatcacgtttcctcctttcatccgtagaccgacaaaaacatcttattcaagctgtcgacggaaaacgagggaggaggttaattgttccgccgcaggcagcgacccgcccgcctctcgcccgatcacatcgtagtctccagtaatgaaatgcaccacggaatcccacgcccagcgtgggttgatgcttttgcgacgtgttattgtgcaaatcctgcgttttcacatgaagatcgatcgttttcattccaagtacatccctttgaaggcttaaagtgcatgcacgtctgtagaaatg

SEQ ID NO: 3687 - DNA, 703 bp, Nannochloropsis_gaditana
cttgaggactgcgaccgcacgcttccgcctgtcggaattgtcccacgcagattttaccacgttctaggtcgctttaaattcaatcacagacacccgtggcaacatgccaccagattgtgggatcctacttctttaagcatacacttttttcggccacttttcttgtacgctcctaaccccccagccggctgcaacaaagaagctgtcgatcacaccagctcgccatgagtctgcatcccgatacctttagcctacttctgggagttaatgagtgcaaaaaatcccagctggaagcgaaaaaatggaggctgtggggatactattagggccagacgagcttctgccgggggaagcgagcgaaggaatccgaagagcgaacgaagttaaaaatctcggacccgaacattcaatcgagcctcccctgtcagtacgctatttccgcgtcccaatctccctcctcttgtcctcattgccctcgatgacatttttaaagttcggatgacatactgagaaaccacgactgcccaatcattacatcccccttccactgaccataggccctgcagcggtacccctcgctcgttcaatctgaagttttttctttgtgaccaggcatctctcatgaacgtcgaggccagccccacaaaaaaatacaaagttgcaactgcataaatcggtgattcgtactttatttgcatctatg

SEQ ID NO: 3688 - DNA, 703 bp, Nannochloropsis_gaditana
aaacgcagccaatctctcaggggtacatatacctagctcttgaaatctaggaatcgagtacccaaggcctgaattatcgtggaaagagggtgacggtcagacacgcaaagtaatcataagccaagaaaagtatagagcacttaccgacggactcgagccagtcgcaaacatgaaaatctcccattctcttcctgtactttaaggttgacaattccaatcagcagtctgcgagaatatcgcatggaagccgcttctcactggatgggacacttattgttagcgaaagaaaaaaaacggaagttgtgttagtcttgggaagcggtcctgctgcacattgaggcctaaaagataaaatgaaaaacacaaagaaatggtactgaagaagcacatcgaaaagaaacgagctcagagcgagcgtcgatgaattggacatggacagattagatgcgctttccgttagaatttgaaccaaatttgaattctgaccgggaagcacgtacaacccgaagcacgacacaatccagtctgagcggcgatctcgctcatgcagcctaccctccctgttcttgtaggtatcacatgccctgcgaatggtactttataaaagtggcatagttttcaatgcatagctgtgcagtcttcacgctcaaaccttactgtgacctccctggtacaatatctttcttatgctttccttggtcag

SEQ ID NO: 3689 - DNA, 703 bp, Nannochloropsis_gaditana
cctccctctcccgttacccaccccactcccatctccacccagcgggacctggagcggctcctccgtcatctcctccctctcgtcgtcgggcgcctcctcccactactcctccattcccccgtcctcctccttccatccctccccctcctccagccagagcggagggtcccaaggcagtggtggtggaggaggagggcagggaggaaggtacctcaccacccagccgggccgcgacgacggggctctcctctgcttgaacgcggacgtggtgaagcggcccatatcggcaactctgcgtgagcctccccctcccttcctctcctcccctcaagccagcactgtcgtggctccagggacgctcccgcctgcctccttgtccttcgccacgcctgcgacgttggccgcagcccgttccatgttgcaaggcttcttgcaggggaagtacccgctgtcctccacctgcacctcttccacctcctcggtcgcctccaccggcaccgcggcgtcccgccccatcattgtccgccgcgcccgccgggcctgtgcttactgccacacgaaaaaaatatcctgcacctgcacccgcccctgtcggcgctgccaggacttgaacctggtatgctcggactacgttccccgacctcggcaccttggtcggtcaaaggggagccggagcccgccccagccacgagtgggccggaca

SEQ ID NO: 3690 - DNA, 703 bp, Nannochloropsis_gaditana
gatccaacgtgagacactacaaaccattccatatcctactgcactgtactttattgggttttcaattacatgctcgtctgatagctgtcaacacagcacagaaatctattggggcgaaaaactcggatgggaaggacggaggagcatcaaaaggcaacacctggctcattataaagctgtttactgactgaactccgtattgcattgcaaggatcaggtattcttaaaagtgatacatttttttaagtagaagatgctatctcgtactggaaacttacctggtgcctatttcgagcttaccaacacatcaccgtttttgcaacccttgctcattgatcctcattctgtcatttttaacagagagaccagcttgagtcattggggactacttatcaaacggattcttttttcctcaacgttgcttattcgtccatccctacgggtgcgtaccatggaaattagccctccctcaggcctgcatgctcgacctcgatctttattccttggggcaaacggacaccatgacccctttctccctcgcattcattcgtgactttgccaatctttcctcctcatggcaggagaagaatttccccgagcagaccacgacattacggaccctggggccttggtaggaggtacgaggcaacgagacgatcagccggcagcccaatggtccgacgatcatgcccgtgaggccatg

SEQ ID NO: 3691 - DNA, 703 bp, Nannochloropsis_gaditana
tggtgttaagcaggtgggaaaagtattgtaaaagattctcttccataagcagcacttctgcaagagccgtagcttcagggaaagcagaggcgcgaatcggcaaacatatctatatgcttttgtgaacaaaacagtggcataaaatggaaaaaagtaatctatttaccatagagcatcaaaagaaacagagaagtatccataggtttaagactgttcatccctatggaatggacgcgttggttggtctccttcaaggcatagacagaaagtcacccggaggtctgcttcgcggagataaggctattactgacaacgcttgagacctttcttcataaacgttgggataaaatatggacaggttgtgccctctttcctaaattgagcacatttgttgaacttggacacaattttcgctaaggaaaaagcggtcacgttttggacgccgccctttttgctccatggaagagtgggcggtcaggcataggcagtcaaccagccacacgctttatgaatattttgccacctctttaacccacaatgtaaacttccaatctatcctagcgtcacacgcgtaggtgcggtgctcggattgatggtgattatatttcacagtacctgtaagggagcttaacagacagacactgtcatgcctcacagattttgtgtaaacttgtggagaccctccatttacttacaaaaaatg

SEQ ID NO: 3692 - DNA, 703 bp, Nannochloropsis_gaditana; identical to SEQ ID NO: 54

SEQ ID NO: 3693 - DNA, 703 bp, Nannochloropsis_gaditana
ttcacgtacctatggcggctttccaagctctgagtgtcgaaaccctgtccttcattccacctatgccgctactgcgtctggccacgtccttgtttaccccttcgcatcgtgcatgctagctgagtttgtctctgatgtagaaaaagaaatggtgaagtaaacgggcgacctcgcgtgatgagatggcagtgccacggcgtgagtctaggggaacactgacacgcctcttttctgagcttcactggcgacgtgggcgagggagagacgcacgattgccacccggacaaggcgcattgcacgaccccttccatggtcgtgtgattgttcatgagccctcagtgcaataagggtgtgttgtcacgaagaggcttgcaggcttcggaaacaattacgataaattcaacgaactatcatccccaggcagcgagggagcaatcgttcgttctcaggatgtacacattcctctctcattccattacctagagcacacacagccatgaatgcacctcttcatgaccacagcgctctaaccctggcgggaagggcagcacactcagcagtcattgtcacagggtccaggaacgagccccctttctcgcctctcacgggcagtagcagtgcaacttcgcaacctccccccctcccccgcccaagtcctcaaaaaaaaagcactcccaccgacaaacgaaaaattgtgacgagt

SEQ ID NO: 3694 - DNA, 703 bp, Nannochloropsis_gaditana
  misc_feature (1)..(61): n is a, c, g, or t
nnnnnnnnnnnnnnnnnnnnnnnnnnnnnnnnnnnnnnnnnnnnnnnnnnnnnnnnnnnnnccttgcaggtcaaacccagcatgttcagcaccaacgatttggagatgcccatcgcggcgtgtgacgaggtaatgcagacctatacctgatctttccatgctgccgcccctcacccttatttttctgaatttatatccttgctttttaccttctttgtcgtcccccccctttttttttccccttcgcgctgactcattctcttttttcccagtcgtttcaactgctcctgcgcgccttgtgccccccttccctccctccttctcatcctccctccctccctccttccgccctttccctgctgctctcagcctcaggtgtcttccccacgggagggcgggttcgaatcctcatcttttcaacgcagaaggtgcagcacgacggggagtttcggcccgccggacgtggaacgaccgcaccgaggcatccaccggttttggaaggtagggagggagggaggaagggagggaagtcgaggggaatagacacgaagccctgcctttctttttttgcgtcttacgtttcggaattggggctcatgcgtttgtggagttgcactttatcgtctattccctccctcttccccatcatgtttccccgcccttcccctcctcttccccgcaggatttcgaccggcgatacatg

SEQ ID NO: 3695 - DNA, 703 bp, Nannochloropsis_gaditana
cggtacagctttatgcataactccacggcacccatagaaaggaagctggaaatccgcagccgctgcagctgctggtataggatccatgattaacacttgtgttacttgtcacacgtgccgaatacacattagctgcgtaccggaaaagggacaaatatagccagacgtgggaacgtaagtttaacctccctaccatccaccggcggactgaccaattactttagggagatggcattgatgcctattttctcacgcgacatttcatccatgacgatacttctccataaattgtacggaagacctattttaccttgcacagtcatttgttgattactggacattgcggtcaagatgctaaggactcgtgagagcattccctcaaacaacgtcaggcaatgtgtcaaagttcaagagtaattttttgtgaaggaaaatctcatgggtgtccatcgtctgacaagttggagccacgaaaaggtacgcgcgtgcaatgacagtgtatgaattatcagccagttgtaccctacacgggaagctcatatcgttgtaaaatgcctcactcacgaactcaatcatacgcctcctcaccgtggcttttacacaaatgcaccaaaactagccacaatgcgaccttctatatgagaaaagggatttgagagacttctcgggaaaacgcttcatagtagatgcggcctcttttatg

SEQ ID NO: 3696 - DNA, 703 bp, Nannochloropsis_gaditana
gcgatggctcgctaggctcaacatgacgccggggccttcgtgacacgcattccacctcaaatacttttggaaatgcgatatcatggcaagatacctcttcaaggatatccggcaatcccactgcacgtgtgccacacacgcgacaaaccgttcccccgccacttcgaggagcacggaagcttgcactcccttcgttgaaggaacagccagtgttgggatttttcaacgtcgggattcgagggagagaagaaaaatggcgtttgtgcgtcagtgtacgtgcgtcttccctcattttcaacgagacatgaacgtcttcgttcttgacatggcttgacaccacatatcctgcgcgtggaaatgaagacttttacccagtaaaatggcgcacgtgaatgatttcaacaggatagcttgtgcgagtgcacgcgggttttgttgagaaaaggtccttttggtctgtaagggcgcttgttcgctgtggatcagcagctcactttcaggcttctgatgtcgaacgttgaccacgtcttgactgaaccatcagcccctgacacggcacttccgcgcatgagtgtccacattactcacaaacttctattttcaaatacgcaccccctgcagcgtcctttcacttctgcgtcagacgcataaagcacgaggcgttgaccgagggaggcacggtgtcggcctgctcagcatcatg

SEQ ID NO: 3697 - DNA, 703 bp, Nannochloropsis_gaditana
  misc_feature (1)..(287): n is a, c, g, or t
  misc_feature (562)..(571): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgatccgatttccgttgtcttccctccctttctgcttctcattgtttgacgtcttttcttccctttcctccctccttctcatcgtctaacgtccttaccttccctcccttcctcctcctcacttttcccctgttctcctccccgtccggattcatcctcgctccttagctttgaaggtaccttagctctctgggatctaaccttctgggcagagcgtatgaaggaaggcaaatacggcatcaaggtagtctgcccctcctccctccctccctnnnnnnnnnntcacaagacatgcccttctcctcgcttttggcagctagcacgagctcgagacgctcacaagcgaattatgttacattggcacaataaccggggattaggttatcacagggcttcctgagttgctgtcaaatg

SEQ ID NO: 3698 - DNA, 703 bp, Nannochloropsis_gaditana
agcttcgaaaggcatattatggctgctaccaccgggcaaggatgaggctaaaatcaaattattagtaggagagctatcgttttctgaaacgaaagacgtggtaagtggaccagggccatggttggtggtcagagctgccttctttttgggagaatgattcttttggaaaatatttttcttcattctaaatctgcggtgcttgaaatgtggagcaaagcttgagctacatcaatgttcacatagtatcaaagcataaaattttgagatagacgtcccccagatgcactctgtggccatccttaagtgcttccaaatgttttaattttggtcctctaaaatgggccacagctaacctcccggccggccccggtaacggcaagagaggtcgaggagctcccggacgatgtctttgtccgggcacacacgacatacgtacaaacaggcagcctcctgtctatacacatcatcttacagctcagacttactgttcataattgacacaatttgtcaattaccgtccatttggtgaggtagcctcagcaggtcggcgaagagacagaagacgcacttgaatgtccccgtgcgacaagtggaaagcgacggcaaggcagcgaccctgattattgaggcaggatcatttaagaggcatctggcgacactggtgatggcccccgcagcctttctttcgtcatgttctcccatg

SEQ ID NO: 3699 - DNA, 703 bp, Nannochloropsis_gaditana
gaaggtggcggtgacgatttttctgtatgccatagctgcttctccggatggaaggatggcgtgactccgctcctcctgctagcactacgacgtatgtgttttgtttgtagaagaacatgttatcacgaagacgcacatgcccagaatgggacacggccaggatttccaccaccatggcgtgaaagggagcacttatacacaggttgccagaaatgaaatgaggccctttgaccttcccctgagcagcaacagcaactcgatcgccctcagtccgatcgcctccccccccgatgtctctatcacatctacaaaggccccctctcccatagtcatgcccacagaaattctcaattatgtccatgtgatcctatcctagcttattttttggggaaaaagttgtggatgtctctgaacagccgtcctgtcgcccgtcatgaaaacagcattaccgcctggaggaaaagcctagtaggagtgggagcactggggaaatttctttcactttgccaggccttcagcccgttgagctccaccacaccctaatcaaaaacaccagacacgaattgaactgtgggagaggtaagtggcaataaggatggcgggggaaatattcgacggtcatcttgaaaatatgattgcgtactctcaagtcccattcgcagcgcctgattttctaatcgctctcttattcgtctggcagatg

SEQ ID NO: 3700 - DNA, 703 bp, Nannochloropsis_gaditana
  misc_feature (611)..(620): n is a, c, g, or t
tgtgcgcgggcacgtctttttggtggcgagcctgggggacgaggcggctgcggccgttcgtgccatgcctgtggggcgggcgcacctgtgtttggatgcggcggccttgccgggggcgatgaaaaggatttttgtagaggagttgaaggggtcgatggggtgagagggagcgtgggtgggagcgaggaaggggaggtggagacgaggcgaagggcgtatgcctgagggtgcacggtaggggaccaaggagggttggaaggcagcctttaaagcccgttttggaggggaggcgtagcgatctagcacattcggggcttaagccatcgaataggaaaaaaacccgcatgactcaacaatgaactgtgtggcgtgtacactactgttacgtgttgtcttccgaaaatgtcttccgcaccgcctttccctcccgccagtgcctcccaggaccgcctttccctcccgccactgcctcccaggaccccccggctccacctcccaggcccgctggtcagcactcctccgtgttggccctctcctcttcaacgtggctgaggcgactcccctcttcatccctgctttctccggtgccccctgtccccatcgcgaccctnnnnnnnnnngtatctctacttcctttacttctcaatttgtcactcctcacctttttaatcctctgcttccatggctctctcccttgcacagc

SEQ ID NO: 3701 - DNA, 703 bp, Nannochloropsis_gaditana
gctctccagaaagccggggtcgtgcacaccaccccctgaccaccctcctgcaacatgcaatacggcccggcatggcatttccgacccaccctcgtcctttaaacatgcccgcacttttgctaacgcctgcatggccgtttcaggccaagttatagatccaattgttgccattaaagggaccgagtgtgtcgcacgtggattggggaagaaatcaacgctaattatgctactggcgctactgccaggggaggttctgagggagttgattaaactctttcctaacgcaccagcgccgccaacaacgatgattgcctgcttagcggctgtcattgattcttatgacttctcaataagataaaatcctcctttcgtttgttaaacctgtatgtgttgtgcggaggctcgtaagaggaggtggtctattgaagggagaaagagcaagcgtgacgtcgaggtcccatagtgcaacctgcaagatcgatacgatctttatgtgttttgctcatcggaatgaccgcgtcaaaatccttcaaagcgtgcgccatccgctacatacagtaaatttatcgatctccggtccggcggcagatacttcctccttgtcatcgtctttgctcggtttcaagccttctctccctaggcaggactgaccatacgagtagccatcttagctcacattccatcacgtaatcacacgttgcca

SEQ ID NO: 3702 - DNA, 703 bp, Nannochloropsis_gaditana
ctggctttccctcttttgttttcgattttcgttccgtcatgtctgtcgagttttttttcttctcccctttctctttcttgctgccaaccgtcagtcttcgtgtatgtctgtcgagtgtttcctgtgctcgaagccactgcgccagatgccgactgctgcttgtgtgttttattcacttcccttcccctaccacctttccacccttgtcccttcctccatgccccgtcagtacggtcgggagtgcgtcatcgccattatgaacagatgcatcgtccaagagaacacctttctggctgagaaagagctctgcgtcatacaggaacgaaagtcgcaggggcaactacccgcttcttcgtcctcctcctcgcgggcgccttgccccccctcacactacagcacgatgcgcgtgcgacaaggccatatcgtcgagtggttcaattgcgacctgagggcgggcatgtcacttccgttggcggacgattggaggcaggacccccgtgtggtaaggaggataggaggttgaaaggggtagagagacggaggtattgggagcagagtgcctggtgggaaaggatggtatggaaataattcatcagggaagaaaggagggcaagtcccagatcttaatgtgcatggtttaccctcttctgtccatcttcagatccgctcgcacgccttgtggatgggcccgtacgtcagcatg

SEQ ID NO: 3703 - DNA, 703 bp, Nannochloropsis_gaditana
  misc_feature (1)..(672): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttctggggctgggtcttcctcagcacc

SEQ ID NO: 3704 - DNA, 703 bp, Nannochloropsis_gaditana
agcgtgcgaaaggagcagttgtttttaagtttggtctgtcaatgcggttgcttacattgtcggactccttcgtcgtccttttgaagccgacagccgtagacgtgagtctgaggaggcaagggaacagatgcactccggacctttcccaagcaatgtttgatcaaggttatctttttataaggtggagtttttgcttgagtatttttgcagttgtttagtggcatagtttgaaaagttcctgtgggttggattaagtaatgaaagacacgaaataaaaaacccataaccgcacttcaagaactgtaaagataccggcataaattacaataagtatgtttttcatagaaatcttatttccaatgccggaatattagggaataagagagcaaggggcctgacggatgcatcctttaccccggggggttgcagttagagcggtaaccgctcaaaaaccgttaccggacgacaccacaaggaagagatcagcacctgaattaaaagcctgattggcgatgtgataaggttattgggcgcgttcaggtcggtataacttgatgacatatttttgggctttgtaaacaggacccgagatttgcttcattggaaagacaccctgcgactaagtaaagtaagtatccggtttggggttcgatgagccgcgtaagaacaggccgttcttgaagagcagctatttcatcccatg

SEQ ID NO: 3705 - DNA, 703 bp, Nannochloropsis_gaditana
ttatatgagcttcatgacatacgagcgaggtgcattgaaggacgtaaagtctcaagtttatccaatattttagcaattaaatcgtcttattctatattgctgcgtcctgctttgaaaaaatgccttttagtaagctgtgcttttaccactcagacggaaaaacgctgtagtgaccaaaatgccgatccttactgtatgtgagataaaagattgatgtgccgctcacctactttgcggcacctactaccttaggctggaagacgacatgatcatttgcataagttctgtgcatccttcagcatgtgttgaaaacatcggaagcaaaagacacacagcgtggtggcgggcagggaaaataacaaggttcgaaaaagcaacagccgagagcaggcgggaagtgtccacccgcctgaccgcacgctattatcacgccaaacatacacgtcgtaggaagcattgaaacttcactgggtcgcttcgatgcgtacttctattgtatgcctggcgttgtatgctcactcgatgataagaatttggtctcactgggcactggtgaaattttcctgtgggagtagcgctgtgttcggaacgggaagaatcggagaaaagacgttgtgccaattgatcaagaaatccttgtcccaaatctcatcattccatcccaccacattccaacttatcggcatctttctagtcacacatg

SEQ ID NO: 3706 - DNA, 703 bp, Nannochloropsis_gaditana
gggcgggtgctcttcgtcttagggcagatcccagagactacggctccgagagggagaacgcactctattgcccggttgggggatgcattgccggcaaatcctccgtgagcagcgggacgggcccggctgcggtggcgaagtcgaaggacgataaggcccttggggattattaccagcgactgggctcggtcttggccggtcggcaggtttgcctcgacattttcatctgccaccccgcccctccctcggtcccgtcctccactggtccctcccccggtctttcctcctccgtcttttccaatttcttggatttgggcaccctggggacactcacgcacatgacggccggacgcctccattacttccccgggcccgttgcgtccccaacctcccccgcggccgttgcctccctcccgtcgtccctcacgcccaccttcctcacggccctccggaacgccctcgcctcccccctcgcccaggaagctgtgatgaagatccgttcctccgtcggcctcagcctcaagcactacgtggctccgggtatcatccacccgtccgaagaactcgaactggccgccctggacccgtcccaatccttcgtcgctgaattcctccacgacggggagaagatcaaggagggcagccgtgtctacctccagcttgccctcctgtacacccagggggggaccggccaacgcatggt

SEQ ID NO: 3707 - DNA, 703 bp, Nannochloropsis_gaditana
cattagtttttttacgaagcacccgtatgcgtcagtgcgcacgtctgggttggctttcgctcctgatttttcccccgggacgcctcttcacctcatcaggcgtatgatcctagtgctttgcagggcgctttttctttgcgagcagatgtccaaaaatgatccacagctttcatttaaaagttcatcaagtatattcgcaaccacaatacaaggttgtctgaaaaagggaatagaaaacggaaagaaaagccgtcgcctagctcatggagaaagaagcaacgcatgttaacctccccccctcggtcatcccattccattccatctcgagaccccagctagccccccaaaagacgagaagacgaaagccaaaaaaggaatttagacaatgatcgtgtataaatgaactctttcattcctctttcacctatactcagctttttccgacccctccgcacgcgccgtcccgcgtctcaatgtctgctccgcctccttcatcccagccagatcgttgaagcgacgtctgtagaagcaaactttggagacttacattcctgagcgccgtcttccgtcggaagatgtatctttgggggagagggtaagggaggtgggggcgtcgggatccttcccccctaccatcactctcatacaacccgctccatcatcattgttcctgctcctatcctcctcattcagtgcttccgca

SEQ ID NO: 3708 - DNA, 703 bp, Nannochloropsis_gaditana
  misc_feature (76)..(85): n is a, c, g, or t
  misc_feature (317)..(326): n is a, c, g, or t
accattccctgcagaatctctttttggaaacttgtccttcccccaccagacacgatccaatggattgacattgctnnnnnnnnnngggcggggatggcaagaccaagccacccagcgggcgccttctcaaacgcccgcgtcagctgacaggcgagttttcccccactttccccgttcctaccgaccgtttccgtggcgctagccgcaaagtgagcggggatggccagagggatggggagagacctcacgccggtcgcgacaggcattacgagggtggagggcggggtggagggcggggtggaggacgagggggaagnnnnnnnnnnaaacaggaaggggggaagcgtaacagctgaaaagatataagaaaggaaccaagagattgcatcccgtcgctgaacaaggagaatggacggcccctccccccaaaatttaaacgtttgaaattttgaatttaaagttccgttacccaccccctttgcctgcggcctccgtccgctttcccccttccacctacacttccaacaacaaacgccagctctcgtctcctcttcgttgcctccacctcctcctctccctccgctgcacctcgctccatatcggtggaaaggccatcacgttctccggatcggtgtccacccagaccctcccaaaggtttcccagacgtctgcgtacacctcgttcacgacctgcatccctccc

SEQ ID NO: 3709 - DNA, 703 bp, Nannochloropsis_gaditana
acccagtacgatcaaatcgtagggcgtgtcgtcttccttctcggggaaggccgtctgggacaggtctggcaatctgacttgatcgggcgtggcttgcaatcgcaccacgcgacgaatcgaagacaggataggcgatagtggagggtttagcgcttgggaggcagattggctagtaatcttttccggccaaacaggcaagaagggatttcctgcaggacgttgaaaggctttcaccaggaggtggcagtgaagaggggccagtgcggcgagtaacgcgaccaggaaaaagccacggggtggcgatctatgccttctggtcatgtcctctacacatgtatttgtggcaggaacaattagccaaaaaagcgtgctcacggcgtggttgcctgtcccaagcccggacttgaggatgttggcaagctcgatcctgagctcgagggcgatgcgagcgaggacgcgactgtcagatggcagagtgctgccgaggaggtacttgcactattcttgcacgcaactgccgggctttgcttctccttcacgtcctttaaatttccacgcgtgaccgcgaggtccgctgatcgtcagtctggctcctctaccctcaagtcaccacgtcctctgtcgtggccccttctcatcccgcaacacttacctcgcacactcatcaggtcagaggcctcgtagccgaacttgcctcgagatg

SEQ ID NO: 3710 - DNA, 703 bp, Nannochloropsis_gaditana
gtagccgatgcttatccttagctgcagacgcagctctcgcccctcctctgctgcggataaggctgcagagtgccaagctcaccccctcacgtcgtgacatgaaaggaaggatttctttcgtagcttctctatttatcgccactcctcgcatccatctacacgcgacaggtagattgtgagctaccgcggtggcgacgctggcaaaaaagaggagggagagcacagagctgaacacttttggcctccggtctccatgcttgtagcccgctgctctcaaggcgttggtcctcatatttatactcaatgaaaccaaaccaacagcagaactccacgacggtggtatggtctgtaattgtgtatccatatggggcacaaaggtggattttaaaggctcatcaaagggcattaaaatatttccaatgtttctcatcccccctccgtcgatccgcgggcgaggctgctcctcctatcgatccctgtggtgcccgttggggataagctgcgtaaaacatcggagtccgacgaaaaatgacaatttcacctcggtttgaagtcaacaacgtcctatacttgctttctctcgcgctgaataggtggccccgtctttttctgatattcattctttcctgctcaactcgtactctaattacctcccctctcggactgcagcacctggctctgtttaataccaaaccgaaagatg

SEQ ID NO: 3711 - DNA, 703 bp, Nannochloropsis_gaditana
tggaagaagaagagcataatggagtgtgcaggaaagccggggggacggctttctgacgcgatggtcgagcgcggcacgcaggagctgtaagaaagacagaatcacgcgtgagagatccacgcctccgccagcactatgcagactccatcctcctccgaccgtaccgtgcatttcacttccttccacccccccaaggaggaggagggcggtgtacagggtgatagtccgagtcggggaactccgcagacgccgagggccttgcatgtcttgcggcaccaccattcctggcggacgcctaagcgagggctgtcacctgtggtacaagctgttttgctgcgtgggcatgtgtgcggtggtcagatttttttatcgaaaaagtattgatccctgtgccggggcgcatgacggcagtggcgtgttcgatcgtcggagcctccgtaccactactagtagccgtctgcaacctttcacacaacgcttgcaaaacctctccttcctgcctgtaccggctcaagcggcatactttctccgtgcaattgatgtcagaagaatgccttctcgcggtcgtgagtaactgaggacgcatggtggtggagtcacacgggcataaataagtgggaacctcctcctcgacctcccccccttcctactccacaaggacacgaaaatgctcacccggcgagacttttttcctgtatacaca

SEQ ID NO: 3712 - DNA, 703 bp, Nannochloropsis_gaditana
  misc_feature (608)..(617): n is a, c, g, or t
cgtgcccctgcccggcaccacagagctctatgaggacctgtccgtcggtgacatggacgggaacgattttgcacgcggtggggccccgctcggggaatacgatggagtcagcctggataaccgggatttcgccgacacgaacacagcccagcgtctgagcatggaggaggtggaggagctgaagcggagcggggcctcgggacaggcaattattcaggcgctcgcctccaattccgacacctgggagaagaaaacggcctttgccaagcagaagtggacgcagaaaaaggcacacaaatacgtggttcgcgtccgggcattggctgggtgtgggagcaacgtcgcggaagccctcttcgtcaagtccgggctggtgaaaacgacggccatccgccccgacagcattgcccaactcctttctttcggcaatgtggcagcgggtgcccgtgtcctggttttggactcgtactcgggagtggtgttgggctgcatcctggagcgcctggggggtgaggggaaagccataagtctctacgcgggcgcgcaggcgcacattgaccatctaaaatatttcaaccttcctacggaccagctcgccccgctccctnnnnnnnnnngcattttccggcatctgcgctggcggagttggaggtagggagggctcggcggagggcggaagggggggagggcggggaggaggagg

SEQ ID NO: 3713 - DNA, 703 bp, Nannochloropsis_gaditana
gcgatataacttgattaagtgcttcacttactcgattttcaatgtgatcattttatgtatacaaaaaaccaagctaactgcgagtacagcatgcacaggggaacggagactcttgtcctttgcttttacctcctccccccttgcttgcttggaaaggcgacgtcactcgcatgctcatctgcctatttatggggcccgaaagtcacgattagtgcatgcatgtgttgttggctggacaagcgatgtactagcacgccgtagtatcgttttcctagaataacatgtcctctttttctgtgctcaaaatcacaactccgacaggagatgccacctgccacaaatcaagtaagttcaccacggaggtcaagagagcctctatggagctttattgctgcacacgccatcttgtgcataaatccagccagggcattcctgacgccaacctctgccatcggctctcttccttgttcaacctcatcgccctctcccttcgtctcgcaagcacgaccctttcccgccggcaaactctggtcacagtgcccgcccacttcacgcacatctcccacaaataatgccatcgaaattcgtcagcccctccttcttcctgcggcggcacactcacgcgacagtttcctccgctttctgccgcgacccccgccctccctctccccacctccctctcctgcctcccaccacatccgcc

SEQ ID NO: 3714 - DNA, 703 bp, Nannochloropsis_gaditana; identical to SEQ ID NO: 1548

SEQ ID NO: 3715 - DNA, 703 bp, Nannochloropsis_gaditana
  misc_feature (577)..(586): n is a, c, g, or t
acaggtatcgatacagggaggttgagcaaggctcgagcacgcctccaaatggtggaccgggagctggagcagatcgaccgggagaggcgagcactcaatggtttgcaagcgagggagagagggaggatggaagaggggtggggggacgaggaggacgaggaggaggtcgtggccgagggagggagggaggaacgggggcagtcgaaagcactgtagataaaagaaactgcggggacgtaccaaacataaatactacgagaggaaacccccaaaagctcccatttccgtaggaagacgtggaaggccaggcgaggagacgttcctgcgccgaccacatggatggtaaggggccatctagcctgatttctttgctcctgtgactggatttctcgcctggctcgcccgctttgctctcgccctctctccttataccctactctcaaactcaacgcccccctcttcaatgctcacccccgccgtcgcgcccgcctcgctcctctcccagtgcgggccccatcagtcactcctcaatcaagcttactttacgtcttttgccactatcgagtgagtgaagtgnnnnnnnnnnttagtaaccctgtccctgcttccctcccgtctcctcttctccctttctcccttcctggcagggccgacctctgcgggcctgcgtccccaagggcttcccctatttccatgtggaatg

SEQ ID NO: 3716 - DNA, 703 bp, Nannochloropsis_gaditana
gggggatgcaaaggtagaagggcagaagggaattgaatgtggatacgtgacgtgttgactttcgttcccaccattcccatgaacaggccgccccgagggcggagacgcacaaggaatgcgtgcactctttgaggtggtgaaggaagtgggtgagaaggggggttggccgaaggaggagggcaaggaagaggaggaggggacggaggggaaagaggagtgagagaaaacggttcgaaggggacacgagtcagacacgaggccggataacacacacgagagtgtcactggtcatcactcgtatgcgggtgtaatgcttttcttcgtggttgtcacttctcgttctcgtcgggaagtttccaagaggaggtatgttgtagggaaaaaagcaacatgcagacgagtaaatggctttgaagtcccctttggcctttactttcagaaaaatacaattgagacacttacgaaaatgacacaggtctcaggcctcccattaaattcgggctggtgtcacgccctagtcaatttccagtagtgtacgtgcccccgcgtgggaggaggtaaagaacatacaagccgcctcacgggtctgggaagttcagctgttacactgcaacaactgcccttcactctcttccctcccgtccattcctccttgtagattaaatagaaggatttttgccgaaatcgtacaccagagagaatg

SEQ ID NO: 3717 - DNA, 703 bp, Nannochloropsis_gaditana
tgcctgcaactctaaggcgacacatgaagagattagtataattttatatccgcgtgatggcggattatttattgaatagtgtcgttgtagataaaaggacaagcaagagggaggtctgcttttcccatgattgaaaagcgctttgccccgacccctccccggcctcctctaccatcagaatttcatagcacgaaccaccgcattttaaacccgcgaaccacccgctgacataaaagtacacgtgataaactggtaatttcgtatccaaagcacgcctggtttccgatcccccccggttttcctgcgcgcgcggggctgttggccagaatgcctcgcccaaactccctcagtcgccgtccctccctccttccttcctcagacacccaaaccccttcggaaagccgccttccgtccgtgaagacccattacgtggcgtctcctgcgtgaatcacagccgaggtgcatggagcacatcccgtgcggttgttcgcgggcgtgggtacttgttttgtgggcagcctttccccctcctgcagtttgcgcaagggaagactctccggttccctcatgagcccaatggcacacaaggccttccattcaaaacacaaacaacaccaattcgcaaatcatgcctccatacaattgattgaaacactcgcaatctcgcatgaaaatgcttgaacacccttttgctcttttacag

SEQ ID NO: 3718 - DNA, 703 bp, Nannochloropsis_gaditana
aattatcatgaattttgcaggcagggaccagtcaaattccaggctttataggcatgatatttagcattattttttcctcgtacagggtggggaggcgaaaattgacttggttcacatttgacaatttgtctttgcccacctgtgagcaaaatgaaatttcctgtcgtaaaacaatttttaaacagcggtgtatgaacttcagcgtcaaaggatgcggtaaaatacatgttagatcctgcttccacccctcaccttttgcgcccttgttctaacggtcgatttgaattcaaattaccgcggcgatgacgactacacgctctgtgccgctccttgatttacagcgcaacgggttgcgagagcgacatgtctaatcatgcgactatgagggacagaatcgaacccttaatcagcctgttatgctgcacaaggcatcaatcccgttcggcaaggtttccttcatcttgtgctctggtgattggcatactttgagtgacacagcggaacgcctggggctacatcctacgaaagtgccatgtcattcttcccagtcacaaaatccaaatcaacttgcccccggcatcgtacttttttatttgcgcgttgtggcccttcgctccaaagtcaggcgcacaaaggcatcggacgacgacctccccaatttctcaatcacatcacgtacggctttcaacagcattttgccatg

SEQ ID NO: 3719 - DNA, 703 bp, Nannochloropsis_gaditana
taaggaaaccctcggtgtcatgccgtagtacatctctcttgctcactctatctccatcatcgtccctgcctcttgtcccatctatatcagtagaagcagtctcgggtacaactacgcgtggcttccgtggtatgccccatggtggcctgtgctggggagctcggagaatgctgcgatagcctcagcgcctcagagtacctgacagagcacacaatccatgatgctggagataaagaaacgccaagaccaaatgctttctactacgatgctcacttcttgccgcactcagtcgaaacactggtgtctgtagtggcacgtgctgcagatggcactgcgggtcacattggtaacaaacgacgtggtagaaggacgtgtagcaagccgaagcataacaatggtaagagatcacaaagggaaaggggcaacatagcagcacaacatgaaatggtttcctcaagaggattgcgtgtgtcaatttgttaggtgtgtagttgaatcgagatccttcagcaccgcgtagccacgagatggtagcgttgaagtgcaatcctgtatgagatcccccccccacacacacacattctttcattgggatagcagagtcagcccgcgagcacttgtcgataactccacatcacctctgtgcttccctagctcaatccagcaaccctgtgtcccctcccttccttttgccttctcagga

SEQ ID NO: 3720 - DNA, 703 bp, Nannochloropsis_gaditana
atattattcattcaaccagtcgcacagtcagtatgttgtatgcataagacaggaccttgaaacagagcgtgcgacatgctttgtcaggggaatgaagtagtcatttgtcgacgccatgcatcagatccgagcttttttccattccacgcgggaaaaagccacgatatatacgccccgagaatttcgttttgaagatgaacgagcacgttgcacatattggggggacgtacgaaatgaatacgcacggaattatgccttatctatgctcacaaaggcacatctgacgccgcctatctcgcctgtcaacgagtggtagggcctagattcatttgtcgggaatgaagatttactcgttcgcccctacaaaggcgactccaggccatcaaaatctgaggacccctgcagtgtcctgcccccgtggggtgactttcccgtctcctgtgacaagtttctgtcagacttaaagggactttctcctgtcatgttgcgtcagtctatattgcatgcatgattgtcgtagatcaaaccctatgtgtagcgcatactctgtagtacgcgtaagacctccccggtctcaacaacccgtctgctgaacgaaagcgaggatccccttcgtgtcctccatcacgtgttattgaacaatgcaaggctcaacattatggaaaatgctcaccatcttttcttctcagccattcgcagcatg

SEQ ID NO: 3721 - DNA, 703 bp, Nannochloropsis_gaditana
  misc_feature (525)..(534): n is a, c, g, or t
gagaagggagcgatagaaagcaagcccgagaggggaaggtagaatgccggtcgttgagaaacgtgcggcagacaaaggaaggcatttctctggtggcgcaaaataagaatgaaggaaaagaggtggaggaccaggaggatagggagctaccaggacgtgaggagagcagtaggaagggggggaaaggggaagagggggaagccggggtgaaggagacggttacagagggggacaaacgtactcgtatgttggggctggcaaggaggtgcttgaaggtcttggtcgagagggagcggaggggcacgtgtggagagaggaaagggctaacgaccctgtggatcgggttcaaaggacagaaaaagggtggagagagacggtaggaaacagggagaggaaaagtgaggggagaaagacatttgtgcgcacgaacatccatacctcggatcagttcagcgtacggcaactttcaatttacttctcgcactctagcaatcaccctctttcccctcttctgtcccccccccnnnnnnnnnngcgggttggcagggcttgatagaaatagtccgtgcttggagaatgccggcgtgtatacgtggaaatgggtccgagacccggaacgcatgaggaggttgatggaggcctgcgagcttacacccacggttcccgccccgccttcccctcggtagccttggaatgggatatg

SEQ ID NO: 3722 - DNA, 703 bp, Nannochloropsis_gaditana
atagagcagttcgaaggcgaaggcggtactcttttgggcgacggcttggagtgcatagtagcatgggcctcgcagaaatcaaaaccaagctggcacatttctgcccacaacaaaggttgaaattatcgtctattttcaaatctacaggccattgcatcgttcctcaagtcggatgccgtcaaaagaatgcaggctcggtggcggggtcgtggctgcggcgtgcggcttgaggtttcgggcattcgcgtgtgatggtttgggccgcatcggtctgcgatgatgtggtgaaggatgatgctttgtacctcactcggtgcttaccgatgacgatgacggtggttgtgatgattttgacctcaggccacagtcctgtcccgatgatggtctctgtgcttgttccttgccgacccggatgagtagacttcgccttcgtcgttaggttttcctgccttttaccggattgggagcggtgagggaggcattgaaggcggaggctgggagggatggacgtgctgctcacttcatgataggcctcgcatcatttactcggcaggaatcctctcgagcccctagcgaagcgctggggccaaagctacggaccacgagcgttgttacccgactttcagcagacttgcgtcgacggacagtgttgcccgccaaaaatcgcggaaggaacagtaccacgagaaaaaggatatagatg

SEQ ID NO: 3723 - DNA, 703 bp, Nannochloropsis_gaditana
atcgccattgccattctcaacaccgatgagcacggttgcgggagtcttcagttctgttgcccgatgcagagaagtactggctggctcgatgtgtgccttttcaggttttgtaagtccatacgatttggcatgtaccgatgacaaaggaagtgcacccgtggccactgaatttcgtgaaccccaaaggattatagcagacgagatttcgagaatatgccagaaaatgcaatgaaagagacttagtgcttgtttaagcttgaagaaattccttaatctttacatgataagctcccaagacatagatgaaaacgatggaatttcaaaggcccccaaaatgccctggttgtctgcccttctttgaagcccgtcgttttgattttttctctaaacgctacccggatataaagcttgtctgcgcacgtccactaagagttacgaagcgttaatgcgacgggtgctgtttggttgtgcgaccacgacatgaaggatttcaataagttgtgtgtgcgcaatagagataatggtgtcgcaggcctgaaattaggatttgcatggcagacgcgaaaaaacgctgcacagacctccccaactgcgagagtatccctcagcattaccgcatgctgtaggttggaacatgttggtccgactcaccctttgccatgaccttcattttttcgactctctcttcacgtagagtaggatg

SEQ ID NO: 3724 - DNA, 703 bp, Nannochloropsis_gaditana
cgcaagcttttataggggggaaaaagggtgtgaaaggcagtcagtgcttgctcctatgaggagcgagacatgcaaaaaatctaagctatcttgtcgccgaaaagtgttgagagggcggggagcatggcccgtggtttacagagaggataagacgcctcagatcggaaaaagaatactgacaataagcaatcaaaggagaacgggggctttccttcctttctcagcctttaaatgtcaaattgtgaatataaaatgttactttagaacctcatcatagatcatatgtttcgcatgtattgaaaactatgcagtcccgtagttgggtatcggcccatatcgaagctctggcgccacagttgaagttttgttctttgtctcttaagcgcacaatatcattttttaacatgcatggagtgtatgagcgacccccgtggatcaccgagtcatgaaatatatgcacgcaaactgagaacacagcgcttctatcaacgcgcgttttgacacgttcaccggcaatgtctaaaaggagtttccatcttctgtctgatctgcttaacggaccgcttctgtccttccgcagtaaggggacgattccaaaattgacagcagcccaggattttttgagaaagtttgtgaattgatacctaaattttaactgaaggagtactgaaatgctgttgaatgctgtcttgtcacacaaata

SEQ ID NO: 3725 - DNA, 703 bp, Nannochloropsis_gaditana
cccaaaaactggccccgcgaggaaaaacatgtcgcgttgtggtctttaaattggggttttggcatcattttccacctgaaaaggtctgtgtggccgtctgtgggttcgtgattctgcctgcagttcctaggtgtcgcaaagaaattggtcctggtgctgcgctttctcagtctttctagcattttgtccatcagaaatgcatggaaggtttcgtactgcctttcagaccatttgatgtgtatttagcattgaatcaatctacataactatattatttctacggcaatacctttgtgacgccccatagacggtccttccatgtcatcggcggtctcagcaagcaaaaagagccttcttccacttgactgaacaaaaacaagcacgcgagtaggacaaattttcttatctaccatcaacacaagcacttgacgccgagttgcaatggttttatatatatctggctgacatgaaggcattaaatccacgcaccacgagcgacaggaaaatgagtcaaacacgagaagagcacaggtcccaggcggaggcggagaagggagcaatcaaagttcagcggcgggaagagcaggtacacagatttttgttcatgatagacgcaacttctgtaaagcgttttttcctgttcctttcctcccttcttctcttctccggatttctcttctctcctccaaggtcctcccccatg

SEQ ID NO: 3726 - DNA, 703 bp, Nannochloropsis_gaditana
cgataggtgggtcttttctttttcatcattcgtgcgtgtggggacaccgaggacgacgggagaggtctaatgccgcgcctcagatctctcatactcgaaccagtaccatttagacaccctctcctatctgtcctgcacccataccttcttcttgccgttgttgagccgcgtattgcgtgtaccagtccccaaaggactggctcccgcctcctactgctggatttgtgccaccagaggtcttcatccttatgtgcatccacttccccccgatgcggtgactgtcggaggccagggggtgggaatcgatgcgcacgtgaatgcaatgtctacaacgacaatgctggccgtgcggaggcaatccagagcacaagaatggtgtatagccttcttgtttacgggaggggtttttctttttccctctccctgtgtataaagtgtaagtgcttcggtgtgtctactacacccctcgctcgactcgctgaggaattgaatgcccactcaaatgtctcgctccgtccccgtgaaccgaattatccatgctcatgaccagctttgagtatacagtgtcatcgcaacttgatgtactcgttgctagggactactgtgtgcgcagtgattgacttccccccccacctgtcctcatctgacacaggacggagcttttcgacgccagacgttcctctccccacgttccaccacgatg

SEQ ID NO: 3727 - DNA, 703 bp, Nannochloropsis_gaditana; identical to SEQ ID NO: 562

SEQ ID NO: 3728 - DNA, 703 bp, Nannochloropsis_gaditana; identical to SEQ ID NO: 565

SEQ ID NO: 3729 - DNA, 703 bp, Nannochloropsis_gaditana; identical to SEQ ID NO: 575

SEQ ID NO: 3730 - DNA, 703 bp, Nannochloropsis_gaditana
gcctcccccagcctaacgggtcttctcccctaagcaaaatcctcgataaaccctggaaaggcgatgtggcgaaaggctccatttgaccgcgaatcacggacggcgatgcgtggtgggaccctcgcgccgaagaaaaatcggggccccgtggcaggaagtgactgggaggatgaccgggaggggcttcatccgcgccgtcgtcgacgaatggaagcatttctcttggaaggctttcgaagcctcgataccatgccatgtgaattgctgtacactgcgcttgtggcgctttcgacccgcacttttgacattcgcgaaaagaatgtggcgtgttgcaggcgttgtgttgtgcttgtggattggaaagcgtgtcatcgtgtcagaaaacgcctggtttgtcttttttttccatggtcagggagcggaggaattttggaggctggtgaagcatgaaaacgcccccctatcgtgccctggcagggaaggcgtgtgtctcattcttcttttccaccattaccacccacctcatcggtgacattatgccggcgttttttcgaaggaatggtcaacttgttgtctacctcccccgggagcatcagcgtggcgttacctcagccttccctgttttttcctcgatcgtaccctcacatgcacattttttcacgcgcatccgcacagcagaggaaggcaaaaagctgcaaatatg

SEQ ID NO: 3731 - DNA, 703 bp, Nannochloropsis_gaditana
aagaaatgcaagttaattcaaaccagaactggaacacaggggtcactcgcgacgcatcctatgaatgctcggccagtaacaagtagccgggacggttttctcattgtgccatatattaccatgcatcgattgctttgccgctagcgcgtgtcacatgtatttttacagacatttacatactccttgaccctcgtcatccacgctagccgtctctctctctctcagttgcacgttactttcgtcaccaaatcaagacttgcgaatacaaaactatcgacttttaaaagttaagattaataatccattcacaatacatataattttcttttttaatccactgttggtacttgtcaattgaaaataatatcaagcgaaatccgcaggccgcaacttccctctctcacctacccggatatagatatgtcaggactcgttaccttgatatcatgcaaggtaccacatatttttttcatggacggctgtctgtgtcgcccacaattggccactatcttgtggatttggtaggttggaggcatacgtcatgcctggatttttccatcgacgacatgctgacctgaactcaagtcaaaggaaaccgatccgttgctttccagatgatctcaactgtaaatttctttttctacccgtcccaccaccatcacgcattgcgttgcacagttgtaaaggcacggtttggaccatg

SEQ ID NO: 3732 - DNA, 703 bp, Nannochloropsis_gaditana
gatactgacaggttgccttccgctaccttgcgtgtctcactatcctattggccgttcggtgtcgaaagtgggaaacgcacatgtgtatatttcaagcgagaattttgctaggtggctcaagaattctcttacggagagaaaaagcgaggtgctgccaaggaaaaggatggagggtcactttcttatgtgtctattcagcccgtggtatgggccgttcgcgccaaaaatgtggcctccatgaccagcggtcaaggacgaataagaaaacaaggatgaagacaaaaacctgtgcaagttttcgcacgccgttgtattagtttggcatgagtctcaggagatgaacattcatatttggcgttggatcggtctggataagtaacatcgccgaccacacccgccttggcccctgatatcatgcacctggtcttgccgaacaggcctccacgcatgttttcttttcatcaggggcgaccatacagtgacggacatgctaaaaattattgtcctctattcctcattacatcgtagctgcgggaaacctggttgtctgcatcggaaagccggttttcttcatccgcgaagtatcatcccaccatcaccgtagcggtctgctccaagctcttaccatcgcgcccccgtacctgacctataccaaaaccagaggcttttcaattggatttggtattgtaaggcagccactatg

SEQ ID NO: 3733 - DNA, 703 bp, Nannochloropsis_gaditana
tctactcatgagtgactcttttggcacttgcacacgacaatcgtcaacccgtaagcctccacccgcaatgtcgagaaaaggcgaggtaagccactacaatcggcagcgcaggcgcctgagatggctagtctcaggcagtctagttacattactcttgacattgaacatcatttcactccgggggcggcgcagcgatgtaatggcctcgattgaaactgcgagcaacaatgaacatctggcattgctttcttcggcggtttctgatagcaaaatacttagtgatgaccttccacaagaacgagacatgcttattagaggtgtgagtacagaaaaacccacaacgcctgaatctagaccgtcacctgaatcaagcttcgggagccaggaggatctggagctagctttgcgaatcacgaaggagaaaattcttcacgaaaaagtggagcgacaaaagcagccaaagagaaacgagcaaaacgaagaaaatgacccggcaaattccatccaaactgcaaactcaaaagagaaagcgtcacttctaggaccgttcgaggcagaaggaggaaacccagccattccgttgcttcaacctgcaggcgagaaagccacccgtcctccaatctccggtcgacctcccttgcatcgtcctgcctccgagacgcatatacaaaaaatcatactaaccatatccagcatcgaccga

SEQ ID NO: 3734 - DNA, 703 bp, Nannochloropsis_gaditana; identical to SEQ ID NO: 2586

SEQ ID NO: 3735 - DNA, 703 bp, Nannochloropsis_gaditana
tcgccgtcatatccaggccatccttcctaaaaatacaaagaatgctcctaacaggtgcaaggcgaaagcagggatgcggtagcagtgcattttaccgccaccttggtcactgaaaactcatttttcaccgtcaagcgctacgctacatgctggctcatctcggtccacaagatggggcctaaaggggagaccgttccgatcgtcagaatggaaagccggagttcacgggcacgccgtgatgaaaaacaagggactggcggcgttggtccaatttacggttgacacatttcaatatgcgttatagcgcaagatccataagcgtgctgctttgggtgccagcccccacttatcatcacatggtcgggcatcactcctgtccacctgtctgagcgaagattgcccaccccatcgctctgagcgtcctacggccacccaccgcttttctccacctcctcctcatacgtttcctgtttgtcagcctgcctcgttcccacgtttaagaatgtatatcacagtgatgaaatcgcatttcggtccaggtttgtcacggcactatctggtgaaatggtgcggtgcgccctctttttcttcattcgctcactatttatcacatattgtcccccccatgcttttcctctttttcttctcgctctttgtgttgtttccccacgcagaaagaagtcttaggacgcccaaaataatg

SEQ ID NO: 3736 - DNA, 703 bp, Nannochloropsis_gaditana
agcatgaggcaagcaccaagcaagtacgagaaggagaggtagtggactggaatactgacaccggagctagaagttgccggcgccgcaggagccattcccttcccacttcctgtctgtgttggtgggagggaagcaggagtgagcattgcacttgagtcgcaggcaagaggtgtgaggttgatgaagtcggggctggggctgggcgagaatcggcgactcgggcccaaggagaggaatcaactttccagcccgaccgcaatgacatgggcaatccccacgtgccgcgccttaggtcgcgacgagtacgcctttacaagctacgattgattgtatgggcgtacaggtaacggcgtgctcaacggagcgtgtacgacttgcgctgtgatacacaggaaagccaacgcacaatcaaacgtaccgggagacgttgctctgctctcacacatcaaattcacgggctgcatcatgagatgcgtatcccgcgcacatctttgggtgtgacgacatggcattggagtcttgagggcattacaaccttgcaaagtcgacaaccttcaagcgctcaaattgcagggattcggagtgggtagtcctcgaacccgttcctcatcctgttacccgcgtcttttcacctcagcatgcccctcttgtgcattcactctcatgtaatacagtggtagcagcagagcaaccgggtgtcatg

SEQ ID NO: 3737 - DNA, 703 bp, Nannochloropsis_gaditana
ctaaatggcatattcctttccaccttcgtgttcgcgtctccaggttggtcacgtggatgcagcaatggcacccgcttttgacgcctaccctccctgccaagtaagttttactgggctgcaactcaatcatctcacatgcagcgtccgatttgggcatgaggatggcttgcataaggagaggacctcccattctacttcgttttcgcaatcacgtatttaagagcatttctcgccactcctgaccaccgcaacagggaatgaagctgtgggtcgcgtacgactttttttcattcgtcggaggccgttagcttgtgtatttatttgcattcaagagagcgggggttcaggaagatgtgacatccaagaagatgaaaatttatcacggggaaaagcaaagaacaaatttgttcacggcatgatgccgaccaccatgtgcttttttcttcatgttcggctcgcaaattgacttgatttgtccagttccacacggtgatttcgcgttgctttgacggcgcggggcgcactggaaagcaacctctcaacctcctgccccctccctggagggccgcacatagaccaactaaggacaccgcccgcgctgttgatccgatgccggtagctgctcaattatttctcgtatctatacagtctagaaatatagcagtttgttgtgcaagggacgccttgctcgaagggtatcatg

SEQ ID NO: 3738 - DNA, 703 bp, Nannochloropsis_gaditana
gatgccatacacagctcaaagcatcgctgctatcgccctgctttgtcggctgtgtgacaccaccttcatgttcctacacccctggtttcgggacgtgaaaagccttttattcgggactcttgaagccaaggcatattattccaccgaaaaactcattgctaagcgcacatcttgtgaacacaggtttcctcacgctgagggtatgagtttatccagcgccgtcccctgtatcagtacaactcataggaacctcgctactggcgcctgccccctggatcgacgaaagcaacagcggctgcgcgggcaaggacagcttcgacgtctttctgctctcttttacacctccttcttcgccttcgtttgccttcgaacggccaatgctgacagtcccacctccttgtccattgatagcaacgatgctacggtagggcccagagggctatggctggatcgaggggttgcgatgttgacaagcatgacctagaaaatgtcagcctaggataagactgcaattgttcgtgcagggaagttttgtacccaatgagtcgtcttggtgcaacgtgtggtgacggagctcgcgcctgcatcgaggccttaccctatctcccgcccttccttcccataggacgtgggacacgggggcatacagcaagaaatccaaacattcacattggcgccgtccctgacagtgcgcgtgggactg

SEQ ID NO: 3739 - DNA, 703 bp, Nannochloropsis_gaditana
tggaaatgctgctcaatgaggtgggacatgagtacgagtgtgaaatcgtggaccgtggctatgacaaggggaactggttcgtgacgttacgcaaggtaggggacgcgtaccaggatgtacaaaacgagtgacgccagtggggaggatgacaatgtggaggtcacggatgaatatgtatgctttgaaactttcggtttcagtgcattgctagcgttttgaatggccgtgtggcaagtttgtgaaataaggtgtggagctttgcatccatcgggagaggcgattcccctccggcggaacgaaacgattcaaagtaaattggaacgatcattgcaaagcatgaatgagttttccttcctgataagcaatatttccctttgtggacgcggcgagagttgtaaaagcttcccgtaatctcactgtcggtggaggcccccaatggcttgacctcgacccaatgcttgactccatccaagaacattttgcaagcaaaattataaaaaacgaaggaggtggcatatcgagttaaacccataacaacaaaccgcagccattgcttttcaaagaacctgtcttttgctttctttatcaaaagcgtcatttctaggccgttaccgcaagcaattcacgaacgtgtacgtcagtgctctgatcccaccccatgccatgtcctatacatgactttgcagatgaaagcgcggccatg

SEQ ID NO: 3740 - DNA, 703 bp, Nannochloropsis_gaditana
cctggaatccagcaaggaaaagaaccctgtgcgtagccgggactgaggcagaagaataagcttccctgcttgaacactcaagactcggatttgtttttggaggcgtgtcaggattgcattttatgcaggcggtgctcacaaactcagacagtgcgaccagtctattcgccgcttcctgggctccctcaaagttgagggatcgatggtgcacgggccgaggaggtcctgcgatgtctcaagattccaccatttcccacatctgttatcgaactgcccattttcaaaaggagcgatccacagactgaccctcggaattctctcctgtcgccttcgggtggaaaggatgttgagatgggcaggaggttagggcgtttttagcgaaatgaagttaagtcaagctgtccgtcaaaagtggacatgtaattgggaaataaataaacaacacatataccagaatctgccacgcaacataaatttagttatgcgcagataatccaaggactgtgactcgtttaaagtcgctggggcggcttgtaagctactggagtagggcatgctatcaacggctgaggtacccacttggcattttgaagaattaataatgactcggacattgccgatcacggagagcctcactatcatgaaatttcacatgtaggtttatcttatcccgcgacgcatagaaagcgacgaacacagcatg

SEQ ID NO: 3741 - DNA, 703 bp, Nannochloropsis_gaditana
aaagacggacttgaaggtacgttaggccagctagtatgagcgaaggtatatcattttcaaagttaccatgaatctgcccgaagtagatttcagagttagaaaaacaagccttgagctccagcaaaagatagatggcataaaagctcgtgctccagccgaagccgcatctacccacttcattgcatgttttcactgcccacatcccatgcccgttcttccccaatggtgtctctcctcaggagcttcgcaccctcttggagggctacggccccctggatgacagcgaagggctgggtgtagaggccccggccacaaaaggattcgtgcgtgtgcgtttcatccacgtggagagcgcgcagagggcgaaggaggctttgataggggcggagggggaagggagggaggaggcgggaggggaagggagggaaggaggggttaccgtgggcgggcggcgggtcaatcgggtccagtattcagtgatgtggtcggaagaagaggaggtaaggggggaggaaggagggaatgcaggtcacggggccgcagttttatcggggggctggcgagtaccttatttttctccctctctccttgccttcctccctcctcctcattccatcctgctcgcactctcccctctccgttcctactcttcttctcgcagcggaacaaagagccacatcccgagcccctcgaccctttcgaa

SEQ ID NO: 3742 - DNA, 703 bp, Nannochloropsis_gaditana
cccgtttcaccgatgtcgtggcagtcgcttctaaaaggagaaaaggcagcgaggcttgttcccggcggcgtttgacgcggacgatgaccgtggatgcagaggaggggagggaggaggagggggggggggaggttgactccatacgcagcgccgtgctaccgtaacaaaaagcacaaggcctccgccacacggccgccacacggtcagaagttttgcgtgcccaatcttgtagtgtagttgacagaggacatgccaccgggtgtacgtgagtcaacaaagtgtccattgttttacaagaaaaaagcgattgtagccgttcatgtagaaagttcaaattcgccttttcgtctgacgctgaccaaagtcctgaccaaacgggcccacgcgtcctcttaagaccgcggtagtgcgccatgaaaaggtgggcaatcgtaccataaatgataagggtgtaatgtggttgtttattttttatttttccctggtgctaggttgctctcaggggcggtggaggcctcgccctttgccctgccgctcccgccgccgctgcgctcggtcatcgcggccagacatgcctcctcaaggcgaaaacgaagaatttagcgacggtaggaacagcagtgaggatgaatatgaagcagagccaacgagcgcggtcacagtgccggtccgtcgaggaaagtctacgatcctccccccttcc

SEQ ID NO: 3743 - DNA, 703 bp, Nannochloropsis_gaditana
  misc_feature (74)..(415): n is a, c, g, or t
aggggagagggagtgagtgctgggtcggaatgatccagccgctttccgagagggggggccgggggggatcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaggaatagattgaagatgggcaatgcgatggacgaaacccggcgtattggcgctcagtcaccatgtatcacgcattttggcttcaggtttttcgtctggacttggttcctgttcccggatacccttccacatttcccgcttgagctgtgccttctcctctgcgtgttatctccctgcacatcttgattgctttccaagtgccgtgtttttcccctcctctcctttcacacacacatcttttccttgttcttcacgctccccctttgtccctcccagatgacatg

SEQ ID NO: 3744 - DNA, 703 bp, Nannochloropsis_gaditana
  misc_feature (1)..(112): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggaggtccgctagtgctgttgcagctggcagcgtacgaggccgagtttctcgaaaagtaggctgtatcgcagtgcctgtgcccatcacctgttctcgtgtgtgcgatgtcatgcatgagtcaccgtccttggccaggatgggtggcgtaatgtggcagtgatttgcggcccacagaaaaggcaactggcaaggctccaaccctcctctccttccattcctgcgacaaaaaaataaacaaataattctaagcccccccaaaaaaacgacacgtggggtagtttggccagatcttttgacggaaagggatgtgtgcgagctacaggcctttgttttgcgccttgaaccctgtgttttcaacaggaatgactcctcctctctctagacttcaaaacgcctcgactctagtgctctttggttagccaaatttcaacttctttgcttgtttcaaaagcgcattcatgcccgctgtcccatacatgcagatgcagcggtgacttttgggttgcctagttggccattagttttgcattggcacagggaattttaaaaccttgccggagaccgtggggtgtattcttatcaccatg

SEQ ID NO: 3745 - DNA, 703 bp, Nannochloropsis_gaditana
  misc_feature (1)..(527): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtccttatgcttcttcctttctctctgccgccctggctgcggccctccccccctccctctctccctccgtgcttccctcccttctaggcctcaatgtggggaggctcttgggacgccattgtccttaccgcaaggtagtgaggaggaaggaaggggaaaagggtgcgaaaatg

SEQ ID NO: 3746 - DNA, 703 bp, Nannochloropsis_gaditana
ttcctacttgggcatcccttcctgaaccgtgttcctgcttactgcaaacacaaccagccttcccacgcttcagaacaaagtacaggcatctcgttatatctttatcataggcacgtcgcgtctgcgccatgaccttgcctcgtaagcgatccacccgacgtcaattctagcgggttactgccctgaaacctcccacggcgaaacatagtgccggccacggccctctcagacgacgcatgcggactaccggcacgagaaagagaaggaagcacaaagctcatttcctttggactctgtttccggagactaaacggctggaagattacgttctgccgtaagtcccgtgtcatcccttcctctgggcagactgtccgttccactctttagacaaacccacctctgaggtatcaatgggcgtcgaagaggcctgaaagtcattcatatcgtgtgctcttcttgccttgcccattttggtgtcccaatctcgcattcgtgcgcatgtaggtggctgccagatccccggaggctgcgccgcgaaggggatgaccccggctttgtcaccttccttttcagcaccgtggtcgtaccattaacctcttccttcctccccgatgctatccgctcccgatcctattgtcccgtctcaacaaccgtcgaatcccgcggaggcattgcagccatggacggcggaggctacacaatg

SEQ ID NO: 3747 - DNA, 703 bp, Nannochloropsis_gaditana
agccgtggagaaacctgcggccggcgctcataggcctgagaagatcgtggtaagtcaaaggggaggaggtcgaggtcgaggaagacaaaaacccataggtcataaaaaaatgtcccacatttctttattttattatatgggattaatggagatctgcatcgtacgtcgctgtgacttcttgatgcgtaaatgtctgagtgcctgtgcgttttgtccctgggctttgctctcacgcttttaatctccgccatgatatctcattgacatgtccttttcgaccccctcttccgggctagctcggataaaccgacgccattcacaccatgtcaacagtgtcaaaagggtgatgaagtcgtcgccctcacagaaacaaaaaggtcgagggctggaggacgccacagtcgacgctgtaagtgaaggaaatcatgagccctttccaaccctttttaaagcccctcatcccgcattcctgcgcccccctatcttgtcccccccgtcagctcctcgcattcttggacctagacgcccagtttcaaaaagtcttgcgggcttttgtaaggcttgtaccccgcatcgccctcttggcggagcaggccgtggcttccgtcgaggttgagggggagggggaggaggagggggagggagagggctgcaccagcatgcacgatccaacctccctccctgcttgcgtggcttccagatg

SEQ ID NO: 3748 - DNA, 703 bp, Nannochloropsis_gaditana
  misc_feature (230)..(239): n is a, c, g, or t
cgttgatccacctcaagcagacctgaggccttttgagcacattttaaaaacaataaatgtgcatcctttcagccgaatacaagacaaatcgctgccggacatgcgtagaacttcataaagaaaggtgttgtgacgatttttcccagttcatgcagtcctaccgctgagctggcagggggacaagtctgtccgatgatgaaggaaaggagggagggaggggaggagggagnnnnnnnnnntcgtgtcgtcaacgcaccagtacgaaagcaagctgatatgacccatgccattttatctatgatggaaggatttgttttttcgcgctctcctctctttgatggttttttcgcgctctgttatgtttacaacactataacggagtcatcatgccaaagctttcaatcaccaacctccttccctcccgttccctttaccatgctgctcaggcacgcaaaatgagtggaagcaaaaaagagagcatgtctctcttgttttatggagccttttacagaaatgaggatggaattgaggtaaaaatgaaatctaaatgtagtcacgggcacgagagggaaggattaggggaggaaggggaggacagtgtctctccattttgctctttcttctctgcccctaaaccgcacacccttcactctcaaccagactacgaagatagatataaaaacagaagggagcgagggaaatg

SEQ ID NO: 3749 - DNA, 703 bp, Nannochloropsis_gaditana
atgtatggaaaacgtgaacgggacacgatggcgtgaacacgagatgagcacttcctcatcaattgaggatcattcagcacgatttgaggcgtcaactgttatccctttgtcttatccacgtttttgatccaacagcttttttgttcatctcgttaaaatggccaaaattggttgtacaggaagcacatttctgaagggactgagttatcccctagacaaactatctttgtagaggaaatgctaagatatcagaaaactgctggacagttttaacaactgccaaagaagcattttctttctactgaacacctttcgtataaaacggtagtaaattcccttcaaactgccctctttgcattcacatttgccggtggtggtgggctatcgcttggattgcagggcgcatcgctcgttgctttgaactttttgttactttctgaccgtgtttttggttcgtatccgatgaaccgactgctccgtatgaaccccaggccttggctttggtcgttcttgtgaatcgttgtagatgacatatgtatcattgtttccaagtcgtcggtgagcagtcttggatagtttgttgagtcctttctttgattttttttggcttgcttgctttctctttcttcttcccgtcgaaattgctgctgcttcaacgtcaacctttccattctcttcctctcccttgtctgcaggactcatg

SEQ ID NO: 3750 - DNA, 703 bp, Nannochloropsis_gaditana
acttgctgacttgggggcaacttgcgccattcctccatcccttccgtgtcgcggttcgcgcggtacaaacccgcagccacgccgcatcccactatcccgagcgatgacatgagtagaagaccgtaggatggcgtcgaaggagaggataatggttttgtcgatggtgttggtggtgatggctccagggcgtgagaggaggtcgtcaaggagccctcgcgcctgtttgcgctgatggcggattccttccacacagacaacgcaccgcccattcctgaacgtgtggaacaaaacctttacttatttctacgaccctgtcacgaatgattaaaaatggacatgaaggtgtgagactcgaaaactgccatgtaaagcagagacagagctgagaggactgaggagggcgagagagctggaagtgggggagcgaggcgaggacgaggtgtgaatgttgttgcctaggaacacgaaggatcctttcctttactcgaagatgaccggacctccgcctggtgtgactcgtatggcatctcgtgggctgggcggtgaccgcaccgcggtggaagtgaatcttaaaacgaggtggggatggactctctctgagccttcttgcccgtcctaggtcccctcggcaacgagcatcctcatattgccctgtttggtattccaatcctctgcaactcctctatcactacagtatcctatg

SEQ ID NO: 3751 - DNA, 703 bp, Nannochloropsis_gaditana
atggtgatcagccttgccagcgtactgccctctccgggggcatttgcgccatctatagccacgcggctgcctggtccaagcaatggattgaatggccggtacaaattactgccacggccttgctcaaggtccgcgtgggtgggcggagtggaggggttgatagatgggcttcgccggtcatacggagactgaggtggggggggccgacttgaagaaaatgcacggacaggccggatgacagaaatgatgcccaggaagaggcagatcttatgtgcaaattgcatgtttgcgggtggcatggtgcgccagaccattcctgcaaatgttcaatttctgaaggtcagtcagtgccttggttgttgcatttcttgcatgttcgagacggcgattccgcgacagccgagagagacagagcgtgctgagtacttcgtatgctcccagtcgtcactttattccattacatgtcatgcacgtgttgttacgtgtcatgccccgaacttactggagtctgcacaacatctgaaaattgacagggtgtcctttacctctttcttagtgcatgagcctccccttgccctggagcgcccgccgtgctatctgcctctctgtctccagcatcttggccacagcgaaaagtaccgcttttgcgtacccgaccagcactttccctgccgatacacgtacgcgcgggctcgctgccatg

SEQ ID NO: 3752 - DNA, 703 bp, Nannochloropsis_gaditana
actgtgtagtcaggagatgggaggtggtggaagtgcccggaacaaaacgtcgaaagtcttgagcctccttgtacctggtgaattatttgtttgtccacgtctttcctaaaaatagtgcacattaatggtcaggtaagaacgcttcgcaagcgtttgagatgttgcggtacaactttagcgcgggcgatttttgtggggttttactttgtaagtcgtgttgcgtctcgctcgctgtttggggtggggggatgagcataaaaattttcgcgtgttttcagggaatttttttaatcatctctgtgatgaattttttcccatgattatgatttgagacaacgatgcatgcgaaaatatttgcattactttcttttttcatacgtgtctttccttaggttgttatcgagaattctgagctaagcacgagctcacgttctcaagcgtcttgacatgttttatgcctctccctctgacctttctgcgtgcagggaatagtgtcattggatttcaaacataaaatcgaggcaatttaatgttttacaaggctgcttgaggagctgacatagtggacagtacattgctgcggtgatagcttttcctcagcttttctcgtgttctcgatctctgccggatctccgctcattttttcttaagccctttattggagagcatcatcaaactgttggatgccgggaaaaggtcaatg

SEQ ID NO: 3753 - DNA, 703 bp, Nannochloropsis_gaditana
atcgcgggtcttacagcgttctccaaagaggacaagtccggtctcgcagccattgtgatttactactgtggtcgcacagctactggaaaaactaacatctttctgggctgataaaaagcatcgcttttttccacaccgtgacagttgtggcgattcctacagtaagtgtgagcgtgtgtaggcaggcgccttgtgtgctcttttttgttgaaaagcactatcacagaaggctttgtccccgtctcgttcatacgtgggtaaactgatttgactcgaagcgtttctggtctttaaaatggacgcagttttctcggcatgtgatggccagcaggtggttttgacgttatagaggtactatcgatcaccttgcttccctccaaacgcaacaagagatatacgcctgtaacacaacacgtccagtcaatccaactcagatggctacactgaaaaaagagcttgcacacttgtgtacaagcacatggttggcaaaggctccctcttttcctcacattgcattaacctcccccccaacgccaaaagcaaacctcctgcaaacgtaatttacgagatgagttcatcacgtatttgggaggttactattttctcagtcttagcttttttccctcgaactaaacgtcaggtcacagtggcagaaggagggttgcggtagatgtgggggtgaggcgtctttatttctcacatg

SEQ ID NO: 3754 - DNA, 703 bp, Nannochloropsis_gaditana
atgcgccaagtcgagggggtgaaagaggggaaggagggcttggggaggcggggcgggcggcggaagggagagcgcagagatgccgaccccccgtacttcactctctgtggagactggcaagtgttaaccgacgatttccttgcaaactggcagtctctatgtagaatggcaatctctgtgtagaatgaccatctgggtgtagaatggcaagggggcatagcacgatgtactgaataaaaggaaagcagcgacacagcatcaataagtcaagaagaaaagcaaaatccgggtaccattctccctctctccctcgcgctcttgagccggcgggcggccccctatcccagtaaggtcacaatggtttcatttttttcgcgccatatttcttgtcgcactggctgagggtaccagggttggttgcatttcggccccacgcgacctgactttctaccgcctcgaggtcatccactttttcgtgaaaggagtcagcctcgccttacatgcactgtgacggccccccatccctggcattcctctgccccaaaacgtctctttttgtcatattgctcccttttccaatatttgaatgcatggacggtggttcaacattttgaattagaacgaagtcaaggagaggccgcaagcttcatggtggatggaaaaaggcatggcaccatggaacaacaaggacaggaacggaagg

SEQ ID NO: 3755 - DNA, 703 bp, Nannochloropsis_gaditana; identical to SEQ ID NO: 319

SEQ ID NO: 3756 - DNA, 703 bp, Nannochloropsis_gaditana
cattatggctgcaaaataatatagcaagagcgaggaggaggaggtggaagtgaagcgagaggaggcgacgaggaggggagaagaacgcacgacagggaccggcgtccaaagcttcgcggccccttacgacctccatacctgtgctgacattggcggacgaaatacatgaggtggaggctcggaaagagccaaaggcggtggccttgaaggaggagggagggggtggaagaggggaccgttccgatctgttcaaatatgactcggcttgaaggcccgcgagcttggagggaagccacacaggcgccggaaaccacatgagttgggcgctttggggggcagggggcgtaaaagggacgggcgagaatgtacggcgtgggtgtgaagcggtcttggactgtgcggtggtatgggtgggcgaggtcgatgggtggatggcgtggtggagtgttgcagtgatatggatggtgcaggcggccatctttgaggtctctttttatcgttcttcctcgtatgtacgatactaagcccgcacaaacgcatccagcgagggtatttctctatctgtctgacagccacgcgctctttttgtttgtttccgttttcactggcgttgcattcctacctttcagacatatcctttcatatccagtccacctctccgcccactcaccctcagcttcccccccttccttcctttcccaca

SEQ ID NO: 3757 - DNA, 703 bp, Nannochloropsis_gaditana
gtgacttggcggtcgagttcgctgaagaagagggagcggacgcatgataccaattccatgcgcagatcaatttgaatgtctgtttgttgcgaagggtacagacttctcgctgccttcgcccggcttacgtggcctgctcttcattgagatggcggtcgagattctgacctttgcgcggtacttcttttttggtgtcttgattgtcgccatggttgaaggcgttagggcgaggtagcgggaaaggcttatgcattgcccccctagccaagggtgagcccatttccctgcatgcagaggatggttttcacactctagccatccaaagccttgttaccttcttgttgctgcccatgtcctgaagactctgccgcccgtggcggctttgcttgttttgtgccagcaagggaacgacccgaggcgcccgccagcctgtaaataggagagacatgaccatactgctccactgattggttccacgctgttcaaaaatgcgtaagggtcattttgaaaaggtgcccgtgggttgtgtgccttgatggggctgaggcacccgtggtcagaggcggaggtcgaaggacaggaggggatacgcgaccaggaccttggcaaggcctcaccgcgacgacaaatcatgaggaagggaatgacgacgacgacctccttcttccctccctcttcctttctttccccccagacaggtatg

SEQ ID NO: 3758 - DNA, 703 bp, Nannochloropsis_gaditana
gccaacttcacttgcgcgtgctgaatggtagctggagcagcatttacaccgcgagtgcttccactcggaatggcggctttgactcgggaagggggccggggatacgggtaggagggcccctctactgtgctgcattccgacgctcggcgccgcccggtggtgaccgggggccgcaacatgacggtgctcctgtaacttcctgaatgtgccagtgtcatggcacgtgagtgaggcgagaagagccaaagagagaaagccggaggcaggcgccggccgtgctgctgcctagctggttggttgattgtatcgctatttcccacacgtcgttttctggcgactggaattaagttttctaccacgtcccacgcgccagcctgcttttacgtctatctatttctgacgcatcatgttcacagagcacggttccgggcgaagattttccatggagcaagccatcatcaaaagcgcgagacgcattcagtcctctttgttgtccacagcaggccgttggagcggagtcactggtgcctcgcgtcgcttgaccacatcagcgacctcaaacagcagcgacacaagcaccatgcaagaagatagccccccttcggcagcgaaggtcgtggtgttgggtgggagtgggtatgtgggacagcacgtcctgcaagcggctttgtacagaggcgcggacgcagtcagtatcaaccga

SEQ ID NO: 3759 - DNA, 703 bp, Nannochloropsis_gaditana
ctcgcgtgatatgtataattcgagggtgtattcgtgaagggtggttgagcaagctttaaagttggtgatgacactttcaatcgtgccgaggcttggcattgtatagaatccagtgatgagctagtagacaaatcacaaacgaccgccggcaggcattttttaaatttttatggcgctgggtcgagaacgagcaggagaggaaaacgagtgagtcggcagtcagatcattcaccgtgcttgcgtctaatttttgtttaatttgtctttgacttttccgccagacgcgaaggctgggtcatctatgggtgacatatcaggtcgtcgtcaccttcatctcttgcgcgtactttgccctctcgtccgcttaccgacgaaacgcagagggcttcttgatcgaggagaatgtctttggcgcatcagttcttgccgatctgcttctgcgcttctatgcgtcggatcacaggtacgtagagcgtcccgatggttgttgctgggaaatccggggtcggaggaggcctgtgtgcggaacggactgaagcggaaggcttccccgccgtatcccgaggctcacccctgcacactcactcaaagatacgcgtacaatttcacatatccattgcccaggaaatggttctttttagaaaggcggacggttatcgacgtcctagccgtggtccccgtcttcactgacatcctgcgggcc

SEQ ID NO: 3760 - DNA, 703 bp, Nannochloropsis_gaditana
cgagggaggtcaaattctgaagggggccgagctggtctatccgcaaagtttgcatgcatagcccgaagcaggttttattcagctgagccacacatgtcgaggcactatctgtgccattcccgtcgaggcccgcgggcagggcgaggcgcacgacgccctctacaacgggcacgtctcccgggaatgacacttccgggcgggagtgctgtgccctgtcagtcgtcaggacgacggcgtcgtaatcgataatctgactgctgtctcgaaggccgatgcacattgtctgtgtgtaggaacccgcgaaggacaaagaaagtaagtgaatcacgcaaggcatagtcgggccctccacagcagggtactcaccaccaggagcacgaaagaatggaaacgtaggcaggaccagcaggacggtcgcagccctagcatactttccctcaaaatcatgtctgtggtgtgagagattatgtttgcatccataggttgaacaagtgggattggtgtcgcgtgaaattcaacaccaaaagcgcgacatcggtgcgcaacggcaacacgatttctcaagcaggcagggtcgaggggaggccccttttaatcctaggatctaccacaaatcacacgcctaagtcatatacccggacaaaacatgccttccccctgtataaatattaagtctcgcgccttcaccgcacaggggtgcatg

SEQ ID NO: 3761 - DNA, 703 bp, Nannochloropsis_gaditana
ggtcctgggtcgagacagccaacgaggggtcacatgttatttattgccgagcgacatccataaattcttgcgaatacatacatttcatacatgtgatagcgtgacggtgactccatgccgccgccgcggggtttcctatccttcgtggcggtcgcgttggtcctgattatgtcgcccatgttatttatgaggaatcctgctgaaacgtatatgaaccttttgggaacgcgaggcttacggcgggaggcgaagatgtcaataccttgggtgattgaaggtaggtcgagactctatgggctggtaagacgtgcatccatcgcaagagcttttacatgcgaccccaatttcccaggagaaccaagggagccagcgcatgtgcgggtggtgatacggactcacgcacgggaacaactccagttgcgatctttaatttacgggttgcgcgcgcaaagcgagggacaagccggttttaaggcagattttgtgctggtcccaacggaatcagcttcgttgcaaacgtatcaacgactgtgtaacggtgcgagctactagtgtttgtatgcaccctttgactaccactgagcgtttcatgttaagtctcagccttatgattttgggtgttttaatccgcaaatgcacatctttcccctggcaatgtcggctcatggatagactttttcttatttttgcatgcgcagagatg

SEQ ID NO: 3762 - DNA, 703 bp, Nannochloropsis_gaditana
ggccttctcacccagtcgagctgccaaaaatgtagttctatacgccctgtaatgaattacatgcaatgattccatgttgaggcgtcacagtccgtacaattttttgataatggccaaaatgccatcgggggcaggggagaagacaaaccgaacgaagcctcccctggttttcgggcgagtaaagcatgtgtcgggatgtcgtgaccgacacggccgcgaaaaatagatgaatgaggctctggaaacaacatccaatcctccatgtgagcctctttatccctgtgcctccgaggttcatgctgttgtcatactgcgggatttcctgcatgtcatgcaaccgcatgtctcgggccttccctctcgtcctcccttccttgaagtgggtgtgggccgctagatcctcgcaaacaaattaaagtaatgtaaaagttacacggagtcacgccgctggcaccctctgaccaatctctcatcgttccaaaatgacaatgcatctttttcaggctggtttcaaggctctaacctggaaaggcaagggcagaagaagcgttgggccgggggcccatttcggctgagaagtcaaggccattactattgtaagtcgcactcttcacgcgttgccattcgcaggtaccttctctcaccctctctttcttatgtagggtgctgctaacttcaagattcactagcaagcgtcgacatg

SEQ ID NO: 3763 - DNA, 703 bp, Nannochloropsis_gaditana
tctaccagcgagacttcctttctccggaaaagtgcggtacctaacaatggcaattcgaattatcacgactgtaaaatgcgtgacgtggctgagatgactcgtgaagagttgcaagccatgatccgagcccttgagagtcagtacgacatggatgccacggctttggaggaggcttacacatatcagaaaaagtatcttgaagacgccttacgacggtgtagatgacttggtacgaaagaatttgtaagaggacccccgtgtaaaatgtaatacgacatcaactaagttggaaaatgtgttttcatgctgatcgacgagcctctgaggtatcctattaaaaagtgtacctgaggcatggacgatggaaatttaaaaaaaattgttcgagaaaagctagcgacgtgacgtttatttcccgtgataatgaattacttctgtgaccatgtcatatgaaagtcgcttttggcagccaaggcgcagggagtggggaggttaaaccttcgatttcgagggtttgttcacgaaagagggcatgcacagcttttattgcgtaagacggaggtaaaatggtatgagatacctgacaaatttcaatgtcgcatgccatagagttcacaggatttgacttctacgtctctgccacacacaccccgtacaggaaggagtttatcgggtcggatgatttgagccgccagaagtgatg

SEQ ID NO: 3764 - DNA, 703 bp, Nannochloropsis_gaditana; identical to SEQ ID NO: 1552

SEQ ID NO: 3765 - DNA, 703 bp, Nannochloropsis_gaditana; identical to SEQ ID NO: 1553

SEQ ID NO: 3766 - DNA, 703 bp, Nannochloropsis_gaditana
  misc_feature (1)..(486): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcacggtcgtgtgatgctctcccttcaggaccggaagtgaggccgtgaacaagtcatggaaggaccattgctcactccttaacctgccaaccaatcgctgaaggggcaccttccgtatgcatgtgcgcagagctcaataccctccccctgcccatcacttttccattgtcgctcctcatcccctcagagcaaggatttagacctccaattgatg

SEQ ID NO: 3767 - DNA, 703 bp, Nannochloropsis_gaditana
ttattcaggggctgaaagataacaagccaatgttgccaatacacggggatgtggactactacgcttcaaaagaaaaacttggcaaaaaacacaaaaaatcgacccatagatttaacggatatggtcagtgaagctgaataggacattttgatatttttacaggaggccctgtggactttcgaaaattttcatctaactgtactacgtttttctgaaagaaagccaaacaatgagcttgaataaaaatgaactttgcgcaaagaatagccaagcgaattgcaagaataggaggatagtgatttctttacaacaaaataaaatgaagcgggcaaaatggcatcgctttccgaaacttcctttgttttgtttttttttttccctttcgcccgccgcgagcgagctctcgcttccgttgatgcaagtctgtgtcgcttgacatgtttataaataattggtcatcttattttggaatggcttgccattactagcacaagccattgttttcggactcattatttccttcacgctgcagggaagggggtctatttcgtaccatttcgggcagtgaaggtgcgaacggtgtggatgggagcactacgtttttgatttagggcagttttagggcacgcgtggtcggcatctcacctacctcctccgtcgtggcgtacttcgtgccgcacatttgcagcgacacgcaagaatg

SEQ ID NO: 3768 - DNA, 703 bp, Nannochloropsis_gaditana
tagcgtgcgctaaaggggatttgcaaggtagaagaggagggcgagagagaggaggaagtaaagagacaagctgaagcccactcaaaataattatgtgtagcttgtaatgcctcatatcattcagtggcatcatcatctgcttgccatcaatgcatcgctttatatttctcgcaaaaaaaatacgccctggcaaggaaaggagggtagtaagcttgcctccgggctctgttgaggctagtcattgttgcactatgtacaaccaatgacatcgatgaagagggagggtaggaaacggctacggtgcctgtgaactttaccgaacgtctcgtggagggcaagcccgggccatggtaacacaggggctttacgttgctgttctccctgttgaagttcctcttcaggtgcctcgctagctccctcccaaccctctacagggcaagaggttcatcccaataattaaatcaacacaacaagaacttccatcggcaagggaccgaagcgcccagcactatattgtgtggacgtcaagcatcatccgttgcgtgtacacctgactttgactggcttgaagagggagccagcgtcgtgaaggcgcgtgcgtggcttcaccaccctctaaacttcaaaagcaagcattacgcccccccgcggtcctgtgttgccaacctttccatgctaatcgacactaaaagagggtgaaatg

SEQ ID NO: 3769 - DNA, 703 bp, Nannochloropsis_gaditana
aggaaggggttaaggaagggaaggaggaagggaggatagtaggttgcgtgggactgcgggtgttgtgtagggaggggaagaaaggggagggaggggaggtggcgaggatgggaaggccagtgggagaggtggtgcggctgtcggtgcggagggacaagaggagccaagggataggacttagaatgctcaattatgtggaggaacttgccaggctcatgcacgtcaacgaaaaaggaaggaaagcgtcaggaggagagcacggtgacgagaaggacgaagaaggggcgcccatggagggtggcagggagccgaatgaaggcaatttagaggggccgacaggcgtggggttgagtgctttgagagccacgaccctgggggaagaggcattacccggcgccttgagtctctatgtaaagcgggcggggtgggtagtggagaaggaaactgcgtacggcaaggagggagaagttctgtaccatctttgtaaacagctttgaaaagcaacgatgaaggggtattttttctattgattataatggctgaagggctatctcgtgcgcacccgggcaggataacgttaaaaactttcaagttcctgtcttgcgatttgttttcatgtcttgacgcgatctaaaggctttgcacgtcttcgcatgtctatatcgtgggggaaagcgtccacacggctttatgtgtgaaatgc

SEQ ID NO: 3770 - DNA, 703 bp, Nannochloropsis_gaditana
gattataatggctgaagggctatctcgtgcgcacccgggcaggataacgttaaaaactttcaagttcctgtcttgcgatttgttttcatgtcttgacgcgatctaaaggctttgcacgtcttcgcatgtctatatcgtgggggaaagcgtccacacggctttatgtgtgaaatgcattttgtcatgcgtgaccctcacttcactagtaccggtcaaacaaggaaacgaacaaaaacgatttaccaccgtgtttaagttccctacaccagcgacaccagatgtgatcctccaaacagacgaatttcagtgtgcaaagcgcctggactcaaccatgttgcagaaggtacgtcgttcggaagtagtatcggaacaaaaacatggaccaaactaatgttggcaaacgggttatggactggcgagaccggccccaccggcgccggacaaggagaaaatggagccagcaaaacgtccatggacacgacaaatgtgcaggccggcattcgtgtatgccttttcatgagcttgtgtgccgggtatggccaaccctttgcgcgcctgcgtccatggtggctgggttgttggtcgtgtgctgtggtataagctgacagcatggggtcgatggcctaccacgcaccaccactcctctcctttaagcattgccttgtacttactgtctcgcacgtccactccatgcgtgtagcag

SEQ ID NO: 3771 - DNA, 703 bp, Nannochloropsis_gaditana; identical to SEQ ID NO: 1367

SEQ ID NO: 3772 - DNA, 703 bp, Nannochloropsis_gaditana; identical to SEQ ID NO: 1368

SEQ ID NO: 3773 - DNA, 703 bp, Nannochloropsis_gaditana
cccccttcatttacctcctcctcttccgcctcctctgcctccgctgcctgctccttcgcatcccttgcgttgccatgaaatcctccatatatttcatctgcctccctagttagatttctgtcctcggtctccaattcacgactcttcacaagctgataggtcgcacagacggcccaattctcccagcctgcccggggacaaaactcggccgagcaagcagtgtagcccgtgtggtgcacctctcccagaaatcctgctgccggagacaagggcgtgggggacatagacctgtcaagaaatcgccaggcacgttacaatggatgaggtccggaaaactttggtacctttcaagacaaagagatcggctacccatggcccgtgtgtctcgctagctcgccgggaagtgaacgagatgcccccaaaaggcgtgtctcgcataccccatggcccaagcccgccctcgtgtgcacgccccgcacgcgatgcttctgcgaaatgcttggaggagacgctaaatttgctgaattgtgctgtgaatgacaggagttcgtcgattttgggcttcctccctcctttgcttccggctggccccctcgagtagccatgccattgcttctatccctttcccaaaagcctgtctcattttcccttcatgcacgctcgattgacccccacacagacagagagccacagtcacagtatg

SEQ ID NO: 3774 - DNA, 703 bp, Nannochloropsis_gaditana
  misc_feature (253)..(262): n is a, c, g, or t
cgggacacaaggtctctgggcccttcgtcgccgcacctcggagcaggaggaagcggatgtggactcggagaaccgtcggaggaaatccgttcccgtcacctctttggaacagctgcatcaggtggtacgtgacactggcttgacgcgcccagcatcgctgcctccctccctgcctcccctctttccatctttccaccctcacctgctcctgaccgcctacctcttttctcccctccctccctccccctccctnnnnnnnnnnagccctgctactcctggcagaaatgcgctccctgcccgccctccttcccgacctcatcacttacaacaccctcatctccgcctgcgccaagggccaccggccccgggacgcgcagcgcctggtcaaggagctggaaggggagggcgggcggatccttccctccctggtaacgtacaactccctcttggccgccctcgctcaggcggggcagtggaaagaggccatgcgggttctgcagactctgcagcggaagaacctccggcctgatgtcatcacttacaccagcctcatccaggcttgctccaaggcccgaccgtcccaggtgaagaaggcgctttactacctggagctgatgaaggaagcgagggagggcgggggagaggtcacgccggacgcggtcgcctacgcggcggccatcgaggcctgcgcacggggggggcc

SEQ ID NO: 3775 - DNA, 703 bp, Nannochloropsis_gaditana
atcgatattcacacgtatatgaaaggcgtttccgcggttttgaatggcattaactggcattaaaggctttctttattaagaatgtggtgaagcgttgaccagtgaaaagtacgtgacgtttgcaagtgtcgcatgtagacaacatagctccgttctcgtctcgaggacacgaagcattttcccgcacatcacgcaccatgccgtaacaaagtaaggccttcaaatttgttcagaattaaacacagtccaacaggtatgatcaccttgttgctgagttagggactgcgaaacgagggcttttgtgaccgtggtggcataaccctgagtaacggttcctaacggctcggggcgttgggatagccgttgagcggtttcacatattgctggcggcaccaggactgtcggttacgcgcgtgtgcatgacttcatgtttggaaatgcaaggataccatgcataaattccgggcaatgtaatgatgaggcatatactttttatggaatgctaaaatcttgtcaaggcagctcgatctcagacgtcatatttgaaagcgtttccgtaggcaacttgatttcttcgcccccaccctttcaaaggctggttgacatccgcatcattcactcggcttctttttttatgcttcctttctatgctcgccttcaatcccattacgcgcatacgcagtcacatcttttcctaatcatg

SEQ ID NO: 3776 - DNA, 703 bp, Nannochloropsis_gaditana
acgataagccacaggactacgaaagcagagagaaagaacatgctgtgcgcggcggcaaagaagagggaacgatctgatagctacagaaaggtggcagggacgatcaccgcctgaatttagggccgggggagacgggccataccaccctgtcgcgtcaagggcttcaaatcctcccagtcacctgggagtactggggagtacgatcaagatggacacgggaatgagcatgagaggaagtaaatctacgcccggtgtttgggcgccgcgggatcacttccgcaccaacctcgggtctgggaacaagcagttccagcgagagggaggggaaaggcaggacgttgagccgtcagacttgcctacttttcgtgtctggacgaggtggcggtcatcaagagattcgctgcgggggtctgagagttcatttgacgcaagtagcctttgatcaaaagctaacgggtggtcaagccctttatatgcgcatacggtccctcgcctcccactcatcacgaagtgactacccgtacgttcgcacacagcccgaccatgcagaacaaatgcaatcatggcgttgcttcgatatgccaagggtgcagcaatgaggagccctcgtagtgtaagagaggatgttgcaggattttgcaattttgtcaatccattgcagagttgaacttcacgcgtgctgacggaggaaagaggagggatg

SEQ ID NO: 3777 - DNA, 703 bp, Nannochloropsis_gaditana
  misc_feature (1)..(698): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaa

SEQ ID NO: 3778 - DNA, 703 bp, Nannochloropsis_gaditana; identical to SEQ ID NO: 1906

SEQ ID NO: 3779 - DNA, 703 bp, Nannochloropsis_gaditana; identical to SEQ ID NO: 1908

SEQ ID NO: 3780 - DNA, 703 bp, Nannochloropsis_gaditana; identical to SEQ ID NO: 1909

SEQ ID NO: 3781 - DNA, 703 bp, Nannochloropsis_gaditana
ttatgagatgtcagagctgtggccttttaataaaggaatggaaaaagtgcgctcatgtactgaccttgctccaaaggcagggaagcgatcgtaagccccgcaccgcttataaggaaccgtccgtttgctagttccttgacacgaacttgactgcctctcatatttatgtcatgcttgactcggggagttgtggcgtcctctgtgccttttccagtgtcccctcgggtcatgttcacggaccgcgcggcgcctccgccccgcttttgtgacctctcgtgttcctccgaagactcccagaggtgagctaagcatgagcagaactcgttcaccatcgcctaacgcagatgctcctgtacaagggctaaaaaggtactgaaaggtcaatgtcgattcgtttaacaagtttttccccgaagtaatgcgtcccggcatgtgaggggggggaggtcgctttcgccgccacggtgagaaaacgaacaagagggaaacgaggacgcaattcaaataccgatgagcaaagcgccgtttccattggcacctaggtcttatcaaattgcataattttatgaaataatagatatgcccatgtatccacaggcgacaacatctcgttttgcgcgctgaagttgcatcgttaagacgtgagagtgaaagggggggcaacaacaacgtcttcggcccattagctaccatcacgtacatg

SEQ ID NO: 3782 - DNA, 703 bp, Nannochloropsis_gaditana
cgaagaaaaagaataagtcgaatcggatccacaaatttggcatgtaagatacttttaatacaagcgattgctttgtgttatcgttgttacgtgtcttttttttgcgatttgctctgcagaattgtgtgctgtttctgaagggtgaggtgtcacttggcttctcaagctacgtcgataggataatgatgttgctaagcactcgtcaacaccatgcacaggaaaagggctccaaagatcctcacacatggaaaatgtgcgataattcagcttgcactatctccttattttctgttgctgctcgtgagagatcatctctctaggatgctcctcgtcgccgttccaactcccatacgtctatgttgatgacgaaaatgcttgcatgcgttcagcaaagtagtctttgtttcttgccaaaatacgtgcggagttcattgattattttcatttatgcattcataatgtgcttttttaacccccccatgcccaagtggaggcaacattagccagggccgcccgttcctgtcaaggagagtatcttgtctgatacaatcccgcacgcacactcctctaacgtacacacgacgcacagacatcaactcaccaggagataaacgaaattcaattaaagttttcagacaggtctcatagaggaccggaacaaactttgcgtggtacgacgccgtaagtaattagagtaggaatg

SEQ ID NO: 3783 - DNA, 703 bp, Nannochloropsis_gaditana
caacacttccccaattgggctacgtatggtacgccgaaaccaaaaatcctgtttatttccagttcttgtactaaagggatcgcaactgaggtgaacttctccctgtgcgtgtattacaaattacctgaagaaatgcaaactgtagtgggtgactggaacagacgctctgtttgaaagagggcttaacaaaaaaatcgagattatcaaataaatactttggggtcaagcattgcctcgcctttcggcgcaaaccgccatcaagtttgtttgatcgtcgtctatcttgcatgtcgaagttgataaagaaagggaagccgatggaataacgagtcagagcattgtgtcacaaatataatgcaatgtgctcgttaaatcagtttactcgccccgctgccctttccgcttagagagtgcattatttcctccacgattcctgtcaaaatccgcactgatcggggattatctcctttcttgtcgccaacaaattctgctttgacgtgtgtatgccccaaagaatgagcacggaacagaatttgtgccaacagatgtgccaagaaatttgtggtaagatggtagagttgtcaactgaacagaacgttgtagatggactgtttgacgatatactcccgttctctaatacaaacagcacaacgaggcatattagccatcttacgaacaaacttcaggcgtaattttagacatg

SEQ ID NO: 3784 - DNA, 703 bp, Nannochloropsis_gaditana
ctggaatagccttgcgcttagggcttgatttgatcacgacaaatgacattgccaaccccaagaggacaccacaccaaaacgcaggcagcggcgatccgcatgtcttgaacatcttacgcaaagtcctctccattttattctaatcctgtcgcagcggtatgaaagatgaggaatgcatgaacgttgcaaccgatgtcacaccttccgtaaaatcaagtcctcgtcatgcatccggtatgggatcagcagcgttctacttcgataaagtgcgcaatgtacgggagctagaagaacagcggcatccttgcagggatccgcactcgacactcgataattaaacccaggcggttttacatctcgtgcgtcctgtagcgatggttttgtattacagacgcgaatgaaggcgatggaacattcccaaattctcatccgtaaaaagcatttgctggtagtggcattccagcattacagccgatgccctgccaccgagatgattttctggacgcgttgcggcagatgtaatctactcccttggtgccgtctacagctttgcagacgtgtcctctgcaccgcctgaccgaaaaactggctatgtgaccagtactcggcatgcctgcggacagcgacccggaggctcgccaatactgagcgggcgaggcgcaggaacctccctcctcatggcacgcacgtatcacgcgagatg

SEQ ID NO: 3785 - DNA, 703 bp, Nannochloropsis_gaditana
gaagagacacggtgatagaatttttgctcgacgaggccgatgaaatctaaaccagccaaagtacaataacacaatatgtatgtatgcgttcgaaaaaagatcatggatttaacggcaaaagattacgatgtacaaggcacaagaggtgaggcgccagtttgaaatgcaatcgtatggacgcaaattcttctgttctgcattttatccgacgaagcgaaaagttcaatccctcctccggtggtcgtcgcggcgaaaatgtagaagaaagcgtcagagttttaacttcatgacgcacactgatagaccccagtcctgataatcttctcgttttgctggtcgtgggcgtcggggcggggaagggggggggaggttatccggcatcatctcctagaggagttcgctcggggggcgaaggcctgggggtggccccaaaaatgtgccccgtgcgcacaagacgcgcctgagtgcgtggtggaatcggacgcgggacgtgtgtggtggataaagaaggtgttaaggggcagtgtatggtgcgtatgggtccgtgcgccttgtcgtggcagtgcggtgccaatttgtggtcgtggaagccttttcgctcacctctttccgcgccggccttcggctttgtgttcttcctcagtcctggccgcgcagaacctcaaacccttttcaaaattcatgcctcttcgcgcacattaaa

SEQ ID NO: 3786 - DNA, 703 bp, Nannochloropsis_gaditana
tgacgcctcgtcgtcactgccgctgtaactttcgttcccgcggcctgacttcgctcccgagtgcatgccattgggtgctccgtctccgtcctgaaggatccagggcctgtcttgggtctcgttgcccttctctttatctcctccgtgcgcatcgtccaaagtggccgcatagccggaagagttgcggcgtcgatgctcatccaccgctgtcgcgatcacatctaatgtcagcaaaccgtcatcatcaaggtcatcttcatcagtgccgtccatatagacacctgagcgcaaattaacttccgagccctccactcgtcagtcctcctcgtcgtgagctcccggagggccacaagcgccccaacggcgaccgtgtttgtcttcagcctgcggaaagaaacgcgccaaaaagtcaaatcgatgccacatcatacttcataagcgaaagtcgctcgtgagcgcaaagctaacccagccaagctttcgcttgtttttcggaatgaggacgaaaagcaatcgtggcatgcttactgccaagggcccttcccgggggaggggaggtggagctccatggaggcatgccttgcgatctctgactacatatttgcttagtctttttccaatctctgaaacctatgtcaagcattcgtcgtgacagtggccttgagacttttttttcgtggagcatcattcgaggagatccatg

SEQ ID NO: 3787 - DNA, 703 bp, Nannochloropsis_gaditana
ggcctgtattcaagggatggaggtgttagggttgaagaccccgacttatgaccacgtcgagtcacattgtagccaaagcatgaaagctcattacacagagtatttgccgcaccaccaggcatcctccgaaccggtccggtagcatttttccgcggcaatccccggcagcccgtggacgcataaaaagagttgaaggtcagcttacttgcagatctttttccacttgttccacgcgactggtgaagtcgctgaattaacccgacctgccccacagcctgcgtgttttattgacaaggaaaggacaggagggagataaataaaaagggtaacgaggtcaggagcggcgtggggacatttccaagtgaactggttgaggccattccattattttttcttcctttgcccttttcccagcaagttagcctcccctgtcctgtccacatctgttataacgttcacttgatcgcatccatgtataaatgcaggagcagagcacggcaaggtaatgacacgccaaggctggtttgttcttggcgtggctgcacacttcaccatcgtccttcaagcctttcacgtccgacttgtcccaaagcacgcccttccggcattagccaggcgctcccccgtttccagcttgatcttcggccccccctccagtcatggcctgcaccactcaagaataaggagctcagggttcgcaatg

SEQ ID NO: 3788 - DNA, 703 bp, Nannochloropsis_gaditana
  misc_feature (1)..(571): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtcttgtccggcctggtcgccctctccttccggtacctgtgcggggaagccgagcatttcttcacgggcaccacacgttggcccgcctggaactttatgggccgtgtccctcgggccttcaagccgatg

SEQ ID NO: 3789 - DNA, 703 bp, Nannochloropsis_gaditana
ataggcctcgaacgcatcctcaaattcacctgaacactcatttactcgcaagaaacgattgtttgacatgttacaaacgtacggtgtgagggtatttaaaccgctcaaggagagtgagaaagcaaggaggtcgaatgggccgacagggcgcataatctaatcccatgattgcactcactttttaggcagccatccgccatgaaagatggcaggactaccatcgggccgtaatcaagaggccgctgggcttaccatggcattcagcggaaaacagcgcccgcggataagatcatcctttcccggattgtgcccctcaccttccctcccctctccgaccgcccgcactctctccttgcttccctttggccgttgtatagtcaccacattcaccatcttgtttttctcctcgttgtctgctgcatttcacctctcttcgccgccactctccttgcggcatcacctcggtctacctccattctccttctctccttccctttacatcactggatgcccccgcccttctccttccgcccacaagccccgccgttaccttctcacgcgcactgccctcagtcctgatcaccctccccgtacctcttcctcttctcctcctccttccttccccatcaccaagctcactcgcctcgtcgaaaagctcgaagaggccgacatcggtctcgtccccaccaccgcatttctgatg

SEQ ID NO: 3790 - DNA, 703 bp, Nannochloropsis_gaditana
cggcaagagagaaactgttatctcgagctctgcgagttcccggagtctttgccttctagccccggtgttctgtgtcctatttcaagctagcgcgtacataaacaggtacactctcgtcattggtggcggcatggtggaggtcgatggcagggaagccgaaaatgcggggcaggaccgtcgcggccccctctccgaacaaagtgaagcccgagtcgcgaataacgaccgagcgcaaaacatgccgggacccgctaacaatctaggcggctggccgctattcgtcctctttcttgcctacgcgatgctcctctacgcgcgcgacggaacgtcggaacccagcaacggacggaaagatgcgacgaattccgcacctccccttggggactctggttcttcctctgtcgagattttaccggaggctccactccatgccgcacgcgcacaaacatcctcgcaagacacaaaatcctatgtcttttcgacatggacgttcgaaggcgccaaaaagaaacatccgcttcaaccacacccgcgaatcgtcgtgcaatactgcaccagctgaggtgaggactggtgaggttcgggcaccttcagggataacatttatgcattcccgcaaattgcgccgtatttgtatatcgtcttcattttcttaccaaagtaatccttataaaacggcattacatggtcactcccaggcatg

SEQ ID NO: 3791 - DNA, 703 bp, Nannochloropsis_gaditana; identical to SEQ ID NO: 419

SEQ ID NO: 3792 - DNA, 703 bp, Nannochloropsis_gaditana
gcgaggtggtgacggacgatctcactgctgtagcaggagcatgggcgcaagctcaacaccagcgagcgtatgtttcatgccagtgctcaaaaactgtatgtctgttctaaaggacattccagattagcgtaagcattttttcccataagcatcatcctccacccttccacgcgtggtggcaatggtttcaagacgttaacaaaccaattgatcaaagcgctggaagagggaaatgagcgagagacaagcgatggttcaaccctctttgcctcaaaaagaggttcaccggtaatttccacattcaggcgcgcgaatgcgtgccaatggacgaagaagctaggtgcatgacagtgccaagaaatggaatgtgttgcacaacgatgtgcgatgcttgtttttccagcactgctgcgtccatcactgactttttccgggtggcttttcgcgttggcccgaatgggcggcttgggcagaacgtgtcatttgctccgaccacagcaggagaaggtcgccactcagtcatcgaaaatgcggcaacccattgagcaattttatagtgtgccagcatgtcgcgtgcttgagctgtgagtttctgatagggtcaagcaaaggaccagttttgtgcctgataacttgattctacgcgcgccagcccaaaaggcacacatctccaggtcaatatcatccgataggagtagttatg

SEQ ID NO: 3793 - DNA, 703 bp, Nannochloropsis_gaditana
gtccttttccttttgcgcggtatgcgagctgtcactttcctctcatggccgcagtcgataaaattaaccgctgcatttagtacgactgctgccactcgggtggttgcgcatactgccttgcggactggcagcatgactgtatttggaccattaatggcggccaccaaaagcgcgtcattcaagactttggccggaccagcggagtatgaagaggtttgtatgcttcaacagtgagaagatagtttttgaacctaaaatttactttatgttgacaatgtcttgctgcctatctctttaccggcctcagataataaaaaaatcgcgtttcctgtcccgcgcaacgcctgcttcttcttttgccgaagctcaaacattcttgagagatgtaggagatttgaaggcttcgcacaattgctgggcttggcggtcagtgataaatcttctcgtaactacttctttgttctagagtgaaagactgaataggcaccattgtgcgatacctaaggaaatataattccttgccggtccgtcttaatactgttcaactattttattcacatgtcgtgcttctggtatcatatgtcgctgatcaatgggtaggggccatggggaagagcggagctccgacgatggtgaacctggagggacagcagggcggcccattctctcggcaatagagagcgaggacctggtcgacgtgatg

SEQ ID NO: 3794 - DNA, 703 bp, Nannochloropsis_gaditana
ctctgcccctttcaaccggaggatgtggccttccccctgatctggaatgcgggggcatttcaacggcacctgcgcaaatgagagcgactcggaaatgacagaaaaattgaccggattccgtgttgattggaaaaagcaatgcgagggctctgattactttcatcatcgtgggacgcactcattgcatgcgctgacggcgagtgaaccgtctctaaaggatcgcatttttagtaggtattgtttaagggccttgctactggattctcatgatgatattgcaatgaaggtaccaaggtgtccaaggagaattgtcctgtcgttatctgggcgtccacgtgctggcacctcccccgtctcgtcctaagttttcaggagcgcataccagaccatgcgacatgatgacccgccggcttctttttctttggcgtcgtgtgcaaacgttggtgtcgcagtggctgcgtcacaaggtcctgtcaggtgtcagcgtgacgaagtggcacctgacgtcgacttgggatgatggccgggccacgtctcacacatgttgcatcttacgtagacttgcagactcggacatttttgcggggggcatcagagtattgacctgcacagtattgtacaccttcaccacacagaaagagaagtcagccctcttgaatgaaggaaaagcacctgaaaacggcgcggcgacggcccctccatg

SEQ ID NO: 3795 - DNA, 703 bp, Nannochloropsis_gaditana
gagagagtaagccgtgctccttcccccccccctgcccagcaagatgaaaggcccgaacgaatggatcgatccacttcctgagcctgaccgacccgattcccaccccttctctcagccacacaccaactgttcgcatgttgtgctcgttataatgtcaagtttccaccgggaagacccgcctggcaagagagaggccagaagcttgcgtgtcgtttgcaagggggtctcgggcatgttttccggaagggaacatggagacacctccatgttcccctcccgctctgtgccccgcttcatagttctcgcatgctagctagcgctgtggttgaggacggaaaatattgggataaataatcacgtaagtaagcgtgaggcaccactcattcactacagagtgtgtcaagctttggtcggatgcgagttttccagaaacgtcgcatgattgcctccatgagacaagcattatgtcgtaacatgtctcgttgacaccattcctgcctctgtcttcggaacaacggccaggccggcgcaagaacagagtttcccgatatacccgggggggctggggcaaggagttaggaaatggtagggcttgctattttgctcggatggcccccaacatgggccccgcccgccatgcgtgccgatcgtgtgaacgccgcagcgcctgatgccgcgccgtggacgctgacaacgtggcatg

SEQ ID NO: 3796 - DNA, 703 bp, Nannochloropsis_gaditana
ggtgcaaagataacaaagatgccctgaattgcgtatcccgtctgcccccctccccaccccgactccagtacatgcccgccgtctatgtcctgaacaagatcgatcagatctccatcgaagagctcgatatcatcagtcggctgccccactgcgtgcccatttcggcccagcacggctggaatctggacgagctcatcgacaaggtttgggacgagtgcaagatgatccgtatctacacgaagcccaaggggcagatccccgactatacggcgcctgtgagtctcagccttctttctacccatatcgtattggttcgaagaggcaggcatcccacctgttcctctcacccccctcattcccttcccccgtctacttccataggtgatcctccattctcatcacccctccgtggaagatttctgcaaccgcatccaccgcaccctcatctcctccttcaagtacgcctgggtgtggggctcgagcgtgaagcaccagccccagcgggtggggaaggagcacattctggcggacgaggacgtggtccaagtggtgaagaagagcggatgaggagaggaggccggaagaacacaggtggcgcggagggctgtcgggatggccatgactgcgaaccggtggcagatcctacagcggcagaagcgacagcaatctaccagggctcgttttgcacagttgaagcgctcac

SEQ ID NO: 3797 - DNA, 703 bp, Nannochloropsis_gaditana; identical to SEQ ID NO: 2582

SEQ ID NO: 3798 - DNA, 703 bp, Nannochloropsis_gaditana
cccaaaaaccgatgatggagtacaagagggcgtaaatagtggttgaaagaatctccgcactgaccgccattacctctttaagttcctgaaagttgagtgtcaaagataaagaaataggttacggccagcaaaagagagcaatgagtactgagctttggaatcatatagaaagtattttgacatatgtatggacagagaacacacatatcacgcaggagaccacgtcttcgtgtacgctcaataaaaagcacgttcctgtcctgtaggtaaagatctcacctccaccctctgacaacaagatacacgaaagtcatgaaacaaaggtatgcttgccagaggtgactatgatgccatacatttctcacaggaaagggcactaaaggcggtgtccgcaccttttttggggcttctcgggatcgtattaattcgcttgtgcgagtcgcggggttctgggccactcgcttgtgatcagctgtcagctgtcgttctgtcccctccctccactcacaccaaaaaagaggcaattgcacaacccaggatgattcgacgcgtaccatgttacactgaatagcataaaatagattgtgtggtcgcgttggcatggatttcatgggtgtttttactcgttgccgcccttctaggacacgctttcagtcgcattgggcaagcagtatcttgtgaccaacgaaggactaagagcatg

SEQ ID NO: 3799 - DNA, 703 bp, Nannochloropsis_gaditana
  misc_feature (574)..(583): n is a, c, g, or t
ccctcgctcgctcagggcccgacgatcagggaatgcgcgcagaacacgaggaagaggactccgccctgccagaaggaagggtgggaaggcccaagggggggggcaggaggttagaacgagattgcactcaagctggcggccgagcgggccagaccccgcggcaaagagggttgaaccaagacgatgtacctaccgtggatgccactgttttctcactgattcgagccgccagtatcctcccccccagcacggccagacccgtacagagggagtgcccgaggacaccgcccgccgtcactgaggaaggagggagggagggagggagggagggagggtaggagggcagggcagacggaggtcggttggagaaattgttccaagcgtttcacgagcatggggtggaggcgggagggaggaaggaaggaaggagggaaggaaggaaggagggacggagggagggagagcacgtaccaccgtaagggtctttggcggcagcgagggcaatcgtggcgatctgcgaacgatcaccccattccgccaggaaggtaagagtcaaggcctgaacaagtgaggnnnnnnnnnntcccgcctatccctacggcgacgacggaagtcgtgactcctacccgctattgccctcgttggaggcagcgctgcgttgcccttccctccctccctccctggtgaacgtgctcttgggtct

SEQ ID NO: 3800 - DNA, 703 bp, Nannochloropsis_gaditana
ttccaaggtaaccacgagacttcaacatggggcgtgatgcagggggggcacgccgcgccatttcatcgttaatggaaagaccacaaacctcacaacttcccaacacaagtctcgatattgccagtctccggttcagtcacttgcgcaggctccccactcaaaaataattcgaaaagaacaaaacccaccacgctcctcgcccaagaacatgcggggtggggaaggttctaggaacggggaagtaaaaagagcacgatcctgaaagtcaggcgcagccggggttcgtgtggacaaagcgtgccccatggccttggcttcgtacggagcccctggcttccctcgcgcggccccgtggggcatgggagaggcttaaaaccaggacggcaaagagcttgaatggaaggaggatgtgtgacgtacccccttcggcgacagctccccagtcagggccccagcccgccgagaaaaagcacgccacggcccgggccgcaagcccaggagcacttctgagactcacttctgcgccttcctcctccccgacatagttctaacagggttggagggcctggaggaaagcgagtgtttttgtgctggttttcgctgtcttgaccttcccgccccttggtcccgcgcgccgtcgcaccattagtttgggggacagagcgttgccttttggagacttgaccaggtgtttctcaccatg

SEQ ID NO: 3801 - DNA, 703 bp, Nannochloropsis_gaditana
cgctttgcctctcatcagacgtcgcacccgcatggccacctgccccgcggagggctggaaaacacatgtgggctattttttcttggcgctctgacgcttcagcataccgctcgctgcagccgcgattccccccccaagggaggagggttctttaataccctttttaaaaccacaaattcagcgttcttggaggccccaaccgcctcacgtgctgttgcacgcgtgtttcatcgacggtggacgcgtgtcatgattttggaagtggggagaagtgctggtggatgcgtctatgaatcattgcctccccctcctcttctcggggctctatcagatcgagaatgctttttctcgattacctttgtttccttccaccgccttgcgtaccacccatgcaccgtgcctgtgcctggttccttgaaatgtgccgttgcgaagcacgccggtgtttgaaagggagggggaggacgacggcagcctctggcccggattgtcacgaatcagacgtcgagacttcaatgtgctgggtctccgtgatgatgaaaacatctttttactgtatttacggtgccaaaccccctgcgagggggacagcgcgtcgtcgtaccgcccttgacacaccttgatgggcaatgggtgcataatttcagttgtctgtgtggtttttcacgcctttttttccccacctgtcctcttcctagggtcc

SEQ ID NO: 3802 - DNA, 703 bp, Nannochloropsis_gaditana
  misc_feature (609)..(618): n is a, c, g, or t
ctcgttacaaggctgtagtccgaggaggaaatgaaagagaggaaggctattcgagtgtgctcattaatttcctgtccgaccctaccgttacggtcagcacgtgagcaagaaaagcaagcacaggcacaaaagagacaaggattcaaagcaatcgcggaaaagggacaggaaaagggaagaagaaaggcttcagggccgtgatgaacctccttccccctcctcttcctcctcctcctcttcctcctcctcctcccccatctcctcctcctcctccgtaattcccgtagtggaatcgctgcgcgtcctcctcttccatcatccgaacatggtggaggaagtgttcttggtcctgcgcgctctggaagatggtgagtggcttaaaggggaagaaagagagtggagatttcttttggtcccaggcactttctcaccacgcccttgttccctgcctctgtcgcgtttgcgtccaggccaaggcgtagccctggatggactcccctctgcagacatgcggcgacgactgggggcactcctggaggtgaggagggtgggagggagggaaggagggcgggaaggaggaaaggaataggtttcccggcgtgcgccacnnnnnnnnnngctgttgcatgcggtggcccatatcgaactgaacgcggtcgatctacactgggacatcatcgcgcgctttaccgacacgccgatg

SEQ ID NO: 3803 - DNA, 703 bp, Nannochloropsis_gaditana
gggggggggggattattcgggcagaagctcgtttggctggtgtggatttcggttaaacgaggcggatgcctgtggctgtatgcctgggtgcctgatgcgatttctcaactatcttctttttcctcagaccctacgtggaaacatgggcagacggactccaggtgcttcgttacaacgccagcaaggcctatattccgcacatggactacctcgagttcgatagcaatgcggaccataactttgactccgccagccccggaggcaccaacaggtttgcgactgtacttctgtacctgacggacgtcgaggaagggggcgagacggtctttcccctgggggagcccttggaaaaagagatgaggacaacgcaggaggtccaggcggaggctcgggcccgggggcgcgcggcggatctgaagccggggtcgtgggaggaagagatgacagaaacctgcatctcccgcctggccgtcaagccgcgaaagggtcgtgcggtgttgttctacagccaacatccagacggaaggccggatgagagaagtctccacggggcctgcccggttgtgaagggagtcaaatgggccgccaacctatgggtgtggaacggccctcgtttcggtcacagcgccacttccctagccaaggaagcggagggtaaaatccaggcggtcttcagcagtgcagtggagggcgtggctttgta

SEQ ID NO: 3804 - DNA, 703 bp, Nannochloropsis_gaditana; identical to SEQ ID NO: 1117

SEQ ID NO: 3805 - DNA, 703 bp, Nannochloropsis_gaditana
gcgatccgatccattgaatttaaatttgtcaagcgaagcataaccccttgttctgcgcattcgctccaagaatatgtccatttggacatatgtaaacttgataaccctccatttttttgaagtggggtcgtgcaagcatatgtgggaaatgtgagtgcattgacttggggcgatggtcgacttgtttggtgttatgcgtccgggaagtactcgctccaacacatgtctccctcttgtcacatagcatatcacctccacaatacatctctttttacagcaaacggcaatgacgactcgccgcaaaggcaaatcctcctcaatgtcctctcctagaaagacgaccaacaagggcataattcctgactctggtcatagcggagagcgcgaggaaaacacacgcccgaccgacaacacggccccttcttccttttttaaactttggacttctgcacctttcgtagtcatcttcgccatcatggcaattgcattcgcgctgggcttgcaacaccaatcccaaggcatggatttggcggacaacattatcaacctcctgcaagattattcaggggcagtatctgacgtcccaagcctctcgaattgggatgcggcacagatgccacacaaagcccagagacaaaagcaaagacggaggacaagcaaggaggtcaatcgccgtcttgcccctactctgtcacgaaatatg

SEQ ID NO: 3806 - DNA, 703 bp, Nannochloropsis_gaditana
  misc_feature (641)..(650): n is a, c, g, or t
gccgtgggccttgtgattgacgcgtgtcacggcgggacctgccgtgtcttcgaccgttacggctacgaaattaaagccctgggggccctacacgacgagcaactcctctttgccgtcccccccagcaggcattttgtatggccagccttcgagatcggccatcgcgtggccgtgcctggggtcacgtcctccttgcccggacatcccatcattctcgagaccctctccgattccccacgtgtctttatgttggagaattttctttccgccgaagacgctgacgaagtgatcgaaacgacgcttggtaggccagggttttgtgcgggctctcccctccctctgcccctccctatccatccacacacatttaaatctggtcgtttgcattttctctcgaggacgttattcaatcgacgtcttgtccctcgtctctctgcaggtatcaccgccgccggcttcgccctgaagagatctacgactggcacccaaggggcggtcgtttcttcgcaacgcacgagtgagaacgccttcgacaccacctcgcccgtggccatgaagctgaagcgaagggtctttgatcttctcggcatgcggtggggtgggaaggcgggagggaagatgaaggggaagggggggggggnnnnnnnnnngaggagtgaggggagggagggcgccgaccccgtcggagcaacgctctcgaatg

SEQ ID NO: 3807 - DNA, 703 bp, Nannochloropsis_gaditana
tgaccatctagtacatttgccatggtaagctcctgagtcgtcggcccttcagcccatcctataatcacacatcggcttacgtgtcatgacccgccagagtcacctctttgatgttcgagcccgccaccgcctccttccaccccgtcaactcctcctagccgcggtctccgcgcttttcttctccacatgcgcgatagcagttgaccgctccaaaggccactcttcattttcggaccttccttcatcaagctactcgtccgtgctggtcccaaaagcagaaagctccttgcactgtcattcctccgccttcgcttttccgtctcccacccacccgtctacctcttcttcccgacaagattggataaaacggcagcctttttcaccttcctccaccttttcaagaggcggcgcgcctgctaaaggacgcgactgtcggaatgcacggcccatcaagacgatagggccgggagtgctcctgcccctcttcctcttcctccactcctcccaggcctcccccttcgacccccaccccctcccacttatgttgagcctttgttttttcaatggttggtacatccgggtcaccgaccacgagaaacaggtggcgttcgccgccatcgtgggatcgttcaagcatcccggggccactaattatacggagcattacgtaggattggtctacgcggaccggtccgggaagatg

SEQ ID NO: 3808 - DNA, 703 bp, Nannochloropsis_gaditana
gaacgcgcacttgcagtacacgaccggcacgctccaggtccaggctcgctcccgctgtgggcgacgccggctgaccgtgagtctctgcgcccccgtcggatccttcggagcgcccatttacgtccccacagcccaaggcttctcctgtcagccggggtgccgggaatcgttcacagggaaggcgatcatccgtgccgtggacgagggggagggcgggggggggcgtatagtcagggaggagacccatgaggtgcccttggcggccttggagctcgggggggagatgcaacgattgtgaaggagggatgtacagcgcggtggttgttttacgtggtggctgagaggggggggtagagggtgggctggccagcgggctcacacccgagggctttgggaaaacgtccacaaaagaaggtgaaggaacgtacaggggggaggaagtagggatgatggagagctgtccaggaagacccactcatttgaaagacgcaaggaatgagcattgctgttgatcgagagaggagggaaggaaggagaagggccctgtgcaagcgcgatcccgtcgtttcctgccctgccagtattccctttcctgcgtgttctactttgtcgagtctcactcgcattcttatttgagattttttatgatacaactggattttcatcgtgtcatctcttccaacattcgatcggtcgaagcatg

SEQ ID NO: 3809 - DNA, 703 bp, Nannochloropsis_gaditana
attgaaccccaccctgatcaataccttgacggtcatttcggaccgttcgcccgcccaccagcgcctggtccaagaccgcttgcttctggaactttctttgctcctggacgacggccgcccctacatctctcccggcgcccgattgcccgtccgctccctccctccctcgtgctctccctcccttgtcgccctcccgccttcgctctcggatacagttccggcgctgggacatggtcgctcagtgggaggccccagtgcggtggccaagagggttccctcttccttgtcgcctggtgtcgccatgggaggggcggcggcgccgggcgcattgatccgacgggctcaaggaggggaggcacgaggagggcaaggggatggagagtggggaagtggagggggagcggccgcaagctccatcccaggctccaacgggcacggtgcggaggaagtgttgaccagcgaagccggtttgaatggtcatttatcttcggaaatgcctcccaagaagcctctcagcggcccttcgggtttttttaccaaaatccagcagttggccacatccgcccggggcaagcgcggcggaggaggcagagtgggaggggtgggcggagaaggagggaacagcggggcgggggagaatccaggtcaacggaaggtggatgaacccccgtcgcaagcgcgccaaatccttccccccgagatg

SEQ ID NO: 3810 - DNA, 703 bp, Nannochloropsis_gaditana
  misc_feature (1)..(479): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaagtcaggaagaggtacgtgccatgaagaagggataaccctgacatgaattcccggggggtatgacagacgaggaaaagttggatcccgcgacaacctggaggctggcatctcaccgggcgtgtcactgaatcccacagggaggaacggatcgagcaacggctgaaggagcacgtggaaaggactgcgaagacatttgagcgggagacgggcgcgaggatg

SEQ ID NO: 3811 - DNA, 703 bp, Nannochloropsis_gaditana
tctgagatgaaagtaaacgcagattttcaggaatgtgcgtcttacaagactctgacctgaagtcgaccgacggcaacacgagcaaaacaggaaaattcaaacgttatcctatccaagctagatcacacgcagattacggttgtcgtaggcgaccttatttttgcagcacgtgtcgagcaagtcttcgtgctcatgttgtcaagccggggtatatatacatacccggagtcaaggaaaaacgactctcgcctgcccgccctgtcgaactaatgacggctaatttagaattgaagccgtacagtggaatatttgcttgcttgatagcttcaaaatgtgtgccacgcgtttgtcacgggctctaagctgcacgtaatacgcattcccgctctcgtcgtcgctttcgcgtttctcgcccatatcgacagcacgtcaacttgccttgctcctggaggctgaacaagaatggagccgcaagaaccacttccaccgtcctatggtcagggctacgcgcacagtgggcagcatacacaatacccctctccggcgttccctgctttccccaccgccgcaagcacgagtcgcccgtacccctcaacaaccttctcatcgatgccggttatacccgaggtggagcgtgagagtgaggaggatgccgcaggaagaggaagaggaggcatatactctgcgatggcgggcgacgatg

SEQ ID NO: 3812 - DNA, 703 bp, Nannochloropsis_gaditana
gcctccgcactcggggcgtgggccggcgaggccatacgatgctctgacctggataatgagagcattctagatgagtgtgagtgtacttgctagcagtacggaagatgggcgccgggttgtttctttcctagctacatacggctcatgcgtgagaaagccgccacgattcagcccgtatgtgacgaaggcgactgacgccatcatcatcctggctgtggaaggggcaacgagcattcactgtgcaatcaaacactccacgacagagaggatggcagctctggcgagggcaagtcgtccatcaatggggtttctgtccctttgctgtgcaatggtgtgctctgcccttcctgttctgggcttcaccctacctccaagacccctcacaaccctgcgtgcatcggctttcccaccgtcggcatcgaccgaaagatcagcaacaccaacacactctcattactcaagatggcaaaaaagtagagagatgtcatccttcttgcattcacgaagcggagagtcccgtttgggacgggaccggtccccggtcgtaaccccccgttgggcgtcggcacaggtcactttcacatcgtcctcggcccctctggaaagctctgttgaggagccccctcctcttcggcaggtggctctcgtcaccaaatttgcccgtctccccttctggccgatttggcacgggcttgtcatcatg

SEQ ID NO: 3813 - DNA, 703 bp, Nannochloropsis_gaditana
cgtcatgaacgacattgacggggcgagagggtgtcctcctcgaggaggcggcgaaggaaggggcctgaggccgggggaccggacgcgcaggaggaggatttggcgttgcccttgattgaattgggggatacggacgccggcgcccctccctccctcgtctcctcgtccctgctggagccaggaaccgatagcgagacccgacgcatcaagtcagacgtcctggacctcctccgctttgacctcgctccggcccagccgggggccgcccgcctgccgccagatgaatccttcatggtcctggcgagctcggggccggaggcggacagaaatggggcggggcgggtttcggtggaggaaggcacgcaccgggcggagccgggagaggaagggaagcaggcagcatcggcggcgcccggcgagggccgcaggcggatgcggaaggcccgcgagagggcgaaggttccagtgccggacatggattcgaaccaggagaaaggaggcagcggaagcgcagagagcggcggaggagcgccagggagctatggagggttgcgcttgccactgctgagaacgaaggggcttcgggtcgagtacagcctgactccggacccctcgcaccagctagtcacgctccattttcgattcaaggcgcccgcccctccctcttcctcggcgcccctggccgtccaagacctgcagctca

SEQ ID NO: 3814 - DNA, 703 bp, Nannochloropsis_gaditana
ttaaagaatgtcaaaagaggaaattccacattgcatcccctgtccttagtttgcggcctgacgaaagcgacatcaattgagtccttgcaccgaaggaacaatgaaacatttgcaggctctccgggggcccacatcaactcctcgactttagaagtgggggtttggcagttgaagtggggggtaaattgggggagagcggcaaaatacgggtaaaaatcgggatttgctggggaagttggcagtcgttggcttctggaaggcaatcaattgcttaccacgagcaaaaaaatggtggtttgggttgagctggctgtgaacaagaagtgtgacgttcatccggtggggtggtacagattgacacttttcaaaatttcaaatggtcagacatctgtcctggttttcaatgcctaattcttctcgacgcagaggctgctagcgttctttctcccgattgtgatggaaactgcacagcgagtatccttccatgctgaagtgagtcgaactttggtaactcatgctggggctgtcttcttactatttgtgttaaaattcggatcgtttcaatcaaaggcttgcacgtgaagattgctcaagtcacgcggcagtcgtcgtgtatagcttgcttccctgcaacacctcaacttacctctttcgaacacaacatacagtcccatcaagcactattttacgtacgataaccatg

SEQ ID NO: 3815 - DNA, 703 bp, Nannochloropsis_gaditana
  misc_feature (662)..(671): n is a, c, g, or t
cccccttgcattttctttcgcgcaatatttggttgaatcctcttccagggaaccttttcttcacacttttcatcgatttttctggcgctaccgaattctgtatgacctcagggcaggacgatggtgccttgcatgtgtatgtaaatatccgggtattttacttctcactttcggctttccccttccagcctccattgacagaagcatcggctggcatttcaacatcacttgctcatattacagctccattttggtatcattttgtcaaatttaccccaatgacaggcatgctcctcgagtccccacctggacagccgttgcggtggatgtttaagtttgaatccatcgtttaaattcaaattcccgactcccaatccacactcttttaatccacactctactaatctccgtcggcccttagcacgacgcatcctaggtcgtgcaaggcatggtggaactccaaaataccctccagccacgtatagacggcgaaaaaaatgcaaaggtgccacaattgatgcgaggagaagagcaaatcgaaactgaaggccgcgcccttcttggattcaaaaagccgttcggggaaacggctggaccagaaaaagaacccgacgccgtaggccagaaacatgccaaggaggttgtcaaggaagatgctccgnnnnnnnnnncgccaccttcgtcgacagccagtgaagtctcc

SEQ ID NO: 3816 - DNA, 703 bp, Nannochloropsis_gaditana
gtataaaatagaccataggcaaatttatggacagtgggcaagaagcgaacgtgccaaacgcggcccacgtagaggcaggagaaacccaaagggcgtcgtgtatgcgaaggacgcgaagataacagaccgcgcacgcacaggactagaaacggcacgatgacaaacgttaccagcagtaccaacggccatatagaagagaagaaggcgctcgaggtggaggatggtgggaacagaagggagaaaattttcatgtggaggggccttacagtgttgtcagatagtctcagcctccgccctagggaaaaacaacgaaacataagacaaaaacatcgggcgcactcggtataatcttcgaactactagcttgcacaaggcaatgcatgtttaaaatatatagcgaattgccattcttctttgtccccacggaagtagcttcttgtcgcaaggagggatggtgtgcggtcagcaggcagagagatgacgccaacctcctggctcctacgacggccaaaatgattttagccactcacaaattacacacacaggatatcgtgcaggagaaaatcgcgacggtggtcagcaaattttcttcgcggacggatgcacattttttcttgctagagtcgagcaacctgtcatttttgcgactggtgctttcgcttcatccgcagtattttcccgacggagggggctgtgtgcaatg

SEQ ID NO: 3817 - DNA, 703 bp, Nannochloropsis_gaditana
taccagtgagcggagaatgcccccaggatatccaccagatgtgcgaacctggcgtcgaaacgggaaaaattgcgcgaacgcgtctcggtcctatgggctgtgtgtcagcctcgggaggacgaaaataagcctagaaaagaaccagggctcattcgccaaggttccgggatgcaaccctttcgaaaccggacttgtagactttcatcgcacgggactcaccgaccaaagctcgagtgaagatgagtttggcccctcgcgtctctacgatgctgttgtgtgtctaataagagctcatcatgaggatgaggatgttttcccacaatgggtgtgacacgcctgctcagtccgaaaggcacatcctccaccgcggcaccgctccaccacacacatacgggaacacggtatggtgcttgtctcaagtgtgcttcgcaggcattgggactgatttatcggaaaacccatggccttccgtgttctctcgagtagcctgcagccgcggtagccacaatcggtggtgaatgattaaatcaaaacgaacatattcaacactcgtatgtgcctctaaattccttcttatattgtttgctatagatgttcatgaatctctgaccagcaacgagcccgagcgcctcgtgaggtgcgcccactctcgtttaattttccggacgtggtttagctgcgcgaggaggattgcgctgccatg

SEQ ID NO: 3818 - DNA, 703 bp, Nannochloropsis_gaditana
aacaaaatctatgatctctaacagatcgatcaacgcactttccattcgctttccgtcctacataaacaggtctactttgaatagccgttggtttctttcttttctcgttgcgcaaagaacactccttggcgactttccattctttcactacaccatgatctcgtccctatacctacctggagggcgaaaggacgacgaggtcgctggggcttacgatgttaatttgggcggcattccaggggccggcgaccccctccaaacccactattctacattccatcaccacatgccgcgagacgcctacactcaacctcaatacacctcgcacccctttgaggtggacggaggattctgcgtggcgatggacaaggacgtgagcggtaccaaggaggaggacacctacatgtactcgacgacagggcagcgttcttttcagccagacttcgccgccgcgcccgcgtcctccacatttccttgctccctctccttctccacacagacggtgccgcaatcggcctcccacccgtctcccatggacctttctggtgagcagcaacaatcgcggcggcagggcggacggagcgacgggggccgaccgtccccgctgggtctcccggacacggatgaagacaccgatacagccgctgggagcgtggaagggcccatcctggaggtgttaggcaagtcgattcccattcctaaa

SEQ ID NO: 3819 - DNA, 703 bp, Nannochloropsis_gaditana
cagtctctcatcaaggggccatcaggtgacggcggggcgcggccggagagcacccagaacggccaagagcagctccgatttttgtgcttagatttttgtgcttgagctgaatatgtatgcgataaacccccccgaaatcagatccttatgtcgaggacgcggagaggggagtacgagggggaggaggcatgtgtgtgggttcgccatgaccagacaggccaaaaacctcccggtccaccggctctgccacgtcttgtagttaagcattctggtaaccctccagaccgtcttaaaatggacgcatgtttttttttcctgtgtcacccttcatttgtgaaaaatcgctgctgcgtggcgaggtccgcctggtgaaggcgtggggggaaactcgcgaaggcagagagacacgcacttgtcgctgactcaagcaccaggatctgttctcgtgcccccccacgcgttcgtgtcgcatgcgcatgctttcaggttctcatgagttctctcatttatcggacaggcactcattcatggagtgcaaatattgaagtcgtgataaagttttctacttcctctcttaacagcccttgtcacggcaccatcctctcacacagcacgaatccagcgtggcctattccggcactctgagaacctggccgtgttggagttacatgcagtgatctagtccgcgcatagggtagcaatg

SEQ ID NO: 3820 - DNA, 703 bp, Nannochloropsis_gaditana
  misc_feature (437)..(446): n is a, c, g, or t
caaccactgtaaaaccacgcacaaactcaacaacaccatcatttccttacccttattcttttacggcgcctccatgatagctttgatttcctattagcagcgtcgtgtattcatcaatgatgcttgagctagaagggagtgacccgacgaaacatgtaggcccttttggctgaaaaaaggcgatttgggacctggtaatgcggcagaaggggaggaaaaaggcaaaaggaaataaagatacgcaaatatgcttatggaaacctgtcataggatgttatttccttcgactgttgaaattgcatctccttctcatcctcttcctcgacttacctcccctctcaggggtggggtcaggcaggctgctcgaactcgcgcatggattgagagcacgtacgccgtcaggtcaaagcccaccaaccctcgttgctaagaccttnnnnnnnnnngggaaggaggtcatccctgcctctctagcggcttgtaccgcgctcaaacgtacatgtatgtgctgaagggttaactcatcaaagttgtaaagagtaagacttttttaatttgatgtatgcatgcatgtggatcactttttaagacaggttccatactttttgcagccttcgtgagtatggccattcccaggagtagcaacaatgaggaaggagggcaaccgccggggcgggagaagaaaaaagaaatttggaacatg

SEQ ID NO: 3821 - DNA, 703 bp, Nannochloropsis_gaditana
gcctcgtctcatcctctctgcatgctgtatcgtccgagaatctggcaattttaggatctatgcctttaagttctattgcccttcatagatacataaccatggaagacggaatggagcggatagcatcctgcctgcccgtggacgtgacgtcgcactcagcagctcgaacagtcgttgcgcgggagatgctcgctcggctcgaggacgatatcgttgggtatgcgcagacactttccaagacatcagtgccacggttgtcccagctcacaaataatcgattggaggcgctaaaaaaaaaagggttcgacctcatattagaagagacggacgtcgaaccgatcaaagggagtatcgaaaatctgatccgtgacttaggcaacgtcctagaggctgaccgtgatttttcagaatgggcacaaagtgaagctgttcgtttggcaaatgggttggtagtggctccaagttcgcccgccgtacataattctcaccatcgacaagcgacatcggcgttgcacgtgttttggacacaacgatatgcaggtcttcgcccggctatcgacatcacatatcttatccagtgtttaatgtccacacgggcacatgaggacttgctggctgtcaatcctttcgctggagaggcaagcacgctcacggcggcattaaacctaactgcattggcacttttgcacataaatcgggcggc

SEQ ID NO: 3822 - DNA, 703 bp, Nannochloropsis_gaditana
tacaccttggaatttgagcgcagtgtcgacgatgacgttgaactagttgctgaaatctttggcaagctagacgcagcacgtcgtaggcgcagcgtcgtttgcacgtcccctgaggcaatcaaaagcctgcttttaaaatttgtggaacacctgcatgctctggagcaggtcgaggcgagcgacctgacgtttggggagtcagctcgggccaatcgtgagataggtcgagtgcgggaggccttgcagtgcaaatccgacatggcagacgcgatagtacgtgtgctggacatgtggcgtggtggtgtgctgatcatggacgaggtggatcaacttctgcatccactgcgatcggagctcaatttccccattggtgcgaaagatcccattgacatggccggttaccgatgggacttccccatttttcttatagatggtctttttagtgccgcagagggtcaccctctatcagagcgcctcaatcctcagatgtcaacccgaataaatttcggtgctcaagcaatattggacgacttgagggatgccgtcgctgaaggctattcgcaacatgctctgcaacgaagtccgcacatgattctgcttgataaggccttttacgaagctcgactgaagccagcattggctaaatgggcattgttatggattgccgagcgcttcatgggaagagttgagtgtccgcaggatg

SEQ ID NO: 3823 - DNA, 703 bp, Nannochloropsis_gaditana
ggatcttcgccgtctggtcacacaactgaaggcggatttctcgcgacaggggggccctcgtaattcccgaccagcgtcgctcctttttaagtcatggctgctgcaagtggtgaatgcggggaaatgcttgaaagtccacgaagagggggacgcaggcgagacggtcgatgcagaccacaaagtggcaggagcagaggaggtccaagcaccaatggatacaagtgatcaagcgggcaggatggaagctcaaattaggcacgagaaaatgcatgtgggacttcccgtctcgcccttgcccttgtttcaacctggcgacatgaagcagttggtcgccttgcatggtctcgttcggcttcttccggacgtcctgcactattacctcagacagcatgtttttcctgctacaatgaatttccaatctatcaaactttctgccgccggccatgagctaggctcctctatcctttttgcccgtcgaatcggcttctctggcacaccgtcaaaccttctgcctattgatcttggcacttgtcagtatgaaccaggctccgatggcaaagtagtacatgtcttgactgacccagccgtggtaacagcttcgcggaaatattattggacggcgcactcgcttttgcgcgacgttgcacgcgttagtccggccttccatgcactgattgatgtaggcgcactcataacgggcatg

SEQ ID NO: 3824 - DNA, 703 bp, Nannochloropsis_gaditana
ttccttcacttacatctattttcaaaaatttgacgtcagagtatttgctgctgagagtcgagaagacaggggagatagtccggcatggtggacaccacgaagctgtaaagtaggccacaacgcgctcattgaccgttgtttcgtctgaaaaggctttgaaatcctttgcaagtactactttgtcttctgcctctgcggctgctgcagcaaacgtccgtccgcttgctcttttagtaaatgcagcaaggcggataggacgagttatgcacatcatcatggtggaacttgaacaacctgcacctacgagggaatgtgtacagattaatcgtctatattccggcaaggacgatcggaactctcacgcggggctggagaccaaggcgaatgtgcgtcgccgggtctaatcatggcacggccaggggcaggggggtgggaggtcgggtcgagcggttcgaagcccgcgggaaagccgtacacgcaacgatagtcacatagacataagtttgtctcctgacacttgccgttcacgacaccgaactagttatttgtcgtccctgacagctgaaccgcccgggcgggcttgatatgagaatgttctctctgatttgtgagcagcaggcaagaaagactttcttcctgaggtaaagaaaatctctaacaagtactgttacatgcatccctcgaactcacagggcacatcatg

SEQ ID NO: 3825 - DNA, 703 bp, Nannochloropsis_gaditana
agaaactattgtgggaattttgcatcggcggcatgtggaaaaatccgccctctacggctcactttgacggcttgcgaggagtggcctgtttgacggtgctagtctggcattttctgtgcgcgtattacccaggcatcgcctttcacaacaaagcttttgtgcaggacggcgcatactcggtcaaatggggccgatcttggctgctattcttctttaatgggcccttctccgtcgacgtcttctatggcctgagcggacgcgtcctcctccactcgtacatggcccacgggaagaacagtacgctcgtcagtgctatgtttcggcggatcctacgattaatggtgcccttcgccgtcatcgttatcttcgcttggaaagaaggccagctaggctgggtgcagtacggcgtccaggcagccgcctggactcgatcgcattggcttcccagccccactttgggggcaaccgtgggctccttgcgttggatagacataaagaacttcatcaccctcatgttcaccgaaagcaacctggcctactatatctacaacccgcgtacgtgaacgatatcacacatgctgtctcgatgcttttcatgtttaccatttcttgtcacacgtcccattacatgtcaggaaatttgtggacgattcgaacagaatggcggggttccctggccgttttctccctcggtttcgtcatg

SEQ ID NO: 3826 - DNA, 703 bp, Nannochloropsis_gaditana
tgggcggaactgccctgggcgcgcttgccaagaacaacggcgggtgcctttccatcgcccgaagcgcaggcgcaacagcgcctttcgacgaccgggcattgggtggtgccggtgcaggtcggtgaccggcgcctgaatgtgctgagctttcatgcaagcccgccggcgttcgatgggcctgaaaaccggaacgttttgcgcaatcacgatgaacttttattctggtccaagctgcttgacggtgcggtcggaccgtccccggacgcgccattcgtgcttgccggggtcgcgaacctcgaccccgtggatggcgacggcgagaaacccgcgatccaccgcctgctgtcagatccacggctccttgacccacagcccatgcggccccaaacagctcctcaggccgaggggcatcaaggtgatccgcgccttgataccgcgatctggccagccccagggccgggggccttgcgcgccagctacatcctgccgtctgcggacctgcgcgtcaccgccagcggcatccactggccgcctgacggcaccgatgcggcgcagatggctgaaacggcaagccgccacaggttgatctgggtcgatcttgtgctggaatgaggccggtggcacatcacgcgctttcttgacgctacgggcgcttcgggctaggcggtcccgaccgtagatggatcaggaaggaccccagatg

SEQ ID NO: 3827 - DNA, 703 bp, Nannochloropsis_gaditana
gtgcatgaccatgtctctgcgggagttctgtgtactggaccggagtttcgcttcccacgccgcgctgtcggaagtatcgataccacaattgcacaagacatacaaggaaaagggcgaagatggcgcctgctatacccaaatatacaaccggccacaagccatgcagttcaaacatgccgtgttgcggaatagggtccctgtggcctccagaccaccaaaggctttagccgtagaggcgacgggtggaatatggcttggcgtcaatgtcaaagtaatgtccccttgcctgtcgtacggatcgtatttctgtgtgagctcaagacaaggcctcgattgatggagtaccaatggtaagcactgaaataattgcattctagatcgccttggcacgttgcatacaaacgagactcctccttgacccaagttcatcctttcagagatgtagcgcgattaacgattgttattctcaaagtgtgcgagttttgagggacgagtacttcaaacgacgtgtctcctttgtatttcgtgtttcacaatacttccaatctcacccaggtgaattgcaggatcacactataaagagtgctcgctttggtcactcgacctcgggtaacctccccacccctgcaaagctttcattctgccacgggcttcgcacatcaataacgcagaactacagaataagtgcgtcggtctcaacatg

SEQ ID NO: 3828 - DNA, 703 bp, Nannochloropsis_gaditana
ctcatgctggtgttcaacagtcgtgtcaagcaagttttgtattattccgggcgtctgtggacagggtatgttatcttgatgttggaaatatgtcgttaaacaaggaacttgaaatatcgggcggatgaagaaaaagggagacgcaaaaaggggaggtatcatggtaaagccacgcaagctcaagaaaggcgggcgttgagatggacacatggtacaatattgtctccagacatcattgtggaggataagcggtcgttatcagggtttcgtgaagacactggcaatcgtgaagatgaccgtggcggggatacgaacgagcagccagaggatcgagaggtgcaaagtgcgtgcaaaaatggtcattaaaaatgaccaaggggatccacgaataggagaaatcatccactgacttttcatacacgtcgttgatcatttttcattggaagcgcttgctacatgcatttaaaaatgactttcttcttgcaccacaacgaagcaggcggcttcaagttctctttccgttgcttgccatgaagcgaagcggggcaccagacgcgtgtgaccgggggggaaaaagaaaaaggaaatattattccttgtggggagcaataactattgtgtgtcgcatgatctgatgataccaatgcacatactccatccccacagggctgagaaaaggcggctttgtctgtcaggttacatc

SEQ ID NO: 3829 - DNA, 703 bp, Nannochloropsis_gaditana
  misc_feature (289)..(298): n is a, c, g, or t
catgaccccaatgcattccatcaactgcccggtgactatgcctccgaaaataaacacgacgaaaatggcacggaagtcagcgtagtagagcgtgtgaaggaagaatacctccacccttgctgccaaaaagagttggaagccacacgggctcggaccaaactcatgaccaaattgacggcagccgacatcacgaggcatgcgatggagcgcagaaggaacgtgttcggcccggagcaggccaatgatcaacatcagcatgtgcatggcacgggctgttgttccctgacgnnnnnnnnnntacctgcacgccacgggcgcgacgcgtgtggcgtttgataggcagggagacgtgatgtccgaggtcatgcgaaggagtggcggatggggtggggaggagtcttttctcgagctcgatgcgtgcaatgagaccggcgataaggtgcctctaggacttcagcaaatgcacacaaattggctgttcatcggtctctcgaaaatctacccctcatctgttcatactacatgactgcaccagtacttattactgacggaagtggttcgtgtcgcccgatcctcacgaaagaagcagtgctcctctctcgcttatgttcagtctcatatcacgatgtcgtattcctaccacaaatcgttcaggatcttcgacgcactttttcgtgcattctctccaaaaaatttcacaatg

SEQ ID NO: 3830 - DNA, 703 bp, Nannochloropsis_gaditana; identical to SEQ ID NO: 2369

SEQ ID NO: 3831 - DNA, 703 bp, Nannochloropsis_gaditana
ttcccttcttgacctcacacaaccctttccttcgtgtcagggatacaacatgcctgtcgaatggggcgttcgtggcgtctgcttcgtggccaaagccacctcttcgttttatcatacggagtgtctgctggctacaagattttaacctccccatctgtttaccaacacgagtatccattgacttaactatggatggcataaagcggtgcaatctagagccaacgcagccctcattgtcgtttccgctcgatgcttccttctctatctgcgtgaaagaatcgtcggcgccattctcttccccgctttttctgagcttgtcctactactttccttctaccgtcaccgccacctctttctcgtcttcatcatgctggctcactgatgaggaagtggaggcgccatttggccttcctccctcatctcaagcgctcgcttcattcatcgcggtcccacaaagggggaaagaatcgtataggttgtggaatcctgccatggacatgtgcctggagtatttgggaatagacagacaaaaacatgtaaaatattatctaagaggccagaagattagagatcattcgaaaagaaaggtcaatggagggcctgggcacctaggggtgaatagagtaggaagctgggatccaaatgaagaggaaagacagggagacggcgttgcgcatacaggggcaagtggagggtggagatg

SEQ ID NO: 3832 - DNA, 703 bp, Nannochloropsis_gaditana
gtggataatattaatgccacttttatcgcattccatacgctctttcagcgtatgtgtcgacgatactgacgggaaacaatcatgaaatttcagagtgatcactacgcaacctagtcaaaaacaatgtgaaagtgtccacttctatatttgcgctcctttcgatttcttttctcgctatttttaaaaatgatacttcttgagtacgggccatatccgtcgctctattctttcacgcgcacgccattgcgataaatgcgtcccccaccgcccgtgaaacccaaacagccgctaatttgcagctaagaacactccataccctctgtcctgccactgcgtccattcttctatgcgaaaaggacttcaatatccttttcgctcgaggcgagacaggaccggggggggtcatctggcttttaccatatggttttgggcacatgcgatggactcggcgcgtccatagttccaatgtcagattccacggccatttttgacgaccgacacatagcattcatgcccatgatttgatgcgtacgatgcgtgggagaagacgttgttcagttgacgctcccagaaaaagaacttgagcccacctcgtccgaatagctgagcacgtcatgcagaagagaacgagcgatacagaggtccctaaaaactgatttttttccaacacagcggtgcgaaaattatgtctacgccaccaatg

SEQ ID NO: 3833 - DNA, 703 bp, Nannochloropsis_gaditana
taagcacggatctcggagctccttgcggctggcagctgcaggcataaagaaatgcattgataacaagacaacgaaacacaccccaaggacaaggtctgcgtagccagtttgttctcacgacttgcttttccaagggtgttcccgtcgtatggtcgcctcataagccggtcagtggcagtgtgtatttctggctgggctaggaggacacggcgtcgcccacgagtcgctagagtctctccttgggcattgtcacattttctaagccgggtggatcacagggtcaaaacgcttgttacgcggttgaatttggatgcacaatggtcgacgtggtggtgcatggtttaaagggacgtgcttgtgcgtccaatcacgaaagggctcgagcttgagggtttttttgggtagagccctggctctgcagtggcccatcggtcctatttaatccccttcacgacaggcatcaagaagacaacgaatgccctttttttcccgattcatcccgctgcttttgctgcttcacgcctttctttttggtttggacacgtccattgcttttggcacgaacacggacccgtcaagtgatcttggatttgtaaacccgccatcacatagctgccagggctcacaacaagcagccaggcataatcagggatcttcgaagtctcgcgccaacattaacacctgtacggcaagcgctgtgatg

SEQ ID NO: 3834 - DNA, 703 bp, Nannochloropsis_gaditana
cctagattacatgagaaattagatcgatcggaagagtagtctgaactaagcattgaggtgaaatcagttcgacaaattgaggtcgttagaggcattaaaagcgcccataggtatctacatgaccttatcttaaagatttacaaggcggcaattttttgtgtgttttcacttttatacatctttataaaggaagcgctgggaaggccgtcgttgatcacatacatccccagtgggcaaacgattgcttccatttgaagacaggatcagtttgtctgaggagtcatcgatgcatgaaaaggcacctttgaaatcaaaatttaaagtaaatatatgtttgcatgccttatccatgcggtcaacacccgtcaactgaacaagttgtccaaccaggcgcagtatttttaagcgtgcttttcagacttttcaaatttccgtttagagcggttgagaactgtggagcgtcactagggcatccgcatcttcagctcctttccaccgactgaaagtttgatcctaacttcacgccattttttacccacactgcagatacttctcatgttaaaagtctgccgtggtattcacaattcatcattccggagaacgttcctccacaagctgcgctactagctttattagggcttggatgcaaagctcaggcatcctctccgtccaaaagaatggtgaaaagttagctgaccacatg

SEQ ID NO: 3835 - DNA, 703 bp, Nannochloropsis_gaditana
ggtttgaacggagatgaacggtatcttgaccgagacaagaggagggtaaaaccgctccgctttcgcttgtctcccgctttacaagccctagctttccttgtgccaccacaaggacatccataaagaagcgctaaaaccagcccatgcgagggttcagcaccgtcttccagtgatccgattttctacatcacagttacgtacttttgcatcgatggaagtatgctggctttattattgacagctatgtacctggacaggggaggtgcaatgttgcggtgacgacgaagcggcgcgagaggagatgcgtctttgttgagttccaatttttcttcattcatccatatacttctctaccacagagctcttatgaagaataatggaccattgcaggaagctactgccgtgctactcgaatttttggaggtagcagtacaccaagtcctgtaagtcttggcccgaacgctctcaaacctcttccccttacatcaagcacttcttgtccgcattttgccttcatcaaattaaaatcacaattcttttcttcattcccgagccatcatttatcaaacatccctgaactggtttgtttctttccctttacctctcacccactcgtacctcttcttggcacaggtacaaccgtggggtgtatccccccgcaatcttcgaacgccggaggaagtacgacgtacctgtctttatg

SEQ ID NO: 3836 - DNA, 703 bp, Nannochloropsis_gaditana
  misc_feature (391)..(400): n is a, c, g, or t
cacgcgaacagcttgatggcagaggtcgaggggaggtggggcaaaaggaggaagaggaaaaagaggaggaggaagagggaaggaacaaccgggggcgtacatagacctttttttttgtgtgggcactgcatcactagtcgtcggtagagggaatttgatgtgcaaataattagaaagagaatacgaggaggtcataaatcagaaagtcagacagccaacaccactgcgcacgaaaatacactccgcgttgctttgcgttgcgcagacggcgaaaaccaaacgtagcacaagacagaatgtaatgcaagtaactccaataaatgcgcagggaaatatattcttcgatctccctgatgatgcgtctcctgtagcggcacgtggcttcgttgannnnnnnnnnatcagttcccgtggttccgcgagtcattggtcacgaaaacgtgccaaagcttgtgtctgtaagcatgatgagcttgcgtgaccttggagaagcatggtatccgtagagatcgacgcaatagatgtttttttacatggatggaggggtacccgccccgtcgaggaaaagaagagggcctcgcaagcagaaaccatgcacaccagtgagcgggcattcaacgagcctctcacagtttgatacttaatgcacttacaggtgtgatcgtccacgcacaggtattgtcacggagcgatcggagaaatg

SEQ ID NO: 3837 - DNA, 703 bp, Nannochloropsis_gaditana
tccttccctggatgccaggcgggactctcttcatgcggaacccccccttgcccttcgacgtggtgtttgccggtcacgtccctgaggacgtgaaggaggagccgttgaacatcgacatgacccccgtcgtgaagggagagaagggcgacggtcgtgttctggtggacagcgccaacaaggcgtatttctgaaagggaggcgaggggggaggaaagggacatgtgtatctaggtagggcgggggagcatgatttgagtatctgcaaaggagcgagaatggaaaaggcatggaggccagcgatgccattccaagggaaagaaacacccatcaaatggcagaaaaggaggcacgctcgctggcacttttcaggggtcttgaaaatagtctttctggcaacgccgacggggaagggagtggcggtagagccaagaaaagtgggaagaggagcatgtgtacaagcgcacatgagccttgtcgcccagcgtgttggtctcgccttcgtttttttctgttttttagcggggctctttgatgaaggaggaggaagcaagacgcctccccccctcccgaccgcaacctaagcttatcgtgtcctactcattgattcattaacgctaattcactgttttgatgccatagacctcgcattcctatttatgttcatgcaacgtgctgtccatttcattgatttttggaaacaatg

SEQ ID NO: 3838 - DNA, 703 bp, Nannochloropsis_gaditana
gctagacgcgagcgagtaaatggatgctaattaaaaaggcgtggatcgatggaaggatttgcgaatgctactgggatgtactgctgtcacggttgcctatctacgagcgaagggcagggcctggcggccgcacggcatagagcccccgtttgacaaagaaagacaaaaacctgttgcatgagataggcaattttatacatggacgtgagccgaatgtgacgagaaaatcgaaggcttcgtgacatgataacctacgcacgattacatacaaacgacttcgctgtcatgcgtccttgatatacgaccgcccgctgtggctttcacaaactctaatttggaatccatccaagctgacaatgacatgtcccctcgacaattccaaacgtgacatccttacgattttccagtatcctaagcgaaggaatagtgtgtcgatggccatggcggcgctcgctcgagtctccgcgactgcgtgtgagcgacaggaacctagacctcctaaagaatggactgctgtaagagtatgacaaccagaagaagccaatcacaccacgagctcatgcacgactgcttacaggcgtatcagaatgatcattctgccaggatacatgcacccgaaaatttaaagttgattctgtccatttttcttctaccctccctccattgctcttttcggtcacgcaaaaatacagaaaagcatatg

SEQ ID NO: 3839 - DNA, 703 bp, Nannochloropsis_gaditana
ggagggtgggaaggagacaaaacgttcaatcgagcccaaaggccatacagaggtgttggcggagtacaagccccagatggaacaaatgaatgaaggtagcgtagacgagaggaatccacgcatgaccccgttgcccatatccgagggcactgcggacgaagacaaccgcgaaccccagggtccaacggacttgaccggcgggaccttttcagggcctaattaccgtgataggatggatcatttttacccacggcccctgccggattctgggaaggccgattatgtggagaagcaagcccacgaacaccatctacatcctccgccttgcccgacttggtggtcatcgacgcctggactttcaaagcctgagatgagtgatcaagaaagagtacagcagcttcgcaccccaccttgggaagagaaatgtgacggagaatggggttatgagggttttgcacaaaaggcagggcgaccatccggtcccgggcagggacaagaggggtcgcatcaagacagaggggaggacgatttcttgaaaagatgtcacgccttcagcgagtccgtcgcctacgtccatgctttcgggaatacacatcccactgcagcctttacattaggagtgaacaatatgagcgactggacctctgaggaacggcggtatttggggggctcccgggccgtgcctgtggacacggaaaagatg

SEQ ID NO: 3840 - DNA, 703 bp, Nannochloropsis_gaditana
agagcatgcacagataagagagtgctacgcacggggagggcatgatcagcgtgtcgtgctgcacgtctccggggtttggcgtctacttcgcgcagggtcacgtgggaggacgtcgaagtcgcgctttaagcgaataaggacgagcattccgtggggtggtgactcaagcgacgattatgaggtggcaagccaaggccggaagcaaagcccaaaattttggtctcaggtacccgaccagctcctcttttgacacgagtccaccacgcgtccatgtgaaaaggtcctcaagtgcatgctagtgtgttcgacacgatcgacacctcggtacccgaggtttcaatgcaaggtaaaaattgcgcgaaatatttttttttcctttttccggcgaaaaagaaagtgtcgtctttcccctcactcgttacgacctcatgaccggacaagtctcgatcatgcagatggctcctcccttccacacggatcttcatgccacaaaattgaagtatacgagctggatgtgttactctcttcatcgcttcggaaatcatgatatggtgtgtgttgatgagcgcatttaccgagtatcatcagttaaaatcttgaagtcagaaacaagccttgctggcatcacaaatatgaggacatgcttaccttactcttgctatgaatggacagacagggtcagcccaaagtcgagggctgaatg

SEQ ID NO: 3841 - DNA, 703 bp, Nannochloropsis_gaditana
gcttagccatgccggccgcatgcaaataacaggctatgctcagtgcatatttttgctgcctgtacattccctatacccttcaacctattaaagcgtatgtcatttcaaagcacaaatccactgcaaccgcctggtgacataccatacgttcccgacccctgcccctcgaataacacgacaaagtggccaaaatcaccacccgtatcctcccagggcacgagcgctctgtatcgagatcagtctgaacacgcctgagacagcattggagacatatcgcgcatgcattcgtcatttataacaataaccattttatttcgggcgtacctcgctcccggcctcgcctcgctaactttccttccttcctcttgcgaccgccccgcctgcgcggacatacgcggcaaaaacctcaagcatagacccatttcgacgcactacagagtgactatttatgtcgcatcatggttcatgagagaagtaattttcgaaaaggcatacagggcttccccgcttcatatcgaacgcgaactcgggcgctctcaggcctcctcctcttcctgattaacgttccatttttatcccaccccgaaatagatcgaccatccacgcaatgtgtaacgtacttattggtgaagctgagcgcctgcgtgaccctgtttgaagagggaatctatattgtaaggggttctcggacgctggggccatg

SEQ ID NO: 3842 - DNA, 703 bp, Nannochloropsis_gaditana
atgtgggcttagagacaaggaaagagaggcgtgggaatgggtggtaaaggagggggggatgcggggtcgggaggggaagtggtggagagagggcgtgcggggaggtaaggagggagagggagcagacgtgtaaccgataaaagcaaaaggaattggttggagtccccatgctcgggattaaaaatcattgccatagacggcaccgaaacctttgggtgatgattagtttgggactcactttgtctttaatttcctttttcctcctttgtgacgtcacagcttatgctcaccgtgtactgagcttgggatcaggaattaatagggctcttgcaggcgcctccttgaatttgtatcccgtcctcttaagaaatgtacgtcgcctgtgggctgtgcgtgtgcctcgaattcttttctttgcgtggtgtcgatgaccatggcgatgcttgtacacacgttgaagccagcggtggagttatgcccgccttgatccaatttgttcatctttatgctacagcatgtcacccattcaacactttaactcaacaaattcatttcgatatttacggtttccgcaatccacgacgtgttcgcctcaggctgcacagtccatttgtccttctgcacgcccgctctaacgacccaacagagctctttctttttgcctgtgcgacgactgtgcgaccgtcggagacggaacaagatg

SEQ ID NO: 3843 - DNA, 703 bp, Nannochloropsis_gaditana
ttctgcgcgtccatttcgtagatacagccatggtagacccttccggccgacgatggcggtgctggcctgtggatgcggcaagaaattgtgtcaaagtctcaggtgggaataagctccagccggcgtgcgtggcaggaggtgagaaagctttgcgaacagggaatatcgagattcccccgcctgcctgacgtttaaagccgagacagcatgtacaaacaagtcgcgtcatgccccaaggctatgtcaagcttgtacgccaggtcgtctctgcgtccacttcagtttttcgtgtttttttttcgtatcagcaccatctacaacagggcagcgaagctgctctctaaaactgccccgcctcgccttaaagcagaaacggcaactgcgtacacttcctgtgcaagatgaggtgacctttcgctcagtcgcacccgattcatacacctaaccacgaacagaaggcaaaacttgcgcgacgcattattttcgtgctttgtactttcccggcctccgcgcgacgtagccacctccccctcctcccttttggttgagccagtctcacgctgctgcgatgagcaaagcatcccggcgaaagtaccagctcctcctccttcttctttggtccctctatgcagtgggtttcaggcatttctctacctcccgtcgccacctctccccgtcggatttgtcaatccctttaagggca

SEQ ID NO: 3844 - DNA, 703 bp, Nannochloropsis_gaditana
acatctcttccttttattcatggaatgtttgtgttacaccttgaatacgcatgaccaaaagtgttccatgcaggacattttaattcatgtaagaggtcatgttcgccagcatgatgggtggcacattccttcctccccccgccagatacattctaggaagatcctttaccgccagagttgcaccgctgcatgccataaatgagtcatgaaggcgacaagaattgctgtgcgctcccgtgaaaactctttaagagcgagctcttgatgttgaagcaacagaaggaatgtcatcacaagcaacttaaaattgtaggaaacgccacgtgttcgttacaggaaaaattataccttgcatggaaataaacaggccagacgctccaagagcggcacccaaagggttcatttcttcgtgcataaccctgatttccatgtatgttacgcgtatccgtacgcgtacgtgttccggcgaaggtcgcaaatttgttctttttatgtcctatttatcaataatgtggtcccctgaagttgcgtgctttatgtagcacattgaaaagaatttattggatatcttccttcaattgatgagacacactactcatacacggcgaattacgacttacaattgtgcgcattgctgcttacgggtcatcttctcatctgctttcctcgccttgcacgttgtagcactgatctccccagcatg

SEQ ID NO: 3845 - DNA, 703 bp, Nannochloropsis_gaditana
  misc_feature (245)..(254): n is a, c, g, or t
gtggaagggcagggaggggaagagggcgggagagtgacgtaccttggacggattgagcggggccgtcatgattttcttgtacattttctggacgttctggtcgtagaaagggggaaggccgcagatcatctcgtacaacagcgtccccaagctccaccaatcgatgcccttcccgtgccctttgttctccaggacctcgggggccaggtactgggagagggagggagggagggagggagggaggnnnnnnnnnnctctccctcctccctgccttccttccctcccgtggacagatcggacgagaaggagaaggtggtcatggtggcctcaggccccgggggcaagaagaagattgccatggtggaagcgcctcagccggtgaacgatttcttgaggtggggggggagggcgagaggaggcggggaaggacgggagggtaggaaagagggacgagagggaaggaaacagagtcaggggatgaaaagacataggttgtgtggagaaaggtaggggcaattgggttctcagccttgcattctcactctctcgcccgtcctgcttccctgcctccctcgcttcctctcttgtcccctttttccctccccctcaccctcccaccaggcggcgcgcgttgcgggagcgtcgtctattggcagagagtgctgggatcggaggaagggaaggaaaagggagccggagtatg

SEQ ID NO: 3846 - DNA, 703 bp, Nannochloropsis_gaditana
ggcgagcgaggcatcggacaggtccaaatcggtggtgcgtccctggccgcgcgtttcataaacgatgagccgacgtttccgggacaagccgtggatatgaccgacccagctggcgatggtctgcgcggtaccaccgatgaggactaagggagggggaacgctggcagtgcccggattggaggaggggaggccggtgtcgaggacacgcacatgtcgcagcggttcgtctggcagggacacgtcggggatttggatggtaaagtcccttgccttggaagctgaaacgaatgtcggagtagcggtcgcgatggggcgggtggagtgagggtagcgtctgccccaaggggagacgaggcgaaaagccccggccgcacgtactaccgtcaacaaacaaaacaaggaatgggcagaaagccgggcatgcggacggggcataagctgtgggcgtgggcacggtgggaatgaaagcttgaaatcgtatcgataaaatgcatttgagcgtagtatttttgcggtggctctcggagggagctaggggctttccagtgacgacggcgatcatgtccttctcatatcactcaaatcaatagacttttcctgcgacagaccctttggtacacccgccgtggacacgtgaatgcctgcgatcctaagttttgccctgacctaacttatttgtctcctcggttcacaatgcggacag

SEQ ID NO: 3847 - DNA, 703 bp, Nannochloropsis_gaditana
ttgtatcagtgagtagtgcactgtggaggctggccagacctttggtcgctgggcgtaattgtcattttgtagagaagtcactggaaatcctcctgacattgctggctgcgcctccgcttttttcaaagctcctgtccagcgacgactaccgagactagcgtgcaatactgcgcccaatacgccgccggacacgaatataactggaggatgtgcacggtatcacttgatttcattcggtgttcagggtgggagccttttaattaaaattgggcttgttttttgtcgaagaggtaggagcctgctgccacgctaggaagccggcggactgatttttttggtagagatgctcggcctcgtcggcttcctggactgccatcgatacaaattcacaactgttggtcgcaaactattgaatatgctatatttttatctttgaacgagacaaaaagcgtgcgtgcttggcgacatgctgtctccggttcatgatgctatatattcgaaggtccccgatgcgctcggccgcccgtctcgctagtcatgcatgcgccaaggtccatgatttgacggtcgcaaaggccaacataacattcacgtcttgtttcttcttttaaatttgttgattaaacagggaagttttgtgggtgcgaccatagaaaggctgttaagtggagcgaaacgccctgtatgcctgaactccgccatg

SEQ ID NO: 3848 - DNA, 703 bp, Nannochloropsis_gaditana
gatcttccccccttcgatgtgcatcccccaaagggccttgagacagcggcccatcgatgccgtaggacgacaacttcaccaagagaggcggatttccggagggctgcttctcgtgcttgtccatccctcgcgacagcgcttcagccacttccttttggcagccaaccatctcctcgggcgagagaccttgggccatgaccaggaccaccacctcgtgcccggagaggatcgcggcgagggagtccacgtcggaggtcatcatgtccaccttggccaggcataatcttgtgcgtgaggaatttgcagcaactttgagggccatggcaggcccggaaaggggctgtctagtgcaagctacgatttgggtcacgaggctcccgcccaggtcgagcaatgcctgcacgatgtgacggccgacgttaccagtcgcgcctaatattacaacactcatctttgcagccaggctcttgattgataccgatagaacgtgtgcaagtaaggtcgagtcaagaatggggctgctcaagagcgtgcatgtaggaaaacgaggacatgttgcgttctggtagaggctgacgtcactgtcttgaagcagggcgatgcatgctcgtgttccacgagggcgcataactggtcattcaggtctccttttctcacgtaccatcttcaaaccaactcaatagagcactatctgcacagcatg

SEQ ID NO: 3849 - DNA, 703 bp, Nannochloropsis_gaditana
tgtcatactttttggtgagctcgtttcccatggccgcggccgcgcgctcagtggataaagttgcagcagagtaggcacgggggcggtggaaatgcccgggcaggaggtaggaaaggtgcgaccaaaggatgaaaacacagcgcggggacaaacctgtctcattgtagcaatgacaacaaagcatgtatcagggtgatgcaaacgttgtgatgggaaattctcgaaatttgagcagctttgttccacttagaggtcgtcgcctgatgacgctcgctgcagcgtgaaagcacgatcgactttgggtctaacactttgctgtaattagtaccaacagtttccatttccatgcacgtccctacacagctatctccatcttcttcgactttcacgcgagaaaactgactcccacttgcctgcgcggcattttggtcagagaatcgtttgttaaagtccttcgaattggacgcaggcggcttttcttgacagccgcggttgcatttccccttttttcaaaactggagccctcatcagcgcaagcgccatattaccgaatccgaacgtagatttcggtaagtttgtctgatattcatgactcgggcacaggattccaccccttaattctattgatggtcgattcgggccgtaaatttcacccccttaccatccaatgtgccactctagcagcccgacctcctctcccatg

SEQ ID NO: 3850 - DNA, 703 bp, Nannochloropsis_gaditana
gagtaacagttgagattttcatgttaaattagcggctacatcgatgcttacgcggtcatgacgtcatgacacgcgttgctgcgggtatagcaagaaaaaagaacaaaaagcagcagtcactagaaggagtaggcgaagtgtgcagggaaatccgttgtcgctcaacaagccacgtgtgtgcgcaaatcgacgagaaaaccagttttgaagacgtattccagtgaggaatgcgctcgcatgatcgactttattttcctcaaatgcttttttggtcggttccttgttttttggggggggggaacgacgcgacactgacgcacatgcaaagatgccgaacttgaggaccccaggccagtatgggccgacggccttagggtagggctgtatttttgttgttgcaacacttcaatgctccgcagcaaacatggcaataaaatatggatttccaacgatttgtaatatgattgaaagggatgaacttcaagaactagttttttaatcatcttctacgacttttttttctatacctcctttcaatgaaataaacgctcgaccctgccaccctcctcaaattgcgtcctccgaagtttacaggaggaagtaagtctacaactttttagccttttaatgtctcgtcctttggaccgcggggagcgcaaaattgatgacgtcaatgactgttcagtccttacttcttatcatg

SEQ ID NO: 3851 - DNA, 703 bp, Nannochloropsis_gaditana
actgcgaaatgctaccatgcatctatggagcaatgatgcaagcgctgtgccgtgacgtctctgagcttcgtcgttcatcgctgttccaattcgtcttggaaagacttggttgaccgcgcatttttggtaaagatacgcttcatatgttgaatcactgtgatcctactggatgctttaccgggcaaaacccaacacaaacagactcactttgcctgtaagaagccacttacgttgccttcacataaaacttgtggtcatgtcatgttttgtcgtgcgtaaacatatttttttctttacttactctttgcgtgaggatacccagcgctctaaatttcactgccacgagtggcccatgtgtccctcgactgcatgcataggcctcacaatgttgacaaattgaacaagagcctgtcgtccttcaataagagctcctcccaacttcgtcattccaacgaaggttgggcgatgaataacgactttcccccgtggcgcataggcccgcaggacgtgaatggttgcgccctggttttgcgcggcatgatacatatgatggaacgcgccccgccaaggccccaaagtgcaagcctcgcccttccttaatccctgcggccaagcacgcgccacattgctcacatcgacgccgtcgccgtcatttcatcgtcttgacaattgttactttctgtcataggtagcagtggagatg

SEQ ID NO: 3852 - DNA, 703 bp, Nannochloropsis_gaditana
agctaagtcttaaagaagcataacgaatcataggttacactggctaaactcatgtcgtaagatgattatttttttacagcgtaagagcggccaatttcccaacaaaggaggtttgggtacccaatcgagtcacgggccgttcaccgggtccccgacacgagcttcccgcctcaaaggcagacaccatatcatccttcccggtcgattaaaggataagcatcctacaacatcgggtacaattttatctggccatgcaacattgaacactcgctatacctttttaacgcgcagtcatggctgcaacggtaaagccaacctcccccctcccggggcaccccctaacgcctatcctccgttttgaatggctgtcctggcccccccgtcgtgtgcaaggcagagacgaggttttgacctgacgtgcatggcaggttgtgtgtaccgacgggggcagcaggcaatgcttttgtggtggttggtagtgacactgtttttgaagtcaagcaacttgtctcgctgttgtccgtttctgccgtcctcgggcagacgtatgtgctatctcctgcagcgcacaaagtgcctgttttttgagaacttacgacacattcttcacaaatatggcacacagcgcgcttttatgactccctcagtcaaaaaaacctccccttcaacctcttcctcgtataccacgaccataactaccgcg

SEQ ID NO: 3853 - DNA, 703 bp, Nannochloropsis_gaditana
  misc_feature (1)..(660): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacccaccaacgctcctactcaagcccctacccctccccct

SEQ ID NO: 3854 - DNA, 703 bp, Nannochloropsis_gaditana
  misc_feature (1)..(457): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgattttgttcataactttttcatcatcatgtttatgttgttcatctaatcctttttctcttggcatttttccttttttaacgcttctctctttactctccctcgctccccccgtctttcccggcccttgtgtgtcgaagcttcatcctcctccctttcgatgaaagccgaatccctgatgacgaagctcaatatcatccatccctcccctcttctccctttcatgcttttcctttccaggtggt

SEQ ID NO: 3855 - DNA, 703 bp, Nannochloropsis_gaditana
  misc_feature (1)..(518): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccgcccgtttgttctggcagaaacactttccaggtaggcctcctgccggtgtttctcgtccatccaatctcctccatttgagcctcttgtccaccttccccctacccttcctgtcaaaaagaacctcagtcctccctctccttttccccttcttccccgcccttttcctctgctttcgtagac

SEQ ID NO: 3856 - DNA, 703 bp, Nannochloropsis_gaditana
tttaatatgttcaatgtccagacaatttctagaatgcacatgaacttaaataggccaacggtgccaccctgggggcatattcttctttgaacaaaactgcttgaaaggaggacatttgaccactcctaactcgcaaagcaacagagggacatttccttcgggggcgggcgtttccttgctggtttgagaaggtcaagacatgaatgcgaatgtttcgtgtcctaggattatacgctgttgatgcctaccagtaaatcatgcctttcaagttgattttgctccctcggactttcagacattaatgtttcagcctcaaaaaaaaatcctcgatgggctttcatcatggatgtgctattagtttttccaaataattgtgttgcatcggagcatgaaatgtctttgatcttttttctgtcacgaacttgtacttgaagagcgagcagaaccgccgatggatctgacttggcgaggctttaagcctgcctcacagtgcaacaatagccgtgtctgccctttatttataggctagtgtgcatcccctaagatgaatgaaaagtgagtaattgcgggatgttccgtggtccctgtgtaggtttcgctcttaacctccttaccccccttcgggttattttcatttcactcgtaacactcacggtcgattttacgttaatcttcatttccattcaatagacatattttcatg

SEQ ID NO: 3857 - DNA, 703 bp, Nannochloropsis_gaditana
cgtcgtgcctggcatggaacgcaaaaggcttttaaatctcgacggaggcagtgtgaatgtagtgtgaatcgattgtgtgtcgcatggttgggtataaaggatccgatgggggggggtacctaacttaagcttggaactattttactagtggcgtgctatctgtccgcgagtggaatgaagggaggcagctacttgagcacagaaataaaacggcttattttaagggctctaagcagggtattatttcaagcatgcaggtactggtaatatacatgtcgatatctgaatgtctaggtttttaagtgtcacattttcctggaccgacgttttcagaattggagagcagccctctgatggcttattgatatttttaccatatttcttgcggcaccatctttttcacacgtaaacctggcattcacgcatcccgcgggtactttagaatgacatggttaggaacgtcgtggccctgttttagtgggtctttccccgccgcattggctgtcaggcagtgcttatgatattgttccatcccttctcaacatgactgaaggcgagggtaggaggttgcactatctgttcgatggctatcttcctcctcacgactcaatatttttcctattttcatattctcctttctaggggacagtcatccgttatctctgtggtcggagcgcttatttattttgcttccacggaaatg

SEQ ID NO: 3858 - DNA, 703 bp, Nannochloropsis_gaditana
cccccgtcacgttcgaccgaaaataacgaggcaatatatatatcgcaccaattaattgtctcgccgcaaacgcacggacatgacgtttctgcacgcgcagtggccctatggggcaaagcctagagggcagtgaactccgaagtatcttaattacgtgccattttttaagagaccacaactgttcatcaacaacagttatcaacgaccgtcctgtagttcttcgatttctccctatcgcacatacggaagtgaccggtaccatgtccaagacttgttttttcgaaacgcgagatacccccctcgggcccacctttgggtgcaaggaaagccttgagattcccaaatgcacttgatgcaggcggtaccctcaaatatttccaggcctgtcatccaagacccttgggagcgaaagacgtccctcaccaagcacgggaaactctccgctccgtttggatgtgccaagcatattatactcgtgaaagtaatatacccagaagctttctactaatttgtgtggtcgtatgggccgagaggcgggcgctagcacctactacaatttgggcgtccagggcccgtgatcccaccgcgtttcacactgatcaacccgcttctcacggtgcatctatgcctctttccccgctgcttgcttgtccaagcaggacagaccgtagcttcacacctggcaccgcgccgtaaaattatg

SEQ ID NO: 3859 - DNA, 703 bp, Nannochloropsis_gaditana
ccttccctcccaccctccctggtgcccgcagatctctggctccgaggacctgaaggcgtcctacgaagaggcccggcgggccaaggaggaggcagacgagaacgtgatcttcgcgtaccagaagaagaagagccaagccgcggagcgcaagcaggtaccctccctctttccctccttccctcccgtctccagcacctcctgagagccgtccaaacattttgtctcgagtggctatcttggatacttttcttttatttctgtccccgcccgcgtgcctctcatcttatctgtccctccctcccgccctccgtccccccactccccaggtgaaagagcagaaggaggaagcagagcgttatgcagccaagaaatcggagctcagtgcgttgactaccgaaggtacggtagactgcttctttgccgcgcgcgtccgtcggccccacctccctcccattcgctctcccccttcctccctccccccctctgcccgccccttcctcctctcctgccagcgtacctgcaccggctctaccacgtcaagcgggagctcgatcagaacgaggccaagctctccgtcgtccgctccgaattctcccaggccctggagcaggagcaggtgcgtccctcccgcattcatctcgaaccctctcgcttctcctgacctgcgtatcgctaaccctccctttatcctccagtccctgga

SEQ ID NO: 3860 - DNA, 703 bp, Nannochloropsis_gaditana
gccgggcctcgccgagaagaggaagcggcaggggcgaggcgggaagtggtgaaggtcgtgtttggacgcaaataaacatgaaatcacgctccctcgtccactactcaatggtgttgtcatagctctttaagtttaaagctcagagaactgggaagcacgtgactgagtcgcgcgtcgagcggttgtggtgctgaacgccgcggatgtgaaggaacagagaagcagttcctgagcgacaagcggcgaatgcctacaccccaacgttcccttgcccctttttagttgccaagcctgtcgcgaggctataatgagtcaaaaacttgaggagtcttcagatatttgcgtgaaacgctagtcttgaccccttgtccggacgaaagagagagcgacactcacttgcttgccttaccttcatcttgttgcgcgccatcctcgaactttacgtgctttgttgtgatttaattgaaaaagcgcatgtatacaagcgggaagaagtgacaacgacaagatatttcggactgtgcattctttttctccgaaagcgctaagaaaggcttcaatttccgttttcttgtgcctacctcttacctccctgcttccctcccatgttactccttttccctctcgagcacaggcgtgaatcgtcgcccctttcctcttccatcccacttttcttcacagaagagagagcatttcgaggatg

SEQ ID NO: 3861 - DNA, 703 bp, Nannochloropsis_gaditana
gtgggacgtggctgagaaacacgggggcaggccgggacaggggggggatgacttgctcgtgcgtgtccgcacggacaagcacacgaccgaaggcgttctcaatccttgtatgtacaaaagagtccgatggccagccagcacaggacaatagcggggccacgttgataacatttgcctcccaagcagacagaggaatgaagcgacgctagtaaagttcgatctcacgatttttttgcccatacatagcaagcacggacgagcacgacaaggaaaagggttgagcgctgcgcgaagaaagatggccgccaaggttatgtgaccttcactacctagtcatgcacgtgatctcgcgctcgcaatcctctcgacagcgcatccagcactttgctggcttttctttgtccctttttgcagtcaaaacgtcgacagcatcgctcgcctgattcctgttagcgaggtatcagacctctaccatgtcctcctgctccctcccacacaaaatacacgacccgcccagaccacaaaaaaggcgtcccatcccaccaccatgtcagatcggtataattttcctctggacacttctggtcagatgattctttggggatgtgatactcgtttcgttgtcgcttgcgcaaggcagcagctacctggctgagtctagtctcatttgacgttcctcctgtttgcaggtttgctcagcatg

SEQ ID NO: 3862 - DNA, 703 bp, Nannochloropsis_gaditana
  misc_feature (1)..(670): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaacgatcctgcggccgtgcttgccagggcc

SEQ ID NO: 3863 - DNA, 703 bp, Nannochloropsis_gaditana
atgttgcggtattctgccagtatttatggcatgtaatatcactctcttgtcaatgaatgtacaaatgaatgagaaaatgggtgacactggtacatgtaagcaagggtggcttgagctttgggcagcttgcctgcattaaagacaggcataatcaaatcgcagacggtcatcagccccacctttcaaccatgtcgcaaccctttcgtgccgaagcagagcagcagccgatcatttttatacgcaaaatgaaagtgtgatactagggcttccagacaggaaggagatgcgagtccgaagggctctcaactcgactgatatcgtagaaaggtttttggacgcgtactctcacaagcatcgaacctggggcgccctaaattaataatgaaatgactcaaggatctcacccttctccatccctgtgtatttatcctcatatccaggattgttgaagacggcgggagagaaggtgtcgggcatccagataaagaataccgccgaccctacagtgacgggcaaggtaaagagactcgttgacctccgcgacaagcactggatggatctcacgaagccatcgcagaaagcatgattttgccaatcgttggtctccctactattttaatctatgtaatcacccatttttcatttccagcagcagccacactaaggcgaagaagtgtgccgtagccaacctttcgcagtcatg

SEQ ID NO: 3864 - DNA, 703 bp, Nannochloropsis_gaditana
agcttgaaatcttcacgtatatgcgagaaagcagttaaatgataagttccatcttgagggagaggaaacgactcaaaaagagtaaaaggggcgtgtaaggcgtcaatgtaaaaaagagaagggacaccttataaaaatgaacaacgaaatgaaaaacagtggtctgtatgactcctttcacctttggaaagatgtacacgtaaagtaacctccccaactccttttatccgtaccggccgttggcagcctgagcccgcttctaagcaaaggacaaacctttaccccaaaaaaaataatgtgcaagggacttatctagaggatgagcgtggtgagatgcacattacgttttgcggggaatgacttcttcacctaaggcttcgactatgcgggggcaattttcgcttaaacccggcttagcggggtttgagcccaacccatacctgggaagatcaaacctgaaaatcacttatcataatctaatgatatcaaagcatacaagcagtcagtcacgtccaaattctctaagacaccaaagattgacacaaacatacgtcattttttaattttattcggagaggttaatagtctcacaaagatctgtccaatgtgagctgctgggagcatatcagatctccgtaaagaaacctgcagaagcactgtaccgcacgaagactgataaagtacatttcaaacgcacagcaca

SEQ ID NO: 3865 - DNA, 703 bp, Nannochloropsis_gaditana
cgcgcctgtaagggaagccaaaataattataaagaagcttttgcctgtaacaaaaatttcagaattcgatgcgcaaaatttttatgaataaacacatatcaatctatgggagaaataatgattgttgaataagttgtgagattttttggaatgcccccagaccctcacgagaacgatcggccggagcctttttcctctttttattttcaagggtttgaaggggttcaggctcccatcaaggcctcagccacctacgatcgcatcacggcgaactttccgcgcctcgacaactcgtcgttcttgtgtgagatacccatttctgtgggtttcttgatctgtgatacactttgtggtcgttaaccggtattgtttagggtcaaaacgcatcgacagacccagagagagctgggcttgggcaaggggcgggattctccatctaatcgcctttgttataagacaacaagcacttaaatacaccatatatttcatgaatcatttatctattaaacatataaggggagctgtatgccctaagaaggacaagagtgtgtaaaattggcctttgcaagcctctttacggagccggacgatgatgtgtcgtcgtggagggcaccactctttgcgcattgtgggaggatttgtccagcgtgcaggcagtgtcccgccgttgatatcttcacggaataaaaagccaaattacgta

SEQ ID NO: 3866 - DNA, 703 bp, Nannochloropsis_gaditana
cgggtggttgggggcaggcggcactgggtcttctgttgctaagcctgcggagcaagttttttgttcatgggggcgtggaaggtccttatgcttgtaggtgttagtaatatagcatgttttcgggtcattgatggtggaatttgaaagagggtgcttggagccacccacgcctgtggaagcaccaatcgcccatttgactagcttaagaccatccaccatatctcatatatgggactcaaatctatcaagaaggtgtcgcgaggcgctttaagagccattgatgaggagggtttgtgagcttgtgggttctgtggcttacagacgcgggtgcagcgcagggagaaatcccgtaccaccaccatacaccctccctgttcgacgcatttttggatggtagtgtatttatgattcacattgtcacgcacacgcttatacttgtgcacaggagtcataatcatggccgaggtcgagattgatgaaaccgtgccctatgagcccgcggatatggctgtcgccttcgaggacaacagcgcagacatcaagctgttcggaaaatggtgagctttgggaggtctatgccatgtcttgtaaaggccccttcggccttactcttcgagcacccactcacgctatgtatattaaccccccgtggccccttttcttgtccttcaggagtctgtccgacgttgagatcaaggatctt

SEQ ID NO: 3867 - DNA, 703 bp, Nannochloropsis_gaditana
aaacagatacatcccttgatatcaagtttgcgtcttctttggaggtcgcattgtatgttcgctggagacgtgcattaagtggagatgaatccataccagaggcggagccctcatcgacgttggaaaaagcacgcaaccgctggtggcaagaaataataagagagtacaccaagctagaaagaaggtaaggtggatgcttcccgcagtcaaagagggaaaggatgttaaagaacagaattctccattgctgggtttcttatcaagaccgtcccctttcatttactacattttacgagataccatggcttgacacatttgcaacaaatgttcggagagatggatcgtcatgtgggcaggcttacccgcccagatcgggtcgcactcgcagtgttctttcatgagtacgtaaaatgtcgttaatgaagcatatgtgatcttgtttatttcaaaaaaaaatcatcaccggtatctccaagtttaatatacgatccgcggagcagtattaatgaggaaaagagtgcggagcgattcaatgcgttcgcgcaagaggcaacacggatggtacgcatgtaaaatatgacgctcgggagagatactttatagcttggagcccatcacagtttttttttttgaatcactacagtctaaagaggacataggcgtggtgcatgcttacatactggcgaccaagacacaccagatg

SEQ ID NO: 3868 - DNA, 703 bp, Nannochloropsis_gaditana
tattccgggagaagagcgagcagcttacacgactggttcgcaggccgcgcggctggaattggatgcgtcagggtggtcccaaatgcctatgttgtcttatgcgaccctcaaggccttatgacaagctgtggatgctcgctttgactgtagtttttttggcttggcattttttgatgcacgtgcaaagtccattggccctccggcgctacgcctccggccctagagaagttacactattccctctcccggatgactggcactcgctctctgccattagtcaccgcacctgacgccacgtcatgggatcaatgacatgcatgcacgcacgacttgtaacggagccggggtggctaggattatgactgagtgtacatcttgagccgagtggtttgaatgcgccctccgcagaatgaggacatacaagtggggcaccggctgccgaccgcagcttccaggttccccgcattttctcagggggtcgcactcccacgcacatcgacaaccactggcagccagtcacgtattcacttgcccacaggctcccatactcattctcgcactcgaacacacgcgtcgcatctctctccacaggcaaaggccggcgtcccgccgccagcaccaccccctcggacaggaatcagcgttcgctcaccccgcccaccttcctttttaaaactccaagcccaccaactcctaacccatg

SEQ ID NO: 3869 - DNA, 703 bp, Nannochloropsis_gaditana
aaaagtaggacaccggaattcaggaggaagagcgaggtggcacggacacacgcgtcaaatctgtcatcgaaatcatgccaacatgctagcaggtaccacaccgtagacgatgtcacaagaaggagcgtgtatatgtctgaagggcttcataagccttgttccttgacacaactcaaggcctttcccgggcgcaatcggcaggggtcggggaggtaacgcgtagcgacactccgctactgcctatagacagcttatatggcagaacactggaaaaaacagtcggcccttttaccagcatgctcagttatcgctacgtttcgccttgacaggctgtgtttcaaactttgttcacttcttgcacagagacgccgggcaggctgtccagtgacgctgctagccgcgttgtcggactccaagatgcttctaccgtgccattagagaagtgaccagctggtttccaataaaaaaccttacaagtgtatgatcaagccacgatagtgccttgctggtcggcaagtgcggacgtgtcgtcctcacgtgcgagttgtttacaatggcacatgacaacgaacccgccctccctaatgcagcccttgctcctgaggactctcataccacggacagtggcacctacggcaatggcagctgtggtaaaattgatataaaaagaaacggcgttcatggacgggaagataaaacaatg

SEQ ID NO: 3870 - DNA, 703 bp, Nannochloropsis_gaditana
cctcttcttgttcactcgtttgcacgtccagtagatcattccacgatggaaatgtcaaggggatcccttgcgtggccgacatgtttgcgcactcgtcctttttttactcttctcaaccgagcagtactgcgactcgtagggcgggagcctgaggatgaaggtgtctttttacaaaactttgtgcctcttggcgcgtccacaaaacgcgctacccccgcgaattccaccggtcatgaaatttatacctgtttcaaaaaacaaaagaatgaatggacggagaaaaaggaccatggtggtggtttattctgccgcggaaggcattgcgcctcccttcgctttgtcttcgctgcttctccgcttgcatctcgccagggccaaattctcgttaccttttcaagtccaacttaccacgcccgtccccgcggcgggtccccacgggacacgtgtccctttttcccctgaaacgggtcgccttcgtgggggttgggaaggcggtcgtggttccgtggaagggggggggaaggtttctctgtcgtgctcgacaccggttccgagaggaaataagagagcggggcaacgcaccccttgcttgcgccacaatgcacacccgcacccgcttttacacgtcacaccttccctttcccagggcagtaccaagcagggtcgtgcattcgtcgggttggggcgtgcgcaggcaatcatg

SEQ ID NO: 3871 - DNA, 703 bp, Nannochloropsis_gaditana
taaacataattttcctattacatttatttcgacctacattcttgttcggcgcgagttctacagcggtagggggcatcagcccctttcctcatgtccttcaacctcctcctatcaacttctgacgaggcttctctccccttttaatgcattggtcccgcaaaagagtatgcattttccaccttaatatttattaagattcaatgtgcgggttgattatcgtccgatgtcatgagcctcttttactcaccatcaccttccttctcccactccgccatcttccttcctgcacagcatctgcgtagctggctgcttccttgtggtggaggaagtttccacctgatgttccgcccatggcttcttttgctcaccttggcgttgcacctgcctttcctcgttgcgcaactcgacactctggttgggttgcagggggaggatttcgtcctcctagccgcagatcccgtcctcagtcggtccctcaccctcctccactcccaccacgacaaactccccctcctgggctcgcaccattgcctggctttgggtggtcccgtgtatttcaccgagatcatctcggaggtcctcggggcggagaaacgcttgtttgaaaagagacttcggcggccgttgagcacgcgggccgtggctgccatggcgcgaaatttgtttctagaatacaagggcctgcctgtccggatgcttgtgg

SEQ ID NO: 3872 - DNA, 703 bp, Nannochloropsis_gaditana
agccagtgcggagatgtacccaccctcctccccgcaatatggcttcccgccttactcttggcagccgcagtattccgaaggggagcccctggttttggtcgacgggctggaccctagctatgccttgccgcccatgatgcccccgcccccgttgcctcacctcctgatcgagccatcctctcccaccgcctcttctcctccctcaaaaagtccgcagcaacagccgcagtcggaggaaaggcctcgatttgcctcgcggtacccgggccccagtcctctggcggcagccatgacgcatccgcatcctgagaactcggtagctgtggaccgcgccatgggcattttggtgagtgatggaagcgagtggtgccgttgggagtgtgagattcgggcggtggggttttgattatgatgatgatgggtgggattttgcatgcatgaagtggaggggacaaaataggaggccgagcaatttgtctgcgtcggttcgcgatcgaatttaagtcgaacaaaattttcacctgggttatatgccgttgctcacgatatatgcgacttgttcttcttcgtgtctttaccttttgacagaggatggaggaggtcgcggggggaccgcgcggccataaggaggattgaaggtgcttgcaacaaggcaactacatggcattgcttgtggacagagggcaacgtggctccatgccaa

SEQ ID NO: 3873 - DNA, 703 bp, Nannochloropsis_gaditana; identical to SEQ ID NO: 71

SEQ ID NO: 3874 - DNA, 703 bp, Nannochloropsis_gaditana
agcaggaaccgtggaagcctcggccgcataatttttgccccagcccccactccttccaatattcttcaggcggttgctttcgctggagctattactttgcctgaactgtgacggctcttgttgatgctccattttccgaggtaccccgccagcggacaaagcgtgaaaaggaccacgtttaagtcaatgggcgtaacgggaggccagcacaggggatgccaacgaccaaccgcgacgcacaaaaagttaaaccacgagcaggatgtcgatccgcatggcaatgtcgctgttgtgtgagctgaaagcggtgagaagacaggaggggccaggctgggtgcggggggtagccgttgggggcttcaagccgtggtcgaggtcgagggaagccgcctctgcagatactgcgcctgatcaaaggggagcattccaggtctcaaggccgggggagtcgggggacatccgggtggaaactcaagtgtgcgcattgtgacgcatgtgtagggcttggtaccctggcagcgcggcctttgaggcgattaaaaagagctccatcgcaacttcttctgtccgcgtctaccctcgattcgaagacgggggcaagatacgagctgggaagaaaatgatctcatccatatattttgtgccctttcgccaaccgtacaatgcatataaacacaggatcaatttattcagtgataaaatg

SEQ ID NO: 3875 - DNA, 703 bp, Nannochloropsis_gaditana
ggccgcatctcgcactcccattgcgctcaagtcatatccagcagcgacgccttggccccagtccgtgctcaggaaaatgtctgcccctaagaatgtcgagctgctggcaggctcgacgattttctcgatgtccttgtctgtgtgtcgttggctgaggaagcctacggtcagcttccctaccaactccagccccccgggccccaggtacgtgcacttggggaagacgtcgcctcccggtaccacgctgccatacttggcctcggcactcgcagatggcccttcgatgaagtaggttggcaaaggtacttccttgacgcccatgacgtagtcttcaaaggccgtcgttgccatcccgccctcaggttcgtcggcgggtgggaaaaactctcccgtaacgaacaacgtgtcaaacgggccggcctttgaagcattgagcgatgctacgcgcgtaaaaagcaggtccagacggcctcgaacctcgcctgctacaagaattttcatcggagcagctgctttgcgttggaagacgacgcgaagggggggagtgaaacgagaagagaggtggtcagataaacaaagccttgtctcgtgacttcactttgtccggacatagccaggatggaaaaggagggtttccatgtgtttacaactggtaacagagcatttttccttgatagcatctgcccgtacatattgttaggct

SEQ ID NO: 3876 - DNA, 703 bp, Nannochloropsis_gaditana; identical to SEQ ID NO: 76

SEQ ID NO: 3877 - DNA, 703 bp, Nannochloropsis_gaditana; identical to SEQ ID NO: 79

SEQ ID NO: 3878 - DNA, 703 bp, Nannochloropsis_gaditana
  misc_feature (1)..(309): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgggacgaacaggcgtccattcggacgagagacgttcggatgattgaggctctcggagggacgtgttcgacgacgaaatcgtctgacaccgtccgcccttttccctcctcccccggaacttccccgcagggatcacggacctcaagttcaagcccgcctacaacccatacacagagccgtcgatggagatcttcggctaccaccccgacctgaaaaagtgagtcggtcgccgtctccttcccgccactgtctttccttcttcctttcccggggaccgagggggggtgcccgccctaccaatctcgagcttcctccgccgacctcacaccgtctttgtcctttcctcccccctccccgtgcaggtggacggagatcgggaacagcggcatg

SEQ ID NO: 3879 - DNA, 703 bp, Nannochloropsis_gaditana
gatcctcctaggcattggtgtcgcgatggcccccaccgtgcacgttgccttttggcaccgacagactgacataggtggggaggaggggcgggaggaagggggggagggaggaagggagggtctggtcttgtgcaagtccattgtccgataggtggcagatagacgcacagacacggacacaacatatatagacgtatatatgtatagatgtatatgtatctgtttatcaattcatgattttccccacacatacacacacgcatccaggcatcaacaccctcgcctacgtgctctgctgcctgcccgccgctgtctcccaactggcgaaggaacaagccatcatcgagtttgcacaacccattaatttttactacttgaatctcctcctgggaatataccagttcgtcctcctgctggtgctgtcccccctgacgtaccggctccaggtggggagggagggagggatggagggagggagaggggacggaaccagtcagaaaatctcgtttggtcttgcctcgtcacgtctgtgcggacctagagcctggccttttccaccctatttccaaacccctcccactgtctgtaaactgggaggctgaggccttttccctcatgcttcccattgtctcccactctttgtggaccgagaggcagcctctgattccctcgcgtctcccccccattccaggggctgggaatg

SEQ ID NO: 3880 - DNA, 703 bp, Nannochloropsis_gaditana
aaagtcgagaagaccttcgaggacgccgctcctccggctatgccctgataatgcatacaaagaacaaagtttgtggactggaaaaaggcggatgcacagggctctgaaggagcctcccattttttcttcgcttgcaccaccgtcacgttatgttttgaaatctccttggtaaaatcaaacttcaagcattattaatttttccgccgtggacgtacctcactgtctccatcacggtcagcgtgtggagggcaaatatatagcatccaatgacactcctttcctcattccaaaatttaaagaaaacctgtatcgtttggtttgttcgcattttaaaatatgagagagacacatccacgatcgtcaaggcaatcgaagtcacacaaaaagtgatttgtttgcctccttaggccctttcctctttcacggcgatgccaaatcctcatacccggatttaacggcagttcaggaacggctgagcagcgccttttgtagataattttgttgatatgcatgcataatttggggaaaattatgggtgcttcagaggcagcaggcaagaaaatctctcaacaaaacgtaaacacactggacccctgcaagacttttgcggatgtcggttccgccgtttttacgcgataagacccacccgattcatgtgcttcgcgttgctccccttttcatgtccatgtacggcaggaaaatg

SEQ ID NO: 3881 - DNA, 703 bp, Nannochloropsis_gaditana
cgaaaaggatcgacagaacgatccaggacttctttgttggacgcaggcctggagatcaaggaagaaacgtggggctttggcttcacggtcctcgccaaaaggatcactcccagtcagtccctggccagattggtccgacaggtgcaagaccacaactgcgtggtggcatttccctcggaatggtccttggatcaagacgtggcagtggtggaatggttgaacacggccagcgaagcgctgggtcgggcggccgtggacgtctccccctttgacttccgccacggagggagggaatcgtcggtgggactgcacctggagcattgtcccatgccagccatatacctgcggattgccctgatccagggttttaaccaacacatccagcgcctcctccccttcgtggacctggcgaacccgtgtcgacacagtctgggcgccaagcttcgggcattggcccccctggtcctacgggacgtgaagatggccgtggtggaggccggaaaggagcggaccctgggctcgggcggaaactccttgaccatcaccctcgacaacttcgctgcctcccggtcgatggaagccgcagaacgcgacgtgaccaccagtcgctgcatcttcgttcaggcctttagggcccttcaccacaaagactcccaggtgctgcgctcctgttgggacggagaccgcgtcttccaagtcacgt

SEQ ID NO: 3882 - DNA, 703 bp, Nannochloropsis_gaditana
aacggctcggatgccgggggggttttccgcgaaggcatgtctcgggtcctggaagatttgtactctcctgaaaccttgaacctgctcatcccttgtcccaacgcccagcacgggctccccaccaatacggacaaatttcttcccaacccgcagcttgccacctgtcccctcgctttggagatgtttgaattcgttgggaaattgatgggcatgtccttgcgagcgaacttgtgcctcccttttcacttcccttccttgatctggaaacggctactgggacacgaagtgctccggagcgacatggaagccgtggataccttgacgagccgcctcctggactcggtgcgaggctgcgaggacgaggcggagttcgaagggaagtttggaggaagcttgaccttcgtggcgacagggtatgacggggacgaggtggaactcatacccggaggttccatggaagacgtgacattcgcgacccgccaggcctattgcgacttgctatcggagcgatatctgcacgattcggacgcccaggtgggagccatggcccggggactgtatgcggtggtcgctcgggacacgctcttgctgttgacctggcaagaacttgaaaccttagtgtgtggctctcctaccttcgacatggccttctggaaggcgcacacgacctacgcggggtacagcaaggacgacctgaccatcc

SEQ ID NO: 3883 - DNA, 703 bp, Nannochloropsis_gaditana
ttcttattttacaaagggctcatcatacaaatacatatatatttatacatcacaaaccaagaatgattgtgaaaatagggtgtcacccgaatcagggatgaaattggaaggccggggggagaaggtttggactacttgccatagcagtcacgtcgtttatccgttcccgatttttcctcctgaaaaaatacaaatggccggacaatattcatggctctctcacatttccatatggtaatggtccgtgggtctctccaaagcgccgcatacacctagtcgggctatacctacgtccaaatgcaggttgtacagccggcaggagaggaggttcggggttgtggcgatttgcctccccgcgagaagatcggaacggacagccgggttggccctgcccccagctttcgtgcacaagcatggcatgcgtgcgccgtcgatggtgcagtagcgctcgcgtgttttggtgcgtcggcattgtgtacgttgtatgtagcatggtctgtgtctacctttcgttctcaggcgacgggtgtcttgcctcagctgggaaaagacgtactaggagggaatgcggcgcatcgcccaagacttctccatgcttccgtgtcagtcatcccatcccacgctaccacacttgcatgtttcatgaaagtcgtcacatctccatccacagcatcgacaaacgcaaggcgaagattagcacatg

SEQ ID NO: 3884 - DNA, 703 bp, Nannochloropsis_gaditana
aaatctcagtgccccccagttgcttgatgaatgaagaaaacagtaaagaagaggaatgccaggcgaagggtgcaatcagcttagcacggcgcgacacgagagtacgtctgacagcgattgttatttaggtacgtacctgtggcgtagggagtgcaacttcgacggcgagtcgtgtacctagatcgatcgtaggcccagaggatacttctctgattttattgcacacgaagctccggccacacggtggctaaagggagctgtttttggatggaccagttggaatacagataaactgtgatcaaaactgtgcaggtactcaaatttcgacacgaaacaacattatcctgcgttccaaatgcaggtagagcatcgaagcggttcaatttaacggaattcccgatccgttaaaagaagatcgccgaatttgaattttggagtcatccgtccagtccgcggagacctcgataggcgaatgcaaaagtttatgggacgatggtgagggaacttgatgaaaaatgatggggatatggagaaggtggaaaatatgaacccactggtctactatctcgacagttcttggctgattgcctggtctgtcatgcctttccatgcggtccttctttcatctgcctcaggtagcgactcgatgcaaagcaaaggcgaatgatacatgtcatcaatctcgccttaaacaggtaccatg

SEQ ID NO: 3885 - DNA, 703 bp, Nannochloropsis_gaditana
  misc_feature (232)..(241): n is a, c, g, or t
  misc_feature (534)..(543): n is a, c, g, or t
gggacggccctgaatatctctgccgttcgtactttgtgtctagtagtttgacgcctagtggccttcgacccatcgatcctttccctccatacagccccacagagtcgggagaaagaaaacttacagcaacggggatggcggggagcatgagcatgttgaacctcgcgaagcccggaacgccaaagaagcagcgttcccaggacttaggtgctccctccctccctccctcccnnnnnnnnnntgtcctcattccctccttgcctccctccttccccgtccgccccatcgtctcgcagcccttcggatcgacctcccttcctcctttcagcttttcgaggccgcagatcgtttcggggtggaccgattgaaaagtctgtgcgagcacaagatgctgacctccctctccctcgacaacgcggccttgatcttccacacggcggacgtctaccaggccatgaatttgcgggaaaaatgcatgagtttcattctgcaggtgagatacattgctcctcatccgctgccctccctccctcnnnnnnnnnngcgggaggaaaaggaagcgcaggagagccgttggcagaaaggtgtgcgggaacgggaaggcctggcacaggcactggcggaggagaggcaaaagcgggaggagctggagagggccggtgcccaaggaggggcacaggggggccgtgtgagggaggagatg

SEQ ID NO: 3886 - DNA, 703 bp, Nannochloropsis_gaditana
gaatggcaactgtcggctcaaatgatcgcgcttccgtactgcttcgcgttgtctttcttgtttggagagaacaggctgagtctttgcacccgatcactgtctatactccccgaaacgtccacttgaatgaaaccaggctatgcgtaccgacgcaagcgttttccccaattctttaaaatacacctgaacacttttattcccattccagtgcagtgcccagagagacgagtctgtcctcctgtttcttgtactagttgttgccacttgaagtacgagaaagactagctgaccaaaaaagcttcattctacgagtgacgaaagaggacttctctcttagctatgatcagggaaaaaataaaatatcattacctgccaagtctccaaggtctgggaacccgctgtagcgggaagaggtaatcgagacagaagaatgtgcacaccagcaaaaacatgttgtcccactcacacctgtcgcgccgtctatataccctgagagcaaagttcatgtcaaacctatcccccatcacgccataatgctagaaagaatggctcacatcgcgtggctaaggcagggctctggaaacatcttcgaaaaattaacctcccccctcgagatggggcactgttttgtttcccctagctaaattggtatttcttttcacgttttgttcccgttcacttcacaccgacagcaagaaacatg

SEQ ID NO: 3887 - DNA, 703 bp, Nannochloropsis_gaditana
aaggacacaagccacgcacctgcagagcgacgcaaggcgccaagagcatgccttcctcctcgtcgcgtgccatgggcaaattgatttcctgtcgaatattgcctgtgttattttagctcacgggaagcggagggagcaatacactggacttgaaggtacctcagcgatgaagaaaaagcgcggccggctggctgtagggacttacttttatacgaaagaaatgccctttacatgtccactacaaactgtatcgcgcgtcgaaaatattgcagacaaaacttccttgggaggaaggagtttgccctcgtacaacatgacaaatggcattttaggtcgacaaatcgaagccgagctgcagcaagcactcaaaggactcgaccaattctgttttcgcaaggcgtggcaaagctcttccaaatccatagagctttcactacacccatgtttatgacacgcctttggagccgcgcatgacgggagctagttcgcaaagtgcattgaaattcatcaagcggggcgcaaatgcctcatggaccatcgccaagggccgcccatgtcctccatgggggggaagaaaattcttttatgctttccttctattttagttaaacaatatagctaccgatagctgatttttgtgctttcacgtgattttgcagggcatacgcagtggttcattttacgacagcagcgggtcgtcatg

SEQ ID NO: 3888 - DNA, 703 bp, Nannochloropsis_gaditana
  misc_feature (200)..(209): n is a, c, g, or t
cttgtgacctgaagaatcgtggaggcctccagcatttcggccatgaaggtgctgacaccccgctgtgctgcgtctcctgccccaacccgcgccaacacggcgtccacaacgggcagctccatggcatcgacgggcacgtaggaccctgcgagcgagagaggggcggagggaggaaggacgcgtattcttgactgggaggnnnnnnnnnntccctcctcccttcggctgccacctaccaatctgagccatcacgcacaggcacccgaggccccggatataggtgctcttcccgcccatgttgggaccggtcaagagggtgaaatgactctccccttggcaagagtgggagggtgaaagttgatgaggaaagtaggggtgcgagtgcaggcagatttagggaaaggggaggaaaaggggacaagaaaaacggttgggaaggagggaaggaaggagctacctcgggttaaaacgtagtcgttgggaatgaactccacgctctcttggagctctaaacaagggtgccttccgcccttgaccatgatgcctgtcgatatcaagtgaacaagcacgtcagtcaataccttctacaaccacataagccccttcactggcatcggcgggcacagaactccaccctgcccctcctctctccctccttcctccgtcccgctccttccctccctcccttctgcgtcccggcacg

SEQ ID NO: 3889 - DNA, 703 bp, Nannochloropsis_gaditana
tttcacccttatggcgatgatgcctgtcagggtgattgccaagtgagaatttgctatctttcatttttcttactcaatccttgtatctcaatacgtatccttcaaaacgtgccgcctcccttaccgtaacatgattaggacttccatctcttgtccattagctctataagggtagcgccaaattcttgtgactaacccagagagtgtggccttagtcggtggttggtttcccatcttggactggcctgtccaaggatgaatgcaggaacacaaagggatgcattaatgttgcatgcgtacctaccgctgcccatgccgtcattttcggcccaaattttcaaactacatacaagatgcataagtcgatcaatggaccctcaaccgtcccacgctatgaccccgtcttgacgatgcaccacgccttgccacctgctttggtttagccgttagcgaccgtttacgacggtttagagccctcgctttggagtcgagtcttcccttttccaaaccctcacgccgaaagggcaatgaccaggaactgattgtcgcctccacttccatagtgtaatttttcacgtgtattcaattatatgaatcactccaataggccagaaattgcaaatttgaacccacccgccagcggagctttcacccgcgtcacggaacgaagctagcgtccgaagcccgacttttatcacatatg

SEQ ID NO: 3890 - DNA, 703 bp, Nannochloropsis_gaditana
tgggtggcgaatgcctgtgaagaggggaagggaagggggggggaggggggaaagcgggaggtggagtcggggaaaggaaagcatcgaggatgagctcaaacgacaaacacgggtaccctaaaatataatttatctcatgtgccccgtatatgcccaaatcgactacattatgcactgctttgcttttcacagcaagcttgcaggcggaggaatctagacagtcctgggcactgacacaagccttcccttgacacagactcgacaacctctatcttgcctgcttaataagcatttctgcctccttagttttcatgtttgctggctgtggtggtgagtttgtttgcgtctcggcagccccccctccgtccccccctctttccagcttgccctcctgcccctccctttccgatagaccatccttggcgggctccccgtcattaatttcggaagacattacagcaacctggccctcagtgcccgttttcttgtatactgagaccctgtgaggacttgggtgaggatgggaagcgtgtaacatcttatgaaaaaagatctgattaacaacctccccattcacctacctcccctcccctaccgcagcatcaacttacgtgccgacagtccctccctttatcattcatgccacactattccctcaaagatgtccacagggacaatctgctgctttttgcccttgtattac

SEQ ID NO: 3891 - DNA, 703 bp, Nannochloropsis_gaditana
  misc_feature (1)..(506): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgtcgtgggtgatacagtccgaggaggcggagggggcacaggccccaggagggaggaggagggagcgcaggtatgcgatgcctggagtgagaagaggaagtgaagagcctctcagtatcaacaaaagagcccgtccctcctcttctctgacacctctcccactctctctcttttccctttcttcctcctccatg

SEQ ID NO: 3892 - DNA, 703 bp, Nannochloropsis_gaditana
cgcggttacgccgctttaaaccccatggggctcaatctatgcaaagcgctgtgggagacggcgaacatagaagttgaagttcctccgtgctacgctttcttcgacggccctcctccttcctctttgcctgcttttttcacgctctatgtcacattcaaccccctgcattctagatctcaatgattgtgcaagactatttacacagtaatcatttggtgccggtaaaatttgtacttgacgttcctttgtgcgcttcacaccccttctgctggttttcctctctaaagttttatccctggttcactcaattttattcccgaaaacgattgtataccccgtcagcacgtcaagactctcaagagaatgggtgttgccggacaaatttcgcagattggaaggaatgtgtaactttggatgtgtcttatcgtcattgttgacaaaattatgtgctttcagagcccatcatttatcacgaagtttccaacgtactgtgaattcacttctcctgcccccaaaggacccctgattctactctcttcattgtctcgtctctcagagaagaagtcgggggtctgcgcatctaaatggtgtcaacacgtcggcaatcggcgaagctggagtcccgcaagcaacaagaagccacctacaggaatgccgccttgggctccatagcggccgtgatattgggcctgcttatattctt

SEQ ID NO: 3893 - DNA, 703 bp, Nannochloropsis_gaditana
aatgtgatgagtttgattgcttcataatttcttacgaatccgaacttccttcgagcaccaaacgcgctgttcctagtttaaaaacagtgcgtatgtaacaccttcgatcctgcattttgctcctaaaaatgagaaggctgattcatgccgcgaaagggtaaatactgtacgaggaaaaatcccggctttcaataacatacattaaggcggaaatattcaatttcgcccactcattcaatttcgcctgcccagtgtagtcttaatttggcaccttcaaagtgtatcgattatgtgcgccgttaactgataatcaagccacataatatctccaaactgcaggaagcattcttcgggctgttgcgtgtgacgtcacgtctgagccgttgaaaaaccgttactgccccccgaaggattccgggtcctgctcacccttcgaatttccagacacgccgcaattacttcatgttcaatgagtcttttgacccgttcgagcatgagtctatgtgcatcgagagcttatgttgaacatcactgcgacgtggtttgcggagttgtcggctacatgaagcctctttcctgtgtgaatctacactacttcagctgccccctcacaacttctatctgttccgattgacgctatcgctctaatacgtttacctcacaattgagttctaacaccaacatgtaaaaccacacagctatg

SEQ ID NO: 3894 - DNA, 703 bp, Nannochloropsis_gaditana
gatgaaacaaacacccaagaaaacgcacaaaaatcgtcaaattttgtcaaagcttacttaagaactaagtaaatagaataaatcgtgtggtagcagcaaaacatggactgggtttgacatgctgttttgcacacgacgctcgcgcgtttgtgcacaacatgcatgaaaaaaatcaaacaaagacaccggacgcagggatggaccacgtaaacagctatattgcgtccaggtacaattattccacccgaaaaaaagacagcgacgcgacaacctggttgtaaaagccccgtgtccttctcccaggccggatcaacggaccgtcggctaggaatgttgatggaaagcccggggttacggaaccggaggaaacgcatttcaccacctttggtcgggaccatgcaggacagaccttgcagagacgtggagcaaggagtttgctgtgcgtgtctttctgggaacagcgtgggagcgggggtctgtccggtacccgcaatttgattttggttcttttgctgccctgtcatcctgaatccccccccggtcggtgcaacattcctgctcttttcattctccctttctttttggaaaagacaagcatccttctccatctgtttcatttcagacccttactggtaacagactcctggaattcttcgagtagcctgttgcccaccgggagctgttcttgtgcgccagcacaatg

SEQ ID NO: 3895 - DNA, 703 bp, Nannochloropsis_gaditana
  misc_feature (1)..(223): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctggctgtcccgcaccccacaaaccttggtagtccggtggagtgatctataatcctgcgacattttccagagggaaagattggatctatgttttgtcgcatggcagatgaggtgttaggttgtatacgcataaggagctgaattatatagtaggaatcttcaaggagtatccaggttttctctaactccagtcatgtcctgtaaaaggtatgaatttccgtcgcatcgatttggatagtaattaataactcctagaaacgacgacaaaggccagtatttaggaaggaaaaaggccatttccacggtaacatagcgggtgtgagagaagtatcaggtcagagagaaggtggagacgttgaactttcctagctctgtgaagtatgagcaaaagcgaattcagccactctaccatacacattgcgctcaaaatatctcggataatgcacagggttccaggtgaaggacggcagcgttcatg

SEQ ID NO: 3896 - DNA, 703 bp, Nannochloropsis_gaditana
ggggggcggagggctcaggcgcggaggaggaagaggagggcttgacagaggggggggaggacaacggtggcagtggagtcgtttccacgtgtaggacgctgcgggcctggaacctgtggttctcgagcacggaagagaccttgcgcgccgcattcgggcgtttcggggagatcgagcgctttgatatgctgcacgagcggggcacgcgcaagttccgcggagtgttgttcgtcacctacaagaaggctggcgacaccgcccgagccctgaaggaaatggagggagcccgcatcgacaaccgcgctgtcttcttggccgcctcggagaggacgaggaaccgcgggtcgctgggcaagggagaatctcgctacttcctggtggacaaagccttattctgtcggcgctgccacgacgtgggccacacgatgaagttctgccccaaccctccgaaggccaggccgtgcaccatctgtgcggcgctgacagggcaccaggacgacgactgccccgagcttgccctcggcacgcccgagggcgccctctgtctgcagtgcggagccaccgatcacgaggacagcgcctgcgtacatcgactgcaagccgcggcggcactgaaggcagatgccggcgtccgctgtctctcttgcgcgagactcgggcacggagctctttgcgggccgcatgcttcaacaaacgcgcccac

SEQ ID NO: 3897 - DNA, 703 bp, Nannochloropsis_gaditana
tatccgactcaaggcaacagcctcaaggaggcgcgattgagcaaggctaaagaggcgcctatgcaccatgactgcggggactgagaccccaaagtgctcggctcagcctcccgtcacgtcatggccaacgcgttcccccatacctgtgtcctcctcttcatcaagtgcacgatctcaaatcttagaatcatcagcgacattcaatcaagatgacctggatgttctgttgcttgacgcaaatcatcaaggcaaagggaagttcgacaaattcaaatttctccctagtacttcaggcacaccgagcgaggcacatctcccgtttgcaagctcccaaagcaacggcacggcctcaataaccacagcggggggctctggcctcatggactaccaaacagtagaacatgagagctttttgatggtggcagcacatcggaaaagtcgccgactcgtgtatttatgtggatttgtggcctccctgacgtccattttgctcggatacgatgttggcgttatgtctgtggcacgtaagtacgtggacatgcagttatctctgacgagcgtgcaaagcgaggtgattatggggtccttgaacttggttgctgccctcgggggcctcatcgctggcaagacagcagaccgcttcggacgaaacagggccatcgccctagcctgcctcattttcctcacggggagcgcctgcatg

SEQ ID NO: 3898 - DNA, 703 bp, Nannochloropsis_gaditana
cgtggtgggcttcttctgcgagctgaccatcgccgacgatgacgccaagtggcgagtgatgcttggcctggggaccatcccgcccgtcatcatcctctcgtttttgcggtgcctgccggagtccccgcgctggctcctcctgcaggaccgcgtccccgaagcccgccacgtgctcaagaggatcgtcgggcacgagcaggaggcggagcgcgagctcatagccatcgaggaggcgatccagatggagcgggacgtgacgacggactggtcagaagttctctgcccccgccatcgcgccatcctcctccccgtcctcatgggcctggcgctggggttcttccagcagtcttccggctcggaagcggccgtgtattactccccacaaattctggccgaggcgggcatgtcgagcacggctcaccaatcgctcggcaacatcgccatttgtctttgcaagttcgcgggggaaatcgtggccatgctctccatggaccgtgtgggccgcaagcccctcttcgtctccagcgccctcggctccggtttcttcctggtcctggcgggggcctccttccagtacagcctccctccctcccttctaatgacgtccttgtgtctcttcatggctttcttctcggtgggcatgggcgcaatcaccttcgtcgtcgcctcggagatcttcccgttgcctgtccgcggcaaggcc

SEQ ID NO: 3899 - DNA, 703 bp, Nannochloropsis_gaditana
  misc_feature (1)..(132): n is a, c, g, or t
  misc_feature (377)..(633): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgcggcgccacggctgttttacgcgcgaaatggatcgagacagggtactgccttgcctccaccttaagaacgggaggaggagcggcgggaaaaaggcgggaattttccacgaaatccgagacacgcaaggtcgccgacatgatgatgagcttgagggggcggagagggaggggcgcctggaggaagggaaggagggcgagggggaacatttagacgcctatgttctttcttttccaagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggagggaggagtggaggaggcggtggacgcagaaccgcccgtgcatgtccttcccctctacgcgatg

SEQ ID NO: 3900 - DNA, 703 bp, Nannochloropsis_gaditana
aaatgaaagagttcccaaaaattaagcccaacacatctttgtcgtgacgagcagtattctcagccggaaacggttcctccccccctccagggggtgtgacaccttggaggcgactccattaccttttccaccccctcggataaagacctcggtcaaagttagatcacaatcacttatcggaccattttgggagccgcgcttcccgcttagttggtaatgtttcggtgcctcgtactaagggctccgacgggcctcaacggctctggtgggcgacgactcggagggaccgggggagagaggggggaggaggtaaaagtcacgctagggaagatgcagcaatggacatgatttctttcgattgtaggcatgcatcaatcctcaagtaacatttagaataatggtcaggaattcgcaggagcagtgtgatggctttgaatgagcggagggatggagggaggaaggggggaggaggtataagtcgccctcccccatagcaattattatccataaattcagccatcctcgtgggtataaacttgctagcttccctttcctccattttcattatcctttttagcgctcaacagaatttcattgtgaaaaggggacgctggatatttaaacggccatatcggaatgggtaaaaatcaaagggcacgacggcatcaacaagctcctcagaaacggtgcaagcaaaacaatg

SEQ ID NO: 3901 - DNA, 703 bp, Nannochloropsis_gaditana
gccgtgatgcggacggtgacacaggaagtcggcgctttccaaacctcatctttgtcgcattgcaagacaattggacatctgggtagaccatcatggttgacagatgtaaacaaattgtatgttatagatagctacatcataaatcttccgaggacaaaaagacgagtacaatttcataggatgggagcggttcggcagttacattgcctctagttttttaaaactttgaaattcaacggacttcctaaccatttcttgagggcgctttgtggtttcgacaatacttcctcggcggcaatcgcaagccgggtgtataggctttgacccgacactaccatgacgtaggtaggtaagttgccttcacactgtcagcgaatgggactcgagtggatcttttacttgacgggtactcgctgggcgcgaccgccgagcacgaaccgatcgtgatcaaagatcatagaaatggcttccagagggtttttgagagatggtcatatctgcgtatgcaaaggtaatgcgtaccaagaatacttggggcggtttgggaagacaagataatgacgtgaaacagactaggatagcgttcgttgatcttgctcctgttatgaattctaagcactatcattcgtgtatcgtctggccatgtcaataatcgttcccgaacataattcagcgctttgcagactgtggtaattcaatcatg

SEQ ID NO: 3902 - DNA, 703 bp, Nannochloropsis_gaditana
ccccatatggccagacccatgccacatgatgctgtcttcgcagagcgctacctgcgcgcgcaagcacaagaatgtgcaagaatacgcacgtgcgtgtggatgttgacgagggatgttgagaatagtctcgtcgtgtacggggggaaaaggtggagtatccaagcggcctgcccctccctgaccctgccttggtaaagagggggtttcctcaccacacacgccgaaatcccgcaatccaagggaatacttcacaactattaggaatatgggaactgatggtggcgctcgacaccatttgtatggttgctccacttgaattttcgacgcgtcgtcccagaggggccgaacacgagaaaagactgcttcaagtactgacctcccgcctcgacacaccttattcgtctgcgttccgtctctcacatttgccgaggtttctcgacagctttccatgtggatgaccttttgggtgtgccctgtctctatgtcatagcttggaggccacgctggtcggacagctgggctagattgtgacggcggaaacatttctcaccacaccacgttttacccaccggtgcctaattcctccttccttggaaatgtggcatgccgcgtacacacccttcaagagtcaaaacgcacgatggttgcgtccccaccctcaatggctaccacttccgatgacggtacttcagcaaaggaaatg

SEQ ID NO: 3903 - DNA, 703 bp, Nannochloropsis_gaditana
gacgcgaagtccgatccgcctgcgaggccatggactggatctgggataggagggaggagcgggaaaaggcaggtggggaaagagcaccaaggggaatgaggggaaaaatcaatgatgtttaatgacagcgggtgaccaaagcctattgtagcaacacaagagggaaccgacgcttttccaggcgccacgtttcatgcatgaggtagaagactagaggaggaggcgtgcctggcgcggttttagaatgtgggagaggggaggtagaagtcacgagcacttacttccgccacggccgcgtgcactgccaccatgtccgccaaccgatcgtgtgcgatcgacgactctgccttgactgtgtgtaaacgtaggacgagtggcgatgcttgtgagctctgaaagaaaagagactggtacgtttcttctaaaaacgcgagaggcaagcgggcttcgccatcgccactcccccgcttaatatatcctgcccgcccctatggcccccggtttgccgggggcgaaacccgcgcaatcatggctacttttttgtaacgactttcatgcctacctcattcagctaggtttttcacgactgcgtggattgttttccatgagaacgaaagagtcgccctcctcctacctactccccaaagcggcgacctcccacctccctccagtcaatccctcttcacaaggaacaaccaagatg

SEQ ID NO: 3904 - DNA, 703 bp, Nannochloropsis_gaditana
aaaaaatctatgaatgataagagccttaatctgcggggttaagattacatctacatttatagactcgcggttaccataaaccctcccttgaaagggggaggaggttgaaaagcacaggcgtgctctcattgctacgggtcactacaattcccaagtataccccttgcaagatcaaacctccgcacgcacacatctcggcagccttaacacgtcgtcgacttcctttcaaccacaaaggcgcccctaccccggacatgggcgcgtttcctaccgtaggggcttggcgagcaatggtgtcagtatcctcccactgccttcccctggattcgagacacagcgatgaccgggcctgccacgtgcgtcgtgctgcccaacgactgggcggcttaaaaaacgatggcgaaagccatatgcgtgcgaaatgtgtggttgcagcatgacggagcttttgaaacgctttgaggcaaggcggtagaggcggacaaaaccaacgagtggctcccgggggggttgatgtcgctccctgaagcataggcttgcgtacgtcgtgactgcaacctaggggtatcggtgctacttctttcttaatatattgccacgctgcagacaccacagtttccgtcgtcacgatacgtacgtcgaatacggcgggagcacgctgaaggaggaggaggagggcgccgcgcaccgtaaataataaatg

SEQ ID NO: 3905 - DNA, 703 bp, Nannochloropsis_gaditana
gagtaagaactctctgtaggccctgttaccgcatcacacgcactcaagaaacagtaaaaaaacaaagtcacacgcttcagaatgtcccgagagcatgaccggctgtggtgcaagaggtttccatgctcggggtggttgtaaagcatgtcttggcttgtatttcgcgaacacagtgccctcgctctgagccagcaccggttgagggacatgccaacgatcacgcaaagcagtctatctcggacaacacgcaaatgtaggaagcacacaatgtccatgcatgcacaatttgtggatcggttcaacgtccaaaacagcatagtacggggagacgcccccaaaataaagcgattgttgctctgtaaacagaattggacctcgactctctctttgcttggtgattgaacaaccctagccgcaggttacaagcttcagccaagtgcgagtttcagtccgtgctacggccccgtgggcactgtgactctcttcttcacagttgaagagtagttgtggtaatgcacggctgcctgtccttatgtattgctggtttgctcggggtataaacggtatctgagctccatcaagccattacttgagagctagatgaccttatccaggatttatttgctcgatcaatgactcaaaatgagaaattgcctcactctttgctgtcaattatcccccttacaacattgcagagggcatg

SEQ ID NO: 3906 - DNA, 703 bp, Nannochloropsis_gaditana
  misc_feature (642)..(651): n is a, c, g, or t
caggtaagaatagagtagggcgcagacaaccaacacgtggtcacattttggccacagacgtcttttccctcttctcctcctgcacgttgcctgtaccattgtcgccgtggctatttgaggatgtgagtaatgtgcgggtacggatgagacagtcagttgaagttgtcggagtgtctccgatggggttgcggaggctgtaagcttagttctttcactttatcccacgtcgagaccgagaagtacataacatttgtggcgcctaaggttgattgcgacccgcgttggtcgacagagccagcactagtgcaccaccactgtaaacggaaggggatacaggacctcctcccccgacccgggcaacacgcgcatacgagccccctttcgataccaaaataattacacaaaatgtttcatgaaaagaaatataagaatccctttttgctcttcgaataggaagaggcccattccaaattacaattgcaccagaactcacttagtttcactattccattcctgctagagcaccatgtccgctttcagaccggcccctcctcgacctccattacgtcgtagcagcctttttttgctccttctccgcctctctctgcccgccaacgctttcatcatgtcctgtagagagannnnnnnnnnccttcccccctcattgtccgcgctgccccctcctccgtggctggcctccatg

SEQ ID NO: 3907 - DNA, 703 bp, Nannochloropsis_gaditana
  misc_feature (483)..(662): n is a, c, g, or t
gggagacgtcgtgtgtcgcggagggcgggcgacacagcggggagggagcggggaggttggaggcacgaacggtaggttcccttgcctgccgtccgggagctcgttcggtgttgtcctgtgtaggatgatgcaaaggggctatggagagatccaaattcgatggaaaaggccgagatggctcggttagggcggtgtttcagaagccgtttctggcggtggcacgccttgattggcatcgaagggtgcagacatgtcaagacttggaagcaatttgtggcgtgaccggcgagtgaaagcgcgtgtatgtgcattccgtgtactttgcgtctcttttacacgatattttactctcacgtgcccgccttccccacccactccctcccttcatccttcccttaatgcacttcccttaacgcacacctattctactttcctcctcactaccgtcgactcctccatgatcgcccctcccctctccccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggggtggtggtcaagaaatttggaagccgcttgccgcatg

SEQ ID NO: 3908 - DNA, 703 bp, Nannochloropsis_gaditana
caaaaagtacaaacatctgagcacgtgaccagtggcctcaccctctcttcagaccgcatttcgaggaaagtattacaaatatcgcagctgttaaggctgatctcgtccaatgtttctcttttgttgctgaagtgcggttgagacgtgaattcgcttcatcgaactcaggactgcgaaaacgaaagtcggcgatgcacaaggtcgatgcctgctaccgaggtccgccacaatatgcttcaatatgaggcatatctgaagacgaaggacatcctcatatcatttctctcttctcatggcactgctgttcttaacctcgggagcagatactgacatgttcgtagtgagagtggacatcggtactttggaaggataaaaagattaacctcccccctgcttgcttctcgtgtgtggtcacattgaattacaggcagctaccaccaagctttgcctgccagtcgtcgttctcaagaaaaacagttgtatcatgcatatacagttgtatatatatgtatatataagtattgctttcactcaataaatctcacaggcgcagcacagccagaccatgcctggagctacagtccggcttgttaagcttcctgccctcttattcgccattttcttccttctcgtcgccttcatccatgtttatgcttccaacatcgaagaagacgtactggaggggaaagatatttccagcatg

SEQ ID NO: 3909 - DNA, 703 bp, Nannochloropsis_gaditana
ggaggtgcccgagcatgtagcctgcttatacgcctctgcggcctgacgttttttctttttcggcctgttctctactgcggtggatgctggaggcggtgggggtgcggtgacgggggcagaagcggctaaagagtcaaggacggggtcttcctcatcagacgaggaggcagtgctctgcgctctcttcaccctcttcttcctgcccgtgacgggccccgcgccctccttcatgcgggaaaacaatttcaagtcctgtgtcgtcttttccccctgtgcgtgttatgatataagcttctcgtttcagttgtcgatcgtattgcggccttgctcgttgggtgatcgaagctttgtgcaatgtccccctgccgctttagcgatgatatcaacgaggtaaataaaaataccagaaccctctcgggataaagaagacagcctgggggattgactcgtcttaacaattcaacagccatggtaaggtgggatgctcgaattatgaaaccctgtgctttggccaaacactcttttgcccaacttgcagccgagatgatgcgccggaggctagcgagcagtaggatgtcaaaatggaggactttccttcctctaacttgcatttttcacgaggcaagctattgaacattcactcgtaaccacatgctatacacacagaagctgcgagcgccctggcgcgttttgtgccaaaatg

SEQ ID NO: 3910 - DNA, 703 bp, Nannochloropsis_gaditana
tatggcgaaaaacaatcgaaacaggtgcgagatcagtgtagctcgaatcgaaaattgcattttttccatttgtccttttatctgcagtctgcgtatcagtgctcgctagttgcagtaagatgacacgccgtggacgttttattccgtccatgagttctcttgtgccttaacgtcccaccggatctttcacagccgctgtgtcatccaaatattcttaaaatactagctgtcatttcccatcgtttgctccctctctctgacttgctggcttatttatttttgtgaacagggcgtgaggcaggaggtcacctttggtacagatgataggacagccgtaaacacttctatgagcacgcaaaccgacatgaagctgagaaagggtcgatggagcctttttcacaaaggcattaaaaaaaaaacttgtaatggagtaagcttgctcctcctccttgttgcggcatcagccctgcaaagctctctagcgtttgtgctgccactctcccctctggctaatcccgcatatcgtatcctcagctccgctgttatcggttcagaatctatctcatcatcttctgcgaagccagttctcagccctttcgaaatcaataaagcaattgttctggccgagggtgacaccttggcgttatttagtgtcatggcgaagcatcttacaaacttcgataaagttaactgcgcgacgatg

SEQ ID NO: 3911 - DNA, 703 bp, Nannochloropsis_gaditana
ggggggggcgggagcactggcaggcgcagggttgggagccggcgtaccattactaaaccagagtgagggaaaaacgggaccaatatcgagaaatttacattgtcagtgtactttggtggcgtgatatcaagagtataggtaagagagttagtatgacagcaagaagaaaggctgaagcgaggcttacctggtggcagtagcagcaccagcctcctgactcgcagcactcgtgtctgcagatggtggctccgacatgctgtctcagacgtgaacgatgcgtctgaagtcctgcacgtgtacaaacgattagtatcggctcgaaagcacaggcataagcaagacgaaaaagctactagccaggagtatgatcgctgacctccccatccttgtcttctccgtcctgcgcagaggcctgatcaaccatgaaatcaaaaatgccgcagtcccttgtgtgtgcatctaagcacatgcttcatacagatatgaattaaggaagataccacatattcggctgagcaaccctcgggcaaccactcaagcggcggcgcctctctcctgctgctagcgaaggacttgacttgctagctgcctggggtcgtagtgtcagatgactgtactgattttcacgctcaaacccgcgtcgaatcattttacaggccggagaggtcacagatcgatagcttactgaggtgcatacgatatg

SEQ ID NO: 3912 - DNA, 703 bp, Nannochloropsis_gaditana
  misc_feature (1)..(254): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacccaccgaaatacacagcgcgtgcccgctgttcctgtcgcgcaaacctgccaatgacgacggcctctgattctgtggagaacgtgctatcgagagcttatacgtaaaacgtgcaaataaaaaatgcgggactctaatcgagcaaggggggcgaatggcaatgccctagaggcgaaacgtcaacttgccctctgcacgggggggtggcgtctggggggggacgtctgtttaagagctaaaattgcacggacatggtgtactgcctctaatactggcttcgtaacattgtgtacagcattccatctacgcaggagggtagaggtatatcgtcctggtggtttatttctttcgatcggctcctgcgcatacgtagcgctaacatcccacctccccaccctcctcctcgtgcccaacttggcgtgaacttcagtcgcaccaacaggcatg

SEQ ID NO: 3913 - DNA, 703 bp, Nannochloropsis_gaditana
aatggaggaagcaagaatggacaaagagtggacttgtccgaagaaagtagcctggatatgctcctagattcatcggatgaggagattgccgacgatgaggatggtaggtttccttcctgcagtatgattcccaaacctttttcttgctcgtaggtgtataatatgcggtgcttgatacatagcctcactattactatcattttcttgcttacgtgccgccgcagggggttctgctcgacagaaaatccgactgaatgacttggatgcccggcttgccgcgctggaaaaagaactatcctcttcttcctcctcatcctcctcctcctcctcgtcgtcgtcttcctccacgccttttccctcaaatgaggagggaatacctggttttgagaaagcggaggaatctgaaggcctgatcatcgagaaaggaggggctgtcttgaaaagtcgcctcgccaaggaggcagccatccctcctctccctcctcacctcctcccactccctgaatgtaagggaaaagggggcggtcgcgtccctttgccggattcggacggacgttccgggggaaggaaacgcctgacccgcaaggagaagatagccagcgacaggatgcaacaaggaaacggtggtgcgcaaagcaccggggatccagcaggtcccctccctcctttacagccgtcctcttctgcttcatcggccggtgca

SEQ ID NO: 3914 - DNA, 703 bp, Nannochloropsis_gaditana
atccatttccctgcatcccccatagccctttcgtgactaattagacttcttttagccttgcacaaagctcccgggcgccctgattggtgtacgctgcatgtctcctgccccaccacatggccctttttcccttacattacaggtactcttctcacaaaagttgaagtgggccgcttcctcagccggccaggacgtgaaggaagtcttccgtcgccgtctacttccgggtatcgaggtccggcgcatcaccgagccgtcccacgtcctgcacgggcagtatggtacgtgacacagggtccgagggagaaaagccaccattcgaccgctgctctcgatgccgtccatgtccttccctgaatccggcccgcttttcccgcaggagtgtacgccacgcgggccttcgcgcctttcgacgtgattggcgagtacgtcggccgcgtcgtccccccggcggtgtgcggggactacgtggcaagcatcgaccaggacgacgggcgcttgccccaggggtcttctccctggggtgtcgattcggccttgtacgggagtgagtggcgccatggcagggtgcaagggatgccctccacgttaccgctccaggggctcgctcccgcaccggcccatatccctcctgaccacccttgatcttgccttctcccacattttccacagacgaagtccggatgatcaaccactttcacca

SEQ ID NO: 3915 - DNA, 703 bp, Nannochloropsis_gaditana
  misc_feature (35)..(700): n is a, c, g, or t
acacccacccaccctacccaccgaaatacacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcg

SEQ ID NO: 3916 - DNA, 703 bp, Nannochloropsis_gaditana
atgacttgtcccccacatgcgatagagcgcaaggcggccagaacgcccatgcgctggaaggtcgagtcgagcagcgttgctgtgtccctaaatcctgggagaaagataatgacagtgataccatgatgaataaaaccaggacccgataggagatgagacctatttatgcgcctaagatattcagacaaccttgtagagtggtgaatattcctttttcaatccatcgatgcacgtaattctttcccaagtctcacctgctgtaccatacgcaagcttcttgccgttcggcggagggacggccattagctcggcaatcagacctggaggcaattcttgcgacgaagacataactttcgctgatgatttgagttattttcatgggcatgattagttgttagaggggttgcggataagaaagcgacctattcgcgctaccgtgccttagatccggcgatctcacgcacgacagccaaaagttagcgagcataaaggaaagacttctcgggaactacctaggctgctgaatctgcatttacacacccacattacccgacaaactgcctggtgcgcgattgctgggagggtttttgagtgcttcttcattcaaatcgggcaaatggcgtgcggaccactcccaagaggagtccaatgaacttcttgtcccgcttacatatagacacttatatagtaggggaaaaacatg

SEQ ID NO: 3917 - DNA, 703 bp, Nannochloropsis_gaditana
cacgtgcttgtctacggaatccgctcttgtacattcgtatgtatcatgactggattacaaaaagggcctggtaacacttattttgtgccagtcttacatccagcttttgaaaattcgtgcgtctacttcaggagcgtggcattcatgtgtgcgggggctaggacaagggttttggtcctttgtaaagatgtatatacatttgtgtttatcaaaagagaaagctcagtaaccgggtatcgagcaggccacaagaggcacaggacacaggagataaaaaataaaaaatagtagcggcgatgatatattcaagcttttcagcatgaatgctgtcgtagacactcacaatctttccctttccagggtcgggcacgcttcgtgcgcacaaaattttatttctccccccttcctctgacagtggcagtaacgtttgctaagtgagagccgatcattgctccttcctaatatacatttcggggccaaaatggctcatcttttattctttaaatcttgttccctcacatcaaacactcagctattcttcctctcgctcgtcgcactccacatttaaaacacagcaacaaatggtagcattgcgcatggttttccttcctttccggccaacgcattgacagcgcaggagcacagccaatgttttcacgatatgtttcctccccgatgtatcgtcctgctattattcaccatg

SEQ ID NO: 3918 - DNA, 703 bp, Nannochloropsis_gaditana
ttttatcttggctagtcgagagacctgtcgatgaatagggaagtttgtgtatggaaatcaactttttcctccctcaaacttcacaccccacatgatagaaagttcagtgcacatagtcggaggtagtgatttttctttcatatcgcgtggaaccccagaattatcaacgtcagtaacggatatttaaaccttcaaactaaggttttgatgacgttgtcatttctgtcgtgctgaagtttatatcagtcacgcttccgcacgacaattgcgttgggttttttgatatcctttacactattaataattttcatcttttgggacacactgtttcaccatttctttcggatcttttcgcactagcttcttcctttccttaaacgctcaggcggcctcaagaaattccggggctgatcatactatttcagtcgcaaagatgctttcataaaaaccataacacaactgtcagtcgtataaccttattcaaatggataatttaaatgtgcttcacaatcactgtctttttttgataacgctatcgctggtcgtccctccacacatctcgccaagacaggggaccgagacgtccccaaggggacgatgctcctgtaaaaccccttctcaacgaccgaaagtctctgatacaattatgctttcgttgtcttacgaattatgtttacacaacacagcagggtggaggagaatg

SEQ ID NO: 3919 - DNA, 703 bp, Nannochloropsis_gaditana
ttgagattcttctttgaaaaaccagtttttgatacccaatccttacttgttttccaaaagaacttttcctgtatgagatgtgcgcgtcgggtggttgtcggggcggatgttttggcttttggggacgggtgtcaccctccgttaggcccatatagccacggcgacctgagacgtcagcgactaatcacttccccatcgaatgagaaggtacacaaagatgccagaagatgcattgtggttgttgattcccggccaagccgtgtgccacctgctgtttgtgtcgagggtggggagtgctgcacgtttcatttcttcgtgacggtcgcgatcgagtgcgtgcttcggataggaaaaagccgcaggttgaaaaatgcgcacgcccccttaccctggggcaagacaaagaggctgccaatggcacgctcgagaccctcgcaaacccatcgcagcgcattcctatgtcttctcacttcttcacgatggcttgtagtggtcgccagggatgtattccctctagtatggttttgagcacggctctgatcaccctgtggggcacgcaaggaggtgcatcacgtctactcactggtggcatgtccccgctaacatgcaacaccatggcctgcgtttgaatttcagaggacgggccgtacataagaggctttactcacccggttcccttttctattcacgtcctccatccagt

SEQ ID NO: 3920 - DNA, 703 bp, Nannochloropsis_gaditana
cctgtcatccgcttctcacttcctcttctttccgtctatacttcctcacgcctcgactccgtggtaggctgcctctggcgcggctttgatggaaccgcacaggtatatatcaccggagcgaaagccggtgtcacggcctaccaactctgcctcttcggcgtctagctactcccgaccgctggggcaacaggggggagggagggagggagggagcgaggcagggagagagggaggaggcatccaaatgcaggcccagcctccagggttcaatcccactgaggacggtaggaggggcccgggaaattcagtcgggggaggagtcacacaagggttatgatatgatttatgcgattcctctgcctacctgccgtccggctgcactcaacgagacactcccgggcacgccttctcatgtatttcgtcccctcccttttcccccctttctccatcatgcagatgacgacgttgagtactcaatctatagtttccggaaaccgaaccaacgtgatgcgtttattctgggtgaggtgtcattttacacagctggggccgccggattgttagctctggcagccatcaaaatcaagacgtaaggaggggaggaaagggtaggcagagggaaaggaaaaaaagaggactgtaaacctgtcaatggacttgaaacactcagcaactcaaattcctgcgcgttgcgcctcgattt

SEQ ID NO: 3921 - DNA, 703 bp, Nannochloropsis_gaditana
cattctcatcgctggcatcacgaatggtttgtgcacaggtagcttccttcatgatagccctctttcatcgtcaatgtcggtgaattcgcgaatcagcgcagatgtaacctacctgaagtcatagcatatttccagaaaatcattaatttttttaaatggcaatgctttctacgccgttactttgcgctttcggagatgaaaatttaggacgaccttagaatcaaatttgacgatgtcaaatagctttcgatagcgaatagattttcgaaaacgcacccagtattaagtaggcttgcagaaattggagaggggaggtttttgaaaccagccagttcgagtcttgcggtctttatggcttctttgtgtcgatttagaacatgaatggtgtccatagccgtaagtcaaggtcacagaattcttttcattgctctagcaagggatggtgttatcatctatttcctgaaaggtatcaaagcgatggaatgaataagccaagagcaacgggagactcgctcggcgaacatagggcagtaggcccaatacatgcagcgggtccttggggaccatggatgggctctcacgctcaacctctatctatcttctacgcaaattttaatgaaggatactcagaaggaagaggaagcggcgcaagaaagggaaaaggcggacacatcagatcagcatcaggagtcaaagcagtatg

SEQ ID NO: 3922 - DNA, 703 bp, Nannochloropsis_gaditana
aaaagggacgcgggtaggccaattaatggcaagtgttcgcacatgctacgttcatcaatcaagcctcagacccttatggaacagaggggacgacacgagcctaaacgctggaaagcgcccgtgaacaaactggacattcaaagcccatgccattgcaacctctcgtaagagatatcgcaagaggcttcgcgatgcaggtaatgtggaatgcacccacacgatgcaacaagtagggcccgtgcagtatcatgtcaggaacaagcctggcagagcctcttgagccgcgtgacagaggatgctaccgcctttcacaaacggtcccaaaatgatgtctggggatggaatctttccgcatacttttcaattaagcccttgccgtccctgtgaaaaagctgccaggcatgtcatgcgttccgtgaaatgtgccgcaggacagcaggaaagcgaacagagcgttttcttccatgccctcgcctatcgccggcaagctcaggctccacttgtctcgcccaccccccgcatttacggggaaagcggcctcgcacatgctttgaccatgccctattggaatgatgattccttgtcttcgaatgcggggataaattatggcggcgacggggaggtctacttgctttgtattcactcgtgtatctccttccacaacaccactccacagccgtctagggagagtttacacacaatg

SEQ ID NO: 3923 - DNA, 703 bp, Nannochloropsis_gaditana
atttactcaaaacatggcaaatttcgtgataaaatcgtcagaaattgagaaaaaggtgtatactgggtgacctaataacctcccggaaagcaaaaatgttgcgtcttggacgatgcaagtaaatgagaaacaaaatctgccgaaataggatttctccccctatcgggtagtattttttcgattatttattacggtagagtctcacatgccaaaaatttcagatgccgagaaaagtgtgtttttactttttgtacttatcttgtggcctgcaggcaagagtacagatcaaaaattgtcccctttttgacttgtgctccacttatctcatacataattgcacaccttttcgctttgtatttcacgttgatataaagatgtagattacgcaaaaggtttttttacgccagcctccgtattgattattttgttcgacctccatactcgctggataagcgcttgggccgtcggtaggaaaggcgagggcgccagccacccaaagatacttcacaacgcacgttccgtcttgagttgccttaaacgcagccctgcttgtgaggaggctacaaggtgtaatctgcattttgaaactactgtttgtaaattgcgtttatttttctttttttacgtcatgtgtcaacagggcatcagctcgcagggctgaggcttgtcaagtatgggcaaaaaaaaaaatcatgtaggagcc

SEQ ID NO: 3924 - DNA, 703 bp, Nannochloropsis_gaditana
agaggaaaggaaggaggaaacaagcaagtgaggacaactagcctggtcatctgctcagaaggtaatgatgggggggggcgagaggttgacgcttgccatttgcagagaatgagccatacatgatcctacagcattcccaggacaatgtactgcccgcgtgagtcatggtcgtgaacaagttgttgaagcacaagaaagctcttttgttgagcagagggtgtcggggagagggaggagcaagaaacttcggaggcggtaagaggatgtgatagaggggagtgtgaggccccggtcttcacgctgcgaatcaaataataaaccacgcgcattgaaaattggctcccatgaaaacacgtgagatacgctgtcacgagttgagcaatcaacacaaattaaaccccagcttttcaacatcgagatcagggacgacaattgacctcgcgtctgtttcaagtcactttacagtccccggcacgcccgtcctcctggcaggacgctgtggctttgcatgttccagatgcacgatacttttatatgatgtcgcatgtcgcatcatgggaagaaagtatgttggcatttcgcgtccactcgcatgactggaaagctgcatcgatcgctcgtctgcagttttgtcgcctaaattgcttgttcctttctcaccatttttacatcaacagtgcaaagactttactggagcaaaatg

SEQ ID NO: 3925 - DNA, 703 bp, Nannochloropsis_gaditana
tcaacactcccaccgccagccgtggtggatggattactatcccccggtgcgtcttcaagaggcatgtactcggctaagatggaacggactggcgcccatgacgaagaggggagagggaggaaggcaaagagggcggcaaggatcagggtgatgtcagccgagttttatgttttcgtgagtgtgttagaggaacggctgaagatagacaccacgagagaggtagcaccacggacaatctggagcaaaggccccgagggtttgacacacagagactgcctgcatccgtaccttgctcgcgcatctgttcctgtgtccgcttccaatacacgaagcccgccgccgtcatgcccaagatcaccaatgtgacaatgccgagcacaccgccccaggacacgcccccgccgcttccgcccatctaggggcaaaggcgggaggagatggttcgaaaaggaaggggaggggcgggtgaaaacaaagggggattaggggtgatcaatcagggggaagccaggagggcatggggatcagaggagcacggggcaagcaggagcttcgccggtaaggtccatgtagggaagaaggattgcggtaccttttgtgagacgggccggtagtcaccgccttggacgcaggtcatgacctggtcgggggccacgcccacgcagttgcacacctgggtagggaagtgggcccgaggagcatg

SEQ ID NO: 3926 - DNA, 703 bp, Nannochloropsis_gaditana
ggctatcggaccgccaagcgcgcgcgcgtcggcggggcttggcgtcgtatcgcgcctggccgcggatggtcgcccgctctatcgcggcccgatttcctatgatgaggcccgccagcggatcgaggcctgctatcggccctatcaccagcggctgaaagctgaaattgcggcagcgcgcgccctgttcggcgaggccatcatcatcgactgccactccatgccatcggccagcgcgcgtggggccgatattgtgctgggtgaccgctatgcggcgtcgtgctccagagcactggtggcgcgggccgaagcccatttccgtgatctcggctttgcggtggtgcgaaaccggccctatgcaggcggctataccaccgaacattacggccagccggctgcaggcgtgcaggcgctacaaattgaaataaatcgcggcctttatctggacgaagccgcggtcaccaaatcccatggcttcaccgctttgcgcgaaagttttgcggagtggacgggccgcatggttgcagaagcgaagggagtcagccttgcggctgagtgacttggcagcaactccattgtctgaaatgtaattgtcacattcacttattgggcgaatgggtatatctaatttggggtgagttcatttatgaacgaatccagtctaaaacagtgatgttcggactgagttttaagggataagtcgatg

SEQ ID NO: 3927 - DNA, 703 bp, Nannochloropsis_gaditana
tccttgcatccaaggctcacaaggcgttgaaaccgattttcttgacacttttttggggtaaccgttccattgtctcctcatgatattgaagagctgtgtctctttttttgagtgcggatcaccgccctgtctggtctctcatttcctggcgccttttgctgtcccttcctccctcccttcctccctcccttcctccctcccttcttgcctcccttcctcccttcttcccatccctccctaaagctcctccgtccgcctcgattgcgacaacaagcccgcccctgtggatttcatccacctggcttatggctacctacccctggcttgggccgcgaacacggcgagctggggagagttctttttgcgcgaggtcaggccggaggaggagggcagtcgttggcctggagagaggggtagccgacacgctgtcacgggcgtggttgtattctatgaagaatgtccatatcatcatattttttgggctttcaaaattttgaatgtttgagatttgtgccgttgccttctcccagctcgggcgtcgtggttgatcaatgtgcacttcgaaatcggggttctatgccctagttttccgactcacatgccgacttttcccaatctctcccttcctcctgcctaaccccccctcccgcctttatctcccctccacgcccaggcggtaaacgttctccctgtcaccgccatg

SEQ ID NO: 3928 - DNA, 703 bp, Nannochloropsis_gaditana
ggtggaaggactagaagaaaaggtggaaagggaggaagggaaagaggagaaggaggaagttgaggaggtcgatgacggtcaaccgcagcttttgaactatataggggaggggctggagggggacctattctacgagtcggtgcgctggcaggtatggaggagaaagcttgttgcgagggggagagtttttcgaaagggagtggagggcattgacatgaagggaggggggagaaaaaggaggagggaggagaggagtcaacggcggaatttactgccatgtgcccgtcgcttcatgagtgcacgggacagatagactaattaatggccccttattgtctttcccgtgaactaggggcaggtctttcggatgggagactgcgtcgaggtcctgctagcggggtctgggacggaggaggctccgcgcggttttgcggaaattttgtggatttggtgggcctcggagggacaggaggtgggtagcgccattcaggagggcggaaggcgaaacgggtcggagaagggcgggggccgtggaaggaaagagggcgaccacggagagagcagtctctgcctaggcctgactaacccttctctctccaagcaggcggcctccgactccgaagccaccgacaacgacgaccgtgcttcctctcagtccccttccccctccctctccgcctcctccgcgcctggggaggccatg

SEQ ID NO: 3929 - DNA, 703 bp, Nannochloropsis_gaditana
attaagtagaggtgtacaacgccgtagacgaagcatgcaactggatgcgggagtgagcagcagtggaggtatggcgggggtgcaagggggagggtggataagcggcaaaaggggctagaaataccgaaaaaacgatgactgaacccactggatttttctagtttcctacggtcatatctagatactagatggctagaggcgcaaaatttcaggctgacgccttactttcatcgaatgcttgcaacccactcgccacacaggtaccgcagacgagtccgctgtcaacaaatacgaccggttcttaaaatggcttttggacaacggcgcacactttcctctactagaattgagggtatggaaatttgtagacagagtttgggcaggacaatatatcagggggatctccttgtttcaatatctacatgctacgagccctccttcgcttaccgatgttttcatgccgcttttagtccccccaccttgtcggcctttgcgtgctaagaacacttctttgtttgtatcatttagatttgaaagcttgtccctcatttctgcttcctcgcccctccccttgattccttttgtcccgtggctctaagcctcgattcccctcttccccccctcatctatacacccacatcatccgattccatctgcttcccacgtcctcttgcacctctttgtatcctcattttctcaggag

SEQ ID NO: 3930 - DNA, 703 bp, Nannochloropsis_gaditana
attatacttacaacctataaggaatacttacaacctataaggatgcgagtccattgtggttcaatcaccatccttcaatacgttttcctcgtaaattttatcacgttcccatcgcggatcacttttcgtaagacacggtccccaatcagattgcactcaaacaccttttattcaatcaccgccctcatgacggttataacatatttatttttcccaaagaggtgagtcatgaaatacgttcgcgagactctgttcctcccccaaagcgtccatcctaaatgcccgttccaaacctcacgccgcttgcagtccttactttttgtctgtgctcctataccgtagtgttactgtttgtttgccaaaaagtgccaggataactcgcgtaatagccggttttgtcagagtgtgccacatgcttttgctgagtgtcacaagcgtatcagctccagttttgtgacatatgagggcagctcaacctcctccgtgttcaacgcatggcgaacttcgactagaatcaaacgcgctccaagcctgacttatcctgtcgtcctacgcccagaaatcgaatttttacttgacgtactcattatttctttcttaaaatacgcaatttcgtaatgttctacggttgctggttgctctttccccccactccaactggttcctttttcatttcaaagctttggcttttacgtgggccatg

SEQ ID NO: 3931 - DNA, 703 bp, Nannochloropsis_gaditana
  misc_feature (578)..(678): n is a, c, g, or t
cttctagaagaccgggacgtgggccatggcgtgcacgaggaagggacgaggtagtcagtgagacgatgagaaaactgacttctcgcattccacggacagggtgtattccaagtcattgtggcgcccaccgtccccctcaggtacgagccactccctctgccaccctgcttctctcgttcttcctccttccccctcttctcctttcccctagaaacagtccaccacttccgttcctcgctcctatcctccctccctcctccccttcggctcctgcgctttttcgaccaggactcgtgtctcatgccagtcatttctccctcactcgctccctctctccctctctcccttgctccctccctctctcccttatttcattcttcttgcgcattttcctgaccgcaggaacgagatcctggccttctttggcggcaatgaggaagggaaaggggaagggaaggaggaagggatggggggggcgagtgacgagcagaatgattggacacggcgtctccagctcatgagcattggggcaggtagcgggtaagaagggaaggaggagacaaaggggctgggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccttcttccttccctccctccgt

SEQ ID NO: 3932 - DNA, 703 bp, Nannochloropsis_gaditana
  misc_feature (264)..(273): n is a, c, g, or t
gatccgaatactctgcttgctttgcttcttccctcctcctcctcctttgcccgtgaccctcctgtcatcccggttctcgtcgacgactccgtcaagccctcatccacttcctcaaccccttcctccttccctccctcaccacggcttcctggtcatgttcttcgccccgccatgtctccgcgcagcacatcaggcgagcccccctcccaagacctcaaactccctccccctttttcccctcccctttgtcttcccttcgctgcnnnnnnnnnnctcttctctgggctgctctcacggaccagcgcgaggctgcgctttctcccgcccgtgctctgagcaaactcgccgatttcttcaccggcccctcctccaccgtgcgctccaccccttcgtccgcctccctggtgcgtgatgaaggaagaggctttgtggattaaaataggagggagggattggtcggaggggagggagagaagaggctgatagaggggaggagggtttgagagcgggatcaaagaattcagggcggcaggccaggggctatgttcgtaatgttgcgtgagcctgagaccctcaggactcgacgggattgatgcttgtgactgatcgactccctccctcattccctcccttcttcctccccttctagtctacctcccgtcagcggcgcgcccgccccgtggttgtggttttggacgagatg

SEQ ID NO: 3933 - DNA, 703 bp, Nannochloropsis_gaditana
aaggggggggggagtgaacgagggagggatgtgtagtctacacggcggctagcgataagcctgcactcggaaaaagcaagatccagcaacggaggccacaacaatgacaagtcgatgcagtagagcacgtcttcacgacatgtgcccgtgtcttccatggtgccgcggtggtataatgggagattccgataggggaggatggaagaaacatccaagttgagccgacgcgttaaaaccggcagtcgctgaccttgacgagcgagggcataaaataaaatgccaccaaagcacaggatgcccacgtcaaggcagcttcatgaaaagcatgcacgccacatgtagtaggggcagctggactactgactactggtgcacagggaagtttgcgtgctccctttggtgggatgtggccctccctgcttcaattggccaactctcggtctgcacgggctccccgcttttggagaataaaagtccagcactataccttttcaatgatgaaagggtattctcacactgtttggtgcggttcgcatgcggagcgcatctttttttctaacaaattttatcgttgttctccggcgttattgatgtcacacacacagcctttagtgaagataccaacctgtctcattgagcacgcatggacggaactcgtccacacagaacgaatcctctcctccgcgctagcttgaaaaggccc

SEQ ID NO: 3934 - DNA, 703 bp, Nannochloropsis_gaditana
aatcaacatggaaactctttgtctgttagggtctgtgcgagttagtttcattaattgtgagaaaatacggattctcactgtagccccacagtcaacaaggacatactgggcatgatatctgatcaaaaagtggagtactgggtaaattcgtgtcttcaccttgcgagcctgcctgctcatatcggttcgcagttcaaaaagtaacggccgttaacggcccgactccgccccgatccttctttgaatcgctgcatctcttgacttctctagtaactttgccttggcctcattctttcccctcataaattgttttacgattcatcatgtgtgataggaagaatgcgtaagaaatattaaaaatatggagtgtgccatgttgttagccttcttgttgcatctttattccttgtccgttgccctgtgctctcgcccctcaacgtactccttactcgatatccttggaaggatcgacttagacgccgactccgattttcactcgtcttatacacctggctcctcctcttttgtaaaaataatggacagagtacttcagtgcactttgttctttcttgatgaggtcttaaaaataacatgcagcgcactttgtacgcttgatcttttccttattgcatttccttgttcgacgtacaatcttacatgtagggattgtgcgctgcatgctgattcagtatctctcataatg

SEQ ID NO: 3935 - DNA, 703 bp, Nannochloropsis_gaditana
  misc_feature (1)..(697): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatg

SEQ ID NO: 3936 - DNA, 703 bp, Nannochloropsis_gaditana
gccttcgtcatgtttttgaaacaggtgtatgcttatgcacatggcaattatccatacaaggaaatgcatgacgcccgtctcagacaacatgtctgcgaacgtgcaagcagagactcgcggagtgaggaggttaaggcgtggcgggcttcgacactcgtactgattgacagtcatgtaaaacattgtttcctgcatccacatggcatgttcggttatatgtacgtttaagtaaggatgtttggtacatggatagctttttggagttttgggcttgtattcttcacattttacgggcattcaagagagtgactgctgtccgatgtcctgtggctgacgatcttcttattctgatcctttataccacagcacggcctcatacacactgatgcacaacaattttaaaatcagtccgtaagtcacaaagatgtctcgcagttcttcagtacttttattcatggcgggcgctgcgacagcctccgtccttttcctcgccctccaccatcagcgacggcggcaacgccatcaaaccgccccttccatatctcaatcttcacattccgtatcctccttgccgccctcgctagaacatgagctgttcgcccgagtggtctcttttttcggggaggaatcgtttcctcccatccaaaaagccttcgtcgtcgtggtgggcctgggaggggtgggttctcatgcggcacatatg

SEQ ID NO: 3937 - DNA, 703 bp, Nannochloropsis_gaditana; identical to SEQ ID NO: 2298

SEQ ID NO: 3938 - DNA, 703 bp, Nannochloropsis_gaditana
actgcaagtgatacggacctgcgtaattgacggagaaaaccagtataaaatattagagccagtaaaaaggagtcaaaggtggtacactggctataaaatgttcacttttcagaaatgtagcgtctttttaagggtgctctcggaaatgagaaggtgaaataagtttctggccagagtttctggccagtgccaggagattaaacaggcgccgatgctgcccataaaaagcatttctatcacaattttgtagaaaacttaacaaagccagagttatgctgccttctttcacgtgattgtatgttgcgcacaacatgatgcacaccatcttttatgagccaggggggagggtttgccgcacccctactacatgccccagcccccgcaagttgcgggccgcaaccccaaccatttcgtacgcctcacggcgcttcatagtgtcggcgaggcagtgaaaagtattagtgagttatctggccattgtgtggcgggcagaacaggtcccgggtaataatgtagtgacatctaagactacgtttttggccaagctggagtctgtcaagccatacccgtggacacaaactcctggtcgctgttacattttttgggtttgtatggtctttgtgtatgcctccatctctgaaagggccgtccgcaatcacacacacacacacagggagagatcccgaccaggcagtaggcaatg

SEQ ID NO: 3939 - DNA, 703 bp, Nannochloropsis_gaditana; identical to SEQ ID NO: 188

SEQ ID NO: 3940 - DNA, 703 bp, Nannochloropsis_gaditana
aagcatcgcagcacttacaaccagaccaagcgtgcacaccttccaacagttgggtaacaccatactatcatggccttccttgacgacacgacgtccctcccttacttccctcccttctcgtgcttcccgcatccaacgtgctgcgaccgcgggggaggacgacagcagttcgaagtcctcgggaaataccggccaaaagaacaagggtttgcggaataataataggcaacggcggccccagatattcattaagaaactccaggcattcatggggcgtttccgaacattcatccgcagcaaaatgatgttgaaagtgaacggacgccccattctcaaagtgacaggctggcacgcttcctttgccctgatgctggccttcgtcctcctatcctcggtaatgcgggggtcaggaagggctgggcgcggggtgagtcctgcggaagtgccctattcggattttctcaagctggttaaggagcatggaccggacgtggtgtcgcggttgcggattgcccccgaccgcttcgacttcctcatgaacggggccccctctttcacgcgccctgtcaaggcacaccccgccttgctcttctttctggacaagtacaacattcctttctatgccgggagccccagcagcaagagtttagtggcattcttgctcttgaatttgctgccctttgcctggatatttttgagcatg

SEQ ID NO: 3941 - DNA, 703 bp, Nannochloropsis_gaditana
  misc_feature (1)..(645): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctggcctccagcgtcctcagcgccttgtctaattttgtattccccctgacagtac

SEQ ID NO: 3942 - DNA, 703 bp, Nannochloropsis_gaditana
cggattacacactcctccaaccctccacaccttccctcccgctgcatgtcctgaaagacgtcggaaagaggtagctgcctgttgaggaaaaacgttcccccgctttaacccgactttcttccctaaaatttcaaattttatgcgagcctccccccaacacggctccctttccaagcttgtgcctgcgtttgcgaccccgtctgcgcatgcatcttcctgactaagctggcgaggcagcttcagatgcgcacaacaccttgagtgtgtttttttgttttcccctcgtggtgtcatagtggggaagtaaagacaattttcgcgtgggggggagccgggcatgatggtatcttgcggccctcgcttctcttttccgtcgagggctgtgtggccctcagctggcgacgatcgaagaagaaaaccgtgtaacgcgtccgcttcggatgtgcgatgctaggatgaggaatattgcaaatgttgccaatgcagcgatcatgtagttttcttgtgactcggctcactgtcctcatggcgtgtgcaggaccctgttcactgtcagtaccctttcccagcccttctattggtcgctcgccttttttttccgtcgtaagcagaagtattccaaaacccacttgacaggccgcatcttctcgatatctaacccaaatataacacagataaccttctctcccctgctgcaaaaatg

SEQ ID NO: 3943 - DNA, 703 bp, Nannochloropsis_gaditana
gccgggagtgggtgctggccaagaaggaaaaacagaggcgaaagggactggatgtacgcgaggacagtaaatatacggcacggaaacgaaaagatcgattgtaataggtgaaacgcagccgtaggtcgtggagggaggaggttaagactgtacaaaagcaataaattttgtgcgccccgctggaacatttgacgcctatgtcgaagtcttgatctatgtttctcttccttcgacggttgttgacatgaatacgataataagtttgagagaagtccttgattttggtcgagcgacttggagccgcttctaggggaggccgatatgctggagaggccgagaggagttgctcacacgatacaccgccgcgaatcagccttactcttgtcttaaaaagcaccagaataaggcggcattgacatacgtttgcaatggtcaaatcattcttttctctcttctccctgttttaccatcgcttttctttaggaagccacagggcgaggcccgttccgtaccaatgaaggtcgctgcagcgtgccaacgcctaagacacgatccccgccggtacgcacggctccggcaattatgcatcccccgtgccacgcatggcacaccactacggaattttttcagtttcggaaaggaggaaagagccaacgagaggggggggcgtcgtggcgcctcagtgccccctcgccctcccatg

SEQ ID NO: 3944 - DNA, 703 bp, Nannochloropsis_gaditana
ctgtgtttgcctgccccttccctgctgcctggacggattctttccatccgacctcccctgctccaacctagttatcacttttaccttgccacaagtgaagcagcggacaggaatgatcatcctgtacacgagtggcaggtgcagacagacttgctgccctcccggtgtatcaacccctcctcctgtgaataaatggcagcattgggaggaggcaaggtcaggaaaaaggatcatgtcccagacgcaatcttccgtccacaacacacacaaccgccaaaaaagggacaaacaatccccttcatacatcttggcccccaagcgatgtggtcgtgcaaagccacctctcgccctcgcttccccgtgaaggggaaaagccacacagactcctcaagaattgtagccagcgcgcgtactgcgcttcggtgcctcaacggctctccgtgatgatcatgcgggctctacgccgtccacgattacacacacaagcatgggcgctcgcggacgctccatgccgaatctatgaccacgaatatgcggaggaagacgatgccgggggaagatatatctccctccattcaactatcttgctggcgctgatgcggcttgcggtatcaacctgcttcccgccaagaaatgacacgcttccttcctcccttgttttccttgctcaattcaatgtctcggctcataaaaccacagaatg

SEQ ID NO: 3945 - DNA, 703 bp, Nannochloropsis_gaditana
  misc_feature (1)..(661): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcatgcctttcccccctccctcctgcctttcctagaggt

SEQ ID NO: 3946 - DNA, 703 bp, Nannochloropsis_gaditana
gcgggcccgcccccctcttcctcctcctcctcttcctcgttcacctccatgctgtcaccggaaagcatcccatcgggatcatcgtacgcagacatgaagccttgacaacgtcgacgccctaccacaggggtcctgtcttcttgtattgtggtggtatattgtacattaaattgcagaaacggtcgataaaaataccatgtgggtaggcctcctgcctaagtcgcgtagactacgctttaaaaacaatgcagaagcgaccgtaccaaaaaagactatacaccgagaaggtatcatttttctcaaacatgtgacgcgtgcaaacatcacaaaagaccacagcatcttatgcggggacgaaaaagaaaaaacgagcgtagaagccaagccactccttctcgaaaggccatgggggcagggcacgactcggacaccgggaaaaaactcgcaaaaacacaaagcgtgaagacctgaccccttctgcatcccagtccaagggaatgtaacgacaaggcatgcgaaagttttgtcagaaggctgcagtaagagggttcggggctgtacgcacatttttggcactctgctgccgttaagccctcggatcgatgccgttgatctgactcggtgccgctagtcatatttacacactccacggacccattcaatggatcacaaccttcctcaaaagcacagacacaacgccatg

SEQ ID NO: 3947 - DNA, 703 bp, Nannochloropsis_gaditana
ccccacgggacaggggaggttgttgaggtcgtgggaggagtgatgcctgcaggggaaaaaagggctggggagcttgcattaccgataccgcctcgaaccgtgaccagccatttacagggtgatgggcaatatgtatggtgagctgccgtgctctgataggacgaagtgctttgaaggatgaccaggaaaacgaggaggaagaggagtctcgagcgctttaaggcaggctggttatgcctaacgcgcatctcctcaaactgactggcgccagccacctgtttctgtttcacaaaatatcgatgcttgtggtgacgttgccaatgccgagttcgtaccgcaaaaactagtcacgagtaagggggggggtgcgaggcgcggcgatcacgaggtgaaaaggaagctgcaggtcgtccagacaagtggggctgataaatttaccacagcgttctcaatgcactcgttccagcagcctcttgcttctctgacgaagcataagatccacgtcaagtgcctgaactatgtgatggagagtttgaatgagtgcgagctggcagctttacattgaatacctctctgtccggttcaacttggctttgacgggtgtatgtcgtttccatgattttgctacggtatcctttgatgtcgatgtttcacgcccctccctctcatatctttcatgcacacaatacaaatagaaaccatg

SEQ ID NO: 3948 - DNA, 703 bp, Nannochloropsis_gaditana
gtggaccccccgcggaagggcttggagtcagaggtgttggctcatttggtggacaggaaagacccgtacgcggggacgctgcggagaatcgtgtatgtttcctgcggattcgaggcgttgaagcgggacgcggtggccttgatggacagtggctggcgcctggtgcatgcggagggcttcgtccttttcccggggtcggaccatttggaaacgttggcggtgttcgaccggacgcggtgagcacgcagtagaccttaaaaagtaacatgtacatgctttgaacgagtttgagtcgcattcgtggagtataaccttctttttgctttaagtgcctgtgggggtatcctaaacctgatagggaggttattattaaactagtgactagaagtaggggaagcagccgccgcccatcaaagcgatacacaaatccatgatcctggcaattgttaaaaaacatagtaaggctaggggatggcgaggtccagaaccacggtctggacgcacagtggggtctaattcttcgcccattcggcccattttgcggccttcggtcaagattcttggattcccagcgcagagatgtgccactgcatcagcacatatcctcgacatcgacgttaacacgaatttgaacggcaccctttctagcatacgtctaggttactcgaccacacgaccttattttaagcgactgccaatcatg

SEQ ID NO: 3949 - DNA, 703 bp, Nannochloropsis_gaditana
  misc_feature (1)..(438): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcatggcccctatagtgtgttgagtgacgtttcatgtgtgggaataatggtcaaagacaacaatattgccccatggacgagtcgctatactagtagctgtcgtcggcattggcgacggggactgtggataaaatgttacttcctcagacgcgtagtgtctcggataagatgtcttccttgtgcctttcaccacacaaccagaccagacttttgtacttcgtttgcattccagcgagcgacgccagggcgtgtcaccactatg

SEQ ID NO: 3950 - DNA, 703 bp, Nannochloropsis_gaditana
  misc_feature (1)..(23): n is a, c, g, or t
  misc_feature (397)..(626): n is a, c, g, or t
nnnnnnnnnnnnnnnnnnnnnnnggtgcaagccgacatattcagtctgggcgtggtcctgcatgtcctcttgactggcgggcgtttcccacagacggccttgggtcaacccgccgtgcttagggatgacgcggaaggaaaaggcacaatcccggaagtggatggcttgcggagcctggttcaggcgatgctacatggagatccttaccgacggccccacgcgtttcacatcctcgcacatcctttcttggcccccgtgcgtcgagacggggataccctgctgggagacttggtggacgaatcggagaaagcggcccgggtgatgctgctttcgatccggcggggacaaggcaaaagacgcgcgtcggggaaggaaagccgacggtcggggggccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccaccacccgttccctctcccgctccatcctggctcaggaacccccaccattgcccctgtacaccgcctacatg

SEQ ID NO: 3951 - DNA, 703 bp, Nannochloropsis_gaditana
gacggctgtctacgtttccaggatctaaagcgctcgattcgtcaaatgcgctcccgtcccgtacacgtaacgatttacagcaacaatttcccatcacaatcactttcaacggtatttaaacctaggaatattgttaattgaaaaaaaatgtcgtcaactagattgtatccactttggaaaaacggtgacccaaaattaaaaaccggcccattgtgcctgggccgacagaggaggttacttttgggaacggtcgagcgcgtgctcggggactccctccgatgatcaagacattgatggtcacagcgacttaatatgtgctcggctgaccttaagtggttatggcaaattattgtgcacatgggtggcctttcgctttcagttgtttggttttgccgtagctaccactacgagtccttacctgacgttgctttatcgcttactgtttttttcactgcaacactaaattacagaaatggggcgggtgctgccttccaaaagtcatgctctagtgataactgcccttatgatcatgacaagcgatgcttttgttccgccgcggccaagactgatgccgattgagcacttaacgggaccttcaatcgcgcgcccgaccacatatgctaccaagggtgggcctgcccccctccctttccgagctatttccgatcccgccagcttctcgacgaaacgattagcagcaatg

SEQ ID NO: 3952 - DNA, 703 bp, Nannochloropsis_gaditana
caaggaggaggtgtcaagaagcgaggtcgaaatagcgatagctgcgagagggggaggggcaggggcgcagagaggccacaacgacagggaacggactgtgtgagcttgtacgggggcctttattatcaagaagagggaaacccaggaaaaagcgcatcgaaagaaaagatgaaggaggaaggggaagacgagacccgtgccgtcagaggagaagaggaggaggattcggacgccgcgtatgagcaggaggcgcgcgaacgggagaaagggttacaggggatggccgagagtcgaagcctgaaccttttgaaccataccttgagccaggcgtataggaaggccgccgttgccccgacaagggacacgggggagggaatgggggcggggccccggcacttggagagagagcgtcagccacatgcggcggagaaacagcaagactctcaaggtggcgggaaagaaggaggacattcgttgccaaatggagagacagaatcgaacgggaaactcatgcgacggaagtcaaagcgacgtcgtgcttccccccgccttccctcctctcctcccccctctctgccccccggggaggacgcagctttctcctcttcgtccccgcctcccctcctgcccgtggaacgtcccaccgcccgcttcaccgacctggctggcatcgacgccgtcctgcaagatgtgcgggagctga

SEQ ID NO: 3953 - DNA, 703 bp, Nannochloropsis_gaditana
aggcgcgcgaacgggagaaagggttacaggggatggccgagagtcgaagcctgaaccttttgaaccataccttgagccaggcgtataggaaggccgccgttgccccgacaagggacacgggggagggaatgggggcggggccccggcacttggagagagagcgtcagccacatgcggcggagaaacagcaagactctcaaggtggcgggaaagaaggaggacattcgttgccaaatggagagacagaatcgaacgggaaactcatgcgacggaagtcaaagcgacgtcgtgcttccccccgccttccctcctctcctcccccctctctgccccccggggaggacgcagctttctcctcttcgtccccgcctcccctcctgcccgtggaacgtcccaccgcccgcttcaccgacctggctggcatcgacgccgtcctgcaagatgtgcgggagctgatcgagtaccccctcaaatacccggaggtatacgcgtatcttggggttgaacctccccgtgggatccttctgcacgggccgccggggtgtgggaaaaccttgttggcgaacgccgtggcaggggagctgggcgtggcgtttttgaaggtgtcggcgcccgaggtggtgagtgggatgtcgggagaatccgagcaaaaaatccgggagctcttcgcgacggcccgtcaggccgcgccggccctggtctt

SEQ ID NO: 3954 - DNA, 703 bp, Nannochloropsis_gaditana
  misc_feature (1)..(344): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagagctccggatcgattgacgaaaatagaggctcaccgtgcccgccttcctcttctcctgggacgccacgctcacggtcgtctcgttccgcccgaaaggtggcgatcaaagtgatcaatttggaggcggaggaagatgacatggaggagattcgtggagagatcgaggtgctgtctcactgcgactgtgcccaattgacgcggtattttggctcctacgtggtggaccattccctctggatcgtgatggagtatctggaaggtggctcgttgggagacctgttgtcctacacggcccagaatcggttggaagaggaagccatcgcctccgccatgcaccagctctgtcaggcattg

SEQ ID NO: 3955 - DNA, 703 bp, Nannochloropsis_gaditana
atgtcttcgtccgtacgaaataattgctcgtctgtcaacaggtttgcgttgctgctaccggcgtgggaaaggtgtggaacgccgacatgtggcagactactgctgttgccggtggtgttgatggttatagcgcttggtattcctgtcatcacgattttgttcctcgtgatttaatttcactggcttgcacctttttctgtcgccatgtgaaggcaccattttatacgttgcatcagaaaagggtaagagcatgatagtcaacaccagctgccatacccgtccatcaagaacgtgtccttcaaatgatatgccctcgtcactgaatatttatgccatcattatgttgtaaggaaggaaggacttcaaacatgcatgcgttggtttacttgcaaagacctcaatataataatatttctacctcgagtatttgttcgtcgtcgctgaagccaagctaccacccccacacatcgcaaataattaccaatggccccactcaaccgagcgaattatcatcgttggcggacataaattctcatgttttcttttccttacataaacctttctcttgcgcgcgcaggagtgtttaacgggcttgatcgtcgctgttgttttccttgcagcacgagcgccgctcagagagcggctctaacctctgccctgcacaggaagttattgtgtgaccaccgacaccaaccttcctatg

SEQ ID NO: 3956 - DNA, 703 bp, Nannochloropsis_gaditana
atgtagaaagcaagaaatggacagcttgaacagtagaataatttgctttatgcgaaatcttttactttccggcaaccgggcaaccttgaactcctcatgtaattgaaaatttgctcgaaaccgtaccctgtattctccacagacaataaacttccctactaaacacataaatccaggcatgaatagagtaatgacccgtgatgatacttttatagtcatgtatgagtaaagtaagcatgataatataatttgaatcatttccaacggcgattcaaatgggataacggcttctgccgtttcgcaggtccgaaacggtattcctggtctcgcgtgagcctacaggctggtgtctgaaactgcgttttacgttttcccttctggcatagctattgcgtacaatatattttaaatttatatgcacttttatgtgataagtaaagacacgcaatcaacaggtataaggggcggcccttccacacgattatgtcaatgtgacggccctctccacgtctcttctcgttttgttccatgaccaagtctatcctttggatcgggcggcccccgcatattcttattttatcctttccaagtcatataagctcgtgaactcacgtaacatatataattaaactgtaacattcacggacagacattttgaccttgtacgggtgaccgtgctcgcttgcattcaagtctcactatg

SEQ ID NO: 3957 - DNA, 703 bp, Nannochloropsis_gaditana
  misc_feature (1)..(700): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntag

SEQ ID NO: 3958 - DNA, 703 bp, Nannochloropsis_gaditana
ggaggcaacggtacgaggagcgtggaggcaccgtagtcaatatgatggatccactgtacatctcctctttcgtaagagatgctggagcggcattccttgatcatgcccaggcaatttatgcacttgcactttcgcaaaatgcctacaaataagccagtctgtgggtcgtcccggactcatgcgccgccttcgcccaacgtggaaaaccaaaaaaagcagcgatgcgaacgagcgggagcgcgggctgggatgagaatgttttctttcgcgcaatttttcctttcctcgtgagtcgtgacgacccggagcggggtgactgagctttcgcggatttttttcccccctccgggattcgcgcaattttttgttggaaggcgtaggcggcatggatgggggtggcgggttgggaaaggataagtgggccataccggcgcgccctggaagaatgttggatagaagcagccagggttcctaaacctaatttttttaactgcatggcgtgatattccaggaagcttaaagaagtgtcggtccattttgaatgtcttatattaccgtgatcttgaaaaggcctggatattgattgacctcctgagttgcttccgtactgcgaaacacaaatcgacacacaaaaatgacttgcgcatacccgcagacgcatatttcttcatcgaaaatacgtataatcacagcctgggcgatg

SEQ ID NO: 3959 - DNA, 703 bp, Nannochloropsis_gaditana
aacccatttgtcgatgacctgggaatgaaatattgcttatgtagcccgcactttgcttaaattttctttgaggaaaagaaatatttcattcaagtagatgctttaagcagctgaaatactagtgtccttgcccccaacctccattaaagcgaaaagatgcttcgcgttcagccgtatgcctgcttgcttccgagatctttatattgtctgccgcgtgaaaaataggaatgatcctgtacacatacgagtaaatgtcgtgttgaccaccgtgtcgtgctgcattcgccattcgctacctgatagcattgtatgtgctatcataggtctacaagcatatgggccaaaggagacatatgccataaacagcagctttttgtcatcgaccgctggcgagatgaggcgagcgaatgataaccttcgcttttcttcgtttgctctgtcgtaggaaccaacttgcaggaaacgatagtgatgaacagtaaatctgggatttatgcaggggtgcaggcgtggttggtagttaggtactcctctttttaggcatcgacgtgcacagacacggcgctggaggagaggttaagtagctttgcagcagagtttcatgttaatgccgacattactgattcctcctgcactttttttttctctggcacagtgtcgacaatttttcgattgctgcattgctttgcttgtctgattgatg

SEQ ID NO: 3960 - DNA, 703 bp, Nannochloropsis_gaditana
atttctgtcgccctttttggacccgcacagacgcaaacggagacgaaaagaccgtccgctggctcgacaaggcagatatcggatcgatctgctgaccttttcccgtaaagttggttaaacacaatcctagaaagcatcaaaagcccgcgatggagatccagaccatacaacaaatatacacatgcgccaaatgcatcaagcttggtgtgcatctcttcgggcaaaaattattggcacatgttatcgacaaaggacgctttcccagcccccacctggagatcaacaattacccgagacgaataattccagcgagtgtaaacattaaatttatttggacagtcaagtcgtgattgcgcggtggcatatgtttgaacgcggtgtccatcgtttctgtgcacgtttctccccgagtacggagtgcggggtatatttttgaccttcctcggggctttcccctggcgtcatcccttaccgtatcgaatgcagggacattcccttttggtccgcccacgagcggggcgtgcgagctcgtgcgacttcccgggtagacacctgcacggatgtcgacgtgtgtttttcgggtctcctgctccacttgtccatgactcatgaaactttggtctgtcttctctatttggttagttcagaaaagcgcagatccgtcgcctagcttcaggaacgcacctggggtaacgagataatg

SEQ ID NO: 3961 - DNA, 703 bp, Nannochloropsis_gaditana
  misc_feature (1)..(638): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaggcggtatgtgtatgcggggtggggggtgcggggaggaagggaggaggttgtggcgtgatg

SEQ ID NO: 3962 - DNA, 703 bp, Nannochloropsis_gaditana
  misc_feature (267)..(305): n is a, c, g, or t
cttcttgccccctctttgacgacgtcttgaaacacttcgtgccaataaactgaagtctgttggggtgtgggtgaccggctttcctcttcctccctcgcgtccttccaggtggtggccgctgacatgcacggtcgaggctcgttcatcgatttctacgacccggcggaggaaggtgccaaggaggaggggaggggagtggcgaagaagatgagcaagcgggggcagggtggggtgccggtcgaggaggaggaggaatgcacagtgccnnnnnnnnnnnnnnnnnnnnnnnnnnnnnnnnnnnnnnngctcgacctcttagaggcgaggcctttcctacgctggaagacaacgcaggtctctccctctttcaccctcccccttgctcgtttttcccattttcctgggatgcatgtatctgtatttttgactatcggtatttttgagtgtgatttatgaagacatgttttctttattgcggtggctttttgatgtgatgtatgtgagacatgttttctctattgtggtgcctgttccgggtatgaaagcgtgcaaacctggatgccctcctccctcaggcatgttccctttcttcctcttccccgccccctccttgtctttgcccccctaacttcaggttcaatcctatcgctttgaatactcagtcgaggacaatatacctcaaaaagtcttcttcagtgagatg

SEQ ID NO: 3963 - DNA, 703 bp, Nannochloropsis_gaditana
caaatatcctggggacaagactcgtgcgcgcgatcatttccttataaatatcatcatacaatttcatgccgctacaatgttctctgtatgaagtgaatgcacgagacatggaaaaccccggaactatttttggagtaattcgataatgttgaagctaaaccgtaactgcatgcacaggaggttgcagaggagtttgtctaagcaacccctttttttcaaggaaacatgtcagataaagcttaacatgtcagataaagcttgtagacgacagtaaaataatgacactcgtatggtgctacttattccaggactcactgtctctgctttgttatttgcctccctttcagccggaccaacaagcaagctgaagacgcatattttgcctacatttcccactccgcctactacgcatggccacccatgtgaataccacacaggacagcgaaaactcaacagtgataacagacgagcaggcatggcaatatttttcccctttcctgaccgtaggccttgtaaaagcgcacgaattgcacgccctgctcaaagctcctctccggcaacgcggtgaacgcttacagctgcttttcgacgagacaatccagaagcgagaagcaatgcggcggatttgtgcagaatgtgggagacgagagggggacaaaggcgtagacaagttgaaggtgtgtgggaaatgcgctaacatatg

SEQ ID NO: 3964 - DNA, 703 bp, Nannochloropsis_gaditana
taacagacgagcaggcatggcaatatttttcccctttcctgaccgtaggccttgtaaaagcgcacgaattgcacgccctgctcaaagctcctctccggcaacgcggtgaacgcttacagctgcttttcgacgagacaatccagaagcgagaagcaatgcggcggatttgtgcagaatgtgggagacgagagggggacaaaggcgtagacaagttgaaggtgtgtgggaaatgcgctaacatatggtgagtgccagagcggagctatgatgaataattccttttgtggtcacatagttcatcattcgctcttgcaaatctcgatggcatgccgtcatttctttgccaatgggcaggaatacgggggagaaatgtgaaggcttacatttggagtaagcacaggaaaaatgcattttaacatctgcggcggcttttcctcctttcttgtctctccgacttccatttgtttctggttcctgttggggtccctcgtccaatttttgcaggcatatatgtctttaataaggtcattgtgatggatggaagagaattacgctttaaaatcccgtcctctcatcgtgtcttaatgaccacctcctcaggtattgtagtcgggactgccagctcgcaaatttccattcgggcgagcataagaaggcgtgcacttctctaaaaatcgcccgaatctgtcgcgaaaatcaaatg

SEQ ID NO: 3965 - DNA, 703 bp, Nannochloropsis_gaditana
ttccaacccttgcgtcacataagtcgcaggtacacccaaccctgcgcagttggctgctaaagttgcatcattcgcgtccatttcacaagcttcccggggggaaaaagggctgcaaaagggttaggcagaagcgagagtagctgctcgtcgcgtctctcgcagggtccccgagatcggatgagacgaattaaattggtaaatcggcaatcttgtaacgcacattcctgacgcatggagcgtcgacagcctgtaaagggtcacacgaggtggtgctgatggtgaagtgccctcgccatgtcttgacttgcattaagcgaggctttgatcaccgcatgtccatgtgcaactcgcccaagcacgcgcaagcaatcaaaaccggagagaggtgtctcatggcgcccgtggtctccgtgttctgacaccaagactgccttgtttggggacgaatgcccgtcctaacgtctggacatataaggagaacttgactaggcgtggtagtagtgtataagcaatgagtgtgacgacgggcgggggtattgccatatgctctcctatcccacttcctcggtgcactgcaacaacaccccagcttcttccgattgatgttcgcatctactgacagcaattctcatctgacctggtatccttgtgtctaaccaggttgatttgcacgagcttggtttctgtcatcagggaaacgatg

SEQ ID NO: 3966 - DNA, 703 bp, Nannochloropsis_gaditana
  misc_feature (1)..(700): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnata

SEQ ID NO: 3967 - DNA, 703 bp, Nannochloropsis_gaditana
cctacaaataaattttgtttctagtgttcaagctcgtagggcatagaagaagtgtacaggcaattacagtaacacgtgaaaaagacgcccatgaagtaaatataaaagagtctctcaagttttgtgatctatccgaagcaacaggcccctcaaagccgtgcactaatggagaaagtcataagatgtaattttggccggttaagcggaggttcttacgcatgcactcctagccatggacgggtggactccgtcacttctatggcgtagaatttcgtgtgcgctcgcaaggcgcgaatgtcggaaaggaagaaaaggaagcctgaaaattgcgcgaaatagcttcgcctcttctctaaaacctgcgcgaaacatctccctttctcggaaaaaaatgcgcgaaaaagcttcctacgttttgcgaaaagtgcgcgaaaacctcctctatagggggactgacgggctgcgttcaagtgtctactgtcttgccggcaatggcgcagcttttggaaccgatccatgcggtggtcaggaatgtatctctgctctatcactcatcaaaatatcaaccattcgtttctgcagggcgttgtcttctgtccccgatatcagtcgattacttagtttgtttgccgatcgcagcccaccctggcattgctgcagggtttaggttacctcccctcccccgtactttgtgacgaaaatg

SEQ ID NO: 3968 - DNA, 703 bp, Nannochloropsis_gaditana
  misc_feature (1)..(196): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttcatggagaggctcaaatctgaaggagcacaccccgccgggtgggcgggacgcctacagtagaagtttctatcagtggaattgtcggtgaaaagatgatacgagtcgttgtgtggtgcgaatattttgccggtggacatggcgggatatggttccagaacttgttcttatgcaaggaagcagatgtcgtcataatgtgggccgcgtgcatggcagcataacccgcatgcctgccggctacgcgcgcacatgaagcgtttgaaatctaacgtagccttccagtgtgtaacctttatgacctgttcatgaagagacgtgcagcgacctaactgtttttcacgcgggcacacacctcgtgtgcccctagttcaacatgtagcgagttgctgcccgtatcgatgtcttgttctacactaggtactcttcccaatctaacaccatccactcaatgcgttgatatttcttcgacagtcacaaagaaaaagcggccaagattcatcatg

SEQ ID NO: 3969 - DNA, 703 bp, Nannochloropsis_gaditana
gctgacctccccccaacccccactccccaccccgagaaatactccatcttttaccttggcccccgcttgccgcggtcgatggcctttgtgcacatcctgcaccaatgtagagtctcccattactggtccttgccctcctggcgcaggctgtgggatgaatgtgtcaggataaggaaaggcatgcgggcacgtacattagtatcatttgccaatggcccgcgcgtctggaggggtttccaacgagacgtacgagagcaaacactcgagagttagattcttgtgtgcccagccccgttaagtatggcgtactctttgctccatagcatggatgtacatctttggtggtgaatgaatggcttcaatgcgctgcctgaatgggcagcaggggaggcataaatagcgaagcatcttgacagggggaggtcgaggaaagggaaaggggggaggcaaaatgtgccaggtgtgctccacagcgaacgaaaatttatgacaatacacactttcaccagcactacggaggaaaataatcgtgctgaatctcctggggtgaagcaattctgtagtcgtggaggtttaattgaccatatctactcgaagggcgaccctcattcctcctcttatcatcccatccccactctcctgtttcgatttagggaagcagccagcccgacaccgccgcagaggcacgcgtttattggacatg

SEQ ID NO: 3970 - DNA, 703 bp, Nannochloropsis_gaditana
  misc_feature (569)..(578): n is a, c, g, or t
actcactcactcactcactcactcactccctccctccctccctccatccctcgctccctcgctcactacctggtagatctctgtccaaaaccgttgcttcagacgcttcttggtcttgcccagcgccttgttgttcttcaagccgtccaggtgggacatcacacccatcactttggggaacccgtgtgtctgcgcacagacagggagagaaagagggagggagggagggagggagggacggagtgtgtggggggagggaaccatgcatggctgtcggaagccaagtgaccagtcgatgcaatggcaggagtgtacagagaaatccatcctctatccatcctaagatacctgcaacatgtttaaaaattcaaacgtctccatttcgaagccaaaggagccatccaccatcagcagcactaggtcagctgtctttgccaggtccagcatggcgcacagatcatcgcccgggcactcaaagaaagtgagccgcttagcttttcctgcaactactgtgatcggccctgtgatgaggggggggggtgcgaaaagggagaaatcgagggagggannnnnnnnnntcttcccatccttctcctctgggtggcgcgatcgactgccaggttcgatccacctcgcttcctatccagcccactcatcttgcctccccgcctcccatcgacagcatctgcccaacgaagccatg

SEQ ID NO: 3971 - DNA, 703 bp, Nannochloropsis_gaditana
agtagacatttgcgtagctctggcgtctgaaaagaaatgtcagtacagaatctctctgctcttgcccccgtctgcatctccctgttgatacgcttttcgccctccgaccacccctccgcacacacctcctgttttccatcttgcagatgtttttggtggccgaatattttaatctgattatgcacaattttgtgtactggttggaaggaaaaatgtggggagcgtcgggtcccccgcctccgttgacagacttgggcatcatggcttttgcgggaattttccccctctcctacagctggttggtaggatttttcttgtatttactcattgcgatggtcttggtcctttgtctgggccgcttgctcctgaacaatgtgccctgggggtgcccggagacggtgctggagaagcgagagggcgagacgctccgcacctgctgcatacccgttcccttcgtctacatttgtaaaagggcctgtcaagtcctcaccattggactggtcctccgcgtcctttccttcgtctttactttggaaccgaacccagccgactactgccaccctcccttttgggacccccccgatgccctcctagagattttgggccggatcgaaatcgtgggcagctgcggagatttgctcttctccgcccacaccctgcacgcgatggccatgatgttgaccgtcctgaggcatgcgcccgg

SEQ ID NO: 3972 - DNA, 703 bp, Nannochloropsis_gaditana
atcacaagactgggatctaagatgacgataatgtttgtggctgttttttgtgattatggtatatgaaataagggcctaaatgggccatggaaaggggcgtctccaaaagaaagaaattccttaccacaatgagtggaggcttcgactaccatagccatcctcactgttatcactgtctatcaagtcctgcatactaccggtcgatgacgtctccgatccgcaagacattcctgtttcctgtgaatttgggaatttgttcgatcaatgtgggggcgctcgccgagaagtgtgaaggaacgaaccgaggcagctgacttgccacacaatgaacacttccgcgctcgtcagtggaaggccgtctccaacattcaaagaaggatgtcaatgtcgtcgacatgcgtgatcatggagcccggtgtggggacccgaacaccgtacgcagggaaatgaagctgggatagatgactatccctcacaggtctctccttaccagtagtaactttaagagcgacagctcccgagaacagaattcactgcttgtctgctcgacagacatgtcagagaatctacatggcagtcatcgcggcatgtacggtgtgcagtcaatcatgcatgtgcgatgcttgtgcctgcagttgtatctctcatgttcgtccttttttccaggtgcttccccgcaggaggaagaattccctacccgatg

SEQ ID NO: 3973 - DNA, 703 bp, Nannochloropsis_gaditana
tcgctgtagtcattgtacgttttctgccttgcagagtcctttcttactcttgtagtttccagtcccactgcggtgtcacaacgttgtgtacgggtagtcattacaggaggttttttctttattaaagtacgctgggaatacctgttggcctgcaaaaattgcctgccgtctcctctccatctctcttcccgattgttcactttcctcgttgtcctcgttggttttctggccttgcccatttttgtcttcggagactcgctcaaaccgcctcctcgtcaaagcgagcggcctccccgccactcccgacacttccgtgtccccttgccgtccgtttcctggctcacacaatgcaaccgtgactaaggccttcagaatggtctgaatggaaaaatgatgagggaagatgtctttgcgcgttcaaaaagagatggttgggtggcaggttgatgtgtctatcggggggtacagctcgtttcagtaatttcctgcgagcgccaacaccatgttctttagcaccgatttttttcaactgtatggcttttctgtaaagcatgggacatgccatcgggtggtaattcattggagcacacgttttgttcacctgctcaagtctctttaatatcctcgtcaaatgccatgctttccctcgccctatgctacagacacaggcatgttttttcccatccgctgataggacaacatg

SEQ ID NO: 3974 - DNA, 703 bp, Nannochloropsis_gaditana
tttctttcatttcgacttcctcataagcgctgttacgctttaattctttcaaggctttgagagaaggaagaatcagataactacatgttacttcccgtgaccacatatttgctttccgtgactcgttaattttgattttaaaaatcaggacaggacaaagaggtgactagaacgctctgtaaagcaaggaggaaacgattattaaatccatcatcctacgaattacaaaatagcaaaaacacgtcgctcgtagattttttaaaaatatttgcccgctacatttgtggcaggttgtacgaagttgagtcttggaagagtcacatttctgattgactctaccccggagagaggaatagcaacggattgataggacatgcacataaatgcgaagctaaccaggcacctggacttgtcatgcacgatgccattttctttaatttttttggcatttttttaattttgttggggggatacctctatcaccacgcatcagcaaggtgtacttggtgcgccctttaatcgcatgggaatgttcgagagagagcatttcggatactccgaggtctctctcaccaagtgcgtcaagtcgacacggtcggtccccgatgctttcggctctgtattcctttccaatccacaaacatgctaacaaacgcacatttcatcacacagagccctgctcggcttgccacggtcggttatg

SEQ ID NO: 3975 - DNA, 703 bp, Nannochloropsis_gaditana
  misc_feature (185)..(194): n is a, c, g, or t
gaatgacaactgtgaggtagactaccgcctgagccatatgaccacgccggcagacacgcgcccctactgcaaaaccatggctaagatcattcgattgacggtgagggagggagggagggagggagggaaggagggagggggaaggggttggaaaacatttgcttaagacaagaagggaaggaaannnnnnnnnnagatcaccaacccgagagccgtcctggaacgggcgcttcggtccttttcctgtgtgacggtgggagaccatatttgcattccccacaacgacaaattttatcacttggaggtaggtcatagatatcctgggccgcacacaccctacactgatgcgctccacgagtttataagcttatctggatggaccgcgtcatctcggaaatgcgcatcgtggcactgtgtttggaggagggggtgggacgtcaggcggctctcgcgtcttctcctgggcccttgtctttaggggaagcgcagtcccggtggtgtggtctttcaagcattatttatcgcctcacggtgtccttgtttgggcccctggttgttctcctggtggtcatctgtcttcgattgcttcctcctcgtccttcgcgtcgccgtagtctccccggagggtgaaagcaatgtttaatgcttttctatctcgttgtcttttgtgtcatcctccagatacctgctttttttagggacc

SEQ ID NO: 3976 - DNA, 703 bp, Nannochloropsis_gaditana
acccccgcagtcgcagacatagtaccactgtgtgctttttaggaagaaggtatattcgtgctttcacgcttgacgtctcgatttgtggcagagggtcttacctctgccagcatccacgtgcactccttcgacgcaactgggaattacgcttcccacaaagcggaacattgtgtgctcaaaagtctcttgacacgttgtgaatctcattaggcccgtgtcatgtgcgcgggtgtggacaccaggtacaagagaaactgttgcagagatgtgcatgacctgtgtggcccccttcaggatggaagtacctctgtggggctcaatgtggcagcattcatgcaaccacatgttgtgctgtcttgtcaaagcttgactctccaggtctttcatcccgtggaggagtgaggctttccgggcgagggtgcacgtcagggtggaaccttcctatccgacccgttgtgtgtcttcgtcatcattgccaccctcctcttttacttggacgcgttgatctcatgcagtgacccgccactcctcaacattacaggcatctttgtggtggcattgtccgcttctgctctcattctgtgcccccgcagcttgtctcgcaggaccacctcccactctaacatctaaccctcgattgacacagacggtcatggcgggatttttcggtggagtagggggcggagggccattcgcagccatg

SEQ ID NO: 3977 - DNA, 703 bp, Nannochloropsis_gaditana
  misc_feature (492)..(651): n is a, c, g, or t
cacacaagttacaaacacaagttacagcccgctcaacaacacatattgctgtgaacaccgtaaagaatcggtagcttcgttttttatctccatcggtacctcacaactcaggcacgatgggtgggtggcgtcaagcataattcagacaagagccaaaaagacaagcaagtgaagacatgcgcgaatgacacaaacttggttgcgctgtcgcatttccttcgatggaagaaccgagccacagccaaacgggtgtcaatgatgatgataatgacttaaataattggcccgatggtggcgacctgcataacgtggagtgtcaaggcaacaggaattctatcaattatacatttttttcacgaaatcttgatgcggtagccgacgtccagcacctgacgttaacggaaacgaacgttcaaaaagccttccggaatttgcaatgcctggtttgcgacgagcgtctgctactggcccacaccttgtggcacaagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctttccacagtcggcccctccatcctttcttcctccctcccaggtgatg

SEQ ID NO: 3978 - DNA, 703 bp, Nannochloropsis_gaditana
gcaaggctacgcttacggtgcaattcctttgagacaaccagccatgttcgaagtccataacagatggggtaccacggcattacttaacgacgggatagtctccatgtagacacgatggaaacccttcccgctcctgaagaacacgcaaccctttgagccctgcctatcccttttaattaccactttgcgaacagttttcgattgcggatagtacaatgcgtggggcggtatggcgggtacctcgtgactttcccgagttcaataaatgtgcccattgtacagtgagcacaggagggcagactttcgagcaatgtgggctcatacacctgcaaggtcgcgccatcgccgccccggagacacgacgccatgcatgactcctttgttgtgcttccacatgcgcgttaaacgtgccttcgagagatataaatcctttttgaaaggtctctgggcttaaattgctgacttgtccttctttcctgcccttgcattcgtgccctatccctttacttcaggcgcccgtgtcgcagccaggcggggcatctgtctccacacttactagagcgggtacgcgctctcgacacagccctcaacgtccattgtcccccttttgtttgcgatgatggccgtgcctttggcttcctcgggcccttcctcctccactatgtcctacccctcgaaagctctgaaagtggacaggagcatg

SEQ ID NO: 3979 - DNA, 703 bp, Nannochloropsis_gaditana
ggaaatattgctcggacaggccacctaaggctggcgtcggctaggtcaacgaccacaaaatcgtcaaccctcaacattccatgccagggcacacctggacacggaatgagaacaagccattctctttcctgttcgcagccacctgggagcatgcgtttcgatggcgcgctcaaaagcaacaatagagcaagaaaagcagcatcagcgaggatcattctatcaggggaaaagagagcgatgccttacaggggtggcggcgttcgacctgtcctaacagtggtattgaggcaaaaataatgccttcaagacaccagagacgtggaaacatgccagacaaattcaaatggaaagatgtgggcacgaatctcgtcgaattgacggccgtggtcttggccaaggaaacccgccaggggctcctcacgagtcgcggaggccttactcccaccacgagcgagcttttcaatcatttacatgctcttacggacgatttttggggccatcctgggtcatcaagtcttttccatgttctcataattgtacggggggggcattttcacaccttccagactggttgcggatttttttcccccaactccatcctccaccacacatcacgaggatcgaagtagcagtacgagctgcgtctcgatctgtccagcaattaagtatttgtagccctgcacaaacccgctgaaaaatcatg

SEQ ID NO: 3980 - DNA, 703 bp, Nannochloropsis_gaditana
agcattcacgctcacactaaccctatgatgtgtgtgatggaatgtgttgtgtggtttgtcaggtgatgagttttgaccccacggagggtctccgtgacttcatatgtcgggctgtacatatgcgatggtgtcatccttattaccagtaccttattgccagtaccacgactcaaaagaaagtttgtcccctttttacatcgaacaaccatgcgaccaacgggaaaaaaaacaagttcgtacccccaggcacgtgacgcacgcctgtgacttcatcgtgatcgaaaagacttccagtaatggtgtcctttaaggagtgaattttacgcgatgtcgccaatcgaatatttccttccaagccgagcaggaaaaaaggagggcagggacgcggcacaccactttcctttttcctcacattcccggcatgtatggtcgctggtgccctatatatctgaagggtattctaataggagcatgcctgatgtgtgatatttgttaatttgtggtatggtggtgcttgttttgctctccatgtggcactctcgctcggagtgcgtgcccgtcgacccgatcttgcctggcccatgacgtgttcacatttcctgtcaagcgtctggcacagcgcaccacatgatagacccgggcgactgctcaccttgcaacatttttcgtactatcagcatttttttggggaaacggaaccatg

SEQ ID NO: 3981 - DNA, 703 bp, Nannochloropsis_gaditana
acgtccagcatgaaggatgtacttaccggccttcgtcagaacctgcggggctgcgtacgtaacttgagcagtaggaggacgatgccgcacatattcgctaggactcagatgaaattaaatgtttgattcatccagtatgctgcgatggcagaaaaaattacaagagatagctcgtgggtcttgagggtattctcaaaaatgcttcaggttggttcgagtctaatgctaccacaaagatgccatgtaccctcaaaataatcgaaatgtcgacgtttactagtgatggtatcattgcggaagcttacttgacttttcgtaatttgttgttgtccttccattgaaagtggaagagtagtggctgaaactttgtagcttctatgctaccataacccgcttcatattcccgatgacagctacagtccactgcacaaagtttgctactgcgttaaagtttatgtagatattatcaaaatttccagttcgggccttatccaaattatcgaagcataaaagtacacatgctgcgcttttgggggtgtacgctctcccttcttgaagttcgctggggccccatgagcgacaatttatggcatggtgacctccactattgtgtcctgaaaactttcaccgatgcaatccatcaacctctcacaggccagcttcattttatccaaggcatagcgggttttgttcctccaaaatg

SEQ ID NO: 3982 - DNA, 703 bp, Nannochloropsis_gaditana
  misc_feature (14)..(309): n is a, c, g, or t
acttgatgtttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggtacctctgtccctatctacccgcgacgtgggcaggaaaggtcaggacggtggcgtggaggaagctcgcttggaggccctttctgcctactacgaccatgccgtcgaaaatggctgggaaggactcatgctgaaacggctcgacagccgttacagcagtcaggggggagaaaacggggagaaaatcagtcgagagaagggtggttgggtgaaattgaaaccagactacgccgaggtgacggacgagatggacttggtcctgttgggggggtactacaaggacggcgcacggtggagggggtaccccagccgctttcttttgggtgtctgggcggaggggagggaggggaaagagggggggaaagaggggggaggcacatgggagggcatg

SEQ ID NO: 3983 - DNA, 703 bp, Nannochloropsis_gaditana
gcagcaaaggtccagaaagaaagactagttaaaatccctgaaatgaatgcgacattttgcgaagaagccttgctattacgatattaattcaatgttcatttatagctatacatcagcttggggcgtgctgtttgttttttcaaaataaaacattgagcttgcgttaagtgcatgtagtcgagaaatatgcactctttaagcaattggctagacaggctcgcgtactcgtgctcaaggcatagatatccgagatttatcccttacatgtatccatagtggctacatgcgccccccatctccttatattcttgtaacactgttgggtagtctgcatttcgtactgatgtatcaaggattcatctttcttcttttaaaaaaaaaggtaacgccacccagagtggagggggggggaagtgaaaattgacaaattattaaattataaagctcgcaatgctcctcttcgtgttggaaaaaatactttctgtcgcgataagaaagctaagcccttcccacgttacgtaccatcctaggtggggaggttaaaggcgcgattcaacttctaggccgcttccattgatctataaatacaccatcttttgactccgcctgcagcaacaacgtgaacaaatcatatagctaccttattattgacgtcctcttccaaattaaagccctaggtcgtgcagaaggccggcgtgccatg

SEQ ID NO: 3984 - DNA, 703 bp, Nannochloropsis_gaditana
agagcctgtgtgcgtgcgtcgtaaaaaggattgatggtttggtcgggtcttagtacaagaaagctggctttacatgcaaggaggggtaccttgtccgcctcctccatgtgcgccttcccccgatctcgctggctggccatgacaatgtgggcgtaaccctgtgtgggtaggtgttatgtcgtgtgtgtggtgtaagtcggatggcacagcggcctttcacagtgaggggggttgatggttctatttgaacaaagctcgaggcgacactggaaaaaaaaggggaggcatccaatatattcatctcatgcggtgacagtcaccgctctgagataaataaaatggtgcgatgaatggcttcataacttcccaaccatccttctagacaccggggcgtgtgttttgttgtttttagtttttagtagcggggaaactcgctgctggttgcgctcgcaagcatcttgaagccttgccggcgatggactgctgcatgtcagcacatggccaactaaatgggacgcacgggggaatgatcgttgtgggtcgatcgtcgacggagtctgtggcaaggattccattggacactttctattcatgttttgtcctgccactgtacttcttcccgtagtcaagcgttttcttcctttccttgttgccctgacgcttcacgttcccactcacggtttctcggccctctgttgttcaa

SEQ ID NO: 3985 - DNA, 703 bp, Nannochloropsis_gaditana
caatcggaaaattcaacggatccttagcgtccctctcagcccctcaactcggtgccgtggcgatcaaagccgccatagcaagggtaggcatccagaaaaatgatgtggaggaggtattgcttggaaacgtggtgagcgcgggcatcggccaagcccccgcccgacaagccagcatggctgccggcctacccgtccagactatcgccacgaccgtcaacaaggtgtgcgcctcgggcatgaaggccttgacgctgggggcgcagagcattttgttgggccacgccgacgtgctggtcgtgggcgggatggagagcatgagcaatataccttactacctgcccaaggcccgaagcgggtatcggctgggtcacggccagctggtggacggcgtcattttcgacggtctctgggacccgtacaacaaccagcacatgggcatgtgtgcagaaaagtgcgcgaaggatttccacctctcccgggaggcccaggacgcctacgcccggctcagccacgcacggaccaaggcggcggtggagcagggcctctgcaaagaggagatcacgccggtgtccatcaaggggaggaaaggggaggttgtggtggagacggacgagcagtacacggggatggatccggcgaaattgccgacgttgaagccggcgtttttgaaaggggaagggacggtgacggcgggtaacgcctc

SEQ ID NO: 3986 - DNA, 703 bp, Nannochloropsis_gaditana
  misc_feature (1)..(492): n is a, c, g, or t
  misc_feature (550)..(559): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaagaacatccacgtgatattggtggtgcatccccgcaaggagagggatcagttcnnnnnnnnnnggcatcgtcaccaaatgctccctagtccgccccaaggtcgtccgctcagtacactactgccccgccaagcaagagcacctggtccgagactacagggacgccacctccatctccatcggcctggaagcggggggccggcccatg

SEQ ID NO: 3987 - DNA, 703 bp, Nannochloropsis_gaditana
gtcgaagtgtggatgtagtccaactcaaggctagcaggcgcagaagcagcacttgtagaatacgggggtagttgtgaaggtaacaatgtacgtgtggacgtctttcatgacggtatcgcgttttgtggccatgcttttaccaacgagggaggaaagcctgcacgcgttaccgggtgcttttatgcctttcttcatgaagacataggattaaaaatgcgcgccatttgacacgcatttatccatcactgttgtttccgcaattcttgtcattcagattgagctgaacgcgtctaaaacggcccagcctccgcctggttttgacggtcaaggcgagaagcttgtgtcggaccatttccccttgccggggtccacgacaagacgtgccaaaaacaccggcggcaacaaagacaggaataagagtaggggaaaacgcctgctctgaaaagttgtggagaagcacaagtaacagtcaatcggactcgggcagtctctcatccggaggggaggtcagcagaccaagcagagtggtggtgagagtgcaagcaaccctgaggctcttccgggacaccacaacattctcccctgctgcattgctgctgtcgagggccttattcgctccattccaggacggcagagccaaagaaaggtcttgctgattacgtgaataccggacgcactcgatccccatcgacccctcacgatg

SEQ ID NO: 3988 - DNA, 703 bp, Nannochloropsis_gaditana
  misc_feature (375)..(409): n is a, c, g, or t
  misc_feature (596)..(656): n is a, c, g, or t
gacatacccctgcaatatttaaagtggtgcatcgcggtagtcatgcacacgccttccctcgcgcgtctggtggacgaagacatgctggcacagtgccatgcgctatttcacggaaagcccgagcggcgttcgtctgggaggggaagaaggaaagcggaggaaaataaaaaaaaaccgccaaagggcgagacccttccacagaccatacccgccggctgcgatgtgcgtgaaacgcgtgcccctacaacgcccctatcagtggccgctgccctcatctacgtccgcctcctccctcggaaagctgcctgcttccacttgaccgacctgaaaatgcactgcccacatacccggaggaacgactggctcttctcccannnnnnnnnnnnnnnnnnnnnnnnnnnnnnnnnnngcccctgtccccgtccccgggggaacacgcacgttcctggacaagccctccctccttcgagccctccgccggcacctcctctcctttcttccttcctcctcctcctccatctctcactcctattacggtgctcggcgcccccgcttggagaatgccttgcgaaaagtgctcttaagccgctggctgnnnnnnnnnnnnnnnnnnnnnnnnnnnnnnnnnnnnnnnnnnnnnnnnnnnnnnnnnnnnngagggacgcagaggggaaggaagaagtgggcttcgtccttcccaatg

SEQ ID NO: 3989 - DNA, 703 bp, Nannochloropsis_gaditana
caatattaagaatcttaagtctgtcagtataaccaaggcttatagatcttgagagacatcaaattccgcatatgtaataatgctatttagctcgaaattcactaaagcaaaaagacttgaaacgtctctgccttttaaagtgataatcttggggtttcccatttgttgagcttctttattatctcacgactctaaatactgaaggccacaaatcagtcttgccacctccttcaaacatccttcaacaaacatcccacccccccaacgtccaacgtcttccgacaaacaccgtcagcataccgtgagccaaaaagctgattgacggatgtaacccaggatatggtcaacggtctttaactagccttacattaggatctgaaaggcaatggaaacaaacaaccgtgctgggaattgcgtccttctcggcctttaccttaaggctgacgtgacacgcttttcccggcgctagtcccgggcgagatgcgggttccggattttcgtacacacgaatccaaatacacgaacacatacgttattccacgctctatgtaagctattcaagtaaattttgtcttcttccaaattttgtcttcttccgacaattttgtatagaaaggccgcgaacgacgcgctgtttaaagaatccaccgctgtggcggccatgatctgaggggtgctgtattgtatgccgtcatcaaaaatg

SEQ ID NO: 3990 - DNA, 703 bp, Nannochloropsis_gaditana
cggtattttgctctccttcccctgcggtcctggtctagcatgggcttggacgttcgggttccatgacctttgccttttgaactaggacaaacaccgaccgaccatgggatccttgagactttgttgttcattaaatgcaagtgcgatccttgcctgcgtacgataaggcgtgagacctgtaagatcggctaagtatttcattcatagagaagtcatgaagaatccaaactttatgtggcgcgtgccaagacatgtacataaaagacagtacagcctattttaagaatgatcatactttcgaaacatcaaaaacagaggaaaaacatcaaaaacagatggaaaggcgtgacatagatcccaacaagcttgctgttccagagggtaatcccgtgggagagagaaacgacgaaggcggcgcaaatcgccttgaacgttcaaatgaatacgtgcaggaagggaattactaccaggcaaggcaagaatacagtgctgttttggaacaaaaaaatcatggcgcacatcttaagactcctacatcgctaggcaggccgtcaacctgttctcgccaaaccggtacgcaacccaccgttgaattatgaacaaagataccgcaaagcagccgcattcattcgctgcggtcaagtatacacctttgcagctggagcttaaggtgctagccctcgtcgtcctcaactccctcatg

SEQ ID NO: 3991 - DNA, 703 bp, Nannochloropsis_gaditana
ttcctcccgtaccgactgaccttctccggaaagcattgcgagacgaaggtggaaatgagggaggactttcctgcccctcggtctccaaggaggagaatgcgcacggtgtctttcatgcccccctggtgatgtaggtagagcacacggggagaagcaattaagaccggtctccaccctggcatcatgttgtaagccgcctccgtcgaaaaaacatactcctttggcgcataattacaatcacatcacacattccctgggattgtgacggccaaatgctgaaaatgtcgttgcttccaccaggatcgagatcgcggcgggaatagctagaagccccgagcctgcttccttgcctctttgaacacatcaccgaatgagtacgcaccggtccataacgcaaagcacgcgggctccacgacgcaaagtacgtgggggttgacctgttcgtgcgcgtttcctcaacatgttgccgcaccgtgttcaagagaaggactccgtgcatctacagggctcgccaccccgcttcaagaagcagtactagcaggagcgagcgctcgactcgatcgatactctcaggtttcggtcacacaaatcgacgtgccttcacccacagccacgtactatctcagccacatggccaggtaggacaatgtctttcttgcggatactggaccatgacctggacgacccgctgttccttcgtctc

SEQ ID NO: 3992 - DNA, 703 bp, Nannochloropsis_gaditana
  misc_feature (1)..(504): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttcccgcctgccttgccaccacttatgtcttgtgggactctcttacctcggacccaacggctttcccagtgaaggcctagagcgaccacgcgctcgtctttccccccccgctctttctcctctgccagactgtacgaagacctcaatcgtctccctcccttcctcccttcctcccttctctttcccgacaggccatg

SEQ ID NO: 3993 - DNA, 703 bp, Nannochloropsis_gaditana; identical to SEQ ID NO: 2138

SEQ ID NO: 3994 - DNA, 703 bp, Nannochloropsis_gaditana
  misc_feature (205)..(214): n is a, c, g, or t
ttatcctttccggtcatcacaggatgcaaggccagacagaagggcgttaaaccacacaaacttaaggccgtgatgctttctcacttggcaaagactccgtgctcagtttcccgcaacaatttctcttccatgtccctagattcctcccctcgttcttcccttctcctccccttcttcactctccctccctccctccctccctccnnnnnnnnnnagcaagaaataatgccataaacacggggctgggctacggtgccacgcttttacaacgtctacgcgctcgtcatatttccagcaacaataacaagacatgttggaatagcattgttgcgcatgagggcaggcgatgcctgtctgtctggtgtcccgaggcacgtttgccaaccccgccacccaacgcgtcagactgtccgagcacccaaaacgacacaatctcattcataaacgcctttaagccaagcacgacggcatggagccgagaacctggtgcctgaggcatcggtcgtctaaccagaattctaggacaaggcttctgtctatttctttcacgtcctcttaggacacgcgtgagggactctccttcgcccatttcttgtgatcataaaattcatcaagcgccctcgctcattgcctcccaagacatgtaaccatgtcccacccacgcacatcccatccatcgcacggtacaggatcataaatcatg

SEQ ID NO: 3995 - DNA, 703 bp, Nannochloropsis_gaditana
tcatcctggcactatttccaggtgacggaaatcgagcacgtgacccaactttctttgggggtatattttgttccttctcctccttttttttaattggtatccgttacaatggctgccctaccgagcctagccccagccgtgccttttttactttccttttttattttttccactgaaaaagacagcacacattcttgtcgttcccagtcggactttgtgattacacttctcatcggtcgccttcatgctgttgattgccaatgaggctcggcttcttgttcaagcagtgctgctgtgcataggggcaggacaatttcagatgtattcatcatatcgtctagttccttcatcactctctttgttttgtttttttcatgaaaattgaacctaattaacccaaaaatttggtttttgaaatgctattggtgtgtcctacgataaatactatcgacattcaaatacccgtccagtgataagtccttgttccaaaagtttgtgttctgtttggcacgccaaaaaaataatatgtgtgcattgccctccgatacccataaagttacgctccagctcattcagtaaacggtaagaaacgcctatatcctgataagcgatgtcagacaccaacaatagcctcgcccttgtcaaccccttgacttctaccgatgccgccccggaaggcgatgtgatgggaggggaacgcatg

SEQ ID NO: 3996 - DNA, 703 bp, Nannochloropsis_gaditana
cccccccccccccttcccacgtgcccgccatgcgccaagtaagtaacgtacacaagcagcacgttgggtatgaatatgaagcgtgaacctaatgtatagcgacttaacaaactgaagggtcgattttttcccgcatttcatggatgctcgtcacaggtgcgagaaatgtcagcagtgtccgaaatgccccccccccccaagccttgtgacaagaccgtgactgacgcaagcaccgacacgggtgcccccccatccggtgcgacggagatgacgactctattccaatcgctcgacgaggcagcagggcttgagttccacggctttgtggacgggaaacgggcgttttctgagttcttgccctttgtacctgagaagattcaggtacgcactaaccggtgtctcaacgaagctttatgttttgttttgcccgccttggctcaacacgaatacatcgcgccccgcattaaaaaatcagtcgaaggtgtcggaccacgccatggcgttcatgaccaaaggctcggggtttctacccttgcgctccccttcctccgccgacggaaccttccctttcgaggaccttcaggcatgcaaagaggtggacgtcatcgccctggcccgagaacggtgttacgtggcggttaacacgcaaatgagtcagtcctctttccacgtgcaccggtattcgcccgtagctcccgaaccc

SEQ ID NO: 3997 - DNA, 703 bp, Nannochloropsis_gaditana; identical to SEQ ID NO: 75

SEQ ID NO: 3998 - DNA, 703 bp, Nannochloropsis_gaditana; identical to SEQ ID NO: 72

SEQ ID NO: 3999 - DNA, 703 bp, Nannochloropsis_gaditana
tgcacatggcaggtggtgagaaagacgcaggagatgcgagggtctgcgatctctatcgcgttgctgtttctttgctttcccaaacgggctttgttttcccgaggtttcccccccttgtgacagcctaatgtgtgtgagacggggaggcaactcgtatcactttgtcgtacttcaggcaaagacggcgttcggtacgatgtgacgtcacgcacaaagctagcaggcggccgtcacatcacgcttacgacataaagtaggtcaaaggccacaaacttggtctgtgtacatcttgcccatagatttaatcaccaaaagcgattgttgatccaaccatcatagctcgcgcccgtaaaaagtggacaaggcgtgcgggaaagagtgctggtgctgcggaagatcgggtgcctacccccggggtgtggaggcgcaagactgatgtgcgtgctctaaccagggcatgatttatggagatgtgtacttgatgtagaaatgcttttgacttgtttgttccgagcagacctcttcgtgtattggtaactccctatgtctccgtggttgtctagcaatcaagaggcatcaggtcatgcgtgcgttgtggacgggccggaggcacccgtgaggactcgcgccctatatgggaacatttgaggacctcacggcagtctatccatccacgcacagtttggattgcttctgaggcatg

SEQ ID NO: 4000 - DNA, 703 bp, Nannochloropsis_gaditana
gttacacatgtccgctcgggacgatttcgtcgcacgtcgacggtgctgaaaatgctggccctaccgtcgtggcgcacagggttttggtcatgaggaggggggccattcgggggctcgtaacgggcgaagccagctttctggtgatgaaggggttccctgcccgaggacaattcgtgcacccactcacctccacttccacacctcacacacacacacgtgatcacatgatctttgattgaagagagcctcctcagagctgcatgctggctgtcgctttgggtgggccagatcggaagggctgagagaaaagtcttgggactcaagaagggaaggcgagtggcagtgcaccagggagcgcgtcggaccgtagcggccgcgccaaccgacgctcgtcgacgactctgcaggtcgtgaagagcaagataagacgggtaagtgacggggaaatcggagtgtgctagagctttgatagagacttctccggccgaggcactcactgggcccgaagagcgtgggaaacggcttgcgagacgaatatttctgaaatatagagtagtaccactcgctttgtcgtaatatctataatcaaagtctctcgttacgtcccagcaggcccaatcacgaactcattcgcccaatctgttcagccattacgtcgcgggctgaagaagctgggcgagggcctccgcaagcggtggaaatg

SEQ ID NO: 4001 - DNA, 703 bp, Nannochloropsis_gaditana
  misc_feature (1)..(301): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgacgggaacttcgcgttctgaccactgcctcccctccccctcccacctccttaggtcaacaacgcgaacgtggtggcgacggacgtggaggcctcaaacggcatcatccacatcatcgattccgtcctcatccccggtgcggtcgccgcccccgcggctgcgtctaaggaggtagggaaatcactggatagatagaaaggagaggaaagcgggcttacatgtcccttcttttttctacttatggatgaaaagccgcccagaacctggacactcatagcattctcctggtctctcaccccctctcctcgccctccctcactccctcccttcctccctccctccctccttcgtgccctcgctcaggtggacaagaagagcctggcctaccgcgaggtgatg

SEQ ID NO: 4002 - DNA, 703 bp, Nannochloropsis_gaditana
tcaataccatcgctgggatgtcataaatagagctactttcggaacttttttagaagttttttttgttgggcccctgaccttcaactcggaaatacaatctcggaattttcgactttgagcgacttttttatgggccatccaggctttgggcggccgccatcgatacttcatcgagatatgtgtactccatgcatcctcgtcaagaaagactattttgactagattatttagcattcgatttttgcattctgccgaagaccttctgatattataccttttgataggcttttgttaacggtgtagaggcccatataccgatgagcgtgagagcacgagcgtctgtgcaccccttttaaatgcatttgcccagtagagacgtggctctctgaatcacaaattcctcgctccatacaaatcatgatgtaaacctgcattgtcgcattcgaactcattatctcccttcgcctgcgtccatctctctcctcgtatgggtagagaaggagaggtcttgcacaccgcatcgcaccctctcataggcatgaaagaagctgataagatcaaaacgatcgtagtacaaggcgtcatcgtggtgcttgcggccttatgtcttttctggacggtgaattacgcgtccgcgcaggtttccctggaagaaaaaggtaattcccaattacggacgagcgacatcagtcccttcaagatg

SEQ ID NO: 4003 - DNA, 703 bp, Nannochloropsis_gaditana
  misc_feature (1)..(657): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctccctccctgtccacaggcctggaccgcctttctagggacatg

SEQ ID NO: 4004 - DNA, 703 bp, Nannochloropsis_gaditana
agaaagcccgagaacgtctggaattagtgcccaacatgtctttttggtacacgcgtgtgcagccatgttatcgcatcatcgtgacgttgaccttcgtacaggaattgaggcatacagcctcctttcggaactcctcctgcctgctcgctccttgcaaaaggaaacatttcctgaggggcgcaacacaaatttagcccctggatggtgaaaaaagcaacgaaacgtcatgaggagatctttaaaagtataccagtggtacctgttacccacatgcatatgccctttctgcccctgttgccgggcaccgtcatgtcggcatcaggtcttttgcccacctctcacaccaacccctcctttcctctttcccctcgttcacatccaggaaatgccagccctcggctcgatatcttccctctccacccgtccaagccctcctcacgatgccatcgcttcacgccccttaccccaccccccccgcctcgatgccgcaaccggcttcccccctcgtccaccgcctggccgggcttgctcttcatgcacccccgacgagtcctgcgccgctactctctcccaccaatgccgcctgggatgtctgccagtccaatcacctcctcgcgcctttcctgtctctgcctgacttggcctctttggcggccacccagaaagccttcgctcccttccgctcccaacggtggatggccga

SEQ ID NO: 4005 - DNA, 703 bp, Nannochloropsis_gaditana
  misc_feature (218)..(227): n is a, c, g, or t
tctctccctctctctctccctccctccctccctcctcgtcgcccacacctcccatttccctctctcaggtagacctgcccgccctaaccaccaaggacaaggctgacctctcctttgggattcagaacgacgtcgacttcgtcgcggcctcctttgttcggaaagcccaggatatcctcgacatccgggcatacctcaaggaggagatgagcaaattnnnnnnnnnnggcggaccgtaccggtcacattttcgtcttcctccttctttcccaatgccggccgaccgtggccacctcctttgggccttgagttgacgcttttgatgtccccctcttgtcctctttcgtcaactccgagcatggccgaggcaggggcagcgcacaacgctagacaattcttgttgtgcatctggacctgcctgcccgatatggaaaccacgccctccccaaagcaacgaatctgtcgcaccggtgaaagaagtggatgcgctcgaacagagacgtgcttttgcatgccaggctgagccagggcagaaaggcgcccgttgcccgttcccacccaaaggagctcttctatgggatcaaatgccagcgcagtgataggatagccatcacttggtactctgtgtgtttccatgtaagtcccatggccttgtatggtcgatacttggtcatcctcgtaatctggaggcgactccatgtgc

SEQ ID NO: 4006 - DNA, 703 bp, Nannochloropsis_gaditana
gcccgttcccacccaaaggagctcttctatgggatcaaatgccagcgcagtgataggatagccatcacttggtactctgtgtgtttccatgtaagtcccatggccttgtatggtcgatacttggtcatcctcgtaatctggaggcgactccatgtgcatttggtgccctggagggaaaaaagaggcactcatgccttccgctgtaaaaggcaggtggagaggggggaggttggtatgcataagaaaagataaacccgtagaaaaacaataaatgcaacgcaacattcaaaattcggattgtgtgctcctcggacttggaacgcacatctcaaatttgtcctggaggaggctacgcgaggcgtctgcaactatgcagggcgctcagacgggcagaaagctcacatctgctcatcctacggcactgcccctaggccaatgtcgctagtggtcataaagcgtcgcttttcacaccgcggctgccttcttgtaggccttccattgcccttggacgccttgagatgttcgacatggacaccagtggacaattgtatgccgccgtgtcctggccgacgtttgcattgctccaaacagacagtgatggtcgggagccatccatcccctcgcgcttcttcccggcccttttcgccgttcgcatgtctaatcgacctctgaccatgccacgctgtacttttttacactgaca

SEQ ID NO: 4007 - DNA, 703 bp, Nannochloropsis_gaditana
aattaccctcccctgtttagttggttctaactactggattgtcgattggatgcgcagcagtgcatgtgtgcctgcgtgtgagagataaaggtggtgtggacaccaggtacatgtgaagtccgacgttaaacggggaaattaggggcggtattcatcagcgttttaaagaatcaacatggaaaaaaagttgaatgttgctgatatctttgattttacacggcattggctgagccattttctgattttctggcgttattcaccatttttagtgtcagtttcgggggggcgaaacttcaaatggttttcaacgggcttaacggttttctcatcggacgttttcttgtgaggcgtgtgcgagaaaaagaattttcttggaaggggctcttgactggaaaagtacgtgcaacatgttctttggacaaaattctggtattaaaaaagaagatgccttttgtgcttcctttcttttcaattgctcgaccgtggagaccgctgaagcaaatatccttgacctcctgctactcattcagcttcaagtgtcgatactgtattcaagaaagattgatatttttcataccacacatagaaatcttcagtccatttgcggctgccgactaaaaaattctaattacatttcaaaaaaccaaggtacaaccacaacgcgatgtctactagtgtagcaacaggagttcagcaaacaatg

SEQ ID NO: 4008 - DNA, 703 bp, Nannochloropsis_gaditana
ggaccgaggcctgccatgtcgcaatgaaatacacgaagaataaagcaaatgcaagctgcaggtcgaacagcaaggcgcggagaaggatactgcgcgtgccgtcgtgaaacgtgccatgatggtttaattgcatccacgtacgcacgcaaatacccacaggagacacttatctcatcttccgcgcagaggtttggctgcacacgcgcctttctgcccgatttaaaaacgacggcagggaatggaaagggatcgccgtcgccgccccagtagcttgagcgaggccggcgaggttcgaggctttagcttgctatcttactgcagttgtaggggaattggtgcatggataaataggtcacatgaacaagttgacgaaggcgacgatcatggccttatttgatgcagcctgtttacgatatattggtatatcgatgtggaggcaaagagccatgccacaaggtgagcatggctcgcgaggtccctcttttcttttcgcattttttatagttgtgaatgaccttgagagctgtatgtcgctttatgcatagaccactcgagcataaaaggatgtctgggactcttacttactacgtggaaattattaatatacaaagccaacagccgtgatcgatctttttcttaggaagctcaccatccacggcccttctcatgacggggagcagcagggaatgtacgccaaccgatg

SEQ ID NO: 4009 - DNA, 703 bp, Nannochloropsis_gaditana
accgcggagggcgatccgagatactgttgaagtgggctgccgctgcctagcactcacagctctcctgcatgcgctgacagcaaataagcgggagttcatgaatctctgtgagcgagtgagagacacaaggagggaagctgagtaactgggcttcagaagcgcgtgcgatggattccgaggcatagatgggaaggagtgcaagaaaggtacgggcatgcaatgagggacgcttgatccactttccccgtctatgcacagtccactcgaacaaaccaggtcaccatggacacaaggaacaatctaacgcaaatattagttaggaaggcgcacgatgtgctgatgtcgcaagcccagcgatgaagcgagggaagaccccaatgatcctagaagcttctactgtgatggcacgtagtttggaaatggcatggtcccatgcagcactttgacgactagaaaggcaactaagcatctccaaatccctcaccatgagcctgttttcacgcgagccttgccttttattgccatgtcctggccatcaggtcgactgccaaatcgcaaacttcaagacataccacccgttgaatgtggaagcagggacaacaaggatttaattggtggaaaggacttaaaagtatttgacgcgtgggctaaacgctccaaaaacgtattcagtaccagcagaaggcatcgtgtcatcagcatg

SEQ ID NO: 4010 - DNA, 703 bp, Nannochloropsis_gaditana
  misc_feature (1)..(656): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaccgtgtcgtgagcatcatcgagaaggtgctggaggctgccatg

SEQ ID NO: 4011 - DNA, 703 bp, Nannochloropsis_gaditana
ttaaatcgctccttccagcctttctaatggtccaattttgtgacaggaatcccgctttaattttttcgactacatttcctatgattgtttgttagaacggcgcttagtcttcgatgaatttttatctagcccttgaaatgcgcgtgaggatgccgcttgtatttttcgagttttgctggctgcgtcgtagctagcgtgtaatgagaaactataccgcttcgtcttccattccaacctttctcgtcttatttcattttactcagctttaacctttaaattttacgtaactatatatccatacattataggaaggaggttacaagcttgcaagcacgcttttgactccatggaaccctcacccggagctagaggacgaaatgtaccacaggagtgtaaggatcaagaggtctccgaaatgacagtatcgccatcattgataactacgtcgagatgtgatgtaacactgaaagaagcatgcctcttgtttcaagaaaacgatgataacaacaagagtggtagtatggacatgccagcatgtttctacgcatttccacatcctcacgtgcgagccagtcttaccatcgatggagaaatacggctttctactagctcgcaggaggagagcgctgacattccgttgtgtacactaaatctcacacagcaactcaaggatgaaaagaatgaggacggtggatcattcatg

SEQ ID NO: 4012 - DNA, 703 bp, Nannochloropsis_gaditana
aattgcttcagcggcagactcgtacactttattcgccaaagcgcgcttggtggtcatgtacaggcatgtcacaggtcgacggcctcgacggaggataggacaagtgacgaaaggaaacatctcgtcctgtgctaattcaatatgtgtatcgacgcaaaaaagtgttgaagcatgaaaattcatgacatgcagaacaaaaagggaaagcgacaccaagttccagacgagccgttggtggactgctcgttcgctcccggcccatatggaagcctctgaaggtacgcacacacgactctttcttcgtgttgttagggagctgccagggtcaatgaagctgcatacactaaaaacgaacaggtgtccgtcacaattgacacgaacgggcgtgacgtcgcaaaaaaggcaggaggcaggcatgctgattttccggtgaaaaagcgggctgcgggagagcgatgcacggacgtcatcgctgacgtggttgggtcgaaccccgtgtgctttcagtcagaggattggatgctacttaagacaccaattgcgcatagctacctgattaattcggtgacaagttcccaagagacatggttaatggcgtggaagtcatgacaatctttttcgaccactattctgaccaatctcatgctctctgttcaaaacacacctcctgatcattccagtcaaactttgaacaagaacaatg

SEQ ID NO: 4013 - DNA, 703 bp, Nannochloropsis_gaditana
  misc_feature (94)..(103): n is a, c, g, or t
aaggcagggagtcgcagggggaggccggggccctggcggggcggtggggaaaaagctcaagatcaaaatgagggcacccacaggggaacaggannnnnnnnnntctgtcccctcccctttctctttttcctctctgtccttttccgtcttccgccctttgagtcttgccttgtcctggtgctctctttcttcttcgcgtaaccttcctcactgtgacaccaccttgtgcttcatcggttttcgtcacatttcaccacaatatacgcatatcgcccctttcttttcccccctccctcttccctctccccgtctggtagcaattttccatcgttatcgcaggcctcgacaatatcaaagcccgcatctggctcaacagcaccctcttctccctcgccgagaggtccgaaagcagcgaaaaagacgactcggttcccccctacgacctcgccaccgtcatccccctggtcgacggcggcaccgagggtttccagggccaggcccgcgtcatcctccccggactgaccgcctgcttccactgcaccctcgacctcttcccccccgcccaatccttccaactctgcaccttggcggacacgccacggcaaccggagcattgcgtcgcctacgcccagatattgctctggccggaggcacacccagagggcacggtgttggatccggatatccccgagcacgtggcatg

SEQ ID NO: 4014 - DNA, 703 bp, Nannochloropsis_gaditana
tcatgacaaggcacagggatgacaagatatgtaccactggggtgagtgggtattaccatataaacgaaacggcattacattcgattttaaacgaaggcacgaaatacagaaagcaaaataaacgtccaagggcaaaacagtcagcatcatcagtcatggacacataatcaacgacttctcttacagaaagaaatgtttcatattgctcgctttgtcacagacttctcatccgttttggtgataccgacgtacgcgacaaagtacatggtagtcatagattttagatcccacttaattctcaggctctcagtcgaggattctcgttctccttgataaacactgttggctgtctatctctcagacattgacatcagcttttaaagaatcaagcgcaatgcacaggtctacgatgattcattcccttctgcgtcgcgtggcaaaaagaaaggggggaggtgtacaagtcatatgggccgagtcgacgagacgaagcatccctgcccaccgtcctgcgtatcgccccatacccaccactggagtccatcttttcatgaaagcagacaaaaaccaatcatgttacacttgcgaagtcgattcagcactctagttctttctctcgtatccgaagcaagacacaggggaccgaaaacaggaagagaccgcgtgatatcatcagatactttgtggacggagacgggggatg

SEQ ID NO: 4015 - DNA, 703 bp, Nannochloropsis_gaditana
cttccttttggatccctgagacaaaggcgaacgcgaggggatcgaaagggcatggacgaggatcaaaggcggtacaaagagcagaggatacacgaattctcccttgtcatcctccatcatccatcttttcatttattcgctatgttggagacccaatattcctggaacaagtcaccgtacgtcgggcattccgcccaaaatcgtgcgagcccgccagacaaccccgtgtcttacctgccaccatgtcatctgccacatcttggttttgacagaatatacgtcgtgaagagtgttatgagctttttttgtaagggtgcgtacaaatttcggtcccaaatcgtttctaggcaaagttgcagtcgaacgccggcatgagcaacggtcgttggtccaccacgccacgtgcaatagataaagccctccttttaacgtcgtccacgggcagaaaaagagggaaccgacatgtttcctctggcctatgctgtcatgtgtggacggaaacgggagaatcagagcaggaacatggtggcgggtagttccagttatacctcttctcgctcgctcactccctttctttgccgggccccgtcttgccattctcgatgacctctggcagtaccccctcccgtgcccgacccggttctgcgtccctcttcagcacaacacaggagaataccgggcttgggaagctgtgaaccgcatg

SEQ ID NO: 4016 - DNA, 703 bp, Nannochloropsis_gaditana; identical to SEQ ID NO: 338

SEQ ID NO: 4017 - DNA, 703 bp, Nannochloropsis_gaditana; identical to SEQ ID NO: 339

SEQ ID NO: 4018 - DNA, 703 bp, Nannochloropsis_gaditana; identical to SEQ ID NO: 340

SEQ ID NO: 4019 - DNA, 703 bp, Nannochloropsis_gaditana
  misc_feature (177)..(186): n is a, c, g, or t
  misc_feature (257)..(266): n is a, c, g, or t
gacaaactgcacctctgtgtggcgggactgtacacaaacttcacttgtccgctgctggatcagacgttagagtttgtcgagtaccacacacagcaaggggtggcgcacattaacctgggagtcgactatcctgtaggatcggagtcgtggaaggccgtgctgcgggtgctgcggccnnnnnnnnnngaggtaaaagagaacttcggtgtgcgtgacctcaacgaggattggtcattggggaagtcacacaacgtggnnnnnnnnnnggagcgcgggcgggcggtgctggagttggcgatcaaccagccggccttggacatgccagagcggctctggaagtactacatcgattttgaaatcgagggggaggacggatgggaggacgggggggaggaagggcgaggggaagggcgggaggaagggcgggtccgggccctgtacgagcgtttattggaacggacgaagcacgtgaaagtatggatcagctacgccacgtacgagggagggagagagggcgggatggagggtgcacgggccgtcttcgagcgtgggtacgcgcatttgaaggcccaggagctcaaggaggaaaggttgttgcttctggaggcttggagggcgctggagaaggagcaaggggaccgggcgagcctcgcggcggtggaggcaaaggtgccgcagcgactgaagaagaagaggatggtgg

SEQ ID NO: 4020 - DNA, 703 bp, Nannochloropsis_gaditana
ttgtgcgttgtgagatgtgtcgggtctaccttataacttaaattttttgggactatttaaactaaagttgggaggctgaccatagacacgtgctgcgcgtaagggatcaaatgcgcatgctagaggcttttgtaatgccagtgattttatggcgcaacgtgacatatgtgagcaagaatataatactgagcctcaaatcgagcaattgaaaggataaggaggctgtatggtggaattttgggaggaagccaagaatcatctcaaaagggtggagtcggcactcggcggatcaatgtcgcggatgcccgaaataaaatatttcgacatcttggccattcaccacttgatgtcatttcgatacatgtggggctttttgtgtctataaaactctttaacagcatgctcacagaataagtcgtatggtaaagttgatccttttaggcttctggcggaacaactcttgatatagtgatgtatctcctgcttggactttcttccaagtgacatgggtagaagattcaatcttttatctcgccatcgagcaaactcgcatatctaagcgtgtggacgaaataaattctcctaaacacatggagtcttgcccgcatattgacgctgtaatcattgatcgaagtaagggggaaaaaaatacattttcgtaaatgacagttagtaaggctacattcgtcttcactttgtccta

SEQ ID NO: 4021 - DNA, 703 bp, Nannochloropsis_gaditana
  misc_feature (549)..(558): n is a, c, g, or t
cattgaatgttggtgtgagtatgccagactcgcatatttaatccttcatgtgcttagcatataaaaatcaaataaatcacttgtgaagttgtaaagatgacggtgtcgcctccccatgcttacgatctgagaagcctcccgaccttcgaatggcaagattagctgacgggcatgcaatgaccatgccatatcattcgtaaggtcatcggcaaaacaagggaagaaacgtggtttggcttttaacgtgaggaacaagcgcatagccatgacaaggaataccgttgtcttgaagcgttcgtcttctatctatcttatcccttccattttgctaggggccgaaccacttgcacaggccgctcatttgaacaatcgacgaatgtggtttatatccttcactctttcatacagaaaggctacgtattattatcacgacctttattaattttttggatggggactgacgcaaggagacaaccgttagaattcaaatacttttttttttttgaaaatggttaccgtggcggttgtatgcagcgagacagcgcaatnnnnnnnnnnctccctccctccctccttcctgccccccttcaaccctcgtcctccctgtcgcggaatggcgcgacaaaaaggacgtttgagcgtccaacacggccatagagaaccttttcctctactctgctgaagactggcacgtcgatcgatg

SEQ ID NO: 4022 - DNA, 703 bp, Nannochloropsis_gaditana
taatgcaagtctgtgagacgaatgccgctacttatcccgaaatattgggggctcgttttaagtagagacaggagaactaagcatatcaccaaaatatgtgcaactaaagattcaagaaagcttataaactacttaatagacaaggcatttggaattatttgacggtaaagagatttttcgatggatgcgccgacagcatagccagaaatattacgtgtaagggtcctttacgatctcgcaaatggtgactttaaggaaggattgaaagctatacagtctcgaatgagacattgactccttctgatttttattatctgcgactgaaagataatgaatgaggaatgcatcaaaaagttgtaattggagtgggaaaaggtagacatatagaggaggttggtgatccgcaggaccttgcttcactgtttttgaaaaacaaccatgcagacgcgccatttttattcaaacgatcatcgaaacatgttgtcgcaatgatggttcgtgcagcacctctccttcgccgcgaccgtggtgtgattcgagcttgtccttctttaacgttttccgctttggcgtcgccggttgctgcagggcacttctttccatcatcgtgcactgacaaaaacgcgatgctcttacttacagcttcacgacctccacgactttaccttcatcatcaggatacacctgtcgaagggaatttatg

SEQ ID NO: 4023 - DNA, 703 bp, Nannochloropsis_gaditana
ggcctcgacgacaataccgggagggatgggatccgcaaactggtcagcttctttattccatgcaatattgtatgtggtagacgtacgttaatggtaagttcgcgttgttggtacatatattttccggaagatgaagcactgaggtacgtatcggggaacaagatgctaccattttaaaaagggaggctatggaggaggaatttttccattatggaggtcacacggtccctcaagtatatatatttgtcataatttattcaaattatattcaccggcgcaagcagcccatcaccttctacgagacatcccgttcatttcctatcgcttgcagagaaagggacctccgatgacgataacgatgtgatggaatggggacctccgatgacgatgacgatgtgatggaatggggactcacaagtgtcgaccgtctatgccctgatcaggaaggacactgactcttgcgacgttcctcaggcacgaacatctggtcgtgctcttcttgaatgatgcttgtcatgctcttcagatgtcgcttgatgggcaacgttgccgttcacgcccaggtgtgagtggtggtatcatcgtcaaccaccccgttgctggcacgtgatgttctccttacggactaccctttactccttactatctttcccccggccatctatcctcccattatcgacttcatttagatcaataagccatg

SEQ ID NO: 4024 - DNA, 703 bp, Nannochloropsis_gaditana
  misc_feature (1)..(191): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagtcccctccgcggccgccctgaaactagtgaatcgtcctcatgctcggagtacatgtaatttgtcaccgataccccatggtgagaccgcaggtaggtccaggcagccatccttccacttagttcaaatgacctcggagcatgcagccaagatacgactcagcgaacgcctcgacaacaacctccccccccccttaatggctacagtcgatgcggcacagcattggaccttgcgccgcttggggtcaatgcacggacaaacaaggtgtaagacttgctttttttcgacgtgttgcaatgcgtgtcctgtgtgttcattggctacggagtgcgtgcaggatgataaataagatataccttgatatgggggcagagacaaaacgctgtaaggggtgtcaggaacggatgacacaagagatgttttggctctggattgcaccagccttttcaaattttgaattttagacagtagacgtgtatatatgggtagtaacaatcataacaaagga

SEQ ID NO: 4025 - DNA, 703 bp, Nannochloropsis_gaditana
tctcgtactgtgatcataaatcaaaatcttggcaccagcagttcctccctccgttgttaaatatacagcaatacctttacacttttgtattcaaagaagtggtcatgaggtaatttggcgtcgagtagtataaatatctgctagagtaaagttgaaatagtcaacaagggggggaggaggttacttatcgcccctttttttaaaagtcgcgcgaccacgttgctttctgcatctgatgccttgtaatgtcgcttccacgccccgtaaaagcgactgcaggtatgcgtgaagcatgcggaaggcatgcatgcgggcggtgtagtctgttttgatcgcctgtcctgcgaatcatcagtcgatctaccagtaagacagaactatgcgggtctgtcgtcgctgtcctcttgttcctttggttgaaaattatgattctctctcttcagtatttctatttttcatcgtatttatccaacaacattgtcaggtactcaagatcagctcctgatgctgtgaatcacgcatttcatctctttctgatgctctggatgactgttcagagcttccagagcaacctcccttctctgttcaatgctttttttcgtcgatttatttgcccaccatcattctccattcactcatcacttaggtcttgcatcatcttttaaattcatattcgaaaagttgatttactaggtacccaaaa

SEQ ID NO: 4026 - DNA, 703 bp, Nannochloropsis_gaditana
aaaaagtcacaggcatcttccacgatcaaggtcgctccagggacgatcgaagtggttgtcggaggtggttgagtgtccattcctcgggggggcggccaaggagttgcgatgacgctcgttgatgtcggggacgggggaataaatatgctgcagaagggtttttttcccactttttttgttcactttctttcgagtagaggcatgggctgcgctgtattggtcatgtgggatcgaaaaggggcggaaggtgtgagtctggtgctccttgaatgtgtatggacggattgaaaacaagcacaagacagggaatttacatgtctccttggtcaccaaaaaatcagacaagaaaggtcggacgccaggacgctccaagatcacctatcgcagttgccgtacatccatgaacgacacgcaagagtcaatggcaaacctgaccgccctatttcgcattcccccccgtcgactgtgggcgagcgaggtagccctctcccgcacgtctcgcttgtcaatgaggtaccaccaaacatgcttacggctccatcccctcctgcacgtcacatctacaggcattttttagatcctgtcccaccacgtttaagcgttcgctagagttttgcagtggccggtgtggcaaccttggaggagcacgcgtatcgcggcccttacaagcgccactaaaacgtaccacaccgtgtgggcgatg

SEQ ID NO: 4027 - DNA, 703 bp, Nannochloropsis_gaditana
cttactgtataaaggcaacgtgttgcacgagcaaaaacaaacgggtttggagtgcttcaccaaattatgaaggatttaattaattacgtgcctgacataccccccatctcgccttcgagcagggaagagcgagacagacaattttgacaccaggacagcgacaacaccatgtaactgaatggaggtagccatacccacgtctatatgcttcgaagagaatgggtctgtatccatttactggcatgctttttcaatgtgataggcttgagagcaaacgtcaagatacctttgggcccaggcaaagagacgtgctgccgcctgcctcccgctttatgtacgccctccccgtgaacgcgatctataagacgacttcattccacgtgtacatcctctccttgaatgtcaaagcagggcatcgtgtgtgcgtcctttccacgccgctcttgcaaacctgccaaccgacaaagagcactatcgggtgcgtgctctccgagacgggcaggttcttaatccctcaaaccagaaaaggtcatgtaaggggctagggtccacaatggaatgcccatgtcccacacgtgtcgcgtgcgacgaggcatctttgttatcgatgtcatcgtcgcctcgtcctctcctctctttaacctcccccaacccctccccttcccttctcgcacacttccctttcgacctccctcagcgcatg

SEQ ID NO: 4028 - DNA, 703 bp, Nannochloropsis_gaditana
  misc_feature (175)..(184): n is a, c, g, or t
  misc_feature (452)..(461): n is a, c, g, or t
ttcctccaccacctccacgctttcactccctcctcgccgccgacgtgcccctccaaaggcttatgtctctccttctccctctttcccgggtcaacaccatccacccgatcctcctcctctttcctttccgtctcccacgggcacagtcctccccctccccctcctccccctcctnnnnnnnnnnccctccctcatcctctacatctcactccttcgtctctttccctctttccgaagcccggcaagcctgggaggagaatgaacgaagagctgcgcttgagtatgagggatggaccgaggagggggaggaggaggagggggagggggaggaggaggaggaggaggaggaggaatgggaggataaagatatggagatcgatttgcgggagcagagtagggttatgtgctcggggttgttgatctgaggagtgttgaggttctgatgggaaaannnnnnnnnnaagctgtcgatgcctgtgaaagtgggttgaagttcaaattcaaattcaaattcaaattcagattcagataaatttccctgtccatggctcctgcgagggcgcatccatcgaccgaccaggccgcccaggccacacacccttcactgggaaagacctctttgccccctccgtccgcgcccgcccgaaaatccccgaaggagcgggggagggggggggaaacgaaccttgtcgaaccccatgga

SEQ ID NO: 4029 - DNA, 703 bp, Nannochloropsis_gaditana
cggtcataaagtgcataatagacgcaggtcaagaggcaaagctccggcgcgcgggcagacggcgactgtagcgaggcgaggcgagaaaggacaaaacatgcccgatttgggaaaaaatgctactttaccatcatattggccttcacgcacatcgtacagagacaccaatggaacaaccgtggctttgtcaatgcctttctttccaagttgggccgctctgaccggcactagcagcacattcagagatagcaagtcaacggcggcttgaggcagcccccctgcccaagaatttttgacattcccgggccccgattaagcatctttcagaggcatgtaagtcatagcttgttaattttagcttttagtaggagccaaagccatttctggtttgaaaaagcggttgtgccctggttggacctcccgttccctccttccctgttgccttgcatttacccgtgagcatggctacgagagcgaaaatcttaccccctacaagaacaagcgtcgtttgacgcacagacaccacggaaagccataaggaagcgttaaacccatcgttctcttggaaggaatgggtcgtgcagcccctcacatcccctccctccgtccctcccttactccctccctccttcctccaaccttccctccttcccaccatcctgtttgcccttgaaaagtggcggcccctgcacgtaaaagtatg

SEQ ID NO: 4030 - DNA, 703 bp, Nannochloropsis_gaditana
ttctgttttgcaacgtggattgttggtaagattacctttataagatgcactgattcgggttgtcaagcaattctcacaagcaatgactgcatttgtcgagtaaattgtcaaccagacgcgccatctcttgcatgaccgcccctaagcttcatcgaagccgtcgtcgcaaagctaccacgtcggctatacagcatgacagggctagaaatccgtaaaatgagtgccctctggagtaagactaccggtatgatgtcgcatatcgttctatatgcaagcttcgatcactccgctattcatcttcacacaagtagggggaggtaggaggcagaggagtaaacgttcaatagaaaaaaagtgcgggagtcatcaaccccaaaaatgaatgcgcgcgcttaatcagcgcaatatttctttcaaacagttgaaatgtgttagctgaccgaaataatagtaggttgatcagagaagaaagcgaatttcgtgatccctattcaggggtaaatttgaaaatccgttgaaaaggaccgttaaagccaacggaaaatcatttcctactaactccacccgcttcatttcacgtgcatttcctaccgaatgatccaattttctgtttatttatgtactcaatcttatctttgaaaactcgacatctttccaaaaggctgctgcggtcgactagcttttctagggatcagtctttatg

SEQ ID NO: 4031 - DNA, 703 bp, Nannochloropsis_gaditana
tctttgcaggcaagtcaagtttgggaccgtgaggcgtagggagccgatgggaagaagcaagatttttgagggcagcggtggcattcttgttgagtggggtaatgcgcgcgctaaaagtgctcattacccttacaattctaccccataaacctatttttctggtttcgacggaaagaaaagtgttacaggggatttaaaataaatgtaaaaatgcaataaaaggcgaagacaatttttttaggaaagagacacaatattttgtgactcttcactgttctacgaataaaattgtaagatttcctatgaaatgtatgattttaaattaaagacgctgcacaaagccacagaaggagcttgaaacaggcaaaatgtgcctccaatttctctccaaaagcgggtcttcgcctattagcagcagtcgcagtccttttccatcacatcatccaagagtctttctcaaatacttcttggggtctttttccatcacatcatcaaatcgtctttctcaaagaatctttggggcctttttccgtcacatcatcaaatgaactctctcgaagaagccttggccagggtccttttttatcacatcaacgataacgactaccgtgaccatatatgaatccttgcaatctttgaggtgtgttcgcgacattgagtattacctacgttgacaatttttaaacaggatacgcaaactatg

SEQ ID NO: 4032 - DNA, 703 bp, Nannochloropsis_gaditana
ctttccatttcgtggtaacacctgctttgttacatccccccccatgccttcgtctctctcttctctgccctctactgtgacattatcacgagctgcaggagccgatggaggcaggtacttggaggaaagtgtttttggcattactgtagcaaaataataatcacttaagcatagatgcttactttttataaccaaaatgtttgtcttggtggcagggccagggggcaggcagaggagaaagggaaaagcccgcctgcagccctcacacgccaaaaaggtaggtcatgtttctttcgtaactaggttttaaatgctagaaaaaacagggagaggtggggaggggcgagaagaaaaaaaatcagtgggggggaaaaaaaaaagcagaaaaaaaaatctcggtgagcggtcaaagatcaaacccgccgctcttggatcgaagcgggaggagagccgggcaatagtatccgtgaacaaagctgcgtgtgccaacagtgccgaactctttcgggactggaccgggtcgaaatgtgcatatagacgattcctctacacattttggattcgtgttgtacgaccttgttggctagccggagctttaaggaacttccccccccttgaaacgtcctattaagtcttacccgccctcctcccttgacccgaccttcaggtcacacgttccggcgaaacgacacatggggaaatg

SEQ ID NO: 4033 - DNA, 703 bp, Nannochloropsis_gaditana
ggaggagttgtgatgtatatatacactaatacaaattaccacgccattaaagaaaatagttttacgctggcataattgccatgactgtacaactcaggacgcgggatcgatttcagcgcagggttctttcttgtttgtttaactttcagcatagtcctcacgcgaaacctcgttgtcgggcacacatttttttccaaaatttcaaattccatgagcacgtcgtcctgcccgttttgaccgatgctaccaccatgacgagtttcccgacccttgaacccgccacgcggtacatttttgcggcctatgcctttctgtgcggtatgttacttctttcacgagtattgaagtgcgtttgttgccaatgggaataatatatgtgcaccgcggcagacataatcatgccatgggcccataaaaaatcaacaaatatgataattttgcccaaacataaaattgagaccatccttctcacaaatttgggctttcatttgttaagatattattttttaatcgaagtgtagtagcaaatgatggtgttaatgaagtaaacacccgggtttgtgtacagaggaaggaatgcaacccggtgcgattcgttgctcctacgctgccatcagccatatgataatcatccttgctcccgcgcgcacaaatgtcacgacaagcacaggcactttaaagcgttcatatctacataagcatg

SEQ ID NO: 4034 - DNA, 703 bp, Nannochloropsis_gaditana
aaaatacaaaacaagacgttttcggaaaatatccccacacacatgcgtatcgggatgaatacatcgctttcttgttcacctcgacattgcatcctgggacaacgtagcttcctagagcaggcctgagatatcaaggtgtcaggttttttcccaatctttcttagaaaaacactcaacctacttcaagagccatgcaagactgaaacctaactgatggaatggatgtgcgagaaatgctatatatcatttgttgtcaagcgttctaggacggcgaacggatattcaaaattttgagcaaccgtcttcggttgacgacagcattcacaagcaggttggaagataatatgccacaattgtggacgtaagtaacaaagtgtccaccatcatggatgttgggcattttatgggcgaagtaccatgcgtgaggtttcatgtcgtaccctgcactttagcaaggagaaagataaggcggagaaacgcacaggctcgatagaatggtggtagaaagaaaggacctggagatgacaacatgtcaagccttcgttttgtcgattccagattccgtgaaatcttaagaaagtctcatcttttcttcattttttcaggggcatcctcctgtcgggaactttatatgtatactctctcacttagcgatcttattatacaacacgtgcttctggacgaatacaggtgctccaacatg

SEQ ID NO: 4035 - DNA, 703 bp, Nannochloropsis_gaditana
  misc_feature (479)..(488): n is a, c, g, or t
ttctcatacgtagacacccgcgtccttacattccaatagtacatccgtccttgctccgaaaatgccgtcctccactcccccctcttgtcttcctccccttcctcctcctccctctcctcccgaccgtcccccatctctccctcctcctcctcaactgccttcccgtccggtgtcacaaagcggggatgcatcctccgccccgccctccctccctcccttcctcggccccaggctggaagcggcccccatttaaagcgagattcgaagatcgcctccttggggagcgttttcagagagtcgaactcccggagcacgtatctgggagcacgagaaggagggaaagaaagggaagagggagggaggaagggaggaatgaggacggggaccctggcatggtggtgggtgcatggacggagggatggagggagacggcccgggacaagggagggagggagggcagagagagggggggcaggcannnnnnnnnncctctgtgtttcctccttgttcagggctcctgttccctccttgtgtctttttcggtcctattccgcgcagtggcttctccctccccttgccactctcttctccactttcccgccctcctcccctccctccctcgcaccctgcctccttcctcgctatcgggtgttttcgtcctctaccaccaacttgacgtcctctgtgtgcagttgcactcatg

SEQ ID NO: 4036 - DNA, 703 bp, Nannochloropsis_gaditana
tgtgttgtcgttttgcgagcgagaggacttgaagcaatggtgtgtgcaacaatcagcttcaaaaaattccgatccccatgccagagaccgaacatgcgtcgtcggcctcaggcgcagagtcgcagtgtcgccccccccaaaggtgaaatgaggcgctcttcgacagagaaagagcacaccatcataaatcactctttgatgaccaggtggtatattgtgaaaaagacgacctatcatgcaaaaaaaaagtgcggcccgcatacttcctcatgctgtccgtctcgtatagtctgcccaccggggtttttttggcgtgtgatgtaggaaggacgacacagtggcttgcttacttttcattaaattgaccttatgactagaatttaatatggataaacgtatctatgtgggaattagctgtgtatagatgagttacatgtctcaatcaaggcctttgggaccttgcctcgaagcgcctccgtcctgacacgaagcgtccaccactcccatacaactcgggctatcctagcctgcactaaaggtagtttcacgtgctaaagggttgaatatatttaaaaaaaggaatggcatacctgcttcttttgccggacccgttttgtcctttctcaccttcacccttcctccccctctttcctcttactcgcgtcccggacgcccagacccaagacactctgaagacggcatg

SEQ ID NO: 4037 - DNA, 703 bp, Nannochloropsis_gaditana
gcatggaaggggttttcgacacatgggaagccggacgtacctgttccaatttcagaggccgcgatagggaaaggggagagcaaagtgacgagaagaaaaaccatcaggcttgctaaattacgcctcgagacacaaattcctcgccatcgttgggtgtcggggcgtcccatcaccatgcctggcctgtatgtgcggggaatagatggcgtcggatgggaacattgaatgttgacgtcgctagtagagagcaacttttgtgagcgagcgtggcggggaaaacgaggacacgaatgacaatgaatccctcaaatcagttttttaaaagcgatgctattatttcaataagcaggttgatcccaacttgatgccatgcacacgtgaatgacgtccgtagcacacaaaaataatcctttccattgtacggtccatccgccagcatcttgcctaaaggcccatacgggcttgatccgtcctccctccttccgtcacgcttttcccctcccatttgagggctcattcctcttcccaaacttatccgtcccatcttacaggtctttcaaacgtcatgctagcactgcatgtcttttttggaacgtacctttcgtctttccttctccttttcatcgtgctcgccaacggggcagagccagcctcctctcacccctctcccgctgagataggagatgttggccgcaatgcaatg

SEQ ID NO: 4038 - DNA, 703 bp, Nannochloropsis_gaditana
  misc_feature (460)..(469): n is a, c, g, or t
agcttgcccccaaagttcgtcgttgcccaacccgccgcgcaaggtgtcgcgcccggcacctcccagcaacgtgtcatcgccactgttgccgatcaacgtgtcgttgccgccatatccagaaagcgcattgtcttcggcattaccgcgcaaggtatcgttattgtccgatccgtgcgcgtgttcgatggatattagagtgtcgctggtgccttcaccgtccagcgccgcacctgccacaagatcgaccgtgaccgaacctgtggcatcgagatagcgcacaagatcctggccagcgccaccgtcaatcgtgtcggtcccggcaccgccccagagctcgtcatcgccaagcccgccaaacaacgtgtcgtcgccgtcgccgccgatgaggatgtcgttgcctgcgagaccggtgatcaggtccgcgccgccgtaaccggtcaggcggttgtcaacattgttnnnnnnnnnnaacatgttcacgacatttttttttggtgagccaagggctttgcatgcatgagcgtgcatttgtacagtgtgtgtgcttttttacgatttttccaaccggtcgctcctaatttctggagtattctcaacggcgtctgttcaacctccttcattccacttccgttgcgatatgcgatttaattaatgctttacaaatcaatgacttcttccccctcttagtctgcaggcaaaaatg

SEQ ID NO: 4039 - DNA, 703 bp, Nannochloropsis_gaditana
gcggggtatagtggaaaaaagaaaagggagggaggagcgaacgcgagcgaacaaacacttgccaggaaccatttcccgggcactcgcgcttcacaaccatctcgtactatacaggaaccaatttcgatgtgatggtgtatgatgactgcgcggaacagtgcgtggagagatgacagaaaatagggcgggaacgtgacctctccaagagagtcgatgaggtccactgggttaaaaaacccacacactgaataaacttacgtccaagtccacggcttaaatcaagtgacgccacggctgctgtgctttgtagtgccactgttgtgatacttatgcgagtaagagtgcaggtaaaggtaagtcttccgattgtgcggcgatgttgaaatggagaagcgtctcgatgggcctgaggaggaagacggaggggaactggttgcttcaataatagaggcactgacgccaggaggctctcgaatatgctctcgaaaccacgattcaagtgtgccgtgggtagatgtgctaaggcgaggcttcgacaaggttttttctcctctggaaagcagcctgcagctgtctaggtgacctcccgcccagtccagcccagcctcaggagttaccgagttggaactagaatttccttcaaatcggcttggcgccccaattgtcggtcttcagtgagctaattttgtcctctcaatcaaac

SEQ ID NO: 4040 - DNA, 703 bp, Nannochloropsis_gaditana
  misc_feature (1)..(113): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaagggggaattgagtacaccgtgagagcggaggtggctcgtcctgaaagtgctgacatgcgatagacaacacccagctctttctgacaaaccatcagttatctttctaaattaccacagtgaattcaaagaagcgatcgctccaaaacgtaatcttctgttggcattgatgattcaatccatgtgaacgcgtctcagataacgagaacgtattgcggaggcgctgtgataaaatatctgcctgtccacacacctacaaacgcgcactctcctccttacctgtcctggccacatctatttcaacctggagctatgccacaaatatgcagtggtccctttgttccctgcactgtaagatgtgagaattttacccgtgtgagccgtgattccgattttcttccctgtttcacccaagcgagaggacgtcgcgggcgctcgccgtgctcgccctccaattcgagccaacaggcctcgatctgcccaccccgtcagcctgccagctttagcttcagccgtaacttacgcgcacaatccgccggcgaagaggtaactttatctctccccttgcattacaggaagcattccatg

SEQ ID NO: 4041 - DNA, 703 bp, Nannochloropsis_gaditana
  misc_feature (1)..(340): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcttgaggagaatgcgggggtagtgcagcaggagctgaaagaggccttggctatgggagagatgctcgagaaaacggggaacaacgtgtgggtgggcgctctgacctctgagggggcggcatacgggcccgactggaagaccttggttctgcaggtactagaatggattggtgggattggagtttttttggggggggattcgggagagggaggtcgtcaatggcgcggacctgcgtgaagtacttgtctcgtgtacatgtgagtctttcatgtccatctatctatttctcgttgtcgtattcatctacatacgtacttgcatgggagggtccacgtctttcatgcatctatgctgacatg

SEQ ID NO: 4042 - DNA, 703 bp, Nannochloropsis_gaditana
  misc_feature (91)..(100): n is a, c, g, or t
agcccactgcctatcaagcttctggctcctcaagtcccccgtcagtatgcatgaacccccccccccccctatggcgacaatagaagcctannnnnnnnnntgtgctcaactatcattcctttcttctcaacaatcatcatgcgtgcatacctgctgcaccatcccgttttcattcgcctgctgcagagtaacttgtcgacgggccatgagctcctgagtatccgcttccaaggctttgtacgaagccaaagcctcatccattgcgcttgcgctcatcttcacgacagagcggtcactacctgtgtgtgcaggtatttgcggagaacctcgtccaatcagaatgacagtgattgctaattcctttcacttctctttcattagggtgcttgggacaagcggcgaacacaagaggaagcacaacaggtggagtggacaaaatgcatgcacaggaggcatgtcaaaaatagaatagtgtctcaaacgtttattcaaaggggtctgtctcaaccttgtctgcgccagaaatgttttttggggaatctttttccctccaagtcgaaaatttgatgcatcaaggtcgacttgctcgccctccagagctagcagcacctctgcttgtgcccctgcctactcggcaatcaatgcgtcctctcagcaacgagccacgccctcaccattcaaattgacagcgcaatcgaccatg

SEQ ID NO: 4043 - DNA, 703 bp, Nannochloropsis_gaditana
agtgcgttggttgatgttgaagggcgccagagaggtccttcaacagagcgatgaggacgacggcacgataggagggacagaccagacaggatgtataagacaaagattccatgcccatagcgcgccaacttcaatcaaaccaaccgtatatcattcctaaaaagtcgccatggccccacagaggcgtcttttcgggcctttgcgttttcactcgggcctcgccggccgcttagccactcttttcttccttgaaagctccatggcccatatccacgtgagtacgttgctttcggcccgcttctgccctcgatgttacgccaatttgcatcctatccttggtaccaccgtcatttatgggtatgtatgaacataaagagtatgtttggaggcgtgagcaaggtaaatttattggggacaccgtaatatgacggccctggcatcattcggcagtgtaattgggtagccctttgttcgccccttttctccacgtctgcggcatgcacgctctcatagagaaacgcaaatccgttgtacaccgaaagttccatatactttagatttcctttacatatgggtaaggctgtatttctgttgactgctcagtgtcctactatttagacacgcgcgttgcaatacattctttagtgtggaaagaggggccaaaatacgaaaaccttaattttattccacctggacaacaatg

SEQ ID NO: 4044 - DNA, 703 bp, Nannochloropsis_gaditana
ctcttatgtatcgtacctgctgggaagcacgaaggcttgcacagtcgcgagaaagttggcagacagaagtgttgtagccatggccacaaggcagatcttcgaaaaataacccatctcttgcttcgcaccttcctttttcccttttttcttccctcgctgtgcatgtacatgttttgtggggtaaggggagatcgtcaggaagcatgtacggatgcgtgtcgggatcggacattaacacacaatgtcatgcccaaaaagacttaaataagtcacaacaccgccatccaccacacattaacactccccctggttcgttcggtaccgcaccaatgcgacgtcatgcatagttttctagtctcgcccagtccatgtccatcgctgcgaaacgcgtcacaggatctagcctgtccttacgcacagcctgtcctagaattgtgccgccaaaacccaaagcggaggctcaaggcttgtcggggcatcacctgcaacttgaggcacctactgcgttgtggacggacgacaatgaggtggtacgcgtgtgccacatgctcgtgttacggagctcacacgcggttattctgtgttcatgatgtcgtcctccacccgtcttggctttggatcgacacctgtgtctcacagtcactcctgctcgccttccccccttttccacccatagctactcacagagccctccacgagtatg

SEQ ID NO: 4045 - DNA, 703 bp, Nannochloropsis_gaditana
caaggattttcgacatgccatttggtgggctcctgatgtactgggaagggcaggttcgggtaggtacaggaaatcctgtgcgcgttgcgaaggaatgacatttttacccgacactttttcagttaattatcctctcaattattttcctgtctcaaatgttgtaaaggagcatctatctgagttactgtctctcgggatttacttttagaagttctgatatgaaacggcgcaagacccattacgagaatgggccagccccgccactcgaatttctaaccttgcatgcacgctcaatcaaaccgtgtgagtggtgataaacgcattttcggacaggcttaattttaacgtcagtagtgtatgccattgacacactttaaggaacggaaaatgacatgcaacagggctccatcgggaccgcgtcattcttccgcttacgtactatactacgtcaagcacaacgctggagcagacataaggggggaaaatgaagcacttattcggcaatgcgactgtgtagacacgagaaattttttctgcaatgcatcgacccacaatttttgcctgaatgatggggaaaagggtctcgggcgtcagaaagttttgtgttgaccatcttcatacttgccgtcgaaaacgtcgcggcttcaatcgcccttgtgtactagtcctgatcaaaagttctcaccatcaacagggaagtatg

SEQ ID NO: 4046 - DNA, 703 bp, Nannochloropsis_gaditana
gagatgcagcggttgcaaatgtgtcactcgtttgcacttctcccttggccacagcacatctcctggaaatgcaacaaagcgagtagacaacaaaaccctgtgagcgttgtcacgcgcactatggggggcctagaggaaagaaaacagaattcttgtacgtcctgaagggttcaaggatcactttgggtcgactctcttttgtttctggaatatgagcaccctgcggctcgcatcgattcctcccaaaactacccggaaaatcccgtcctggtactttcggcagggaaatgtgcccctaagacccaatgcagagaaatagacactattctacgggtactagaataactagatcatccactcctgtgaaaaggaaacgcttgtttggacgacaggtctcacaagtctttcgggacggcttttttccttgtcctccttgtcgttccttctcctcgcctccgtcgccgaagacttctgtgtacttctttcctccccctttggcgcaaaccatacgaaagacacgcatattagcggatggaaacaaaatcggatgcaaccagctttttatgcgcgtagcgcgcgtctgatcttcctgagcgctgactccggagcgtgcggccacgcataaacgccagcttatatcgccctcctcttcacttccttcatcctagtaccccctaggtactgcctgccccttttcatcatg

SEQ ID NO: 4047 - DNA, 703 bp, Nannochloropsis_gaditana
ggttctgacttacggcctcggttcactcccacatacagaatggccgacgccacgagagaaactccgagtccacctatgatggcctgagacatatatgtatatatatatatatatatagattaatcaaaagaggttgaatgagatcgcgcgcgaattgcctccctttggactccaagcctcacgcgtgaaccccatctggtttctcaatcctccccgtgcgattgaatccattacctgcgaccgcggcatctgttccaaggcattgagccaagcacgggagaaagtcatcgttatctgtaggtatcgtggcgatgtgcgaaggggtaattgaaggcgtgtgtgcatgtaataaacggcacctcattcccaaggagatgcacgaggcggatgagcaagaagcaaggaggctctcgtcgtaagcggaaaaacaagacctggtacgatcgaccaaaacacgcacgcccttccccattcacctccttccaaccaccacggagccccacgtgcatgtcacagatcccggcaggcgccgcgggggtggcacgagttggcatttggaagggaggggcagcgggcagcccttcgggtcccgggccaccgggcgcaaagatcataaaatgtgacgctttgccccttcctacctgcctttaaaactgacgagacgccctcccacccgacaatacaaacaggaaccgctcgaatg

SEQ ID NO: 4048 - DNA, 703 bp, Nannochloropsis_gaditana
aagcactcggcactctagcaaaaatttgcccgtcccttccccttaaaatgcctactccgtcatacgacctcagctacgtcgtcatcactgcatgtgtagcatgtggctgcgtgttcaatgggaaggcaaagagatgaagatccatgagcatgataaaccggtgacgttctcaggacgtgtgtcgcggggggtagatatgtccttgccggcggaggtaacttgccccgaaaaaagccctttgaacaatcccaaaagtcccaaaagtgacacactgcttttcatgctgtcaaaagtgcatgacctcatatgtctgcaccatgttgggcgcattctacccgtcgacatggccgcaaaggacaagcccgatgccctcgcaggttgagcagcacgggacgaagccattcaccctttaaaaaaagaataaaatgcatgtccgtcaccgacacagcccccctcctccagggtgcgttccttcacgctcgcaaagggccccacgttgcggcgagggcatcaggcttggggcatgggcgacttgtagcgttgtggtttatgtgataattacgttcacgagtcaagggttgacttaccgcgtggagggtgcttgtatggccgtgtctttctatccctacgtcgtcggcaagattgccaacagcccttcccccgtccgctttctgttttcccgtcaaacacagcaagacctatg

SEQ ID NO: 4049 - DNA, 703 bp, Nannochloropsis_gaditana
agcgatggaactcgactaatcataattttggtgatggctagtggtggaatatagaaggattccaagcgcgctgtttcgtgtatcctaccactgatattcgttccatgcgcaatccacaaatttgcacgttttattgtattcgccaaatttccaggtgcatgtttcatacacataaaggggttaagctacgaagcggcaagccctccgtcctcccccgaaggaataatgcatgaaaaggatgatgtgagggaaaaggcccccactttgggtcccggacgggaagggagggatgatgtgatggaaaaggaccccggccggggcgttccagcacacatggtcgagacatacacgattcacactttaatggtcggtggattaaaaatagcggccgtaggcttcatctagtgactcttaaagctcatgtctcgccctgcgaagctgatttaattgtatgttgtctgccttgtcatcgggcctttcgcaatagatcgagtatcttcacccccttgtatgttgcagcatccttccgcttcaagtgctacgacgagaggtgctcatgttccatgtgtattttactcgctgtcctagtacatgccattagacgctgatcttactcccgatccttcccctatgttcgccataatgtaggtttaaagaggcctcttctccttggattgctgcaaacatgcctgccttagcggct

SEQ ID NO: 4050 - DNA, 703 bp, Nannochloropsis_gaditana
aggaggaggagggggaggaggaggaggagggcgaggaggaggaggtggtggataggggaaaaggggagacggaggagacggacgggggcgtaagaagaggagacgaagaaagggacgcggaggacacgacgacggagggtgttgccgatgagggaggggcaaggcccgccccagcccctccctccctcccaaccccaccgccgttgcacgccagcccccaaggaggaagaagctgggcccaggccgtgaaagccacggcgtctcgcccccctcccccggccaaggcgatgggggcccgtcggaggcaaggcacagaccctagcatccctttccaagcgttgaccatggaagagacggcgcggggagggccgcgcccggccttgtcgcgtgtcgtggagggcagggcgggggagcacggaggcgtgacctctcggatcattgggggcgcgggacaggaggccctggggcttgcgtccggcacgagggaggaggtggatgatgaggagggatggatccacacagggaacctgacaagcgtccgggcgaagggggtagagagtgtctttggaccgagggggggcacagggccgacccaggacagagacggggtcatggagccgtcgctccccttggtcgcgtgtgtgacgacggattttgcgatgcagaacgtgatgcttcaaatggggctccgcttgatgtcctt

SEQ ID NO: 4051 - DNA, 703 bp, Nannochloropsis_gaditana
ggaggtggctgctgggatgccagggcggtggacggcggtctggaagtcaaccgcccgttgagcaaggaggagactgggaggaggtagaagccccacgtgctggccggtgccaccatcaatgagattaccaagacaggtgcccaaaacattttaatgtccgtgccatgtcgtctcatggtacctatgtcggtcgtggacgttggaatcaaaaaatcaaggtaaagttgctgttgagagggcagcggcatgacgtacagatggtttgctaagcgcggtggtcgcaagaagttgggccgaccagccccacatgaatcggcacagacacatgccacactgtttcttcacctgctagacaacatcgaattcctgcatgcattgtgcgagaccgcgtgtgtccttgcgaggcgttcaagtggatgtatcttccctcgaaaagcgaagcatcgagaagctcatcgagtcgatcggttgctcgtccttggaaaaatgcacttgcaggaaacgccgtggcttcctacgcgttgcccgcgctttgccagacggagtacgatgctgccgcctcaactctgacacttcaaccttgtccacctgcgtgcacagggccttgtctgtccagaattgagggttctggaacagaacagagccttggaggggggtgcgtggctgtcctcgcgctctctcgcttcgagcggcccacaccatg

SEQ ID NO: 4052 - DNA, 703 bp, Nannochloropsis_gaditana
gtaacggaggtgttgaggtatctctgcattggtttcccgttgtattcttcaaactacagattttatcagaacacaccgagttatcagcagaatcatgtgattgttcattataagacttttttattttgcagtttttcttgtgaaaattggcttagcttgaaggacaatagccccagtcaaagacgcgacctgagtacccggtccgatccgtagattgcttttggcccccttcccaccaaaacccaattaccctatgattgctttaacggataccggcattcgacacgattgcatgataaaggggggagggagcaagtttttgagacgttgcaagttttggttgcggcgtgcctgcaggaatgaacgtgtcgtgcagttttgatccaggcgctcacgcgtacgtttctcgagaccgagcacagtgtcatagagactttattctagcctaagggtacatgtttacctgcccaaggagctgctaacgcagccatccgtcagaaaagggtgtcgttaaagtccatacacagaagtcttgttttgcggattcttggtcgcctaaaattccctttgttttcctcaaacctcttttttgaccctacattaataatcagagaggcacggaataaaagggatatacttcgccgggagagctgtcaacctgagaaatagggaggtattcaatcctcttcaagcccgcaaaatg

SEQ ID NO: 4053 - DNA, 703 bp, Nannochloropsis_gaditana
ggcggaaagcccggaggccccgatgagagaaaggaggacgaagacagataaaagaggccacatcgtaggcttgggctcgcggttgagggatctggttgaaaatgaattattgaggaagtcaggaggtgaccaagcgggatgtaaggtggcctagtccgaccacaaaatttaagaggctttgcaaacctgccaacacggcgcgcaggcatttaattactctcaaactttacaaagtttacacatagcactttttaatgacggcacgactcaatcgggggcaaaattgcaaggtggttgctcctcttccatgggaaagggatcgatccgagccgctgcctcgcgctccatgggcgcgtctctttttcgcgtaacaacatccaaaagacgacaaacagatatctgatcaagggtctttacgcagacatgattttaatgccatcgtgcgcgagatgggtgtatattacattcaatttccgtagtcacgggcaggcctgcctcgctcgcctcttctttgaagcactttcagcgacactcgggactaaacttgctttgacaagccagccctgacagcgttaaaatcacctaccgacatgcaggcttgaatcgtatatacttccgacggtattggcagcgttgcatacttttcgagagacggcgagttgctttcagcagagctagcagcaggggtcgattagccatgatg

SEQ ID NO: 4054 - DNA, 703 bp, Nannochloropsis_gaditana
tggaacccatcggatttgggaaggacgtcggcaagggtccttgaaaatagtctcgcaatctttgcttttaaatctaacaatagaaagaatccagcgatggcgtcatagcaggtacgaagatttgacaagaaaatcagcttgctcacgtgaagcagcctacaatcttaaggagaccgctcaagctgcgcaggcgtgtcgatccagtagcatgtgtatgagcaacaacatgacgaaatcatgcgatgggctatgttcaattccttcactctataaccctatcaatgtcccagtcaaatgatatcgcccgataaacttattcctggacagaggtgttgtctcttaacatgcaactgaatgtccacttgtcaaggctttgaggtaatggcgggctttctcatgcggagggaagcgttggtagaaccaaacacttcgacacgcattagttgatagggacatcttcacacaggcaaaagggatcgaacggacatgctttcgtagtcaagactgaaaatcataccgtggaatccatacgggatagatttgcgcccactggtgcttcttttctgtttaatgctagcgccttggggggtagggacagggcgccgccgctcgttacttcaagtgctacactgcgctttcacaaaactcagaggttgcctcacccacattaaagaatcacgtaccgttccgtacttcacgtgca

SEQ ID NO: 4055 - DNA, 703 bp, Nannochloropsis_gaditana
ctctgccttacgagggaccatccctctccttcaagttttctgtgaggccaatgggggggaatataaggaaacctaccgaggttttccacccggctatgcccaactgattgcctcccccgcctatttctggccaattcagcttcattttatcaataccagggcctctatacctcgctccctcgtccctgcctcgtcccgcgccgaccccacccgggactcatggaacggactgatcgaatgcccctgctccaacaggcggaccttcgacctgagggcgaatttggtggatgggaagcccccatacccggtccactgtcaaggtgaggtgctggcccagagcaatcccgtctgctcccttgccacctaccaaggtggcctccgctgctgtgagcctggcatggtcttgctggacagggagcagctgcagccagtggaggaggacacctacctactgaaggcgcgcttctggtacgaggagtaccgcgaggagggggccgggcaagggcggggggacgcagtggagggcattgtgggcaaagggccgagaatggttcaggagggggggagagcggttgtatctgggcatgagaaagggaaagtaacggtggggagggaggaaaagggggagccgcccgaaggagaaattaccgacgacagagtggagggagttcggaggcttgctgctgtcaaagacagcaagatg

SEQ ID NO: 4056 - DNA, 703 bp, Nannochloropsis_gaditana
ttctgaggggccaggacggcgatgatgcggtaacgtggagggaaaaacctgacgtgcgaccacgggaggaagtagagaaagagcaaggtgttgtaaaaaagcatggcggcgacgaagaacgtgagcttgaaggtgagcaggggggaggagaaattcgagatggccgggaagagggtcaggaggaggcagagggagacaagaagacggtgggcagcagctcgcaccatccgggaaggcaaagagagggagaggtgggcgcgaaaacggtcataatactggcggccctggacgtagaaggctgcgggcatgatcccgaagaccacgacggcgttggtggagaggaggaggacgtcgaagacatgcaggtggttttcatcgtcgcccgtcacgtccagcttcagcaagagggcacagtaggtgactaggaggatctcggccagggcaaatccttgcaagctgtcgtcgctctgctcctcgtagggctggagccgcaggtgcaggcacattgtcacggcacagaccagacacgcgatggccagctgggtcgcggtcccggctgcgatgaaaatgatcaatcccgtcaaaaaaagcttgcgcagtagctcgtagatctcgaaccaccagtaacggcgtcggtaggtcttgtacaggaaggagaggttctcgtcccaggggtggacgttccttcggtacttcaaaagga

SEQ ID NO: 4057 - DNA, 703 bp, Nannochloropsis_gaditana
tgtcacagagaccgtcttgaaaagccgattctcttcacaaatgttcttatctaggccacttttgcggtacagtcaggtaccaaggagcacgagactcctgatttttggtaattgcagctcgctcctttccagctcgatgtccctgctcgccgttcctccccccttgatgcgccagggcataatacgtgagcaggacacgcgtcttccgtcttttgagggcgaaagtggaagtaaatgaggtgtgctcgtcgattggttgaccacagcgctcgttggatgcagtgtgcgctttaagtttggtgcccgatgcttgcttggctcctgtccccgtcgctacgatcatcgcctgcttggagagaggggcgtgcgcagccttgagaccatgatcggttgcctcgcctctgttttgcctgaaccccgatttctcaatgcctattaggccgagctcactattacgatatgcgggccggacctctactattaaatgatctgtgctcaccagaaggatgcttagcgtggttcccaaagtagctctacccaacacgtccttgtacagcgtgtcgggctttgaacccttcgacttcagtcacttttccccctccttcccggtttttatgcattacttggacaggctggggccttctatatttgattgattgctacggtaggatcctcagtagctcgtgtcgtgcagtccaccatg

SEQ ID NO: 4058 - DNA, 703 bp, Nannochloropsis_gaditana
attgaaagagaaagtaaattaaccagatgggcacaaccatgtacaaagcaatataggggcgcgatgaggaggttaacaatcgcgacaacacacaccctctccatcctgcttgtatggttgtgacggcagtactatgtattgataacaacgataccagttgctcaggaggcacagagtatttttgtctttgatttttcttacaaaagttgcttacctcggataaacgtgactgcatccaccccgcaaaaacctcgcaaaaaattggatggatggatcgtatacctgcgtgcatttaccactcacgacagccaagaataaaatttgttttcacgaacagaggcaagtatagaataagtcacttcactcccggctagtaggatgctttgacgggtttgcggatgccatataatggcatttgtatcgtcgtccttgcctcgtttgcttccccccaaaaaatagagagtgacgttgttcttgcagcgagagcggcaataaggtcgactttcctttcccatgcgagaaatgcagcggcgtcctgtaaatcaggcaaattattcaggcacaagattgaatgaaatatatgtgcgtacgatagtatgacacaattatcataattgtggcttttcagacagactcgcacttcgccctagtccatatcatgataccctagccactatcaactgctttctaatactgcagtatg

SEQ ID NO: 4059 - DNA, 703 bp, Nannochloropsis_gaditana
  misc_feature (1)..(667): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcgaggacggtattttggacggcgtcagcgatg

SEQ ID NO: 4060 - DNA, 703 bp, Nannochloropsis_gaditana
ttgtttgggtaatagtctaaagacagctctctgcgttatcttttttgggtgctctaccgtactttaagacatggtaaggcatccatctgcatgaatgcagactttacctgtatgactgaccaacgccattggcaccacctgtgcacctctttatcagaactacacaatgcaccttgcagagctattccctttgtgttttgggcattgcatgtgtcgctctcgtgcgtatttcaatggttttaccttaagcatgtgctgacatgttacaacttgggcaatatggcccctttctgaaacccttagcgcggccctatcaccagttcgcctacgtacatctcacacaataacacacacattcacgtaattgatgaatttatgcatgtttttgtggtcattttggcctgcctggctggtttttaggtcctgtgtatacaaggtagacccgaccctttggccatgtccctcgtgtttactactcattgcgctgaaccaaagtatccgcaacttcgtacaacaattacactcgtcgcaacaagatgatcgtttgatggaaacactcacatggtggtgcgcaaggcgaatcaaagcgttatctgggtgtttgccaaaagctgtcgcccctccgttcaactaaccttcccactcgctctgcccttcctacaactcaaaacttcaccagctctttgtttccccggaagctatg

SEQ ID NO: 4061 - DNA, 703 bp, Nannochloropsis_gaditana
aaagagggtggaaggactaacgtcccgtgcctaggaggtgtggtgggcgaatgtaatggtgcccaggagatttaaaacatcacaaaggaggtttgtcttggattgtttggtttgaagtggaggggtatgggtgtatgtatgtggaaatgtgtacgattgtggtgggatggtaggtgcggttttgttgtatgtggcgatgaagcgtaaggaacaacgagaaatcagacagcatgcagaatcccgagaggaagtattgagtcgataaaagtaagtgaaacccgtaaagaatgccaagacagagatatgaaatgtatccacatgtgtgacaatgcgtggtatcttttccccattgcacgggggcacgttggactggttcggacctactatactacgtacgcttcgctttattttttaaaaacatacgaggagcgacaatctggtataagaacacatatgtgcttcactttatcaaagcaatagagtattatttggggtcggcacctcctcgtgtttaaaatttgaaaaaaccgtttgagtaactgcctatgcgagggcaaacatgctttgcagaatatcaggcgcaaaacgattcactcacaggtgaaagaaagggatttaaaattatgtcaatagtcacaaatcctttaatttccataaatctgctttcttgcaagactctgccacaggaaagacgacactgatg

SEQ ID NO: 4062 - DNA, 703 bp, Nannochloropsis_gaditana
  misc_feature (129)..(138): n is a, c, g, or t
  misc_feature (552)..(561): n is a, c, g, or t
cctttccatgcccctcctctctcgttgtggaatcggaatgcaccatcttgtagggaagaatgagaaaggatagcggtctcgccccatgcttgagccctcttctccctccctccctccctccctccctcnnnnnnnnnncccgcatcttcaagctcgaactcacccatttttctcgctgtctctggtcgggcggcgggtttcgcgcttggggcgcgaatgtgtggtcctggatgaacgccttggccttccccctctacctctacaccgtcctcgttgccccccaccacttggtcagttatttcttggcattggtcgccttactcttgtggtggaagagcctctactacctgaaaggcttccgggccacgggcaccctggtgcagatggtcattcaaaccgtaggggaagtccggtggttcgtcgtcctcctcttgatcatcggctttggcttcggttctggattttacatcctcttccgccacaaagcggcggcctgggcctcggtcgtcctccaaaaggggacctcaggaggcaggaggctggaggacgcgnnnnnnnnnntgtcatcgccaaatggcttggcggcgttgggcttagcgtggcggccactgccgcgctgggtacccttttctttccccggcgtcctctagaaacgcaggccgcggaaatgtctgcccctgcagccactccccgaagctcaatg

SEQ ID NO: 4063 - DNA, 703 bp, Nannochloropsis_gaditana
  misc_feature (347)..(356): n is a, c, g, or t
ccgctgtgcaggcatggtcttcaccgccaggatctcctacagacacctcgttggcttcccctcccttcgttccctcccctgaaagcttgccacgaagcaaacagcaccgtttcaccaccgtcgcgacagctgctctcgtaaccgccgggctctcccggacgagtacaaagccgacaggaagcacgagcacgcgggaagaccgggcctttcatcggcaaagcagtcggcgcggtcggtggatcccgagtgtggtggagatcagcaatgcggtggccgctttggccaatcgcaacgaccgattccgacgggcccggagccaggtggagggagggggggagggagggagnnnnnnnnnncgacaggcagtgtagaaggggaaggtcttgggcaccgagggtctttgcgttacaccgataagtctacagagggcgggaatgcccccatgtggcaaatcaggaggaagccattacatgacgcctggcggctcaccccgtcggagctgaagcttttcttgaaacaagggatgcatgcaacctcccaaaacaatgggggccggggtggggaggggcgaggaagaggaggaagctcggaagggggaaggagctggtggggaaggctgttcaagaccgacgggggaggtccttcgtgctgcacccatcctgatattaacgccatcgatgtgagcggctccacgccgctgatg

SEQ ID NO: 4064 - DNA, 703 bp, Nannochloropsis_gaditana
gcccccaacacgccgttgcgatataaaaataaaattcaggtcgtaacaccaacaggtggcatcatcgctgcgccctttcgatcgatctctgctgtgcacttttccccctcgtcttgtcctatccccgccgcgtccctcggcgccgtgtccatggcacccaaacgcaaattggcctcaacacgattgaacttggaagaaagagaatacagcgcaaagggatggatggacctggacgtccctccgcacgagctgcgcccagaattctccctgacgatgggtcagtgtttcaattggcgccgtcaaggtatgtgggaggtggggggaaggtctgaagaaaatgcacgagccagtatatacgagcgggccgttagccatgtgcgcaccatgtccttgtgtacgtgtgcatctattgaagtccttcctgcggtcacgatctgttcacgatccaacctcacgttcagggttggaaacgcaggccaaggtggccgtgggggaaggggaggaaggagggcgggaagaagagggggacaagaaagaggagggagggggctgcgacaaagtgtggatcggagtcttggaccgtcacgttctggaaatacgacagactcccacaaccacgctggtgcgacgtgtaggcgccagcgtggacgggggtagggtggaaggcgggagggagggcgaggtggaggacaaggttctcatg

SEQ ID NO: 4065 - DNA, 703 bp, Nannochloropsis_gaditana; identical to SEQ ID NO: 2063

SEQ ID NO: 4066 - DNA, 703 bp, Nannochloropsis_gaditana
  misc_feature (689)..(698): n is a, c, g, or t
cgatggattggaaaggaaggtagcgcgcgaatcttgggaggcgctgcgtggtggaaacgaacgggttggctctactgtcctcagatcattctttgctcggtaaagccatgccttcctctctccacacccgctttcaatgtctgcgcccctcccgactcccacttcgacttgacttcttcctctctttcctccctttctcctccctcttacgcctccttccctcatcctcttcctcccttcccctccctcgcccctccccttgcccctcacgtcgtcgcctggaccccttcttctcctcttcctcctcttccctcctcctccttttcctctcccgcccttcgctccgaccccgactccgacttctgccccccccgttccctctcctcctcccgccagagccgcctccctcccgtcggccttcactctcctcccgcctctcccctcgtccctccctcccttccttccgccccctttgcttctctctctctctcgacaaatcacccggctccctcccccctccctcttcctccctctttccatacctccgcggtgctgccgcctccccctcttcctctttcttcctcctcctgtctttcatcctcttctcctcttttcgtccccttccttctcctccctcctctacctcctcctgctgaccttgtctcccccccccctcctcctccttgtcnnnnnnnnnnccatg

SEQ ID NO: 4067 - DNA, 703 bp, Nannochloropsis_gaditana
  misc_feature (1)..(68): n is a, c, g, or t
nnnnnnnnnnnnnnnnnnnnnnnnnnnnnnnnnnnnnnnnnnnnnnnnnnnnnnnnnnnnnnnnnnnntgcgccaggtcaaggccttgaccacgtatgtctccccggggccctttgccggcggcgtgctcccggcccgaatgtctgtgatgacacccaaaccccacgtggtcgacacttcctcgcctttttccagggagtccatgacctcgggcgtgctttctggtgggctggaagccgcgggccccgccgtggaaggcatattctcttccactgcactcgtgcctccctgatgcatgttttccatatgtccctctttttcggccgatgattctccttgtccctccgcccgcgcctccaaggcggttgtagaagccgtgttgtccaatggcggggatgggggagaagacggaggcaagttggacgacacagcgtcgtcgacgggcatcccttcttcctcaggcatgaccctctcctcttccccgggggcaggttgcaggagttcattgtcctggatggggtcttcgacagcaccatccttgcgttcttgcatctttccttccaagagagttggcgggtgttgtgatttctctttgaccacgtcgtttttttccaggtcagtcatcatcccctctgctgctgttccatcgcgcaagattgtggggacgagcacgggcgacacgttctcttcggtgccaaccatg

SEQ ID NO: 4068 - DNA, 703 bp, Nannochloropsis_gaditana
cttgtgtttttcagcgagattgatcctatcaaggagtcgactccctccttcttatgcctgaatcccaaatggcacggcgaccgcggtgtggcgcggttacgtcggatgggctctgtcgcatgggtaggattttagacacatgacacggtggggatgggcaatgtttctcagtcggatcctaataaacatcaaacatccgatcccgattaagtgtatgctccaatcctcgagtgtttcgtgtccgaggcctaccactctgttggcctggagggttgatgcaggatctttgagaagcgggaatttatagatttttgagcaactggatggtggtggtcaaatctttgcttcgaattaggtaactgagcacgctatgttcctgcccacgcttaccatcccccttcctcaaacccttccctctattccatcctcccactccatctttgtttgcaaaacgtactgaatcttcggctcctgctcctgcccttcctcttttcccattttcttttagatggcgtccccccgtcctgcctcttgcacacctttcctttcggaggggtgcctgctatcctacaaggacattggtgctgaggattgccccggcagtgcgagcccccacggcagcgatctcggcaccgaaggccagtccttcacgcctcttacaacatggatggcgcaccaatgcgtcctggaccggcaagggatg

SEQ ID NO: 4069 - DNA, 703 bp, Nannochloropsis_gaditana
aacttcctctggcggtatgctcgtccttcgatgccatgtcctgccttgatcgcggccgatagcggtacgccactcatcatgaggagcatacgaccgcagacaagttgcaggcagcatgcccatttcccctttgggacgacttacccgtccacaaaattgaagtccggggctttggagggaccacgcgctgcttgtatcctttcaagacttgacagaaagacgaccaggagaagaagcggacatagtacgcacatggatagagaaaccatccgtgtgcggccgtgcaaacgggctggatggcgcttccaaagtcggagtgtattcttgggcgagggctgctgctgtagactagcgaggctgagacgagtgatggaaaaaccgtaataaatggcttgaagcggccagacaggacctgtgcggagtgcacgtaggataaacatagagggtagggcacatatgtcgcaccggtcaaggccggatggtgtcatttgcacggaaatcgggccgggctcaagggagtggcgacaatcgtcactgagaagataggacgagctctccaataaagcatgtcctcaataccatgcgccagtttttcattttggagcaccttcccgaccaccataggctaccaggtgtggtgccagacaaagtggggagcatttgtgaccttgctgctgcgtggacttgtacagacgacgtcatg

SEQ ID NO: 4070 - DNA, 703 bp, Nannochloropsis_gaditana
agaaaaggacagggcaccacattcgacctgacactgacaccaaggtgcatgaaagatcacattggtatgcactttccgcccgtgtgatcctgcacaagggtggctttccacggcccggagaacggacgcttttgcctccctccctgtagtcagtcggggggctcacacaacctgtgccatgaatgtggggacttatgtccgacgcccactgggagaagaggcaacttcaggttgcggtcgggtttggaaggactttcgaacgagttttagaggggttgggagtgcttggtacgcatccaattgtttttatcttcttcaggcaaacatggctgtgaggtcgatctgtcgacctcctgcccctctggcctctttatcgtagtctagactgccatctccgtcctccctaaccacacagtgaacgcctcgaaaatgaagcaggccccggccccgcgtatctcgtgtcggtcccaaaaactctcacctccgttcattgaagatgtgcttgaccaatacaagcatttgccggatacctttaacttggctttgggagtctcgcattgggggccacctcccagcgcaatacgcactcttcaagccatgggccaaggggtagagggagaaaagtacccggaatcaaggggcataggaacacaaaaagaggccgtggaggatgtaggaaagcaagaatcaaggtctttgcatg

SEQ ID NO: 4071 - DNA, 703 bp, Nannochloropsis_gaditana
tgtaaaccggagaaggaaaggtggcaccagcacgatatgggccaggaggtcgagaacgcgagagaactctaaggggtctgaccagacaatcgctggccatggaaaaaataaaagcatcgtgatgaagatttccgtaaaagctgtgcagcaacgtgtaatctgactggcgtaaaccttcaatgggcactgtcgttgtctttatctctcaattatgttaaaagtggaggccctcgcaagctccctctgtgccttcgccaagagaattctttttgcgtcggaatcccggtaagaggttgcggcgtgccattttgtggctttggcccctgcttgacgggtttaaattcggggctttggtgcgtaaaaggacaaagatgcatggagaaacggactgctgaatgcgatcacagaggatttctttgccgaaggccaaacgagccatcgattgctgttagactctaggggcggtgttgcccgtcttgattctgtctctttcagacgcctcttgagttcaaagacagccgacaaagaatgggacatgcagaagagattgaaatgcacttatccgaggtgtctgggtgtgccgaggtctacaatatgtaagttgagattcatacacagacttctgcttccctctctttcctcctccctactcggtcctacctaagtgtcgcagggagtgccctgagtcattgcagtcgtcatg

SEQ ID NO: 4072 - DNA, 703 bp, Nannochloropsis_gaditana
taactcggaggtccggatggggccacacgactggtcactcgtttccaaggacgacggagtggacagacggacaagaaggagtgaatgactcgtccatacgtacactctcctgtcgggctgatcaccttgagatatcgaagaaggggtggtgtgctcgtcatcgagttcaataaatcatcgggtaggccgcagtcttcggaaagacgaggcataaccacacataccacctggggaggaggttaacaacgtcccagaccaccaaggccttctttccacggtcgtggagagcggaaaacactctaccaactaaagaaagacgaaagaggatgggagcggcgtcgctagtttttggttttggtcttcgcctatccgccaaaggcggggcagttgccgcacgcaggccgcagcgctcgcccagagatcccgagtttcaagtagagggcacgcctggttttgtctccttgattatcgttataaggcttttcaaagacgtgcagtgaacaatggacatgttgggaggtaaacgtgatccttgtggtttttttatatatttcccctggtcaagacctggcgcctctgcctgtgagtctcgaggtggaaggtaattgacacttcctaggctttttcctacttgcttttcaacaacatatctcgagctccgtcctccacctaatccttgcccactaccttcagagcaggcatg

SEQ ID NO: 4073 - DNA, 703 bp, Nannochloropsis_gaditana
  misc_feature (1)..(492): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcctcttcgcccacgaaaactggcagcaagcggggctggaatccaaactgcggaccctagccgcccgtcgctccctcgccgatttcacactcggcccggtcttgaccgtgacgacggagcgtttcctcgcccactgccaagcgctcttggatacaatcccggggacgaagattctctggggggggaaagcgttgagcaaagccgccatg

SEQ ID NO: 4074 - DNA, 703 bp, Nannochloropsis_gaditana
gcttttctgaaccccaatgttgcccgtccagtcagttagaacggcatacgacaccgcttaagcctcctggcgctagctcggagcacaagcccccccctcccattgcctgtgcccacggcggcaatattcacagcctcacaccgatgcacacgctcacacgcgtacatacaacatatatacagggtagttgcgcggtgcctgtcggtgtgggtcatccactcgtgggtggaatggtgctggttatgaaggcctcagcatcgccagcgcatcgatgaagggcccggtcccgcctacgcaccaagacggtacgtgatttcagagaccgccacagggtacacacgtgccaggcactcatctacacaccattgtacccaatcgtggtagctgccagccgcgcaaaagtcaaacagtgaaccctcgaccatccggtgcatagccaccctgagaagatctaaagtgtcgtgccattcaaccgaagggtccgtggctcttttctcattcgaccgtcacgttgccaaagggctagccggaaaacactccgctcttgccacatcatcatcccgcacgaaagaaaaacgggcgcgaggcattcaatacagttctgagacacggcaagtggtaggaggcgacctggccgaggtgaaaggggggcgtagtcaccaatcatacaacaccatcctcctgtacgacttaaggacggatg

SEQ ID NO: 4075 - DNA, 703 bp, Nannochloropsis_gaditana
aatgatggaaatggaaggtattaaagtagttgtgatcagagaggcacggccctcagactcttttcctgattggaatttattgcattgaagtagagttaaatagttagtggctgcgtacctggaccccataaattttaatcctttccactagctatccaaaatcaaagcaacttccacgaacgactgtgtcttttgcgttagggtgcataatacataatccaaaggactgggggagtggggtccttttccatcacattgcgatgacgaaacccttatcgtcgccttcaaccaaggggctcccgaaaattcccaaggcttgtactgccttcaattgctcacatgtacacatttttacctatttataggtgtataaaaggttgtagatggttggaaattaagggtttggtgcagcaaggctctatcagcacgtctatgggatttttagggccgagatactacccatcctcttcccatcttgcctgctgcctcctctccctcttgggctatttctccctgtcggactcgttgcttcaaatttccaacactttgggctcccacatggtcttgcagcaagcaccatgccgagcaacaatttttggacgggcatcttccggtgatgtcattgccatcacgctttctcctcctgccgacgagacttttgatcttagggctcggtccttaatagatctacttccaaggaatg

SEQ ID NO: 4076 - DNA, 703 bp, Nannochloropsis_gaditana
  misc_feature (1)..(422): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaaggaaaggaggcggtaaaggtgccggaccacgtggcgcagttcgtgtatcccgacgggtgcgtgggcaggcgggatgtgcatcttcataccttgacttttctcctcccttccatctcctccccctttcaccctccctcgattttcgtggtcggcttgcgcccaatccagcgacgacgttctcatgcccctcctcgaatccccgcccccctttcagcttctctctccgcgcagaggaagcccccccctccttcttctccttcgtcctcacggacatg

SEQ ID NO: 4077 - DNA, 703 bp, Nannochloropsis_gaditana
tgtgacctagtctgatcatctcgccttatttatgactatcggcttatcccccttgtaattgctcgaaagtgaagcagaggatggatgtggatgaaggcgctataaatggccgtccttctttctccatatattcgattttctacactctttcgcatggtaacctcacttggcatgattcatgacgacgaaatcggacgcccgaaggccaacgaattaacacactgttcttgcaggcttttcccaggcagcttccatttattcacacgggatttccagctgtatatacgtgggcacgttcatttagcagtcataatgaaaaatgcgttggcacgagtaatttcagcggctcgattcccctggcccggttcattttagcggctcgatttttggggcccggtgtcggcactcgccaaagtctgcaaggagagaggacatcgaagaagttcggcaacgccgcctcatttcctttggggatgttaccgtgtccagccgtgcacgaatcagaggcactaaaggggcctgatgagcggagtgtccgatcgtatctcccccggcatgaatcccttgaccaagattgtcccccgttagagtctatctagcgtgcccgagcatcatcgtcccattatcgtctcatttcctgccccccttttttacttccctcattttcttgccaggaccttccgtcccttcccatcagaatatg

SEQ ID NO: 4078 - DNA, 703 bp, Nannochloropsis_gaditana
aagttgagctggtgtacaaagacagcgtccacaactgcagcattacggtttcagaaagcctcggtttgttgatttcctggcctaaaaagtccttttgggacgacggtgcgtcatcctgatcatcactagtacgtggcgctcgacggggttgtatcgcaaagtgaaaaaaagcccgtttcgagccttcgaaactgctcacgagcagtctcccttaacagacgtgttatcggagagcggaattcattacgtcgttacacgggaagagacaagagaccttcaccctacaatggatcggtacaacacgtcaaagctggaattttaggagtacggagcgccaccaccccaccattcaggcatttttttccttcaagtgcatctcctccacttgtttcctctttcttaacgccatttctttcctttgtttgcacgtttacttacgcattgtgctggacgactccctctgggtctgggagatcaacttttaagaatttgtacgacatggtgtttaggttccgaatggaacctcagagcgttctgttcaccagaggattccgagtctgaatcacttgttcggcggcacatttactgctacttccttgtctcgcaggcaaccatctatggtccacccgtgattctcttcgtcagcattatttgtcgggcgcctgtttgaaatctggtcccgttacgatctcgacagtacatg

SEQ ID NO: 4079 - DNA, 703 bp, Nannochloropsis_gaditana
agccccatcacctcgtcatacaaacaggagtctgaaactgatgtagaaagatcttggaagggggaactactacactgtcactgctttggcctgcgcagacgctttcattcaggctgccgtttcagcgacttgaccgttgcagtcggaaacttgtcgaaacgccgagagacccatgccagcaccctcttgctcatttttccatatcagaaaaaagtgcttcacatcgagacccttttttccttcaaagcgattaagtttttctaaaaaaattgctgcctactgtagacactcatatcaattttcatgcggcgtccacgcaaatgttaatttctccctttttcttctgtcgaagttcttgggattttggcctcctcatgacattatccttctcaacgacacctgacagaaccaagttctttattacgcgacaaattgatcaagggaaaatcagctgttgagcttcatcatggaagtggcgttccaatatttaaagccaagggcaacatttgggcaagatgttcgccaagccctgcaagacacttcagcaaaagtgctcctcgcattgccctctgtcccgccttctccaactttttcgtcgaaatttattcgtaaaaatccttgtagtgttggtgtgagcacgtgtcgggagatagcagctcatgttgtcaatacggagacatgtgttttgaaaaatgcaagtatg

SEQ ID NO: 4080 - DNA, 703 bp, Nannochloropsis_gaditana
tctgtcatcaccactagcgtggtgcacactcccctcggagggatccagccacgtggtaagaaacatagacggggcccgatgccgcccatgcgggagggcgagacaggggcgtggcagaagcgggggagcggggggaggaggtggaaagggttaaaagaggggccaaaatgtccataattgcggagaaacgaggcgtttggtggttgtaaaatgataaaattgaggtaattatgcgattgaagcagatacttacgtggacttgggtgtaggtctttttgagatgttggttgtagagagataattgcctctgagacacgggtactccggtttagacatgggcaccgacaagtagcacatgcgactcatgaattttctcaccagtgcaatcaatacaatatcttccaggcagtcttcagagtggggacggattgcttcaccgggtggaaagggactctcgcattttttcttccaacattattcgggtgcaagcagagtcacctacttcacattggcaccatgcagactcttccccaggctcctccgcttcagacaacaccacctgctgtccaagacctagacacacgccccgctattctgctgtactatgcctaccgccctctctctcatccgtcctcgctctgtccctcaaccccgccatcgtcccctgagggcccttcccccttggcacggaaagaggataatg

SEQ ID NO: 4081 - DNA, 703 bp, Nannochloropsis_gaditana
  misc_feature (1)..(699): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtc

SEQ ID NO: 4082 - DNA, 703 bp, Nannochloropsis_gaditana
  misc_feature (1)..(199): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtaaaatcaagcatttgagtccttggaggggacagaattggcgggtggagtggaggatggatgggagtggctgacgatggcaggctttgcttcctcctggcatttttattgagaaagcgccgtatgttgcttcctcggtgagtgcgacgtatcgttcctctctaatccttcctcccctccatttttacgcaacaggctaagatgggaggcacagaggagccatgcaaaactctgtgggtaggagacatccaggtgagcactctaaagacgaagagccggtcatgacacgtgatatttatttttcaaaagggttgatatgatgaacaggaattttcatgtcttgcagatcgattgcgcctaaagatggctatggtggtattatctggtcattaccgagcaatcctcaatcctacttattctaaatcagacacggagactatgaacacattctcatcatttttctttcctctttcctttttttgggagcagccttcctgggatg

SEQ ID NO: 4083 - DNA, 703 bp, Nannochloropsis_gaditana
  misc_feature (1)..(496): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcggtgcgaatgggttggacatgtgagactctggataaaggacggtgttcctgcttcaagtatgcccccgcttgaacggtgacgtgtacagcggtcttcccaagctgttgccttccacatgccatagcgttgtcgtacgccgcgagtttttgacagcttcaccgccactacctcatacatagctattcaaccggatatggatg

SEQ ID NO: 4084 - DNA, 703 bp, Nannochloropsis_gaditana; identical to SEQ ID NO: 2189

SEQ ID NO: 4085 - DNA, 703 bp, Nannochloropsis_gaditana; identical to SEQ ID NO: 2187

SEQ ID NO: 4086 - DNA, 703 bp, Nannochloropsis_gaditana; identical to SEQ ID NO: 2188

SEQ ID NO: 4087 - DNA, 703 bp, Nannochloropsis_gaditana
  misc_feature (1)..(642): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcccaaaccaaataacgagcatgcttttccattctcccagcatgcacttgaacggaa

SEQ ID NO: 4088 - DNA, 703 bp, Nannochloropsis_gaditana
agcgcaagggcccctccataattgcaacggctgattcaaatctcaacggtcgacagcaaccttctctcctcgtacgtttaagggtcggaagctgggcgttgagtacgttagaactttcatcttgtcgataacgactccttcttttactaaatggtggttatttgtgcaatgttgccaccaaaattcgtctcttcttttcgaatccgtgacactgtgcgcgctgagtgcgtggtgtgcgtgagaaaatgagagagctttatcgtcccttatcctcgcttccttgcttccctcctccactagccggtgtcaaagcagcgaccatcgtacctatttttatctttttgcagtgcctttattcttttttatatgccatcagttatattattctgtgtgccaaagtttattgtgtgacgctacatgatgggatggccatgagcttccccgccgtgcctctccatgcatgtcgagtgcgcggaaagccttgtgcatgtacttgcccttctaagatcaggattgtattatggctcaacatcagctaattcccttttctggtacgctttggtccgctcattccctttactgtgggtacacagggacaggggcacgacctggccattggacacgacggcatctctgtatcagcctgagagatcctcaaggcccttcttctctgtctattcgtgtagatttaaacctcgatatg

SEQ ID NO: 4089 - DNA, 703 bp, Nannochloropsis_gaditana
atgccccttgctgacaaagatttgaaataaaaaatcgacttgaactttgccggattcgacctttaaggacagttgtaggattgtcctttcttcccgttgttatgacagtaagcgaaacaagccgcggacaggacagactggtcttttaaaagcgtgtggatgtacgtcgagggatcaggcagcttgtgtgactgagaccaggttcctgacattcgatctgtagggcagttattttcgcccaaattaaaaaaattgaaaggagtaacggccgtgccgcttcgtagatcttcctgcccaacggaacaaagggttttcaaaatagatctttcctctgacactccattctctggagagccctgtgccatgttaatgtagcatatcatagataaatagatgcttaaagttgtaaacgtggagtggaagaggtgctttggaggagtggtagccagataacttttacttgacgcctttcatcgaatgtcgcatcggatggcgtcgctagtcgctcaatcaaaccactcgcgttcctgtgcctattttagaaagatgttgttcttgcaagcattctacatgatgcctctccctatcttgactttgccatctgtctataaggtccttaaagttttacattcatcgagatcacttatctttctaaaacagggcagcggctgaagtactttccaaggcatcgacggtatttatg

SEQ ID NO: 4090 - DNA, 703 bp, Nannochloropsis_gaditana
cacatatcatcataccataacaactcgctctaacatggtaatgatggaagacttgctattggcaaaagtaaggatgggtgtcctcaaatcttacgagaactaggaagcatatgactttcatgtgactttgcccctttgctccaacaacatggatcaaagaagaaaagaaatgatgaagaatccaagtttttcctgctggaaaaacaatggcgtcattcttctaattatatcggatatgttcgggctttagtctgttgctgtgcacagacccgtttgcatgcacacacctttgcggtggctgtatcacttcccgcggatgcaagctggacggtccagtcgcacggtggtcaaaggtggatatggaatcttttttgggtgtgcgcgtgaggatgaattttaggtatttcgaagcctgcgtagcgtatgaatcttcagcgcctgcatcgcctcgggtgagggaagaaagtggtggtaccttctcgcttcatcccactcacggcgtcggggcgagcacaaccaagacaacgtttctctgtatcttaaggctcattctatgccaccaggaggaggtacttctggtgtctggctctcgattttcgtttaccgtcgatctcaatgctttgtggactgcccttcctcaacccgtcttgcccctctcgcaacagattcaagcagggcttttccaccgccagcgctcaaaatg

SEQ ID NO: 4091 - DNA, 703 bp, Nannochloropsis_gaditana
cctcgtccaaatagtacgtggacgcgacgaaggtcaacggagaaggggcggtgcgcttcacggagatcttcaccgtgaagacccgctcgccgttggcgggcagtggggcccactgccagaccaaggtagtgccattcccatccaccatcggcttcttccgataccgtttgctcccgtcccacggctccagggcgggcttcgcctgcgaccggagatatttcacctccgtggctgcagggagcgtcaaagacacgaccacattgtccgggctggcggtcccgttgttggactgcacaatccgaaaaaccccgcgtttcccgcgccgcaacggccggaccctggcggtcgttgccttgctcatggcttgcgcctccatcccggccaatccgacgatcgtcaagtccctcagtgccggcacacaggatcccgctccctccctcgagacctgtcctggcgggcagggaaggcaggcatccgtcatcgtgtgggcgtcggcccaatacgtgttctcttgacagggcaagcaggcttccccccagagataggcgccttccccgcacccaaccaggtcccggacggattgaatccctatgccttggcccattttcacgccggcatcgcaggcgaagcggaaatgcgccccgacccagacgcgggaactcgccacctcgttggcaatcgtcgtcaggctcgtgtaacgccg

SEQ ID NO: 4092 - DNA, 703 bp, Nannochloropsis_gaditana
aaagcttccttgctcatccattgcgggtcataaaattacaagcacgagctctaggcttgcctcacgtcgtattccctgttgtaggcccgtcttatttggaaagctatgtggtaagtagcaaaaaagacatatgagcagacaaaaactgaatagtactgaagcaagaaagcagcacacgggttaacgggaggaatcctgtgttggcgtaacattggaaaagctgcccttattcatctctcgcgaaatgcgaacacattttttcccccggcctctattcaattccctgcaggaagcccttaaaaaactgatgatagatcatcacgtgagtcatatggtcacgggcgacattttagacgtctgtcaacaatttatgcaaagagtcgcggacaaggcagggatggttctcctacgacccctgtgggagagaccacgtcgggagctcctttccctattggagcattcctctccccctccctctcttcctccctcccttcatcctgtctcatgctcttgtccttcagctctgtcttctgccccttcatcttttactctcctgatatcttgttgcagcgtggagaagatgggcatcactcgggcgagagatttcgtcgctttatgcggagacaaagcattgcaaaaattacttaatctggcacgacgcaatgaggaacgagacaagcaacgaggactggaggatagccaa

SEQ ID NO: 4093 - DNA, 703 bp, Nannochloropsis_gaditana
  misc_feature (275)..(703): n is a, c, g, or t
gagaaagaagaagggaggggtaatggaggagagagatcacaagatccatatctagcactcttgaggacgagcaagcgatcctccaacttgctgtccttccctccctccctccctcccttcctccctccctaccttccaccggctgcggcacgaccacatctaaaccacctcggaccaccacattctccctcactcgctccaaatttgaggcctccacgcggaagtccagctccttctcaatctcctccgcccaggatcttaggggggaggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4094 - DNA, 703 bp, Nannochloropsis_gaditana
atacgaaatccaaattgttacctttcaattttaacctctagactcatatgcaataattatggaattgtagatgttatagtttcacaaagcatcaacaagaggaaagaaaaagattagagggaaggggaggttcaacttaatgcgtcacggttaatccgctttaccatccccttaatgtaagtctctgtccatggcaaggatgcgggcacggttgcctaggaaagtaccattgcttccaaccgctataaaaccatgttgacactgcaaatcttacgttgatatcctgtgagattcgtgaactggaacgtgtgacatcagacagcaactactcaccgagctccgcggatcacatcacaatcggatcctatatcttattcttcccatctgcttcctgtatacatctccaaaattgtactccataagtgcagaaaagcagtgcgagcctgagctggagcatggccgcaaatgcggtctcgtaactgccacaagtgttgagaaagatttcacgtccgcaaagtggcacgttcttgtgcaaaagcagccatttacaaagcaattgagcattaggcacataataagcaagcaatataaataagtacgaaaggcgtgaatgggttctcctccacgcggtccggttattcctgcggggcaaggcggactcgctttgcgcgttgttgtatcaatctgggggtacacctcgatg

SEQ ID NO: 4095 - DNA, 703 bp, Nannochloropsis_gaditana
tccttcgacacgctttccaaagacttgtgcgtcgggtgtttggacaccaaattgcttcacgtagtacacgtcgatcgctgtagatccttagcgagtgtcagtgctgtggagctcgacattcccattatggaaaaaacagacgtcagcgcccgcatatatgcaacaagcaggggaatgtgacaacgacaaaggcgttttctgattggtttgcacttttcctgggaggcagttcccaatgcttcttgtaacgcgtcgaccttgtcatccggctaacctccccggacggcaaacgcacatccatttgaatccagcgtcacacacaacgttatcgactcttacgaccatcgatcgtcgcttttattgcaatagattgattctattcacgtttcccgatcggttgtttctaatttcagtcctttcctctcccaccacccaaccctcctcattcctccgtggaagcctcatcctccctgtcatttttcttccccacacacatcttcctcacacatatcagtttctctcttgacattggattcttgccatgtactccctttgtccgcgcggatcgatgcctgtcgccatagtgcgtcctcctatgtattcccccctccaagcccgccttcctgcgctgtatccctcccggccgccagctattcacattcaccgtcggcacgtctcgtacgcatcctccaaagtcttcatg

SEQ ID NO: 4096 - DNA, 703 bp, Nannochloropsis_gaditana
  misc_feature (419)..(703): n is a, c, g, or t
ctcccgccctccctctttcttcccttccttccctccctaggtggcggacgtgggcctggtgggctgtcccaatgcggggaaaagcaccctcttggcggccgtttccaacgccaggccgaaaattgccgactatccgtttacgacgctggtgccgaatctaggtgggtggggggggcgtctgaggaggtagacgatagcgttcagggagttgagtaggggcgatccagttgccttggtcccgcttcctccttggcgccttcaaatgcacaggtttgatacacagcgcgcgcctactgatcgtcctccctttctccctccttcactccctccttccctccctctgtccctaggcgtgtgtgacggtgaccctctcgactacgcctccacggggggagtacgaggcaaaggaattgtcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4097 - DNA, 703 bp, Nannochloropsis_gaditana
gggataccgcacccagttttatatcaaccttactttttaagcaaggttccatatttcaggggttctataacctaactattaccaaagaattagttgtcaaaatttcaattgcaacgattatggggctcattcgcccgcttgtcgtgctgtccacaagaattgctggcacttccatcaagttccatgtcgcacttgcgccgttacatttgttgaaacggtcgggtcggcttcagagcaagtagcagcaagctcaaaagaggtcgagggacgatcccgggaaagtgttgtagcattcccatagtgaacccatcgaagagttcagagacaagaagcaagaactgtgcaatattgccactatatcgcgattccttcatcaatcacgtagcgcgcatgcgaaagccaaaaacacacgaagtcttcggcaatagtcccatccactaaagcccacccgttccgaggatggtaaccaatcatacagatccacgttacccataaggaataggagggagacagtatatgcccgtacaccgcgcgtttactggattcgcccgccttgcggttcaattatcgccttttcacaaagggtgggctatcggtgcctcgttatgccacgcatggtgctctctctctctttctctaccgagaatcatcaatatatatctcttctcaaataagacggttttaacacactcgaatagatcag

SEQ ID NO: 4098 - DNA, 703 bp, Nannochloropsis_gaditana
tctggaatggtgttcgggttccttgtgcgcattgcttacatggaggaatctaggggtgacgccccggcaaagtttgtcgggcggtagcatccaactcgaagtatacatggaaagaaattatcgaaaattttgtggattgtgagatgaagcagtcttcttttcctagagactcttctcccccaggcacccataaacgcgcagggaaatactctgtatgagttagttagttgagattaacctcccggcttgggagcagctacctgtgagctgacaattaaggtctgtagctgtctcgtgttccacgtgcatgtactagctatgttttgaaaatgatgttaagtatgctgcttgcattggttttgctggaggtaactgggaggaatgagacattaatcgacccgcaagtcagagaagcataacacgagcgggccctgctttgttcgctttagatcgaaggtgtatgggcaaaatggcacgtattgtatttcaaaaaagtacgcagtggaaggtgatattgtgtaacgactttaactttctaattagacccaacatgctaggaatcttggacgcgcgctttacaacctcgaccacatggtttccccacataaaacatgttccaaaatccttcatcgtttcattcttatgaatctcctcattctaattcttctactttcccgtgcatctttcactttgtagcggaatg

SEQ ID NO: 4099 - DNA, 703 bp, Nannochloropsis_gaditana
agcactgcattcgagccctgttggcgcgtaatcggcatccctatcgcaatgtcctttcatcctccatcatcgtcgattgtgaaaggctcgcgtcgtccttggtgcaaggcccgcagatggcgtaaagtccctaaattcacgcctaacttattcttctcttcatgcgtcttgcacgtatcctcatagcgctcgctggacgtgctaaaatccagctcttaagcatgtggtatctacggcgctttctcctccggcagcctcgcagtcatgccctgtgccccacctccccgtcttcctcccacgcaccttcctcttccctgccctcttcccccctccaatgccgtgctctaagtagcactggcggggccggcttctataatttccccccctcggctcactatgacctgatcgtgattgggtcgggccctgctgcgcaaaaatgcgcgatcgacagcgtgaaacgaggacgcagggtggccatgatagacaagaacagccaaatgggcggtgtgtgcgtgcacacaggtaagaaatcgccgtgtccgccttggggtatcttcgatgtcggcacggaggaccttggtcgagtcctgcgtcgtcctggtcctgttggagtggggagggctgggcgggggcaaagagggaagacagcgcctcgtatgtactcaatccactcctctccacctcatttgcgcacacaatcatg

SEQ ID NO: 4100 - DNA, 703 bp, Nannochloropsis_gaditana
cgacccctgacggttactccgggtgtctgccaattgcatgatggaggcctctgcttcctgcgtccggccccgctgccctccctcccttccaccctgcgcagccgcaggcggaggcgcgcggggcctttgcagagttttccttccactctcatccccttgccttctatactggctctttttcctcgccggtaccaacagcaagacgccatcgccctggagctctttctcgaggaccacacctccctctttcttaacttccacacccaggccgccgcgctctccgtgtcgaagcacgtccagaaccaccaccctcccgtcctggctcctcgccttaacttgagcccccgtcggctcctggtgcacgccaagacggcccatggccactctctgacgcaggcctgggtgcgtcgggaaatttcaaatttcgaatacttagcctgcgtgaacgcggcggcggggcggactcataacgatttgtcgcaataccccgtctttccctggatcttggccgactacacctcggaggttttgaatttgaacgacccgcacacgtttcgggatttgaaatggccgatgggggcccagaccgaaacggcccgtcaacggctccaagaccgttacgcggcccttcgggagggatacggagaggcgtgcttcgcgggtgatagtgggtcttccctccctcctttccaccacggatccc

SEQ ID NO: 4101 - DNA, 703 bp, Nannochloropsis_gaditana
atatgaactctgtagcggtcaagtgtgactcttcgatgaaagtatcatatttcattcccatatgcttacttctgctggtgtgtggcccattctcgccgcacatttttgtgcattacgcgcgccgtcacatcctgcccacacacccaaaaagcccaaactacaagtcagaaagcaacttatgcaccatggttgaacgatttccaggtgtgcgatggagccaagtaagaaccaccttaccatacgccaccgccctaggccattcttttccttttaagagtcgatcgcttcggtagtggtctcctttggacacatgcatccagggtcacgaacatgttagttgcttttttggcgccttttctgctcggtatgacgtccactttttggaccacaacccccctgaacggcaaattttcgtctttggccgtctctacatatttaaaacttgtcgaaagcattcgaactgaaggcgtcgttcacatcatccttcttcccctctgcaggagcggctgccggggggggcagggaggaagaagggagggaggaaccgaaagcatcgtcgtcagggaaggcgaaagggtccgaggcgaaggcatcgctgctcatcacactccctttcccgcccgtggaggacgttgtctcagcccgcgtggtgcccgcagcctgggcctgcatcgtttctggagcagggaaggtgtcggagatg

SEQ ID NO: 4102 - DNA, 703 bp, Nannochloropsis_gaditana
cttctaagcttgagggtaaattgtgtctcgtgactgttaattttagattttcttactttttacacggagggggaggttaagcgccagtccggctgaatgcaaacatcttgacctcaaggctcagaatttaagccatgacaacagcaggccaagaatacgtgtacactatgtatgtggattatattttcgtccgggacacgtgattttatccaacggcatgcggagctttcaaaggggtaggctaatccgtaacggttgaagttgagcgaaggacgtaagagtacgaagcctcccctacgtgggggggaaacaggacagtatgataatcgaacctctttcgcaacgcaataccagccacagaggaagtgcgctggaattccatgcggtccactgcggacgggataagaaaaaggcgatggccgggagagcaccgccttttctttctgaccctagtcaacatcctgaccatgtcacgggccttttatttcgcccggccgcagtcttggtgcccatcgagtaccgggcccgcatccaatatccaaagagcacctttctttctcgagcttcgacccagctcggcgtggtgtgatccctttcttccattcgcccgcggaggaccttctcgagctggcacagtggaggcccctccctctccccctccccagccctcccgccgcccgcctcggcgtaccttcgaagcatg

SEQ ID NO: 4103 - DNA, 703 bp, Nannochloropsis_gaditana
aaaaagaaaaacgaaagaaacggtgacgtaccaccttcaatgagaggtctttaatacccgttaacaagtaatcatcaccacacactgacaataggggtcctatcgagatgtcagccaagaaattaggtgctaggaaaacagtgatgctccttagctcggcagtgccttttttcctatctcgattgcaagtcgtttcccccttcccacaccaatccctgcgactcctccatgactcaagcctacgcggggatgacttcaattgtgccgcgcgccggaggccagtgcctgctttcacttcatctacactgttttcatcgtctcccaactgtcaagcccccgccattcagttcgcttctgacagaccaggcgtccggacgcaccttcagcctgctgttgctgctttgatagagaggtaagccctccttttaaggaaactcgggtatacagggcttaaatcagttaaaaacaagatgatgaaatgacatgaaaaggttgctgactgattaaagaccaagaaattatttgttgcgtatttctttgaccacataatgcagatatgacgggaggttgatatcgttgggagaaggacatctttcccctccgtcgccatggactcaaatacctagagtgacaactttgaatattctaaaacatctgataaacgacatccatgggatataattattttcaaggcaaaggaatg

SEQ ID NO: 4104 - DNA, 703 bp, Nannochloropsis_gaditana; identical to SEQ ID NO: 434

SEQ ID NO: 4105 - DNA, 703 bp, Nannochloropsis_gaditana
gcctccacaacccggacctgaaagattgagggagggaagggtacaaaggggggaggaaaaagcacgcgttgtaatttatgcgccctgatgcaagcatggagatataggcgcgtcctcatgcactgatgatgggaacgtgtgcttgcatgaaatgaaaaggaagataggaagcaggcagcaaatgggccgaggggggggggcagtgccattgacacaacgaagcgtccctttaactaccttcaccacggacggcatgtcttccaagcatgtacccaaagtagctggacgtggtttccttgcccgtgtggcgttttccccggctctctgtcgcagaagaaggaaatggaggagggaggtggttagaggcaaagggtgatactcaggaggcgatatcatattattccagcataccatgaagtcatccaccgattcgcccgtgctctgggggaactgcaccccccaaaacatgattgcgtgcgtgtatggtagcggagtgtcgccatgggaaggcagtgggttccagttttgtgtcttttcttaaaaaatggttttggggtccctgtgaccgccgcgggcgagaagctgatccggtgccgctctctgtctgtttaccctcacccatcttgccgtcctccgctgattcattcatgcacccacccacccaaccggtccaatcccgtgcacagacgcattcgagagcatg

SEQ ID NO: 4106 - DNA, 703 bp, Nannochloropsis_gaditana
atcttcggaaaaggatgaatttaagtcacaaaaaacctacaggagggaataaaaagtcatggaagcacaaataacaaaaatcatacgctgccaactgtcatcaagccgtttagcttaaaaagggaaatgctagtttctataggcaccacgccacgtatgcatatgcaagtggtacatatatgcaaaaatgagtataaacattgatgtgcactagtcattgtcgcatgtcgtcgcctgatttttttacacagatgagttcatgctgtccaaattcttagggaaatgcattttgaatttcaaaaatccgttcacaacaaggtcgcgtattcatcgccacctttcgtgcaatttcatctcatccctacatgcaccttttttccattaagtattttcacattcattggtcttttgtggagccttcaaaaaattgtccatgttgttggctttttccattaggcccccttcagggatccctgcatgaccgcgcttcccatccctgctccattcctttcaaagaatatttcgtttgctcttatctgggcgcaactacccgtgaaaatattttcttatggttgtatgctagtacttttgaaacattatggggtaagaagtctgttgctccacttgttgttatgcaagcttctcattatatatgcaattttctaacacaccatgccgtctagacattcttacgttcaaaatg

SEQ ID NO: 4107 - DNA, 703 bp, Nannochloropsis_gaditana
ccttcatttacccttttccctcggtcctctcggcccactgcttgctcaaagccagcatttttaactttccaaccatcgtgtccgacacggcccgcatccgtgaggcaagcacgcgcatgactccctccttagctctcaaggtgatggcgttaggctgcactccgtccctttccatcatctcaagaacctctaccagcagtcgttggcctccgccccccttgctccctttcctgtccgctttacccatctctttctctaggcaggcgtaaatcaagccgttgtacacgcgcacgtccggcacccacttttttccccgcatattttgcacccattgcaatgccgtctctacctcccccgccacacaggcggcccggataacttgcgcgtaggtgcttcgggtcggccgcacgcccaaggaaggacatagcgtcatctccttccacgccgccaggaccccgtccaggtcccccttgcgggccaaggcggccatccaggcgctccagaccgcacccgcccattttccgtgcgactgttggggcgctgccggcatcggtgcccccggattgcgacgagctttgaaagcttcaaaaatctcccgcgccgccaccaggcgggaggttggcttctccggtgccgagggctgctgggaagacgaaggggcagacgtgtagtgctgtataaatgccacgaagagcgagtcatg

SEQ ID NO: 4108 - DNA, 703 bp, Nannochloropsis_gaditana; identical to SEQ ID NO: 2469

SEQ ID NO: 4109 - DNA, 703 bp, Nannochloropsis_gaditana
  misc_feature (1)..(545): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctgccacccttccttcctccctccctccctccctccctcctcccgcgcccaggtgtaccccatcgacggcttcctccccctgcgtacacccaaaaatggcgcgaaaagcgacccggctgacgccttcctccaccgtccttccaatcgactcatg

SEQ ID NO: 4110 - DNA, 703 bp, Nannochloropsis_gaditana
aaagtgctccgctaatagtagtagggcttccgcggtactacggcccactaagacgtctgatgacacccccaaaaatatgacacactgcgcaagcgcctcttgctacgcgtaacggaagagattcctaccccactttgtgtctgtaacgcgtcctctgcacaagtgtggtgggtttagacacagacattgtcatcgcccatgggctttgcacttctctttagcgaggcgcaatttgcagcccgaaatatagctctagcaccgcgataaaggcggggacaaggacactggaatccacgtccttttcattcatcaccccgatttgtccacactgcaggggatggttcctgtgtccatgcctacgcgtccttcccacgtggatgcggctgtctgggaagccttgcccctggcacttaagatcgagatcgcccggggagaggaagaagcagggaaggaggcaggaggtcggggtggggagggaaaacaatatgcagaggttgcgatgcctgaatgtgaggcacgagatgtgattgatctagtgggcgaggaagaggaggagatgtgtgcacccagctcgcgaatgaagggtatcgcagcctcgcatgagaggggagtgtccaggaatgtaggtcaatcgcagccccgctgccgacagtctcccacctcatccgaaggcaaaggggagacggacgatgatgttgttatg

SEQ ID NO: 4111 - DNA, 703 bp, Nannochloropsis_gaditana
cagaggacatgttgggggcatttcttgcgttgttgatcttcctctcacattcccacagatgaaaacgaacgacatcaggcttcctgacgtatgggcctcactcctttagagtgggcgaggcagagcaatagatctgaggcggcggcttttatcgaacggcggtacagaaagctgggcctgccgatcgagcggtaagaagaaaggacgggggacgccttttttacttctttttcctttcttagctctccgttgacatcaacctgaccaatgacactctcgtgacgcggaggggccacctcttagtccaacatctctcttacttttccctcgctccgcatttcgcactcgcttgacccttagcctttgtgtagcttgcaccttcctcagtctctttcgtttccctcgccaccaacaatccagagatcagcctggcgcaagcagtcgctcctctgtcccgccatccccttctccttcgcattcggtggccctttctccattcgttgggtccagcactccgacaacaacggtattcggcggtgcctccagccaaggagaaggcggacgcgcgtcgtcgccgtcatgatagccgactccacaacctcctgtgacactgggcggagcatccaagccacctttatttccgccttaatgggcaccttaccggagacttgctttctctttgatgccagagtgagaaatcatg

SEQ ID NO: 4112 - DNA, 703 bp, Nannochloropsis_gaditana
attttctccctccccctttaatccatcctatttgtcgttatctttctttttcttgcccatatctctcttcttcagcaaggcttctctcccctacagtctacatggtgatgtaaggaaaagacttaatatatgtgcccgagaagactatcaatatacatatatatgtgcccttgttaccttcttttcccctgaagaatcatccgctgaaagagaggtgaaggaaggtcccatcctgattattaattaatttgattaaatttatcatgcggatttctttggaatgcttacgactgaatccaaagctttccaaactctcaagtggtgtggataacgagttacagggttttcagagctacatcagtggtaaacgatctctaacctccccaacgtagcgagcgagcatagagcccgccctgatttatctggattcgcctccagcactcgtacacctcgttcatgtacgctggcatatatgttttgatagtaacgtgtagtaagttagccttgaagtgcaaatctgagaagccatcctccgctcactccattatatcgaacactgcacaaatcgcatcattttcttcacactgcaagctcagtcctgtcacacataacttagattacaatatccacccaaccacagggcctgctcgtgctttaacatcccaaatacgagcgtggaggatatatttcagctaattcaatg

SEQ ID NO: 4113 - DNA, 703 bp, Nannochloropsis_gaditana
agccgtcacctccctctttaagagacaagaccagcacaaaacgcccacgggcatggcatcacatggaccatacgactgggaagataaacgaaggaaacggaattggtacagtgcgcgtggcatgccggaggaagaaatcacatgataattacgacggctgtatcattaccggcacggcgcgaacggcctgtgcccggtcgtgtgagattttgttccattattgagcccctgaagacaccaagcgcgcccgcaagcacgcatgttctatcgtatgcacggttctcaggttcagtgaatggaggctaaggaccagcacgtggagagttaatgccttcagtatcacaatccacggcgcttagttcgagtttcggaagaagaaagaaggaagcattatgaaagaggctgttcctgtgccttacatgcgcaacaggtcattaaatgtgcaaatgtaaccatgactgttctcatgcaaatactgagctttttggaagggacgcatgatttttccatgtcggagcatggagagatggtgcattattcctttcctttccacgcgccccccctcccccggacagactagccggctctctttctccttgggagtgaatgggacattttctcacgtgcatcttgttttgatgccattcttagaatatacacttacagtcgtggtcccccttttctcttctctttgcttcagatg

SEQ ID NO: 4114 - DNA, 703 bp, Nannochloropsis_gaditana
ccttcgcctcttctctgccctcgacgtttgtaaggcgcataagggatggtttgccaacagccagcattcctctctccttcctcaggaatggcaccctcggcaggtagctctccctcctccctcccgcctgccttggcggcctccctgtatcttcatctcgactcctgcgtccttacactccctcttttccacctcctttttaatccaaaccttattgatccctccccttcaccctcccttctccctcacccgtccttccccccctcaggcctgccacctccggcttccatcctattcctccatctggctctacctctcagtgatacagcccacgaaacgagggaaaacgggccgggaaggcttctggttcaccgacatctccctcttggtgttgcggctggaggcaggcgaagagggaggccggggacggtggagggtgttgggtaagacgagaaacggggagggtagaacggaaggaccaaaggggatcgcggagcggcgtctatgtattgcgaatcgttgatacatcggggacttcaagtatctggtcgaaaaggagggcattgcactgaccagacccttccttaccgccctccctcccttcctcctccctgcccatgacccctccctcgtgcagggactgagcacttgcgtctgtcggggcagggcaaagtccatcataccgagctcattctaggcgatg

SEQ ID NO: 4115 - DNA, 703 bp, Nannochloropsis_gaditana
  misc_feature (85)..(94): n is a, c, g, or t
tctgtcggggcagggcaaagtccatcataccgagctcattctaggcgatgcgatgggtaggatgggcgagcggcgggggggaagnnnnnnnnnncctcataagagtcttctcccatcgtcctccctcctccctcccctccacagcccccgcgccttcgcactacctcctccttcctttttccctcaaccgttggtccctcctttccgatccttccctccgatccgggtcgatcactcgaagcaaagctctgcgggaggcgccctttgtgttgcgggtattctcggcagccccgttggaaatgagagaggtacgatgcagagcagtagggtgtggaaaaagcgatgaatatataacgaatgaacgactacaagggtgaccaagcgatcgaatagctgaagggcagagttgggcagctttatttcactaagagggaaaagaaaagcgaattagtcagcggaaagggaagagcgtggagggaagagaggaggaggaaaggaaggaatgggggagtaagatagggaggttcggaagtagctttcttctactacggagaaagacgagggggtggaagagtttcgtcggacggtctctctcacctcaccttcccgtcgcatcatttgacctctttctttctcatttcctttccttccctccccctttacctccctccttccctccctctttgcccacctcctgcaggtt

SEQ ID NO: 4116 - DNA, 703 bp, Nannochloropsis_gaditana
acagcccgcgacgtgccatctcccacgtatcccttcatcgccacgtccagtgcatgcactcagcgcctcattcccctctccctccctccttccctccctccctccttccacagggcgcctcggacggcggcctggacattcctcagtcggagaagcgcttcccggggtacgaccgtgacggcaagcggtacgatgcggacagccacaaggagcgcattatgggcgagcatgtggctgactatatcaactacctggtggaggaggaccacgaggcgtacgaacggcagtttgccaactatatcaaggttggatatgtcccctcctttccccccttttctggctcctcgtgtctttgattcgatggtcacgtggatctttccgtgaaagttgcctactcacgcgcgacccgatgtgtcctgtctttcctatcgtctcccttcccatctctccaaaaccctttcagcacggtgtctccggagatgattatcaggacttgctcgaggaggtgcatactgctatccgcgaagacccgaccgccgcgcccaagacggaatgggaaggagatcgcacgaagtacaagcgtcaggggaaggtgaggagaagggagagtttgggaaggaagaagccgatcgaagtgtgtggagtgaaaagcagttgaaggcatgcgcttctgcctataccaggcactcacgtcatttatttc

SEQ ID NO: 4117 - DNA, 703 bp, Nannochloropsis_gaditana; identical to SEQ ID NO: 2521

SEQ ID NO: 4118 - DNA, 703 bp, Nannochloropsis_gaditana
  misc_feature (617)..(626): n is a, c, g, or t
ctcacctcgtcgagcatcttcacgtaggccggctgggcaatctgagggtcgcattgcagagaagagcgcttgagctagccccgcacaccccataagctaagctcacgtaccccatctccatccagccttccatccacccctcctctcgaccctacctcggcgaagcgtcgcagcgtggtcatgtcgctgttgaagcagctctctgcctccgggtattgtatcttgaccgccacgagctggcccgagccctgtcaatgccaaggccgagaagcacagaaacggggattccaggggaagagagaggacgggagaggacaaaagatgagcgagagggtgagcagcatgtccgggggggcgggatgtggcatgccccaggggctgcgtctgagaggagggtgcggaggagggagggaccgagggagagcaacacagaaaacagtagtcgattcaaaggacttcgagaagattccataacacagcgacaccgtggttataggtcatgactggctacggcagatacgaaccctggggcccctccgacctccactgttcccactcctgcctccctccctcccttcctccctccctccctccctccctactttgagcttggcgannnnnnnnnnccgaccttggcctcgcgcatcgtcttggtcccctccctcaacgacgtcttccacgaccacgtcttcccccaggcaag

SEQ ID NO: 4119 - DNA, 703 bp, Nannochloropsis_gaditana
  misc_feature (574)..(583): n is a, c, g, or t
gaaagaacgtagaaaaacatgcatcgcccgttaaaaacacttctgctgttgaatggctgtattaaacactcacacccgcgaatgctgctgtccacactgcactccccagaatcttgtgacgctaccattcaaaactattttccctttcttcacactgggactgggcgcactcccgcaaagatgcctcgttgactcccaccgggaacgcctcactcctccgtttcctccgcttcccgatacgagtgaccgaccagccacaccctggctattagagcacagagctctgctaccactacattcaattcctcttgccactgcctttgtggcaactaaggcggcccgcattcggtcctgtgattgtggaggcaggaggtacgtggcgtaaccaactaggtttggtgatttaagttcgtggaacggatatggaagccatcgcagtattaagtctaatacaccgcgtgtggaatcagggcaaaaagcaacctttcaccgtgacttcttcaccacgggcctaccctctccttccaaggaacaagttctcgtatcccccagcccgcctgccctccctccctcnnnnnnnnnnaccgtgatgcattctgttccggtgtggcttgttggctatgaatggcagataacgcgcgaggctgccactgtgggattccgtcgccctacattccttctcgttaccgcttacgagcacatg

SEQ ID NO: 4120 - DNA, 703 bp, Nannochloropsis_gaditana
cgcaggcatcgagaggcactcctcctcgctggacggtcggtatcagcagtggcgcgaccccaacctccgccaccgccacgggggggttattcgcgggcgagcttgcgcgtacctctgccggcacaacaggtatattgggctcgtcaccgcgctcgccaccctctggggcagtgggtgttgagtccttgttgcccatgagctgtgggtatgccgcatgaggaaggagaaattggtgaggggagcggagactagaccgtggcgcgaacggcatgaggaacaattatgccactttgctgacatggaggcagggtcaagaaaattgccccagcatgccatgcttgtgcgcgtggaggaaaatgctgggaaaggctaggcgagggcggggaacaaggaaacgagcgagcaagtgctgtggagggaaacgcaggcttttcgtttcgcttgtgcatgccatgcccgtcaccttttccctcatccagtccgctctcacgcatcagtcgtatgagtggaggccacggtggaaagtggcgtccgattggatatcgtgtgtttacactttacttgtgacttcgtgctggtcacgaagcttcgccaaaacaagttccgcatcagcctccatatctccccctgtcataggcataaaggaaacctgccttaaagatgtaaatctatctgtcacgcttcccatacaggcgccataatg

SEQ ID NO: 4121 - DNA, 703 bp, Nannochloropsis_gaditana; identical to SEQ ID NO: 2223

SEQ ID NO: 4122 - DNA, 703 bp, Nannochloropsis_gaditana
cgcgccatgtggttccctaccaggtggtggaggaccggcggcgggttaaggccatccgttacgaggacgccaaggtattgtcagcttcctctctagagccctggtcgctctgattcgatttaacttcttttgttcctcttttccgatgcgagcccgtgttaacgtgctgaggattcaaatgttgagagcaacgggaacataaaggcatgtgtggagcgtttccacgccgattgaagttttcctttctttgcgacgtgaccgcatctgccagcaacacagtatcgtctacgccttgggatatctgcttcccaccacatttttctgaccgtctacgaccccgacacttgcgcagggaatcatgcaacagcttctgcggggcatgcattttttgcattccaattggatcttgcacaggtaccaaggggggggaggaggtggctcctcgggcgcggcgacggcaattcgtgtcggaggcccttgagtagttttattcagatgccaccttggtccatacccgacggaagaacgtgagggggttcggtggactgttagcgctttccagattgatcaacctcctccttgaccctgctacgctctcccctcctgcgtagggacttgaagcccgataacatcctgataaccgcccaaggaattttgaaaatcgcggatttcggactggcccgttactttggcaaccccaatg

SEQ ID NO: 4123 - DNA, 703 bp, Nannochloropsis_gaditana
tgaagtacattgttcgcccttgtcatgggatctgagtttgaagctccagcagtgctgctttatcttggatgttcttctttagaggaacgaaatatgggcgggcgaaaccagtgttaatacagacgtcgctgcaccacagtgacctagaaaagatcctgttggtccatgatttatgtttgtttcgggccgataaaaaggaccattgctgtggcgtttcggaaagtccgagtggggcctcattccatcacaagcaggagcattccccgaagctcggaaacgttcacagagccgttacagccatgtagcacctcaagtctcaagcctggaggcatgcacccgaggccacgccggcgctttaccttccacacaaaaacagccgtttgggccaatctgtggcactctcctcttgaagatttctcactgaaggggtacttctcgtttcaactttcttcttcacaaacctctttcatcctcatccggcccatccctgctcaagaccacggcctagggcagatcataaacacatggcgcatgaatttctcctcagtttctatctcattattgcattttgggtcgaaatatgagatattctaatcttatcccgtactatccacccatttaataccacacggcctccaggttctgagtccgatattgaaagcaagtccctcaaagtgttgacttagtcctctaaaccgccatg

SEQ ID NO: 4124 - DNA, 703 bp, Nannochloropsis_gaditana
tctgctccgagtgttcctgcttgaggggaggtggcggggggtggtttgctgggtatccccttttcatgcagtttcagctgctggtgctgctggtgctgctgctgccgctgctgctgctgctttcgtttccctctctgctgctgcacaggccgccgtaatttgttcatctcgtcggtttggccatggctttgaggacgacctgctcgggccatggaggtcaggggaggctaaacaggagcgcccctaagcctgcgcgccagaaacggagatgaaacacagatgcgtgacgtaagttagatcataataatattttaaagccaatacggcatgcggcaggtgttagtttgatggagccacatcaatatcttggtctcgcgcctgccagtaaaaggggcggcgaggggcaggaattgctcgcagggggaaaggatcgagatgggcggagtgtcaacttttatctcgcatttcttgtatggaaatcatcgcgttttacgcccatcgaatatgatcatacgtattaaatacatcaatactctataggtgcaggcttgggggtcgcttggagggcgtgctggtccgattttaggctggtatttgagcacggacagagcctggccaaaggacgcttcaactcccctcctcaaagcaccaggtcccttaacttcccgagagtgtccgggtcatcagccaattgggggtcatg

SEQ ID NO: 4125 - DNA, 703 bp, Nannochloropsis_gaditana
ttggggcgaagccccaggccagaacgcattttggagtgtcaaaagcgcaattgccgatcacaaatcggaagcccacatattttttcatgtcatccctactagctcaatcgtcgttcatgaatgaaatctcatcaataattgataaccctcataaatgagccctagtaggtttaaaggccctgccggggggtatagactttctctcggggaaggaggtgttgccatagttttacttccagggctagtttcttcacctttcttctccctgtgggtagcgtcagtctacgaggtgctctgcattatagcattgggagttgtggctcgagagggtaggactcctgccatacggtctgcgtgacctgttctcttcgtcggtgcgtacgcgcgccctgggaaagaaaaatcataacgaaagaggcatctgcatagttcttatccgtcgatctctgtactcttacatgacttcactcggggtgcacacaacttccccaagggttcccctcgtcttcggatagctagctgctgccagtgacttgctctgagggggctacccgaccgtttttaaaggaaggtaaaaaccgtcgagctttacgatggtgagggaaaggaccgctgggaagtaatgcatcatatactggtgaactcatattatgagctcagggattaaaatagacgagccttgcagaatgtccctccgtgcatg

SEQ ID NO: 4126 - DNA, 703 bp, Nannochloropsis_gaditana
cagcgagctctttgagggtgaggggacgaccccggggaagtgttgggacattcccaggtgagctcacattatgagctcagagacacaaagacaagagctgtacagaatgtctctcggttcattattccttcgtgcgtgcgcgtgtttcacaaacagatccgggtcacatagacccgttggtaggagtcccaacctctcctgccaatccgtcccatagatatggtaataaccatatggatcgacggtacccacacggagaagaaaggcacagagaaataccaaataggtaaaaatatgacaacaccttcttccccgagggaaagtctatactaccctgggggcataccaccgggtggtacagcggctcggctcggccggaccgcgactccaaatgcactgtccctttctacatatcgagaaatacccatttcacttatagcgcgacacgacatttttaacaggggcgacccgaccgctttttacactaccacggtaacaaccgtctagccgcccctcagagcaagttagcagcgagctctacgacggtgagggaaacgacctctgggaagtaatgtatcatataccattaaactcacattatgagctcagggattaaaatagacgagctttgcagaatgtccctccgtgcatgtttcctttccagtgtgggcgtgtagcaaacagatccaggtcacacagtacg

SEQ ID NO: 4127 - DNA, 703 bp, Nannochloropsis_gaditana
cctggggaggggttgagggcccggcgcggtctagcgccccctcctcctgccccacctcctgccaccccggatgccccctccgcccccgctcctcctctagcttgagcaggggaaacagctaggaggagagcattgtcgtccgcctccccttcctcgttggccgcccgcatcgggttcgaaccagcaggctcccaggcggagggcccgcgcgaggtgacctcggcaacccagaagatgtggtgcgaaaccagaatatcgaggtcctggctcgtccttttactttgattataatctccttcaccgtttcagcatcctgtcacctttgtggtcacgaggtagcaatgtgcacttcatttctttccccttggctatccccttgacgcatcgccttccaatgctgacacgccatcgtgcccgctgcttcgctcgacatctgtccatgacggtacacagtgttggtttttcgatgcaggctagtatgcaccattgtctaatactgtagcatgctggccgtcagggtattaaacaggggaggtagacgcatcgctaacgcgcctgggcgaggaaatgggagtttataccccatgttttccaataatgatcgatacattcaggcatgcagggccgtttaaactctcgcataacgtttcaaatctatcacgggtcaccaggcgttcctgtatcgctcgaaaccacaaaaatg

SEQ ID NO: 4128 - DNA, 703 bp, Nannochloropsis_gaditana
tacaatgtagtgaatgcggaagaggttccttcgaatggcgtgcgtcttcagctcctagctcttatgactcaccactgcacgccagcaagacaaagtcatatcaatcaaattagaatatataattaaattcaagtaggtagtcgcatgattggctctttcgcgtgagaaccctaccatggagaatgtcgtgtggagcggtgacggggtccgacatgcggggcccggggcctggcccatatatcttcaagccacgccgccgccggaaagcaggtgcgaggcgcgctctagagagccaaaacacaacacgggaacgccaaaaaatccgacaagtttataggaaagcgacttatgtagtttcaggctgggatattttatgttataatgtacgtcttgcatgaaatacgcgtcccatgaaaggcaagggaaagtgtgcacctgcgtgttcccaaagcggtgcaacgtagcctctatagaagcttttcgggccggattgacatcgacaattgcttgatgcgaacacccacaactacaatttcaccgtagaggttctatacctattatgagttgagctataagtatggccgatcccaatcattttatctgtgtaccttctcgacatttttattacactagttttctcgcccgcccgagagttctgctccccgctctgtctgggctctccctcctccaactttatattatg

SEQ ID NO: 4129 - DNA, 703 bp, Nannochloropsis_gaditana
taatgtatcaaaaaccaatcgctatcccactatttcatagacctctctcatgacttacggcctggacgaagtgcctgaggcgaagttctcctacgaggtgtcaccgatggctgttattgtgaagaaaacaggccgacggtggtatgagttcgtcacctctctttgtggtattctcggagggacattcactgtcgtgggtctgctggattccaccttgcaccgtctcttaaagccgtcatcgaacttgcagtcttgagtggaatattggtggcaaaggttgtagaataggtagcgagctggtggagggcatacagcatatcgaaatcaaaaatcaaagaaggaaacacctgaaaaggaaccgacccaggctgctcaggggggcgggcatgtggggaatgtgaaggagggcaatgacatgttccttctcaccgagacagctcttcatatttctctctctcatgcccttcgcatgccttatacaaaccatgaaacgcgcgttgcacctctattcgatggattctcatgcaagggatgctctgaaacgaaggaaagatttattttgccacccttgccttcagaggattcgtcgccatgtgtcctcattttcactttcgcatccctatcggcatcattcgcatgactacaaaatcaggggaaaagaaacgtagagggtgcttgcatagggctacaaaattagcaaatg

SEQ ID NO: 4130 - DNA, 703 bp, Nannochloropsis_gaditana; identical to SEQ ID NO: 997

SEQ ID NO: 4131 - DNA, 703 bp, Nannochloropsis_gaditana; identical to SEQ ID NO: 999

SEQ ID NO: 4132 - DNA, 703 bp, Nannochloropsis_gaditana; identical to SEQ ID NO: 1000

SEQ ID NO: 4133 - DNA, 703 bp, Nannochloropsis_gaditana; identical to SEQ ID NO: 1001

SEQ ID NO: 4134 - DNA, 703 bp, Nannochloropsis_gaditana; identical to SEQ ID NO: 1002

SEQ ID NO: 4135 - DNA, 703 bp, Nannochloropsis_gaditana; identical to SEQ ID NO: 1004

SEQ ID NO: 4136 - DNA, 703 bp, Nannochloropsis_gaditana
gacggcgagcagaacgagccaggagatttgaagaagggcgcaagctaaaaatgaaggctaaagaagagctagcaactcttgagggtattcgaggccgcttaatagagggccttgaggccaaaggtgtggcaagtaaatatttggcccatatacgcagagcaaagctcacaccagtttaaaaggaattataatagatcccttgccagcggaaaagagttgacagaaaatcaaaagcattaggcagattaaatttcatacataatcatgatcaaatggttcagcaaaaaatctacatgtttacttgcggatgatgttcaaggcgggaggtcgaagcccgttcccccgtgactcttgagtggaacgagttccccgtagcataccctcacgttccatcgcaaaacaacgacaaaaattcacactatggatgatttgccagtgcgtcgtcgttttattgtatcattctcatatgtgccacgcctgtggggcatggaagctgtctgcctgtgtcaatttttttcgctggcctatcgtctggggcgttgagggatgctactagtagtactacttcaggaacagtatcacggagctgcggagctcaatctaggagcattccgaggaacgagattgagaatcgactcgacccatcacaaccaccaatacaaccagcatagttagacagagctcccacacctttacggccatg

SEQ ID NO: 4137 - DNA, 703 bp, Nannochloropsis_gaditana
gcgcgcgagggatactacgaaacccaggcccacgtccctggatagactcagatatggtcacgggactccacggacacattctgcccatactcccccggcacgaccaccaccacaagcagaccatgcccacgtcgccctcggtggacagtccgcgtgtctgagtcctgggagccaggacctaaatccggaggggcccaatgcggcgtcagggcccaaccgttacgaatatttgagggcatgcttgaaccgcgatggcttgcgcacaatttcgccccggatatggcatcgggggagggacggacgggggaaagatttgggaaggaattgtggtaccatggaccaggcaccgtggagattcgctcgcttttgggtatcgtggtacatttgtggcgtcgcggccgacgactgcggcgtaaacctgacgttctcctgtcctgtccgtgcacgcgtgaatctgcctcgattcttcctcaaagcgcgacaacccagatgggtcgcataacattacgacatcgcaggagtagtctttagacatgatgcacttgcacgatgccttctgcacatgtttgtgactagtacgtttgttgtccttttccgcattgttgtttacgacggtgcgtcgtgtttatgttcaagacgcgcacccgcgtcttatctgagctttcgccacgccattcatgaagcaaaccgacagatatcaatg

SEQ ID NO: 4138 - DNA, 703 bp, Nannochloropsis_gaditana
caggaccaggaagccggcggactgcctcctcaggtcgggaagagtggaaatgggcgtaaaatcaagagggcgagccaatccgtgccagcgcaaatcgcttccctgtgtgtatagatgcgttttcgtgagaatgagggtgtggtggcggtttaatggacatgcctgcgtttccggaatgggtctagggcggacatgggcatgacgccatcatgcttctgcggacccgccgcactcgacgtgccctatttgtcccccttaattgacgcaatctgtggaagagttgcgatgcgcgcctacgtctcgttgttgaaaaatatttcgacggttatgaatatctaaaggaaggtcgacggtgtttggaagaggtggtctggagactcgagacgccaaaagcgacacacggagagctcgtttttacacagtgaagagaaactccatgaaaacgaactgggaaactgcgctggtaagtgatgtacgtacaaacaaatttcattcatgtcaggaaactgacagatggtggattcgggaacaaaacgtgagatgtttattataaaattcttgctggcgcgatctcgagatatgagacgtgctgcgaaggctcacgttccaggctttccttgcacattcatcgccgcagataacagaacacctggtactggtcccgtaccgaaggaagtacgtgcatcggtatcacgaatggatg

SEQ ID NO: 4139 - DNA, 703 bp, Nannochloropsis_gaditana
gaaagggtgcgggaggtatggaggatggattaaatttcgatgcggacttagattttggagaggacgacgagtaggatgatggagtgtgaaagttgaaaaaggaagtagaggataagctgtgcggccctctgctgaaaggactgcacttaaacgtgtcgaatcacgacacaaatcacaatcaaatgaagcgcaaagcacggggtaaatgtcatggtcttaaatttcggaccgacattttcatgactgtggttgagagtgatcctcattgcgcgcaatttactttttgaggtgagagcaacgtgaaatgcaagggaagaggctgacaagaaagctctccatctcgcttgcaccatgaccagcaaagcctctccatgcatgatagccagtggcatgtgctcacacactcgtacaatcgacactagcgattctttgcaattcatttttccgggcagacgggccagctagcagcagagagggaggaggttggcagtgcgtatcaagtctgagcttgaagtgggcaattgttccatccaagactagagatggtgactttcgatgcggtgcgatatcatacatgcattaccaccacttcgacaggaacaaatatacacctccgctgcttgtttggatccccttgcgagtacaaatctgtcagtgagttattcgcacgcatcctgagtagccccgcccggattaccagatg

SEQ ID NO: 4140 - DNA, 703 bp, Nannochloropsis_gaditana
tgggaagttgcggtatttgcatccatggacacccgccacgaccaaatagtgtcaggtggaccatcttgccccttcagtcacaccggggtgtggtttaggatggtgtaaccattatattgtcacgagagacacacgtctccggaggcaggcgtcgccgcttcgccgtatttaacagagcagacttgtacactcacgccttcaagcacactgcgaacttgcaaggaaacaagctttgtccggggcgtccaccatctctgtactcatctttttctccctacgctcccagtacactcgttcacaggcttacgaagtgagggaaacgaaatcaaaaattgaggctttaaattattctgccacaccagcatcaccccaagggcacctctcccttgcccctctggggaccctctgaaagaaccaatttagcttctgctattgactttggcgtaaaatataccataccgacgcggctcttcaggcacgcggacgtttgaccaggcctggcgggtgcaatacactctttaggcacgcggttgccgcccgttgcgcagcggcaacacagacgatgttgcaattttgctcggcgcggcctgactcggccaggacagtttccatggtccgagcgatggggacaagcaccatacggtcaaggcttgcgaccagaagaggcacctttaactcacctctggccgcatcaagcggcatg

SEQ ID NO: 4141 - DNA, 703 bp, Nannochloropsis_gaditana
agccaacgcgcactgcacccttgacaaaaatgagcaagccactagacccaaaagggctacgccgaggaaagagcgccgcattagagcccaaaatgaggaaactgccttttgagacatcttgccattatattgctgtcttggcttgtgcaatacataatgaaaaggctgagcgttgtggacatggaggcaggaagaacacgacccgcgggggaggtcgaactaaggggggttcccccgaaaccaacaataatttccatcgcacgacaccatacactctggacatgtcaatatgagcctcttgtgtatcgtatttatcgatcctcgactgctttctacggcacggtgtgccagcctctgggggtgtaactgaggcggcgcaagatcagcgttgaagtttgttgtcgacctttcaatgtctcacttgccctctccccgaggactgctcatgccccttttggtcatttttaaatggcccccgctttccttgagacagccatggacatgtgtgctacacgttttcttagagtctaacgcgagcttgaccaggttgtccccggaatccttcctgactttcctgtgccgcgaggaccctactcgcatatcttgaccgtacgtgttggtcggagcattaccgcaacatctcacgcccacgaccaatgcctttgtcgtatcattaccacaggcactccgaagagagaaaatg

SEQ ID NO: 4142 - DNA, 703 bp, Nannochloropsis_gaditana
  misc_feature (1)..(694): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggggatg

SEQ ID NO: 4143 - DNA, 703 bp, Nannochloropsis_gaditana
gaacagaaatttagccctgacctgaaaaattgcataaattgtaaagataagttaattcagggacatgatggattccttctctttttcacgttttaaaaaatgaattacgcaggcaagccacccagagcacttgtcctccggagatttacccctcaaaatatcaaaataagcccacagcagaattttaacacgtgaaataaaaatgacaccctcgaagccctgatataaacgaaaagaaagaatttacaacgggagggaaaggacggagaaacccaccgtattcaaccatcgcgtgagaacttttccgagtcccgcgcgttgcgtcacgtcggtctgggtttgtcttttttttggtattttgagtgtttgggttttggttttccgtgggcgctgcccttcgccgactcggactccgggggggtggggggagcatcaagtgcgcttgacctgagtcgtaggaagtatacacgacatgacacccgccacgtagctggtccatacttcttctcacatgttttcaccgcgcaatggttcataggtgtcgccggccctattgctgtggacgtgattacgagcgtcgggtgcgtagaaggccccgggttcatcatagcccacacctgcttcggccccccgcgccttcactctttctgccttccgtcttctccacgcttggcgggccattcccacggactttggtgccatg

SEQ ID NO: 4144 - DNA, 703 bp, Nannochloropsis_gaditana
aatgcatcctcaccacacgccccttcctcccttcctccatgagcccgttcaggcaaaggtctcgcgacggaggggagcggtgcctacctccgggtattcgcggggagcgaagccttcctcctccgcacacttcgggcaggggggcaaggatgcatctccgccactgccaacgtgaatcccgcccggattgtcgaggtaggaggttactcttttgccgtgctgcgcgggcctgctgccctcattgtcggactctctttccttcttgtcccttcattgtctgttggctttccctctccttgctttagtggacccagcttcgatccggcaggactcgatcttcccgtctcctcccttgccagtgtcctaccatcctcttctccttccattaccctagctcctccctgtttcctctctttgtccctccgtcatcacgaacagtctttcaactgctatgctccctcccttccctccctctctccctccctctcagctctaccaccaacacgagaccagccaggcagaccgcctccaggacgcgtgccagcgccttcgagaagctttccctccccatgcactcatcccttccatgaaagcgaccatagcgcacttcacgcacgacaaagggtaggagtaaagacggggagggagaaggggggaggatgggggttatacccccttgatattcttccctctgacatagcaa

SEQ ID NO: 4145 - DNA, 703 bp, Nannochloropsis_gaditana
ttcgttgtaaggacattttgaatgtcgcgttgaggtcatgaatatctcaaagcatgaacacgaaaaaatcctcccagatagaaattggaagatgcgagctgcaaattagcgccaggctgagcttggtcgtaaacgactataaatttagctacgcgctaatgtaacgcataccgttttaaattgaagagaggttgacttcgcacaccgtacccaaacgggggccttacgatcccgtgctttccctctttattgcttgttcttggcacatttttccttcaaatcagcatacacgacgcgtacatctccatttattttctcaacaggtcatgggtgacgtgaaaaggcagcaggctgcggcagtggaggcttctattcatcaacccctggaacgcctcctgtctctcgacgatgttcaagctgaagcccgaaaacgtctccccaagtaagtgaggaaagggcgaaggaaacgagtgataggcgcggaggttcatgaatagtgtgcatggaagtgcccgtctcggatgtctgtcatgaactgacggtgaatactattcctgtacatggatggtggactgacagggccctctatgagtatgtcgcctcgggtagcgacgacgagcagacattgtgggagaatcgacaaggattcaagcgccatcttctctgtccaagagtgggtgtagacgtgtcaaaagtggacatg

SEQ ID NO: 4146 - DNA, 703 bp, Nannochloropsis_gaditana
  misc_feature (1)..(356): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccaacctcctcaacggccttgcctgcctgcacgttcggccctcggacgagttgctctcccgcctcctctgcgaggctgaagccaaactcgccacttttaagccccaggtgcctccctctcttcctctctcccttccttccgtgtcctttctgtcttgttatgctcttttgcctcctccttccctccctccctcctttttcctcttctgcccccgcctcggtcgttgtcctccctgccgcatacatgcatgcaagttccacccatcatcaacctcgataattaccatctatattcatacatgtatgcatgacttgtgcctccattgccgacaggaaatcgccatg

SEQ ID NO: 4147 - DNA, 703 bp, Nannochloropsis_gaditana
agagaagagtcagacgtcgcgcgatcgatataagtggatagatgaacagagcggtaaactaacgcatatattcactatttttcccgaccaatctcaaatatctctttacttttccatttttccttgtgtgatctctattctatgtggcaatatttctaatgcaaagaagttcacgatgacctgcttttccgtcatttatgtggttttcaagcccaacgtgtggcggcgcttgccaagggaccaattcgaacccccatgaaaggggagacagcatcgcaaggcgggggaaagggcaaaaggatggaatgaatcggatcggaacggatcggaacggatcggaacggatcggatcggatttggcggaagaagatcgtcagcctccccgcccgaacgtcaacaacaacactccatcccttcttgagggaaacctgccccgacggtgcgtgaatgattacccaatccgggcgcagtttgatcagcgtgggtgagaaagaggaggaaagagggctaactcacggtctgcgctggtcgatgcgatgatagaagggcgccaacttggttttttaacctatcgacgtgatgaccgctagcctcggatgcttaccaccctactccgctcctccaaccacgcagagccatggaaacaaaaaggaggagacggagacgaaggagacgtccacagtatgggggacttcccctactc

SEQ ID NO: 4148 - DNA, 703 bp, Nannochloropsis_gaditana; identical to SEQ ID NO: 468

SEQ ID NO: 4149 - DNA, 703 bp, Nannochloropsis_gaditana
agcaatcctgaccacccgttccctttgtctcaattgccaccagaccgtccatccaccgtctgcgacgtgcctgagcggccccaaagcatggagggacatgtacatgaattgtcggcacaaacaaagaaaaagcggtgcagacgtagccgcctgcgtgggcggggagcgaataccttgtcgaggagtcgacgcttctcgaccgaagcgagggcgaggcagcgacaagcgcaaacaataagctttacctctgatggcttcctctcttacagtcctagtttttcgagatttttatttttctttctgccgttcctgaggggtaggaaatgcttgcttgagaggtaatgccgtcgtgtactttgtgcgctgatgtcgcctttcgtttttcggataaatttgcgtcatcctctgcgatttcctcactcattccatctctcgctatcaacctcccccaattcgaaatccatgccaaacaggtgccccacctggcatcaattatccggcaatttttgatcatacatgtaatttatcggccgagctgcttcaaatatgtcttatcttttaccctctaccatcgccatcccgcgctggcgcctcccttttccccagtatttctccctgcctcttctccttctcctggtggttgacctcctcaaccggacccatgccttccaagcgggccggctagcgttgaagcatctcaatg

SEQ ID NO: 4150 - DNA, 703 bp, Nannochloropsis_gaditana
  misc_feature (1)..(373): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctgccgtttaattcttacggcgcccttcctccgcgcgctcccccccggatttcaggcaaagaaggcgcatcaggcctacgtgaaggactggctgggcttcttccaagactttgatttcctgcttacgcccgcggtcatggtaaggagggggtgaaggcaggagacgcgaggggaggaggaaaaagccggagaaggaagaaaggaaaaaggctgctgggggcgtcatcctctccccctccagtccagtctccacaccgctttctaccatttttcccccttgatttcctggttcgccgccaccagctcccccccttccacgcagagctc

SEQ ID NO: 4151 - DNA, 703 bp, Nannochloropsis_gaditana
gaaaattgatcccatttctaaccatcttttgaggtcgtcgcttttgggactttgtgccagaaccatttgtctgatcagcatcgcccaagtcctttcaacaagcccagagcgagctagccagcgattaggcgaggtgccttcaaaatgcaccagaatgagactggagtcctctccatcgttcgcaaagcaagcacgtgcacttgaagtgatccatttgagtcgtcggtcgttgtcctccgtcttttaggaaaccaaagtggtataaatgtgggagttgaattgcttggggcaaggtgtcataacgcctggcgctagcggatgctaacgaacgctttttcgagcaactaaaaacacaaagctgcatttgagcaccactaccacataatgatgaacagtggtgtaggtgtacaaaaatcaagaagctttgatgatcggctttggacgttagatagtcggaattagggaccagatcctgttttaacctcctgtgcttgtcgtctatatggtgctccaggccaaaactcactactgttcaagcagattgcctcccacactttcttgattctctagcagtagattatgtcattacacgtacctagagattgtgggtacgccgtgctttgccatgtggtcctaaattacaatcgttcctctgtccctgcaggatcgaaagggactgtttcgtttctacgaagacagcatg

SEQ ID NO: 4152 - DNA, 703 bp, Nannochloropsis_gaditana
  misc_feature (1)..(635): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtcagagcaacgggagcagcggctacagcgggttcagtgatcagagtgacgtcaacaagggcaatg

SEQ ID NO: 4153 - DNA, 703 bp, Nannochloropsis_gaditana
  misc_feature (1)..(606): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggacggacttcccggaagaggcggcctcgcgcctcctgtgcggcctgccccttgcctcggagcccttgggcctcatcaccctccaagacgtgatg

SEQ ID NO: 4154 - DNA, 703 bp, Nannochloropsis_gaditana
aatgtttgacttcgatggcaaaaccatctgcgatattatcgagcgtggcaaaggatcaggccactggaatttaaaaaatggtgtcagcgtcataaaaatgcataagaagcctaggggcgggagttggcggcattccacaccgtgttggggatgacgtcatagcctcgttaggccatgccatatactacttctgttcaaaataaatcgtgtcctggcacaatcgccttctgcgcgtcgcacgctgtccgtagctctttttgtcatgcggggcggcatgatttcgtctcgtctttgaagcagtatttacaagggatggtgaaatcgttccgagttgcatctgttgacaaattcaaagatgccatgaatctcagagcgcctgccgccaaccgagatataaggactgccctccgaagaaggtgatggcagggtgacaaatgtattaattgctggggggcgacgttatttgtgcatccttcactccatccaattcggatgtctttgttctcgtcgatttgaccaacagccgtcgacttcgggttagaggggaacaaggggttttgctgcagtttgatctgaacctcgattcgctcaagaattttgaattgtaaacatcttgaccatacacaaaacttaccacactggtttcgcacaggaaatggtattacgactcctaccttatagcaatacagttttatacagctcc

SEQ ID NO: 4155 - DNA, 703 bp, Nannochloropsis_gaditana
cgcattgggcggaaaaataccctgatcgttcttggtcacaactatgataaatagttttgtcttgtggtcgatacagttgtactcatttgcaaatgtacgaccttttttttttaatataactcgttgtctgtagcaagaaatcaatcagttgttatgatgaataggatgggtcccggggtcacccacctttttgctcctatttcaaataaaataatcccccttcccttcagcgaaaaataggccacgcgaggtgttccactaatgaaatagttttatctcagcactcttgccacaattgtgagctccgcttttccatgatcacgtgctggcatttctgagtgcaggggctggtcacgggaggttttggttccctcctctgtgctgcatgtcgtcgaggaggtctatcgtgggggggcacttgaactgagttcagcattttcccggtagtttacacatgtgacatgcatctgaatgtatggaagcgcgatgctgtcactccgggtaaattgattggcctggtgatgaacgctacctcgtcaaacggagtctgtctagtcgtgctatccttatgcccatcgatctcaccatttcatttgccaacacacctaagattgcaagggatagaatttcttgtcgtcttcttggaggtcctcctttttcgcgctgcctcttcgttgttctcttaatagctgaagacatcatg

SEQ ID NO: 4156 - DNA, 703 bp, Nannochloropsis_gaditana
tgcatcctgcggctaaggcgctttcgcctctaaatgtacccatatccggctatagggctaacctgtggcataacatgaggtaatcatttgatgagcgagacggtgcatgcaaaagtggtccattacaccgctctaattggacatattggcgtgtgttgtagggcaccccctccctcacttggaacaagccgcagcagcagcaacgccggaggtgtgacgcgggaaagcgtgcatatgaattgaatgtcggtcgccgagtcaccgctgaaccctcgcgcatgatttgccttgtggtcacacggatgagagtgtgtgttgaccctatttgcctttccgtgacactttcatggcaaaagggcagtgtgacaggtcgcggaggaagctttcaccgccgactccaaagcccctggcgcctgcatcacgttccgcatacctcattattctcgtctcccgttctactatgtctgcgaccatatccgatgctcgtacacattacacgaattaatagcattgtattggttgctcggaatgccatttgagtccttttatgtctgcgttcaattgcctggcatcctgattgtttgtcactccttaggagagtgaggttctgatgctgccatcatttctcttcagcattcgctcacactcaaacgacaaccgcaacagtacatccggtggtaaacttgaagcgtactctatcatg

SEQ ID NO: 4157 - DNA, 703 bp, Nannochloropsis_gaditana
cacctttgtgtacccttctcgtgaagaacatcggcctttgtccccggggtcacataaaaaaggtaaggtgaagctagagaatcaatcggccgggatatgatactaacccgcaacctctccgcacaacccgattaatcccacttccacaacctttatgaagccgccatgaccgcacgcccccctccgatatcacaaagccttctttcacgacattgagtgtcctcgttttgccccaagtggccatgtgcgcgccgtaaagtccacgagaccgggaggtcctcgctcgccctacggcctcgccctacttcaaaggttgccaccaccaccgtggttggtgaccaaataatcgcctttctaccacatccggtctcgcgtgttcctcccaaaactgcctgagggccgtcgaacattgggatgatcggtcctggccaggaatgggaagtggacgatcgaaagtcatggtatttacgaccatttttatgttgtctttgcgcacactacagatttgttcatctctgaagatttaacctgaaggcgctttggttcctctttgggaatggttgtttgaaattccttcccgcagaaattcgatcccggagcaaaggcaatcttttcgagatcgagaacgtggactgcgtaggagaggtcttaagcgtgattcatacaagctggtcatcgaagtacagaaccgccttgcaggatg

SEQ ID NO: 4158 - DNA, 703 bp, Nannochloropsis_gaditana
  misc_feature (1)..(571): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccctctctgcaaagacgacctctgtttcctgcctcccggcggggggggagtgcaggggctggtgctggtctcccgggtcaccgccgtcgttcaattcctcgaccctttgaccttaaaaacgggggaaatg

SEQ ID NO: 4159 - DNA, 703 bp, Nannochloropsis_gaditana
gaggggcatcacgagtatgaggagtccagggcatgagtgatccatagacatgctcttctgtttgccacaaaaaaatgctatgcttgcctagtcggacacaaaatttcgtgcaatacaatccttgggctttaattgatgccttatcaattgtggcaacctcgccgtcgagggcaactgcccaatgatatcatacgatcctccaaccgtcacaggcgaggcacttgggaggtcaaaggtcatgggttaataaaccacaatggggatttatagttttaatttgtcggcaacaaggagtgcttgacaactcacacgccgtggtgtgtctcgcgtgcgcgcaaggctgctttgagagctccgattgcagaatcctctcctgctttgacccctgccgcttgtccaatactgtatccagcacccagaggcattgtgaattaccagcgaacatatagggacggcaattcagtgcataagtatgtggctgcattgaaaagcggggcgaacgtagagacgcggcgatatatcgcattcatatgcggctgcattacagagcgggagacacgaacgctcttgccatgctcactttttttccccttcaaatatcgtcgcctttccacagcagggtgattgaggcatggagacgactgccattccgctgacacgaacagcggcccgtgttctttgccctttgtgtggtttgtccatg

SEQ ID NO: 4160 - DNA, 703 bp, Nannochloropsis_gaditana
  misc_feature (1)..(691): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcagtgggg

SEQ ID NO: 4161 - DNA, 703 bp, Nannochloropsis_gaditana
ggtcgaaataaaggtattttgggcgtgaattgcctaatctgttggtttcgttctagcatgggaaaaaccctccctattcccggtcttttcacatgcttttcacgtaccttccacatgactcctccacgtgcatcaagttctacgcacatgtccacattttgcacccctacatcatgcgctctcatcattcggagattctgcacggcatctggcgtgggtgcggttgtgtcacgtttttttgattcctccatcgtgcttccaaggccctatcctccccccctcctccacaagctctctcagctccatgatgtcgaacttctccttcatgccttgtatttaacatgccacagaaagcccggcctacgcatcgttcgaacgacagtgccctttctaattcaatgaatggaagaggtcgtgcccacctcttgggggatccgaaagacctggagaaaggcggaacagactggcaagcggctcgcagccagctcccaccgctgtgggtggacgtggttgatcgggtgggtatagaagcatgccaagtgcggggaaagtatccaatgcccccgcgtcatccctctgtccaggatgccttgtccttttcccccttgcccggctttttgactcttcgaatcgccggccgcccctggtccccgaccccgactcacaggtggacgaggcaatccgaaacatccaagggcaaatg

SEQ ID NO: 4162 - DNA, 703 bp, Nannochloropsis_gaditana
cttgcggtcggcggtataagggggggggctgagagcgggcggggcgagagggacggcgtcgctgggtgctaagggaggattgcgcacaggttgcggcaacagtctggccaggaacgtatgctcagcctcgtcggtgttgctgagaaaggaggtggaggaggaggaagagtcctgaatgggattggaagggccgtaaaaagaggacgggatgtggacgcgtctgcgggcagtctgggagtctccggtgataggcgcaaccttgctggcggcagtggaggaggaaaatatactaagttgcggcaaggcaccttcgcaggcgctgcttggtcgagaggaaggcggtgatggtgatgttgtggtgggaggaggagaagacatggctgctgaagttcacgcggcaatgcccacagggcaacgtcaattataaggctaaggctatgggagggtttgagcacggggcgcgacgtagctctcctccgtccctatgtacgcatcgcatgtatgtacctgtgcgagaaaaaaacgttgaatgggacgtcagacaggcagcatcgtacggaggcaggtgttgacttgactttgagagagttgctgctttggcgaacatgcgagtacgcgtcttcccctcagccggttcaattttgtatgacagatgcaacctacattcgctccttttaacaggccaattgcgtccagaccaatg

SEQ ID NO: 4163 - DNA, 703 bp, Nannochloropsis_gaditana
  misc_feature (239)..(263): n is a, c, g, or t
gaaaaggccggacaggcgataatccgcgggcctattccgcagtcaaccaggcccaaatccgtcaacacattgatcagctctacacttgcgttagcttttgcgccaatgaggcacgtggatcatcctctttttttcctatcctcccttcctcattctaacccctctacccgggagacattcattgacgccgcctccttcccctttcccccggctcccatgcccgcccaccccatccacgnnnnnnnnnnnnnnnnnnnnnnnnnatgtgtaggccgtccctccctccctccctccttccacgctcatccgccctgtccgcccacatcgatgcacgtgcgcttccatggaccgggccatgtcgtaattgaccacgttccggacgtctttaatgtctaagccccgcgacgccacgtccgtcgccaccagcacccgacaccgcccgccctccttcccgccctccttcccgccctccttcccgccctcctcctggcgcttgaaccggcgcatgatcagggaccgttcgctctggtccttgtctccatgcaaagtctctacctcccaccctcccgcgctacttccttccctcctcatcaacatcgttcgcaagcgcccggccacgtcttcgcacccttgtttgctcgacacaaagaccagcacctttcctgcctccaccaggctcgaaaatttctggaacaaccattcc

SEQ ID NO: 4164 - DNA, 703 bp, Nannochloropsis_gaditana
  misc_feature (37)..(61): n is a, c, g, or t
ttcccccggctcccatgcccgcccaccccatccacgnnnnnnnnnnnnnnnnnnnnnnnnnatgtgtaggccgtccctccctccctccctccttccacgctcatccgccctgtccgcccacatcgatgcacgtgcgcttccatggaccgggccatgtcgtaattgaccacgttccggacgtctttaatgtctaagccccgcgacgccacgtccgtcgccaccagcacccgacaccgcccgccctccttcccgccctccttcccgccctccttcccgccctcctcctggcgcttgaaccggcgcatgatcagggaccgttcgctctggtccttgtctccatgcaaagtctctacctcccaccctcccgcgctacttccttccctcctcatcaacatcgttcgcaagcgcccggccacgtcttcgcacccttgtttgctcgacacaaagaccagcacctttcctgcctccaccaggctcgaaaatttctggaacaaccattcctccttcccttcctccctcggcaccaccaccacttcctgcctcacgtcctcgttggcctgccctgcccggccacagacgatgcggatcggatcgcgcagcacttttcgcgccaaattctccactttccgtttgaaagtggcggagaacataaggctttgccggtccggtcgaatctgtccgaggacggaatgaatctgagatt

SEQ ID NO: 4165 - DNA, 703 bp, Nannochloropsis_gaditana
  misc_feature (381)..(390): n is a, c, g, or t
agggggttcgatatgtatggttctcctttcgaatgagaatccatgcgccccggtatttttgttgtgcaccaggctcggactcgacagggtgcacggattttcccaaaaaacatgtgacgggggggatggatagacggggacgcagacgacacgacaggcatcgggtatccaagcccgggaatttcctcccgttaaaagatcatgattaatttgactgcgccggtctggcccgtgttcgatgttcgtgtttaagttgcggagacagcacggtggatccttacatcgcctatgcacattttttgaaaattgttaccggccattaccccgattttccccccatttccccccccccaacccccgcaattctgggcccctcggtcnnnnnnnnnncccctccccctcaccctccttcctccttcccctccgccgcccgcaaccgtaggtaggccccgatgaagtcctccagcacctcccccccgtccaaaacgcccgacacgtcgggggtttcccgcccgctccgggtatccttcacgagtttgtacggatgcagaacgtagtttcggatctgctgcccccacgaggcttcgatcaggtcgccccggatttctgccagggcctccaccctttgcgcctctttgaccgccaagagcttggccttgagcagggccgtcgcctttttccggttcaacatctgggaacgttc

SEQ ID NO: 4166 - DNA, 703 bp, Nannochloropsis_gaditana
aagagggaggccgaaggaaggtggacggtgtcatggcacttgtaaagatggacttgacgggggggagggatccgagggaaaggaggggcaaaaggcagaaagggaggccagctgacccggcccctctcaaggaacgggaccattgccaagcccatgacctcatcgcctcgacacctatggtggtagatcgcgatagtggagtggggtgggaaagcgtgcgtgaggcacgcgtccatcgagcctgggttttgattgcaaccgagcgagttgggccgcaaggaccatttttgagagatactcggcacgtcatggctgatgaaatttcctgtatcgacctccctttcaccaaaacacggtcgtatagcgcttaaaattggcagaataatcgagagagatgtcgacaatattttttttctaccgatgtgagggactttaactgttcagcgggcacctccctcgtccctggcatcttaccgagttaaatgactttatgagcccgtttagcactgtttgcagggggcatcccactgtccactgtccaatcaagcaattcaaatgctgactctttcacatctactcttctggaagcatttctgaggctaaattgacgcggagacaattcgatcgatcgcctccacctcctcactcaacctcccctgccttccctccatccgctcctcttcgcagtcgagcacccaccatg

SEQ ID NO: 4167 - DNA, 703 bp, Nannochloropsis_gaditana
ggaatgatggcgatgagggggtcttgcctcatcctttcacgtactatcttgggaattgttctgcttgattcgatcttcgcctgctgtcgcacaccgcccgcggccgagttggtcatatacaccaagatacacacaaagaaattaggccatggcttgcttgcctttgtgacccacacacacgttcacaatcgtcagatgcacgcgggtctacaacaccttcacaactggtccctttcgacatgaggcactgaacgcaggatgtgtcgcgggttgggggcaagcttgagatattatcaccaaaaaaggtggaaaaaatgcctcatgtggcatctatattgttccaactgcccctcctctcagcctcccctcccacctttttcccgcctgtgcgttaccacccctgtaccacaccgctcatgcgcgtcagtggcctgcgggaggattgtgccaggctggcctaaaagttttggcgttggtcggacgctgttgtgtcaatccgattttgaaacgaggcgtgcgagtcgatccactcggtcaagtagaagttcccctccctccgtccttaattcacacgcaacacgcaagcaaattcatgaccttccactatcacctcttaaccacacgcatctgacacacgcaacaggcatcggaaccaggcgaaaggatcccccttgtccatgatcgaaggcttcgttccgacatg

SEQ ID NO: 4168 - DNA, 703 bp, Nannochloropsis_gaditana
  misc_feature (1)..(622): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccgggtgcaggccgtgaacaagaaacgcgccaattcatcgatgtcacgattgcaattgtaacacaggttgcagcaatg

SEQ ID NO: 4169 - DNA, 703 bp, Nannochloropsis_gaditana
tcttctggcaggtctgctttatttcataacacaattactcctttgccataaaatgaccagtatgtcggtacatataccgcaaaaaccatcatcatttgagtggtggagacggaggatacgagaggaggaaagtcgtagcgtatggcgcgaggtagaggaacttcggcattcctcgtcgcacgtgcagctcgttttcttaacacgaaaggattcgtccgctatccaaatgatggaagagataatggagccctcgtggtttctccccgtgtcaagcgtggaaatggcctggaatgcagaagcaacaagccgagtcggacacgcctcccccggtcaaaattccctcgagcggcaaccaaccaaacagcaccaaaaattttcgatgaccaggcagagcgtggagaccgatgtgccaatgccctcttgtctcccctttcgttttccctccgtgggtcgtgccctccgccttccccggttttcccgcccttctccgcggaagctcttggccttccctcgccattccagcttggcttttgccttgttatctcgacgtggaaagaagaacgcgagagcccagacgcaagaatcaaatccgatcgaagtaggcaagcgagtggaaggggatggggtgggagaagaacgggaggaaaatgagagcgaggagaagacagcgaggcttgaagctgagaatccaatgccagcgatg

SEQ ID NO: 4170 - DNA, 703 bp, Nannochloropsis_gaditana
gtgggtagaggggtggttggcgatgcggatagcggcggagtagaaagcggaaaaattgcgcgaaaagggtgggggtttagattttagaaggggaaaattgcgcgaaaagggtgggggattagagcagggctgccaccgtggggggttgttgaacgaacacattgcgcgaaggggaaaaaaacctgcgactcattcgattcttgagttcaatcagggatgggaaaaatggcaatcaaatcctcgtgcatctatttacaatcctagagatgtctactttgtaatttcagacctcaacaagcttgggctgatgatcatggttgggcttttgtcagacaggaaggcgagaagatactcgctgagagcggagagtgtttcgcgggtaaggaacgagggcatagtcgaaagaagcgatttcaagcaccagttctgtttttttcacttgttgtacagcttcattcacccgaaatgcatcattatccctcgcgatgtccctcgcattctcagcacgcggcttgtgtgagcttgcaagagaatctagcagaccccgcaaagtccacacaattcaagaggaggatacgtgatgcgattgctcgttttcgtttcctggattaattcttttcatgttgatcccatcactgcctctgatacaggaacagcttcttccaggaagcggccttacactctttggttgactcgataaatg

SEQ ID NO: 4171 - DNA, 703 bp, Nannochloropsis_gaditana
tcatgtcggcatcctgacacgggcgaaaccccgcgcagtgcctgagtcggctcctgccgctgaaaaaggaacaatcgcgccggggcacggtcgtaagtaaaaaaaaaggcggggtgagtcacgcgcagatggtgacaagcgataaaggaaggacggggatagagatgtcgtacacagtaagaaaccgacaaggcccccgcgcgccccccgggctcgaagcaccacgccgtggcatatcccccccggttgagcttgaggcaaggcgtcagctttcgtcccaggtggcacggcacaggtttaatgatatataacacggagattcagtcgggggttagaatgagcgtttgggcatcccccaggcccatggtccatgtcagtgaaggagaagatcggaacggagcttggcttgacggccagacccgccttgggcatatacgggcaaaggcgtgcgtgcttctcctggaagtcagtggtcattgaaattatttgctgtgtgtatgtgtgagcgtaggagcatagggtgtacgtaaataagagggtttgtgggtcgagaacaagagacgccatcctcatgttacgcaaaacgataattgatgagggcagcgacctagaacaaatttaacactaaacctgcggcgacagaccttaaacgcacgtttacatagacagttgaagtggtaggagaataaagcggatttccatg

SEQ ID NO: 4172 - DNA, 703 bp, Nannochloropsis_gaditana
  misc_feature (308)..(317): n is a, c, g, or t
tgagcttcaggagggtgtgcaaggacccacctatcttgatagccgccgagaccatgatcccttcctcggaagtggcctggcgccattcgtggtggctcgtgctcttcaacagccctttccgttctcggctccacgtggaccattcgtggcagatggtcgcgtccaagtactccaaggtccggtgcgtatgctcgagttggttctcgctgggcaaggggaacagcacggccaaccgcccgactttccgctgcgtgtaggggagcttaaagccgcccccgcccatgccggacccccgggtgccctccccnnnnnnnnnncctctccttgcatcgtggcaacgtgcacgcggccatccacatattggaaaacttcatccgggaagaccctccccggaacatgaccgagaacctggtgctcaacctctcctatttctacgacctggtcggcgataagtacgtgcccgtccttcgatattttccctcttctgccctcccttcccgcccccccactgggggcttcctcgtgtggtgtatgtctgtttggaaagagaatcaacgaagaatttagggaggaggtgcgtctttcctttttcaattttctcgctatcaagcctctgaattccgctttgtaaaggaaaaacatgtacgaaacaaatctttgtgcgaagtaagagttaaaggcttgtatttttctcccctaccct

SEQ ID NO: 4173 - DNA, 703 bp, Nannochloropsis_gaditana
ctgtctgtgcgatgcacttttcgaggtgggaggggtcaatgccatgtggaatctcttgaccaggaacataagacgagtcgttgcccacaaaatgtccacgtctgccaatttttttcgaagccgcccaccagatttgcgccaagcccagcacaggcacgtgtgatgcgtgagtgtcatggttgccagcagggcgttcttcccttcccctgaaactctttttttcccccccaagttcctttcccctcgttagtctaccacatcttgaggctcctacgaggtagctgagggagggaaatgtaatgataaaaaaacacaaaccccatccctcattccacctctggcctgctaaaatacacgatcctatctatcgggggtaccacggtgaaaatctgacacattcacgccggtcgcgacgaaaaatagtggtcgaatttcgcggccccgaccaacgtcaagtggaacaaagtgactagaccgcgcgccccatccgctgtcaatcaattgatgccgcttcagccgtatgacaaacgacccgcgcacgtgaaaactcaccgcaactgtgtgacttctgtgcgatgcttttcttgtccagaatgttggactcgcatctctaatctatttgttagggggatctacttacgacagcagcttacctccccaccccccttccttgaaaaccagcggggctgctggaaaaaacatg

SEQ ID NO: 4174 - DNA, 703 bp, Nannochloropsis_gaditana
cgtcctgggcgccggcaggccatgtctagatactgactcacgataacgtcgttgacaattcttctgggactctagtttgtggcgacgctcttggatcgaggagtccgtattatacacttttgaaccggcctgagggttggcggatggccggtgctgctcgtagtatccgacgaatgaatgggtcatgcccgaaatggaattccttctgtacacttcaaagccagagacttcacaatttcgtcttaagttgccaagcagttggatgtttgtattttggggggcaaaataaccgtggtgcacttgtcacatgctgggtctatttttggtggagcgtgtaactaacgtaagaaggaaccacagcacacatcaacatcaagcggactgcaaaactggtagaagtccatttattctgccgttacacgactttgtttggcatacatcccgtcaccagagacactttttgggcagttattttgttgcagggcactactaagtgacgttttggcaggcacgtacttgctccttgctcccctcagtgaagtcacgccccaacgtgaccacagtcacgggagcgattagtatcatggaaggggaaaggataagggcgacaaggctcgttaaattttcttttatcatcattgctgaacgcaggatgaacaacaggaagcttcatgacaagatagcgcggtaggaatatcggatg

SEQ ID NO: 4175 - DNA, 703 bp, Nannochloropsis_gaditana
tgagggggccatttttttgagtttgtttacagtagggtgtttttaccctttgttaggaggacttgcttgtgtgaaagtgtccgaacaaccgctaagtctccttaccagtcgaggcaggagcatttgatggctcaaatcgaccacttcaaaagcgttgataatcaacaggcgacgtgcttgacttattgtccatctcgagttcacgatgtgaacacgacttctttgccacagaggctgaattgttttctcatcacaacggaggcaagatagaacaaagcaccaaatattatatgtcaggttgcatggaccatttcgaaagcgtctttcctctctcaaaggcttttttttatgggaggtcatagtagcctaacgcagcgcgagttgaagtttccgtctgcctgttcgtcgtgatccaagggcagatgtttgggcaggtcaaaaggactgatgtgagattagtctggccatttaaacatgcatctatcgagtttggggaaggctctccatgcatttggacctttttgaacggttgctctaacattctggagttcggtattagtataagtttaaggcaagactttggtatgccccttaccaggacatatcttaggaatataaaaatatataaatatgtctgcatgtcatggaccattttactcatgtcaggtagctttaaatggagccattgtacaacgaagcccag

SEQ ID NO: 4176 - DNA, 703 bp, Nannochloropsis_gaditana
ttatgaaagaaagctaatgtataaatcctccgagctatggctgctataactggataaagctcatcttttcggcgcgaagggtcaaccgtcaacactcgccttacctctccactacatacgtaaacaagacaagagtcccttggatttgaatatgatggatatttctactttgtctctcctttgtacatgtgcgtcttctcatgtcgcatgattgtttgcacagtacgggagataaatacattgcagagctctcctggctacgtaccccacttcgatcggctaggtcttaggtttgccaattctcgccagcaaggcaagaaaaacacaagttatgcgatttaagacaattttaagagtcaagaatgaatgtgtggtcatcgtaaaaaggctgacccttggaaatcaagacatgaacgggtgcgaaccaatagtctcctcggccacgcccccgcatttgactacaaaaaataaccaccacaaaatagcaatccattgtgtgctttgtgatttgaaaagatatatgcaaaagggaccttgccgtggaaatactcattttgtccttgtgctgcctgcgaagtgggtttctgtgcaagcacatgcactcaagttttttttcccccacccggtcataaattatttattgaacagaccggtctatgcaacggggctccaccaaaaagctttgtcagccactatcgccatg

SEQ ID NO: 4177 - DNA, 703 bp, Nannochloropsis_gaditana
agctactcgagaaagcgtcgaggacagacctggattcccactttcctttccctcgctcgtctcgttcctcctccgcgacggcaggactatgtctaccaccaggaggacgagggcgggcgccccgtcctcgacctgggccacgtggtgcactcgttgaaccggttggacagcggcgaccccgagaaaatccttctcatgtccagggacggacatacgatgatcatcgtctccttccaagacgtgaaacgctgcctggaggcggcctggctcgagtattgcgagatagccaaccccgccgccgcgacgccggagcttgggcacctggttgggtcagagcacgaggtgccgcctcaactggtccctgcatatatgatgggcgatatcggggtaggaaggggggggagagatgcggggtatccccatcctcatcagcagcagcaggaggcgatgatgattatgatgcaacagggtctcggcgggggtactactggatatgtgccatcatagcggggcgggaggaaagaaaagaaggacggggacgaaggaaagcgaaagcgacaactgtacatgggcctgtgctttacttcttctgtacgtgtccagggtataagggcaggacaacctgcctaactctgatgtgtgcgggttctgcttactctatcggtgccgagaaagtagcaaattcttctcaatggacgtggct

SEQ ID NO: 4178 - DNA, 703 bp, Nannochloropsis_gaditana
accactatcactttctactgatcttaactgctaaaaactttaagccgtgtgaaagagaaagaatgcagcggtatgagaaccgagaggatagatgaggggggaagggaagaaaacaattggtaaatacaggataccctttcgacttacattgactcatgccctccagcttcaattgagattccgccaacgtcttcagggcccagtataggcctcgtaaagccgcccgaaaggtcattttttttcccgcttgggaccctcaaaggaaccgatgacgtttgggtacgtaaaccatcataaggaagtagccttgcctacctgacatgacgcgtgggtatgtaattcatcacatttccacagcccggctgctgaagcaggcaatattgctaccacttagccggggagtgcttttggccatgaggctgtaaaagcgtgagcatcggcataagtgctttttgaaaggaggtactatcatgtgaaaggggccgaaggggataggaatacttcaacaagagcgttcgtgaccgcagacatgcatcatcaccatgttcgggatgcttgcgttgaccgacagacaggcaacaaattttaccttcccgctttggttttttctccaacagaaaaacacgtcaaagtctttgagacgtatgcgtcgtcggtagcatctgttttttctccgtataagaataagatcaaacattaaatg

SEQ ID NO: 4179 - DNA, 703 bp, Nannochloropsis_gaditana
  misc_feature (54)..(63): n is a, c, g, or t
aacgagacaggcacgcggtacatcctgaagctattcaaggttaggggggggggnnnnnnnnnngctgcatgtgtgacacaacaacgagactaaggcatgacgctgcagtagccacaagtcgagtcaccgcgtggacttgacgcccttgcacaggatgtaccgcggctaagatatatagagctagcgggtcaggcgacggtgagaaacaggaatggggaagcgagttgatttttggctgccaaggcgttgttattttagcggctctgtgcctgcgactcggcgactgattcctatgcccattgcgtcacgcacccgcctgctcccactgaatttctttcaaagatggaatatcgtgaaacattttgttccctaactcttattggtgcatagaataacattacggctatttttttctccgctggtataatttttgtcatcaaagctgtttttatatccttatcctctaaagagtgacctccatcaacgtcgacagcgatgcagctttggggctcttatcgcagaagattaaaatacatgacgtcatgctacgacagccccgaatccaaagaacaaaaatctcaataagcataacatttttcctcgtttctaccgctctcttcacacattgccagggggggaaaaggccaatcttaacactgtacaggattgcgcccctgtgtctcggcgttatatgggccgtatg

SEQ ID NO: 4180 - DNA, 703 bp, Nannochloropsis_gaditana
agacagatatgtcagagacaaataagctgggacaagcccaacacatgactttactcgcttcttctttttgatgtcatcttcgagcacaatgtttatcagataggcgtggccccgcttatttgagccaaaatgtagcggcatcatctcaagagagcaagagcacggatagatggtcctcgtaaaattttcacttcctgtattgaggacaagtgcacaccacggactgaactagacaccggaaggtaaacgcctccgttctcgctatggagcattaaagtcgattctctcgctcgaacaaaaaatattaatctagtttctcctcaagggggtatgacttccatattttgacgcccatcatgcaatttatgcggtatcggagtgggcggagagggggaggaggttgaaagcttcttccttcatgtcttcgggacctttacattcactcaaacactttgccatcggccctcaggcatgtccatctcgacctctatactatgtatctcccccctaagttagaaataaagccggggctttgttattactttcctggacaggtattgggaaggcacgggggacaaggcaaggaccaaatttacctcctccttccccggcccgcccctgtattttgttaggatggccgcattcaacgatcatgatttttcgtttttttaatgcacgcacttcatttccccaaaaaaacatg

SEQ ID NO: 4181 - DNA, 703 bp, Nannochloropsis_gaditana
cgggcatttcttcactaacgatttaggccgcttcactggcgacgcggagtttcgtcggttcattgtgcaatatcacgcagataggctacacaaatttaaagcggtcgcgcagattactgtatgggactggcgcaacgccaaaacgccgagaaagaaactgcacttaatcaggaacgtccttcgaatgcgtggcttagaccctgctgtatatataccgccaagcgcccccatagaaaagcaagggttctcagaaggtgaaggtgatgtcaaagataaaattctgaagggtgctggcccagtagatggtgaagtgattcatttacgcgggcatcctgagcctcaaggggggttacatagaggtcccgattttcagcagcaaaacacgggcggaggtagcagtaggaacgctttggctccaagtacaaatatttgaatcactcagtgtaaatagtttgaacatgtaacattagaaaatcagataccattaatcttatcaagccctcgttttgagcgtggacactggttagggggggaggaggttggacggctcggatcggccccggcctcgcccacggcgcttcaagccccgggactttcgaatgcgttcccgtcactttgcttcaccatctccgtccctcgaaaaacgacaggtgacggacttcatccctcttcaaacatggcatgcttttcagagaggtggatg

SEQ ID NO: 4182 - DNA, 703 bp, Nannochloropsis_gaditana
  misc_feature (324)..(333): n is a, c, g, or t
attggcatgccaagacgcaaacggaagcgcccacgggcacagaggtctggtggaggcgccactgcgactagatgtcggcagaagagagatggacccggtggaagtgaagaaggggaggtcgaggccaggggcaacgaaatagacggagcgagggagaacggggggacaacaaggcggaattcgaccggtcgtggaaaatggtcatcggtcccagcgaatgtgagcgaggcggagattgtgtgggacggccaaagaagtacggaggacatggacgaggatacgatgggggaggaggttgaggaggaggaggaggaggaggaggannnnnnnnnncgggaaggagaggatggtagctttgagccttctattggtcactttctatgactccctaccacccagaggggccgaccgagaattttcttttgaaaaacctgggaagctccatttcatggtacgtcttttcctttctttcgtccttcttcttttcctttcttgggtgcatgattctcctcctctcccttcttttgaactcttctgtcgcgttgctttcgctacgtcctgttgtcatgcccatggcagatcctctcggacgcttaaccttgccgccttttcctcccttcctcccttcctcccttcctcattcgattctctgtccttcacacagggatcgtatggccaggtggagtacgcgctcagcctaatg

SEQ ID NO: 4183 - DNA, 703 bp, Nannochloropsis_gaditana
  misc_feature (1)..(352): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtcctcttccccatcattcttgccgcccggaatcctcgcgatccaatcctcccacttgactctgccccaccatccgcggcgctggcgccaagaatgggggagggaggggagccgccactgcctgcagagtaagcgggttggagggatggagggagggagggatggagggatggagggagggagagagggggccattgtgcgtctacaagcgcatcagggtggaagcgcgtgcatggtgggtgtgccaggggaggggcaggcccaggggcgggagaaggagagagagaggaggaatcggagagagaggtgggaaaggagagggagatagggagatggagagaaaggggg

SEQ ID NO: 4184 - DNA, 703 bp, Nannochloropsis_gaditana
gaaaggcgacggatctgtgaggagggaggaagggagggagggaaggagggagcaagggaggaaggaagggaaaggggaagtcagaccgaaggcacgttacttgtaatgccatcccgtgcagaatccatactcttgataggctcaccttctttgaaaacgcttctttcaaatcctgaagcgtcgcatttttgttggcaaggtccaagtcgacatgtttccctttgcccaacgccaccgtcacccgcaacggcatgataaacgacgcgcaaaagcaccaagtatgcccagaataaggaccggacgatacggtcgtctgctacaggatacaaagcgatggaattgagaagcatgtcgactcagaaaggttgcgtgaccattgcacctagagccggagaatgactgctatcacgacggtaatgtgcatgctagaagccccgcggcattccaatttctaccacaagccatcaagccacgcgtctcaacctctacgaaatcattgatcatgtgacattgtatattttactgatgcccaaggccttttcctttgtgaacgcgtgtgtatgtactcacatctcttcacccttcttcgcttccctctgagatcaacttactaacaagcagcgagctacagcaagtaccgccgctatctgagcaacgttatacacaattccaagcacatggcctttctgtgtgttactttatg

SEQ ID NO: 4185 - DNA, 703 bp, Nannochloropsis_gaditana
gagtctgaatgcgcaacacagaaaggaggggtgatcaacggtaatgtttgcacgagtaatgaccagcaaatttggacagaagtaataattggttattttacttgatggatgtttgactaattttcttacgcatccatcgtgagggaggtcacctttctcgcctcacgatctctcacaaacgcaacacgacatccgtcctcgatccccgcttccttcattccctcgcgctcgatgtgcgcaagggatgttttcgagtgatgaacgagaggataaaaaaaaggggatgcgccatggacgcaactttgaatacgctgccttcttcacttgttgagttattgtaggtcaattcaaaaatttaaactggtaacggtcggcgttcattttgtcccgcttccctcggcatcacaatgtaaacatgtcggtgctctcgcggctaagcacgataagggagctagtgcacgattgccttaaattagtgctgctcgttttgtggccctgattacaccatgcaacatgacctgtgttcctcgagagcgcgcatttctctatcctattctagcttttggccttgtccattgaccaaattgtctttacttctttctcatcgtttctgaccattttccttttttatagcacgcaaaagcatcaagggtaaatgagtgcagggccccgcactgagatttttgttcttggtgtagttcgg

SEQ ID NO: 4186 - DNA, 703 bp, Nannochloropsis_gaditana
tgcgtaggcacgaggacatcataatcccatacgggcactgtctcatctctctctcaaaacgtgccacccctcctccccccacgtaaaaaccacggcgtaccgctatctccgatgacgatgcttttgaacaagtaggcgtagctcatgtttggtacgggcacagactgtaccgagaatggaaggaagcggagtgaaaaaaaaaaaggtcgtatattcatcgatatcaagtccccttctgctggcttgacagcaccatgacatttgccctccctcctgagttcacgcaaaaatgtgtcaccgccttgcttgcgacgtgtcgccattagatgtctcatgtccggatctttaattgcttactgaccgacaccagcatctttttggttttcaacctctctcttaattaaaaaaacacggcgttccctttcaggaggttctccgtgagagccagttcgacgcctgaaacctttggcaggtcgtgaactcacgccttctcacccggacgtccgtccatgcacggtgatcaatatgatcacgtagaatgacagacgcagtgtttttttgggttttatgactgggagctgactgatgaggggagggaaacggagcttctgactccgcgatccagagctttcctattctcatattaatatcctcgttcttgccacgactggactcatcaatgtatccactcacgaacagaatg

SEQ ID NO: 4187 - DNA, 703 bp, Nannochloropsis_gaditana
aattgatgaagaggtctgagatcgggaacgcgacgcgccatattgcctcgccacagtccttctgccttcccaattcgaataggcagaatctacacgataccattcgtcttccaccctgcacgcccgacaagtgtgtgtttcgccaccaccacgaacacgtttcggcgggcaagacacggcatccatgcatttgcctgcaaaaggcattacattccccgcgcgcgctgcctagatgcatatcttgccccacgccggggcggcctcggcgccaaagatcatgaaaagcgattttgctcaccaacaccagtaaagccgtgggcacgggcggaaccgaccgtcacgggtgtcggtcgcaagacgggatgttgggaggacgaccgtgacgtgtgtgcgtgttggaagaagacactggtcaattttgcacatgtttggcatggacgtgacgctggccacaagggccgggcaggaaagctgctgtctgaaacttggcgtcaagcactgcagacagccgccaccatgcataagaaatgttccctgtccataaataccctagtttcccatcagatctccccccgtttttcaggtgcagggtcttggggttttacaaacctttttgcttggtttgtgccctcccacctttcctgcttagcgtgtgtcgtgctgccaccaggttctgaagttaaaatctacgggtgacaccatg

SEQ ID NO: 4188 - DNA, 703 bp, Nannochloropsis_gaditana
ttccatctgaaatctcctctctagttcctgaagtttctttgtcacattcttcgtaattggattttctttcatcaaaattcatagattggctttccaaaggagggggcttggccggcgataaaatgcctcgctcttgaagcacaaaagccggaatggaaatggagggtgaaaggggtgactgctcctgtgtcatataactacagtgtgaggtagtgtttcgtcgcctgctgctcaagtaagtgagtaaacggtgccaccagcgcattccaatgagatcgctttaacgggtacgttgactgcaagtggggtggggaggttaagcgtaagcaccaaaacattttcaagtcttaccgtgcgaggagaacttatcgcacgtaggatcacaatgtatgctcaataagtttcatgcatacaaattcagggatgaacgcggcagaaacgtgtcacgagcacacggcggctggataattcctcggagaaagagagcatcgaacctatttgatgtctcctgtggttccattcgcttaattcgccttcaaaactatcgcgccattccttgacgtcgacttgtgtcgaaaaaggttttgacagacaattccctttgctgacagcgatgtacataacacagtcgatcacctctctcccacatttgatttttcctcaacttccctgatttattcggtacagctgagtggaagtaatg

SEQ ID NO: 4189 - DNA, 703 bp, Nannochloropsis_gaditana
aacatttcacctgttgtcttcccattgtcagattccatcatcacattgtgatgcgggaggaggcggaggaagaacgtcgacggcagaaggcgctggagaagcgattgcggggtgcagtggggacaggaggtaacgatgtcaaaaagtaataaatgacgaaagtattgacaccggaacatctcgtcgtttgagagcgagacttaagttcattccatgatcgaatatgtgatcgaatgtgtacttttcatttgcagattttgtcatcaacgccttattattaactaggtctggcttcagcctcggaaatcccattggcgtcgattgagagtcgctcaacggcattcgacagaggtgtcattaccctttcctctcccccatccttttgctctccgccggtgttgtcctcgaaattgctgcacggggtcatgatggaggcgcccacgggcacggagtcacagctgtaggagatggaaccggaaagaaaggagttgataggcagcacgcccgaccaattacccccccaagttgcaaacactatcctcactcaccctatcaccctccttcacacccacgccctaccttaacgagatcaaggcagccgattcgggcgccatttcgtagactccccccccggagcgtcctcccctcggcccctccttgcgcgtcatcacgacaaaagagccgttgggcgggttcgtcgtgc

SEQ ID NO: 4190 - DNA, 703 bp, Nannochloropsis_gaditana
  misc_feature (1)..(698): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaa

SEQ ID NO: 4191 - DNA, 703 bp, Nannochloropsis_gaditana
  misc_feature (1)..(626): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagggagcgagggagggtgggagggaggaagggagtgaggaagggtgcgggaaggtctcccgggtggaatggatg

SEQ ID NO: 4192 - DNA, 703 bp, Nannochloropsis_gaditana
tatgggatgtatgcagggggagagggagaaggaggaaagagtgttggaggggcgagtgtactccttgcagtctccgctatgagtatggggcaaaaggaagggggagaggaaagagaggtggcaacagcagcggatggcatgatttgctgctggaatgtgacctgactctcggtgtactattccctctttacacattccaaagtgctttagactcactctttgctctttttattcggtgctcttcccctttcccttcagctcccccgcccgcccagaggcgcaacggaaaaggctcatgacgaataaacgggccttcaaaacggccgttgcagccaaagacggcgccaagaaggaaaagaagatcatgcctcgacgcgagaaggagaatctccaggtcgggatacgcctctaggaagggatgatgtctctctctcccggcacatgccatacctatacctccctccctacgttgtttaccattttcagcatttctgcgcctgtgtgtgtgtcatgaagcacgcagactttcttgtttattcttgctttccttcgcacctgcccgtctcttcgagttttctttctcccttgttatatgcgtacatatatatatacatacatatatgtcaagaatcatgtcctcccccactgcttacctccgttccctccgctcaatctcccaccttatgcccttttatcccaggca

SEQ ID NO: 4193 - DNA, 703 bp, Nannochloropsis_gaditana
tctgttttccattcccacgttgggaacgatgcctggaatccatttgtatcctcactgtggacggcaatccacattttactctcgactggttgctcctgtgccggcgctcgagcggattcatgagaagtcaactcacacacgcatgtccttcgcagcgttttcacctctggcctcccgcacagcttcacatcgcgtgtccgcgtaccagaaagcatgaacgggcgtatagcgtcccatcgacacattacactgctctttttgttccaaacaggtggcataaatttaaaaaaatacagataggtttttcccccccctgtccaggacccgagagcctctcgggagcgagcgggagacgaaaaaagaaccacgaaaaaggtcaagttcccgtaaatgcttgtcagtcccgccccagcaaaaccaggcacgacgcgaatgtgtgcgtctttggacgtgtttagaccttttttcatgtcgacgacatgtgaagtcacgcctgcattcgcgccaaatgttatttttttccgggtcaagagtgtggagggaccatatcccgttagtattaaagctcaactcacaagcgcctctatattgcttggtgttctcccttttacttaacttccttttttctaattttcccccaaaacattacttacacggactgatagctgcttgcttcgcttggggcggcgttgggacgcgaatg

SEQ ID NO: 4194 - DNA, 703 bp, Nannochloropsis_gaditana
  misc_feature (1)..(650): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcagaacctccgcgacggtcgcatcctcgattttgagggcattgtgagaa

SEQ ID NO: 4195 - DNA, 703 bp, Nannochloropsis_gaditana
gcggtaagtggttgctgtacacctacttccgcaccgagcttttcccgtgaaaaatagccaagcttccttgaacaccacttacgtagcgatagtgcaggtagatgggaaatgccctagaccaaaaatagacggagcgccttgtgccttcgtctgtttggtatctgatcgcgcctgcagctcccccgatgccgagagcaaagagggctgtgatggggcatgagcggacaggaagggaggatgggaaggaggggaggaagaaatgagggaaggagagaaagaaaaggagagcggagatggaaatgaaataaacgatacaatgcaatgtcgtgttgggcgtgctctgtgacaagactgcacgcttcacgccatgcggcgcacgcaactcacttaccagcatgcctcgctttaagagctgagggaagcagtctaatgctagacgccatctatcccctctctcccaattatccagcctgcaaatgttctaaatacatatttttttcccttgtcccgagccgttcgcctctgtgtatgcgccgaaagacagggaggtttttgtataaatcaaagtactgctcgatccttggtgacctcctcgctcaagcggacaagatcagcgagcagcacgtccttcgcgacgcgcgtcggtttggagcctcaatcgataacgaaaacccttacattgtgacaggtgggcgcccaaatg

SEQ ID NO: 4196 - DNA, 703 bp, Nannochloropsis_gaditana
  misc_feature (174)..(183): n is a, c, g, or t
atggtggttgcatcgtgtgtgcatgtctggtgaagcgtcgccatgcgatgctcgatgtgacacaccctgcttgactgcccctcccatcatgcacagaagcttgccgccgtggttaaaggaggctccatctatacgtcgacggacgcgggcgccacctggacggagcaaacggannnnnnnnnnctgacacatcctggccgactaccaatccgatcatgcacagagccttgccgccgtggttctaccaggctatatctacacgtcgaccgacgcgggcgtctcctggacggagcgattagacaataaatcacgcaactggcggtcgatcgcgtcttcgtctgatggcacggtacgtctttggatgcaggccatgacgcaaaatgcacgataccgctgtcctcgatggtggccccattgtgtgtgcatgtttcgtgaagggtcgccatgcgatgctcgatctaacgcatcctggccgactacctatctcatcatgcacagaaccttgccgccgtggaaggctcttttttgggaggctccatctatacgtcgacggacgcgggcgccacctggacggtgcaaacctccgctccttctcgtaattggcaagcgattgcgtcttcgtcggatggcacggtacgtgtttggatgcagcccatgacgcaaggtgtgcacgatgcccctgtgctcgatggtggttgcatgg

SEQ ID NO: 4197 - DNA, 703 bp, Nannochloropsis_gaditana
  misc_feature (305)..(703): n is a, c, g, or t
aggaggccttcattcaggcggcacgcgtgcaatcccggcgggacgaggaagtgaagcggctcaagcaacaggtccaagggctccaggtccggatccgagagcgggaagaggcgatgcaggacatggacgcacaagggcgggcggcagcccgggagtgggagctttcggagcgcggtgggaaggaggcacaagatcgattgacgtatttaaaaaatgcggtctatcgctacctccggtccccgccagaggcaggaagcgaacgcgctgccctcgtgccggtgatatgcaccattttacgattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4198 - DNA, 703 bp, Nannochloropsis_gaditana
tttccaagcctcccgtgcgaaaactcaaagacccgcatgaccacctgcggcttccttactgtcacaggcggggaatgcttcttgcagtaggcctcgtactccccgggcggtacgtagatgtctgggtgctccttgtagaggaggcaccaggggtgaaaggagatgtggcacttgcctacggggcactggacgcaagggcccgccttcttctcctgacagatcatgcacttgagggtgcgacgcgcaggggccatgcgggagtagtcaatcagctccagcttgtcgggctgtgtgaaagtgacgtcggggagccaaagcgcgcactgtatatgggcccagtcccccgaggtggtgggcttcagggcaccccccccgtgcccgcagagggagcagcggaccttatgacagtccataccgtactcacagagccggcaaaaccacttccccacgggaatagcttctacaccatagcagccttgatgcacgctcagatcgcagtggtcgcagagtacgatttggttctcgacctcgctgtggccctccccgcacaccgtgcagagtatgtcctaagggaaagatgatgccgcgtacaatgactgaacatcatatatccaccgttctatgcctttaccgtactcaaaattttatttcacgttttgaaaaacgaatgaggacagggaaaggtcatgatatacctcttgtc

SEQ ID NO: 4199 - DNA, 703 bp, Nannochloropsis_gaditana
  misc_feature (570)..(579): n is a, c, g, or t
atcgatgaaatatacgaacttttaaggggtcgatccggtttcgatttttgtagtggtgccctggatacctttggggacatgtcaaggacaaattttcaacgagtatcgcaagtttttaagacgaagccaacgttgaatcggatataaagtgacacaatcaccgcattggcacaataaccgggcattcgtcgtaacgacacattgtgttttgcggggagctggtttttattcggagcgtgtcggtttttctctctcacctacatgacaatatgttttattatgttgagttgatatcccctgccactgctatcgtctcctaatcatcgaatcatttgaaatcttgagggaggacgcagcacctggggggaacggccaaaagcaagcagaccatgagatcttgtgcagctcaccaagaacatgctcaaattctccactctatgaccctatattcaaccaattacatcaaagtgtccattgacagcgtcgtttcgccaccgatttgcgagactcgcgagtcattgcgcgtcgcgttgggtgggagggcgggaggttaacttcaagcacgaagtnnnnnnnnnngcatggtgctatagtggacgtatgccttccaacaataaagcacattattgtccttacagtggacttgtgacgagagtcaaggaatccagcattttgcctattgcggtctggcggcgtggcaatg

SEQ ID NO: 4200 - DNA, 703 bp, Nannochloropsis_gaditana
tttggtcggcgacgcctgtgcgagactgaggcggtgcgacgacagggttaaccattccattttgtacatcaaacaccaaactgggtgcgcactaagcaaaactgagcgtaaacatacagtggattcatttgttgagaccttgcgcccctattgattgtcctgaaaagacagtcgtggacgaaattgttatctttgaagtaggtccgctttatctacttgagatgaacgaaaaacttacatttctgacacatcaattcagtacgcggatgcgatctatgagacacaatgtcttttaaaaactttaatcctcaccaggtatatgtcacctggatatcaacaatgtggcgcctcgtttcttttttttggaagggtattttaaccctttcctcttgtccctcccggttcccaatctctcctccttctccttccgacgccatttatttttacggcgtagccagtcaatcaaaccatttccgctggtataaagtccagattggtacaacttaacaatttgagtaccttgattcaaggtgcgaggccgtctggctttttttttaattgacactgaatgggacacgactgatgccttccatgacgttgaccacgtcgaaaccattctccatggttttccttcttttcctcccattcctttttcgggtcacatcatcagttctatcaacaaagtggctacgcattcctcatg

SEQ ID NO: 4201 - DNA, 703 bp, Nannochloropsis_gaditana
tgattttggagcagcgcattccttctttgccttttgcaatcaagaagcttgacagcatgatcgccgagcctcccctgtattcctggcaagtcaaactggcctgctatgcgattgcctcgggatgtgtcgcccctcttttcttctcgggctcgttgattgacggtctactggcgggttttgtcggcatttttgcgggggggctgtgggtgatggcggacgtgtcctacattgtcgggaagttgggagtctttgcctctgcgtggctggcatcgttcctcgccaccattttggcggcccatatccccaacacctgctccctggccattcattttgggcccattgtctacctcctccccggctggagcatcacgtcctccatcattggtacgtcttcctcgtgttcgctagtgtcgtaagtcgggtctggcccccgatgcgggcgccttgcttgccgcttccctggtcgtgttgcacgccggtgtcatactaatgcaggggaggggagacggacaagggggaaggtcgctggatagccgtctttgaggaagctagcggcctatcctttgtcagggggggagggaaggggggggcggatgggtcattgtttagattgttgttggttcaatcctcggtcgtatcctcatatgcgaccatttcccttcccttcggatgcacgcccgcagaactgtcgacgcaaagcatg

SEQ ID NO: 4202 - DNA, 703 bp, Nannochloropsis_gaditana
agccatgttgcagactcatcgacgaaagaggaatatacatggatgcacgagtctaactattagaaacacgtcttgtttggagtcctatatatggaccgaggcgcccagtagtgcctgccataattcgatctgacacaccgtccagcgcaccagacactcttggatcacacatgtgccccaccttaaaataaagttcagagctctacaatttaccactttctatggcacttcgttggttgcgttatacacatttactggtccctttccccttgcccccctcccaccatccaagcttgccacgcatgcaagcaaacgcaccttttcgacggtgtggcactgggagcacttggtcttaaaaatcttggcgcccttctctgcggacatgttgctactttgatggatttgagaaagattcctgtaccgtacgatgagaacaaaaaggttaaaaagggtatttgccgggcgcaaacaaaagcatccagagatccccttccacagtcgctagcccgccccggatctcgtcccaccgtccctaaaaccgcgcaatccatggacacgccagtggtgcaagacgtgcgcgcgtactgcccatgtttgtcaacatctcgtcttctgatttcattgggtcgaaagagcatcaagggaacacgagaacataaaactggcttcggacaggtagatgcaagatggagcggggatagcg

SEQ ID NO: 4203 - DNA, 703 bp, Nannochloropsis_gaditana
gaggccgagacgctgggagtgcctgtctccctccctagaaccgcgcgcgcgccacctatgtagaagggaagaggaggaaataacgcagtgaagaccacacagagaactaatagcaaggacgacgaagcttcaacggaggagctctcgctccggccaaggggcaggaggtcagcgcaccccaagatagctagttgcaccttcaaagtgtatcacgcaagccaaaaacattgtaaacttgccgtgcaaggccaaacacaaccgcgtcaccccacgctgcctctgtcaggatggactccatggtcgcattcccactgaggacgaaggcgccaagacgggggcaggcgggggaggatgagcactcaggccttgggcccctctccgcatttcgtggccagggtgcgacagcatggggcaccacggccccgacacatgcacggtgctgtgtgttgtctccacgttggaatcctttttctgtcaatgagacgaaaatgattaagtatgtttgaagtcttaggctgccgaatggctcgggcgttccccgccgctccttctcgagtctcgcaacccatcacttttctttcttacgcaatgcgttcaccgcccctcgttccctctttatacccgttctttcccgttcgatcgacaaacaggggagtcacataggctttgtgggtgcgtttaaccagaggtcccgatattaatg

SEQ ID NO: 4204 - DNA, 703 bp, Nannochloropsis_gaditana
cttcatggaagagactgtttcaaccctagcactggggtcagaaaagcatacccggatgagaaatctcacgtccatatatgttggctttgaccgtcctgatgatgaatacctgtccccgagagcgtttcaaacctctctaaacttgattatttgtaagattttaggaagttcttgtggtacttagtattcaagcggggcttagatgcgtgcttgcccgtaacttgacgcttcttccttaaggagcttggatacgccgggtagttggagttagcgtcttggagcaatgagcgtgtggttgagagtcaaagcgccctctgtatgattgaacgtaacagcgtacaggctcatatgaaacaattttgtttggcgaaggaaggcgtatgcaaggcgcgaagtttgtgacccttgcttgcacggtccgatcccacctcgtttcccctgacggatcagagcatatgccttcaagtcctttgcccatctctccctctcatcacacagtatttttcaccatcgcctagccatggttacaataatagaccacagctgcagcaccagcagtgatcaaatggtgccctatgtcagccccttgcctctgaccaacggagtcttggccgaccaaagtgccagccgtcttgccccaacggcagggagacagtcgaaatcgattagcaaacgattaaacgctttggccaccgcaactatg

SEQ ID NO: 4205 - DNA, 703 bp, Nannochloropsis_gaditana
gctttggtttcctccgtaggatgagagaaatgagggtggccatgtgaagatgggcgttcggcgtgactgtttatggaaggtttcaaaaagaagaggccatcactggatcagagggaccaccatgaaacgaggttccagtgtgtgcgtgttgataaacgtatcaaaaagggagtcaatttgccgtgtatatgactctttattggaggtatctgggcattagaatggcctacaacaagatgtttcttgggcctgaagaagctcattacatattgtcgattgaataaatcatgttgtgaaagctggcaatgccgacaactgcgagggagagagggagggggggaggacacttacatgcgtctctctggattgtggcgaaaaagaaagaatgttgcctccatcttttagggtaaaaaaatcaatttctttggcatgtcacctttatcatagtcctcccttcactcagtgttggacgttttacaggtgggggaggtttgttcggggaggttaataccttatagagccatgtctttcggcttctcgctgcagcacaaaacatgttttacatcatcgttatcactcaaaaatatttgcatctgtcaagtccttcacgatagtgtcgtagacttcttcttgccgaccggcccgttccctctggcttcaaccagcaaaccgcctgcgacgggcttgccggaatacgtaaatg

SEQ ID NO: 4206 - DNA, 703 bp, Nannochloropsis_gaditana
gctaatgtgtcgcgtggctattgctacggcctggatttccatttggaaaggttgttacggtctgcgggtttggcacgcattcatccggccttcacgaaggaagaactccgacacatcatactcagcactgtggcggccagtcaagtgcgagacgatatctttgtccgtttttggatgacatcaggtgcagtagatgccgaataagcgaacggagggaaggtagcgtgtctcaactatttgaacgtcttccctttggccgatcggacgccccccatgtcctcctcacagggcgtgggaacttcgctatcagcgcgaaagagacgacaagcagcggtttctttgtcatggtccatcgctatccctccaaaggtgacctcaagctgcaggggatcaccgagcatgtggtggaggacatcccgctcaagaaccccttgttggcgaccatgaagtcgaccaactaccttatcaacgccctcgtctgccaagccgccgaggacaaggtgattgcttgcactctgtaaaccaatgttgcctttcatacggcctcgaattggccgtctgactgcccggagttttcttctttcccccatgccaaaggccactttgatcttgaagaaacgcccccgaggcccctttcagaatgggaatgcctatctcacgcttgccttccatacatatcctgaccacggatagggaggattct

SEQ ID NO: 4207 - DNA, 703 bp, Nannochloropsis_gaditana
  misc_feature (555)..(566): n is a, c, g, or t
catggcagggaaaggtttttagtctcacgtcatagccgtctcgggcaaacaaggagtaggcgggtgtgcatcttcattgcttaaagtcgtgtaggctgcattagtcttacaacgattttggtgtctcacgtgtgtgacagtgagcctcgattccacctggacttttgcttttctccccctccctccgctcccctcacgttccctgccaccgtccctgtactgcacaggaccttcccgccatacggtcaggctttaaatgaccaccactgagggcgaaggcagtgctgtggcaccggcaccctcaaaaaccgcttcgacggcgacttccacctcctcatcctcctccccggccccctctgccaccgctgtcaagccgcgtgtattcacctcccggaacttgaaccccactttgcaagctgtcgcgtcgaaatccgaagcccaagccccccgagtggccttgccaggatccacgtcgcgtctgacagtgatcaacaaaccgtttcccagtccggaggagccagggccgggaccgggggaaaatggagagcgcgggannnnnnnnnnnnacgtggatgcgcccgaaggcttcgtctcggcagtggaggaccctggggagggggagggactcgggtgtgagggagggggcggacgcccaccgtacaggcacagggcctcggagggggagggagtcctgttccccatg

SEQ ID NO: 4208 - DNA, 703 bp, Nannochloropsis_gaditana
gccagtggttaagactaccaatatctactgcagcattgtctctctgttggcacctcgttgtgcagcagttaggcagtgggcggttctcttcgccctcccgctcgcccgacctcgcccactgcctatttagtcgcacgagctgttgcaggaaaatgtcttccccgctaccctcactgacattcaagttacagcaattggacatttttttaccgtgaggcagtaggtacttgaatgcatttctggggtggctttggaaaagagaagttgaagttcagcatgggccgtcccagagagcagcggctgctggaagagtagccagactgccttacacacatcaaagagctcctccggcgagaaggctgtggcgtgctctgtcaagctcattcttgcccattcatttcaaacatatataccctctttttcgacaggcgcggtcgagcgaggctgtttggcgcgaggcttggccagagcgatggccccacagggggatagtgggagagagctgatggcgcccagagacataggcgcgggagaaagtaggtccaagctgtgtcatgcgcaagacaatgtcagagacgattcaggcaatcgtggatgtggtgacgctgaatcctctttcaacgcgttggagacccctatccttcctgatcagtatcagcacgagttctcctatgagccgatgcagagaccaccgaaggaaatg

SEQ ID NO: 4209 - DNA, 703 bp, Nannochloropsis_gaditana
cagcagtttttttcgaggaaaaagatatcaacactagtcagtgtgacgatatgggcgtgatctctcacgaggagacgttaaacgttacccagagtcgcgcatcatgctgatgtgtctagtattggattgcatgatttggaaatagcccataaataaaaagctccgggcccctggagcttttttgatacctttctccgataatccatacatgtattgattcgcaaagttaacaaatggtgcttcttttttcttcacgccaagaatgcgatatgaaggaggccgtcaaccccgggcaaccttatgaaatgattattcctaccatctagtcgtcacgaacaagggggggaggaggttagtgttgcgtcgcatcctcctccttcttacccactgtcttgcatgaatcaccctcacacacacaaaactgcggcccagagcattgatgattattttcatggccatttggacacatctacccaggcgcggcgacggacaaagtattgcagaaagggggccctggtgcgttgctccaggcatcgtccatcagacgaggggtcacataatgcgcagcaatcataaacaaaagagaagcggtacctctaaaagttctgacttaaaaggacaggaaaatggacgaagcaacagcacgcctgacgtgtcttatacaaacgggagcgcacatttagtgcaagagcctgctgtaatg

SEQ ID NO: 4210 - DNA, 703 bp, Nannochloropsis_gaditana
accgaatatgtccgaggcaccccaggaaaagcccgaccccgaagaaagctcggcgactgcgttggccgagagtgtcgaagcagctgagggagaaagcttgccgaaggggaggcagggggacagattcacgtccccggttcatgacgagagaaagatcccggagttgcaggagggaggcgggagagcgagagggaaggaggatggaaaggagggagggaaggggggagagaaagaagttgcgcctgtcccaacggtgccaaagaaaaagaagtcaccaccagccccgatacccaccgctccgatcggccaaacctgcgaagcctttctggaaacggcggaccgttacacccccgcgaaaagcccgagggatttcaaggaaaaccccgtgcgggtccacaaatttggggaacacacggaatatcccaattgcgacgtccggtgcctgttcgagaccaacgacaattacggcgcgtacgacgccagctatgacaagacatgggaaggggttcctcggatcaagtggactatggaaagcttcaccaactacccggacacggaactgaaccgggcccattccaacggtttcgagatcgtcatgaccccccgtttggacgcggaggtctcctgtgtatacttcggatggtcccccaacgaggtctttttcaaccctatgaaagttccccctctgcgggcggcgcaaaag

SEQ ID NO: 4211 - DNA, 703 bp, Nannochloropsis_gaditana
aaaattccgccttgatcggatgtcaggaataatggagtctccttcagcttcatttgaaatttcttattcgtaaatgggttgatgagaattgcgagacatatttggaatgcgacacacgcacttctccatatttccggcgtcggatagctgctctttcaaccactttcaacatgaaataggaccaaagacaaaaacactgagccaccttggatcccgcgaaagactaacacaaacaaatctcctcgtgtgtcttctcatgacgaaattcctccgctcggctttttttccctatctgtttttgtttttcccgtgggagggaggaggttatctcatgtggtaccaacagcttatcgcccgtgtcttcaaatgatttccgaggcgatgcccctctgacgcggtgtgcgagccctttcctcgccctccttgcaacaaaactcacttttcgctctatctcacgacgcacacatcggaaggaatggacagttgcctcgcgggaaaagctttgcgcaacgtgaacggcatgataggtgcacctttgggaggcactatgcctcacggccaaagtcgtccaagtcgctctatccctcgctcaatcccaggcgcgctcctgttcctcttcgttgtttctctcctgccctgtgcgattgttggtttttcttcacaagctcgggtgcgtggttggcgtacgctccccttctcaatg

SEQ ID NO: 4212 - DNA, 703 bp, Nannochloropsis_gaditana
ccgggtccggcgtaaagttgctcgccatgctatagtgaagctgcgggagtctgtctcgtgggtcgcatcaccgcacgattgttgggtagaacggatggtatgaatgcgatggatggaacttacgagccgacgtcgcggcaacgtcctgagttttctgtccacaaatgttctcggattccaagtagattcccgggaagggcatgcacgctcagataatggtgtcacagatatatatcgttgccacggattgcagggggcttgaggtcttcgtgtgggatgtgcccgctttgtgcgacgtgccgctcctcttcacggcatgtgagagccgggcgatatcgagggcgagggagggactcaagttacgtgttgataactgcactcattggaggcagaagcaccaaaaatctctgaaacgaccattatctatactcctcacaagtacaggaaaagggagtgggtgctcaagacataccggcgtggagggttgatagcataaccgaggtacaagggggaggctgcgtaataaatacatacacccctcaagtacactaccctgcaaatttaaaccccagcatctctacaatgatatagacttcaaagctgtcgcgtagcgctttatcgaccacggcgaatgtcgaagtaaccatttgcgacctgtctcttccctcccaggcatcattacctcaggcacctccctaccatg

SEQ ID NO: 4213 - DNA, 703 bp, Nannochloropsis_gaditana
gtggcaggagcgacgctaaaacacttagtagataggcgcctcgtcctgattcttgggtgtttcttcccctttctgcgcgcaccatggtcttcctatgcagcctgtagagtcccgtgtagtttttattctatcccggtgtcggtgtcctttgtgcctttccttgatgagacgtgggcagagattgggtgttagaagacatgggaaaatatcgctcgagagcatcggcgaggcagaaggcttgagaaaggttaaaggacagaaaagtcgccacatgtgacactgcaagttgaacaacaaggaccctagcagtccccttgcatgtgcctttgacatcccttgcgggccccgtgtgtgcatgtgcacgccatcagtgtcatgcgattgcacagcctcttaacctcccatcccgctttcttttctgcttctgttgcttccgcatctacatcctttctcgctcttccaccttgtctggtcagcttcctggatccacggtccgtattattatgaccccacatgcgcgcagtctcacgcttcgatatgagagattgatgcgcgtaatttcgccttgctaatgtgtggaaaaagtagcaggcaatggaaggatcttggtccctttccccccttaagtagcccgcaccctaacctttccatacagagcacttgccacagctcaaaaccaccttcgttacatacggacatcatg

SEQ ID NO: 4214 - DNA, 703 bp, Nannochloropsis_gaditana
ggttttcgtgctcgcccctatgctccttattacccacttcctggacctcgacggcgagtagagccccgggcgtttttcgacctattgctctctttgagcggagagcgtgggaagccttggatagcactgcctgggcactgcacttgttagggcctgcggtgtgtcggctaatcaattttgcgttgtacagtcagcattcatgtagcggataccttacggctaacgtgcgtcgcggcgatcatgaaattttttgttccacgttggccatgtttactccaatcatacgtgtgataagaaatgtcacagacacagcattgtatgtcaaaaaagagtctgatcaagctgtgggtcagttgccattttgtaaatcgtgaaaagtaagaacaagctggtggaggaacgacttgtagaagttgaaggatagcgtgcagagccatgacgatatttttttctaaaaactcagagaggtgttggttatcgtgctcatggacacatccttgcatgctgatcgatttatgcacgccagtggaaatgcctgcattctgccatggctttatcaattccccttcctgtctcattcgctgtcgcgagcgaggattccaacaaaacccgccaagctctgtcatcgcaacgccggcatctctctcatccgcgcgcacaactctggctcaatagaatacacacagggagaagaggcgacatg

SEQ ID NO: 4215 - DNA, 703 bp, Nannochloropsis_gaditana
cggtatagtctgtaggaaaccgcttggaataaaattcgatcggcgcaagccctcactacggggcaggtggagataggattagagaacagggaagcagacgactcaccagaaattccatttcgctcgaccgcgactgcgccgccatccccccgcgggaaaaaatcacaccgggatcactgtgagagtgaaatcaatgtattattaccagatgtgatcgcatgtgggggagagaaaggaccttaaatgaccacaaaatgtgcgtctagcgccctttccttctcctcgatgtggcatcgctcagaaagtcaatttgtgggcgatggaccgcgctttccctcaagtcaaggcatgcggccttggaaaagcgcccattaatggtggttgtggcggtcgtgggcgcgaggggaaagtatgttgcgtctggcaccgagtgggtcacgcataccgggactccacgtgtgagggcatacattttgcggcggaagacaaagaggaagcagcgcgagaggagaaatacaagcagcgataactcctcacttttcatgacctccggaatccatccacagtgtcgccctccattagtgctatgttatcatacgtgcggctgtcctcttttttcttctccccgatctccaaggggatgggaaggtattatagaagccgtcatctctccgccttgggcgcccctcctcgtctcagcctc

SEQ ID NO: 4216 - DNA, 703 bp, Nannochloropsis_gaditana
  misc_feature (293)..(695): n is a, c, g, or t
cccgcattccttctgccgaaaatgcgtggtggcctacctggagactcgcatgcgggaggggcgaaccgactttccctgtcccatgcggggggacgcggactgcaggcatgccttcaggtaggggggggcggaggggccggtagcgggtgataccagggtagagaggggcaagaaggctatcgcggtacctcgctttgaatccatcctgttgacatcacccacacccaccttcctccccggggaaaactttccctccagccggcatgctcacccccccttcttgcccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagacgtt

SEQ ID NO: 4217 - DNA, 703 bp, Nannochloropsis_gaditana
tgattgcaagctttaccatcgtgtggatggtggaaggggggtgggcggaaaaataggacgcatgacaaaggttggtcaaacccatgtctagaataaaacattcaatatgacgatcaatcctactaaaaccagacgataatattccaccttccataaactttataaccatatatttgcgaaggctcggattgcagatggcagaccgacgagcatatgctgatttagacaccaacgtacctgaagacacacgtggccgacgcaagccaataccgaatatgagaagccctctctacaattggaaaaacgtgcatgatagtcatgtgattggtaatggtgggaggaaagtgcaagtgccgtggatgaggcttccccaggggcatacgtcacacctcaggatgtcacggatgttgccacctcacttatagaacaaagacacaacttcgctgcctcgacaaagtgttcccgcccgtcgggcctactcagacactctcgaggaacgtggagtactcgtgcgaggatgacagtccatcgagttatttcagacatttcgcaagcagcaagcaggctgcgtgctctacgcatcagactctcggatgggagggaaagtttttggttacagggctcgccggcatcatttttgttactttcatcccaccatttcgtttctgactgagagttttgcaaatgcaacaacacaggcatg

SEQ ID NO: 4218 - DNA, 703 bp, Nannochloropsis_gaditana
gcaaagcggagagctgccgacagcagggttctgcgacagaggcaagctggacgggttgacgcctggtgagggggaagcaggacgatgacgtgggcggtggtagcgagtggacaccattcacgcgagccacatgtggcacacgcactgatacagtacgccatacatgccgacgtggagggaatagcggaggcgtgtagcttagcgccgacaacgcgaggaggaggagggagagcaggaggaggctattgctcccgttgcgctgcggcggcatcgtcaatgggatgaagcggagaaaagcagccgacgcacaagacggcgccccagcgtccaattaagcaagcctgtagtggatatgcggtgttagtatgaatgcactttgcgtacggccacgtttacacaatgacgaaggcatctcagccaccctcgccaagtcaactctgctacagaagaaaagggggagaaagaggcctttttgtctttcctgagtcctgatcgacaatgtctcccacactctcggaaccatggtgcgtgtgtaagaggtgggaagggttggcagtgtgcgaccgcacgcgacgcgtattttggtgtcgcggtatctgacctcgccaactttcgattgaacctggctcgtaaccgactaactcccataccgccctctttcctgtcacagaaacccattcccacgcgtttgcagcccaagatg

SEQ ID NO: 4219 - DNA, 703 bp, Nannochloropsis_gaditana
gaacgacaagcgaaaagggttacccatcgtggggggaagaatgacattaccttggggacgccacagagctccgcgtcttactctttcgaaatgcacgactgtgagtcgatcccatactttttagtatgacacggaatttacctgtgcttcataatatgcatgaaataaattttggaagccttgcaacgagcaaggcagcatctggcatggactttggaaagctagtacagcatttttcttctgacaaaatatgcagagtaataccatctagcgagcatgacattgggacctcaataagaaagctcactccctttttaaaaagaattcaatttgtgattatttgtggggttgaaaacgttacgtctgttggcgagtggtggatactttaacgactgccggaaatgagctcacaaaatgtaccttttgtactctactcactcttagacagagaaaggactagaatatgccacagctgcgcctgaactcttcaaatttctgctgtaccttcgtcgcggtactgttcgtctccttttttctgagcgccacatgcgctttccgattcccgcgtagaaccagtgcattgctccgacatcgcacgtatgcagcgacttccgccttccatcccacttccaccaatgtccatttgccagcgagcaccgctatagtgggtgcaggtcccaccggtttgttcactgccttgatg

SEQ ID NO: 4220 - DNA, 703 bp, Nannochloropsis_gaditana
tgctcttacgaatgagggctgatcaacgtctctctgtctagaatgaagatgcaaataaagcccccatcagctgcgatgaagtaattttgcaccaggccgtcctaaacatgactccactttccatccgcaactgcactttgtcttcattcttcttcaactcatgacagcttgtctattagactcaaaaagtcgtgtcttaaggcactagtgtcgcgcctcctgactgtggtactagcgccctcgtgacccctactgtggtacttctcgaacaggacatgtttgtgtggccgaaaatacattttaccgctaagacccatacgccaagaagaaaataacgcaagaagcgtgcaaagatcaagcatttctgactccctgttataaacgcttcgccgggaacactcctagatgtcacggcatagctcgttgtcgggtcgtcgctaaatcgattccccgaagtcgggctttggtcgtagtccttctcacattcgtttcttttgtgcccccacctgaattcatcaagggaattttataccaacgtttataattttgccgtgtacgactcagtgagacattcaccgtgcattttttttccaggtattgcaattggcaggagcgcggaggttagacttctgtgaagatcagcgaagcgaaagagggccccatctcactatattctaccgcactttgactccaagaaaacatg

SEQ ID NO: 4221 - DNA, 703 bp, Nannochloropsis_gaditana
gttggcgatcttttgaacccgtggaatcgcccatgacgctcgatagggaaggcttgctgtgtcgtgattgcagtgagagcgcctttaagtaaagtggcaataaggaagggggggcgccgggaaagggaggggccaggaccacgggcgagagctaggaactcaggcgaaggccaggcctgccggctttactgctactctggacactttataatcgtcagcacaccaagggggaaaaagacttccaaccagcgtggcgagacaattgaaacctccccgattcgtggggacctgatgtccgcctccttgcgaaggaggaaaaggcaagaagaggtaggggcattgcacatggctcaatattccgtttgaatgccctcgctgttcctgcactgctgcatggggagacgtcgctgaacgcatgacatattcggtgcaacatgccggccatgtccaaggccaccatgtctttaagagagtgcgtatcagaaggagaggaggtgcgttgtatgatgtactcgcctattgctcggccatcatttccagtcctgttcgtcgtatcttgttcatacaatttctttttcttttcaccttgcacacatctacccacagtatgctggcccgctccatcctttgtcgtcctgccgttaggtatggtttgacgagctcaatcccctgcctgcggacaaactgtcaaatgtcgctgatg

SEQ ID NO: 4222 - DNA, 703 bp, Nannochloropsis_gaditana
tctaaaattcgaagcgtctcgtttctcgtgtggaagcacgcatgcccgtcagtgcacgcagagccgccctccacttgttaaagcaacgagactatgagttcatccacttagctagcaatcaactcccttctgctcgatccattcccttccgcattcttaggccatgcacgtggggagccttttggcatggctgacgctcttgtgctgctgttatagttgtcgcctggcttatgtgacatccccccttgccccaggacggggccacgggcagcggacggtgactattaccccgcaacggcccgtacctcttctattgcaaccgctgacaaactatccttgcgccacgctttctgcccgtcgttcctctttacccgtattttcatccttttcgtccttctttgccgagcgggctggagtgaacgcgacgaccagcggggataacttggcatatgaactgcgccttctggagctggagagtcggctcttgaaattggagggaatcacggggcggacggctagttcaggcggtggtggggcaagcggggggaaaaaacgtggggggaacgtgcaaggtgcaacgggcaccggtagcagcgctttcaaccacattcttccagacggggagcagctgttgttaggctgcacgttcgccggggccgtgctcggcttattcgtgggccgcgccttatttaaccgacaaatg

SEQ ID NO: 4223 - DNA, 703 bp, Nannochloropsis_gaditana
tcaggacaatgatctgattgcgggtgttcgggcccccgattttgcaaggagtctccagcagaaccagaaccagggtcaggtaagcagaaagaaaggcgtggaggatggagacggtccggtttcgaaagtcgaagcttgtgcccgagatggccggcaggacacagacgaggccgaacactactgaccaagctaccgtagacaggattaatccgggccaccggtctgccagtatatccacgtagggctggatggctgcaaggagatccgtcgtcttcatgatgagtggaggagggactaagggacgtgtgtccgagcgtgtgtgtggcagatcgaagagttgttagaatcctactagtagtaggagaaagcgtcgcttgatgcaacacgggggtgaacgatctgtcgcagctcacaatgctgctacctggacgctgagtcctacgcatgcatgccgtggatatagccatgaatatagacatcaacctacggcatggaccaaacactctgaccgttgcctgcaattatgccataatcagtctggacactgttatcacgggagtcggtgcggcgagtcactccctcgccaagattgcaatactaagatgaccaacgtttccttccggcactcgagacttactttaacgccactgaccgcgcatcaggacagatatacctgctatgcaccatcggcggcgtggagatg

SEQ ID NO: 4224 - DNA, 703 bp, Nannochloropsis_gaditana; identical to SEQ ID NO: 1691

SEQ ID NO: 4225 - DNA, 703 bp, Nannochloropsis_gaditana; identical to SEQ ID NO: 1679

SEQ ID NO: 4226 - DNA, 703 bp, Nannochloropsis_gaditana; identical to SEQ ID NO: 1682

SEQ ID NO: 4227 - DNA, 703 bp, Nannochloropsis_gaditana
cgtggagtagcttcccttacggcgtaggagcattataaagagttatcaagacagatacatcaaaagtagcatatgtcacaagaagtcgcggcagaacgacgttgtcatcagattcactgtgcttgctcatgatataaagtaaagcaaaaggaatacatttacgcttttaaaacgtatatttggcaatcatctttacaccatatcgctgtaacgttcaaggtcaattttatgcaagtagaatgattatgtattatgtatctcgcagagatgttttaagaaagcccactcagttgatttcagaatgttctctctcgttgcgtgatgggccagtgaaagggggaccgtttaatctttttcaaaatttcaaaccacattgacattccggactacgtacgcggctcgtcgttaggctgcataccaagtccctgcgaacacatcctcacgattcgtattatttttgttatttatcttttgtgcgatgctttaatctttctttgctttctttcttccttccaaattatgacatggctcgcaatggttcatataatactcttcgtctttcgaagccagaaggtcttcgtcgcatccccctggccctccactttctttgaagggaactcagcaaactgtcattcgtacgaattaatgtggcagtgttcagtccgtgattaaagtaattatgaaacctcaccataaatagatg

SEQ ID NO: 4228 - DNA, 703 bp, Nannochloropsis_gaditana; identical to SEQ ID NO: 1685

SEQ ID NO: 4229 - DNA, 703 bp, Nannochloropsis_gaditana; identical to SEQ ID NO: 1689

SEQ ID NO: 4230 - DNA, 703 bp, Nannochloropsis_gaditana
  misc_feature (1)..(564): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttgtccttttgattcgcatcggcctgcatttcttgaccaccattcccccaataattaataatactagcacaatccatcgttcgccttccttctttcgtaggggtacacgctttctacctgcgcttcacagagaatg

SEQ ID NO: 4231 - DNA, 703 bp, Nannochloropsis_gaditana
tttcagtggccgtaccggtgcaaatgaaggtattaaatgtaagattgacatattgaggcagcttttcggtgcaatcagcgcaccgcttgtttccgggaagtttgctcaagtctttgactgctctaagcaagcgctcctcctttcgtttgtccagcccggtcattaagcaggccgtgtacttcccttgcgccctagagagtacgtcccgatttcgtggcctgtgtgttgcgaaaagcaatggaaggtttccaattaaagaacttcaattatgacggtcctgcagatgacgacatgcgtctctacccgcctgggccggaccacatgcctttcctttgcttgactccgcgcagcccaagcagtttccgtgcagtatcaaacgcgttagcttgcagcttcgtgtgtgttgcagaccaaggatgtgcatgacaggcggtattttggtcaagaaaaggggtccgggttagagatagccgggaaagacaacggccagccgcctgtccgacgccggcctcccccccgggcccaggcccgcgattaaatggcatacatttgtcgagtcactaccatgggaccatctatagagtgtgtagtagtggaatgtatggaaaagggtgcgtcgtcatggcgcgagatttcgtttttggttttatcttttgccagcactcaagccgcccgccacacaacactttggcagggcctcatg

SEQ ID NO: 4232 - DNA, 703 bp, Nannochloropsis_gaditana
ggtctttccccttcctgagaattgcaaagaacaagggaaaaagggcaacgacctcaacccaaagtttaatgccgcactctatggcacttcacaatgcgttggaatcagtatcgttgacaagcagtcaagctctcaatatttcctgagagccgtcgccatccctcacccgactgcgtcaatatttcatgccagaactcattgagttcactgagaaaggctcctccatcatcgattgaaaaacgtacagatcacagagacgtgagtcaacggcacctctgaatgtaacccacgatgtcatgcttgaagacgcgccatccacggccctcaatcgtcttaaaatgtatttcgtgtggccatcttcgctaagagtcctgctgcatgtaataagcgaggggggcgaaccgagacgagccaatacgactgcaaaccatgtcacataatcgtgggatgccgaagattcccccgtattcagtcccgaaatttgacgtccacaactaggacgacgtggcggtgccctttttacacggcaccgcgtatttgtgcggatattcgtgccacattcaaggctttccttcctcagcccgtatcctcattcacctcgtcgtcggaaggtctcctctcacctctttcctggttaatttcccacccgtccagagacaagaagaaaattcaagtagtaccggaggaccattgccctatcatg

SEQ ID NO: 4233 - DNA, 703 bp, Nannochloropsis_gaditana
aaggcttgtggcgcccgcggatgatggaggctatttgacttgccagtcgcccgacgacctgatatcgagagagcacggggaaaagaagtccagggggtgagctgatcacgtgtgacacacaaggaggagaccgagcccgccatatttcagaacttgcccaagagggcacgcggagacgataaacgtagaaatgagacgcgccgcggacgccaagggagacgtgtaaggtgggaatgaggggggggccgaggggagaagagcttgcctggtctttggcgtcaatcagatgccattgaggtcgagccttcttggcggcctccaaagccgcatcttttaccgtggaactgacacgggtgaagatggcagaggcagcggaagtcgctgctttgctcgtagacatggattttgtggcctctgggacgggaggaaggatgcggcgggggggggcggcgcacgtcgagggcgctcccaagtttgacttgctgacaaaatttgggctctgcctattgcaaatggatgaacgtgaatgaatggacacattgaatgcgatcaccttgcaaggggcttatgagtttcatgatgcctgtgtcaaagttttctccttaggatgtgctctcctcgcacagtaaccagaccctgtcgccaacctcttacaaagctccctcgtgctcacgccgataccataccgactcacggcctcgta

SEQ ID NO: 4234 - DNA, 703 bp, Nannochloropsis_gaditana
gctctttgaggtggacggagggtactgtccgttcggggagagtttccttgggaacgacgccatggtggtggcggccacggaggcgttaaggtgcctgcaacttgaatctttgggcgcggagtacaccctgtccctgctgcgggctttgatggaagaggtgcaggacgtgaaggcggtccaggatttcatccagacgaaggcggagcgactcttgaacttgtcggagacgaagaacgaggtcgagaaggagatgaggaagctgaaccgggagatgaagaagttggtgatggctgccaaggcgatgggcgtggagggggtggggaggggcgcgtcggcgggctcgggaggcgcgggcggggaaggggaggaggacgagggaggggaggatgatgagggcggagggaagggaggggcggaggaggaggacggcttgaatggcaaggacgtgagcacgacgacaggcccaacggtcctgggaagccccgaggttcaacatttgaattcaaaaattcaaaaagtcagcgggcagttgaaggcggcccgggaagagctgggcttgtacgagcgggagtttgcccgggcccgctcgttgccgttgggggaggatcggtatcggaaccagtactggtactacgaggaggatccccgtctgtacgtgcacttgcggtcggggatgggggcagggcgggagggagggggcggt

SEQ ID NO: 4235 - DNA, 703 bp, Nannochloropsis_gaditana
gcatgtaaggtgttcaatgctcccgcactggcttcttgataaatcaatcttaccacccaaaaaatggggcgaggatgatagtccaatactgcttaagatgcaagggttcacaattggcgtgttggtgtcgaagttttcactggactctcccggccgatctgaggtgccgagggaggacgatgccatgggaggcagggttcttgttgccaggggtgaggcggaggatatccgaagggagatatggaacgcgacgcctctcgacgcaaatgaggctgtaggaacaagttcctaagaagtgatggcatgtgaaatagccatggtgtcgtgctgatggctgggagtgaaagcttgcggtcgaagaagggcgtaaagccgaggcgaagatgcctggactccgaggggatgactcttccctttcttttcccgcgtgcctgatcatgtatgccctacgctcggatgctccatcttactgtggcatcacctcattcatgatactacgggtggaacgtgttggtagccgcatgctacggcagacgccgaaggtgaagatagcacacattggtgcctagctacggcctctcacgcctaattccaacacatgctacttactaactacaaccatggacacgaatacgagacagggccgcgcattcagagctgtcagtgtaacagatcaagttcatctggccacctaggtacaatg

SEQ ID NO: 4236 - DNA, 703 bp, Nannochloropsis_gaditana
taacaggatgagatggggcattctttccttccctccttctcgaaacttcaaaatccagccctgagtgccaagcactaaaagcaataaatcaatcattacgtgatccagaaaagtgtgcgagggattgggccctctggcagtatttcaaggacttggcactcaccatgtctgtctgactaggtagtggatggagtgggggaggtctggctagtacgtggtttttcctgctgggtgaaacaacttgaaattgtacgcgttttaaaaaacatgaggacgatgtgataccgtgggtccggtttttgtgcacacgtgcaacaccgctcacatgcggcctgctcccaccccaaagcgaccgcgagaacctcgcggtccttctcgagtgttctttagggcgtcgctgcgactcgcctcgaggggtgaaatgagagaatgcggccccccggcgccttgcaattagatccacgctgccgcacacgccgcaggctcaagctgggagtgaacgcgagacagcgactcggagatcctgacctttgggactgagaggtgtgcttcgccggccttgattttttccccccgtacctcgtcctcatgcatctctccattgtccgaccccgtcaaccttcaccttaccgcaaggtgccaccaggacccgcaaaagttggaggttgcagtgaaaattccccagtcgtagcaaagaattatg

SEQ ID NO: 4237 - DNA, 703 bp, Nannochloropsis_gaditana
cgattttgaccttcatcgctcccgctgagcttgagattagacgacgcattagacagtttgccgagctcgatgtcggacgtgcctgtcattttatgacttccgtcgaaacccaacacgtgaatggatctgataagttgatagtgtttccagcttggcaatcggacagaccaccctctaggatggggaggaggaggtggaggaggtcttgctttgccctgttctctatccaaatgtagtgggcacgcgcctgctgcactggtacactcctgcgtaaagtaaggctcgcactttattgcaggaggggaaagattgtgtgtcaatacgtgtgacagccaggaaggcagggtaggagcgacgggctctgccgttccgacaacagagatggcacgagtggtcagacccgcctgaacgcgacgcgacgccacctcgagctccaaataccaaagcacgagacagtgctagagcattttttcatgcaatagatgagacatgtgcccccgacggtgtctgggacacgggcacgtgacacgtcgcgtgacgggcgagtgtatcctggcagatccagcggggcgccccaccatgctcggcctccatcacgcacatcgcccatgttactttcccgtttcgccactgcctcgctgcgaccgggggaggctactaggcaggacatgcttctgacacaaccatttcatgtataggaaag

SEQ ID NO: 4238 - DNA, 703 bp, Nannochloropsis_gaditana
agagtcgaggtcgcaacatcggatgcgaggagcaaggtggcgctacccttgggaggcattgtacagcaagaagaagacgagaaggagtgagtgtaatacgacggagaaaagaagatagcataggggggttgcctggtgaagacgctgtcactcttatgtccgaggagaaactttcttttcccggcaaatgttttcacgctaggagatggactggaacgacaggcaataatgcggcctgggtcaaagtaagtatcattggatgatggtgtctctccagcgcacgacaaggtgtttgtctaatgatcagcggctagtgtgattatgtatattcttttttgaagcatatacaaaggaaagggggaaccgccagccagggtctgggttataaactcaaataaggacacgatgcttccggtcaaagaaagtagaagcataccattaaactaactatcatgacaccactgtatttaattactgttgttgaatattgtagtttgccactgtacttacacactgtagttaacctcctgaccccccgggcaggaaagtcatggttggcgagggtggttgcaaccttcgtgcaaaatcctcttcgcaaacgtatgccacaaccatacgcaactttttgtcctcgaaatagaacacatttacgaatcacccgcaataaatatgcaagcagaaacagcacaggtatcacatcatg

SEQ ID NO: 4239 - DNA, 703 bp, Nannochloropsis_gaditana
gattcgtgtacgccaaactgttgctaggctgttggcccacagcgagatccatcgtgtttctgtcgttgtgagcccctttttgtgaaactctgtgacctgaagggagttgagcgcaagtggagggggccgccgcggcgggggtagcgtcatcgaggggcaccgaaatgggcatgcctgcaaaacgtgaatttagacatcaccactctccccgcccttattaggtcgctgccaagtgggagtcgattgcaaagcttacacctgtctcaaattgagctcttttttttttgcaatcaacggccccctctggaggtgacatagagatggggcagtcgaaagaccatgacatgttgccggcccattagcgtaacgctgatcgagtcccaaattaatacatttaaatgggacctgcgagttaagactcatgctatatctttttcaaaccgtacatggacaattgaagaagatcgagaggctaaacaggagacatttacatgtgagcggctgatgaaaatcgtgcaggcctccgtgactatgtacacgaattcaactgaatttggtgggatctgttctcaaactttctcatttttatgcagcacaagcacgacaggaacacttcggtaagagagaaccctaattcacaaaagaggtcatcttaaacctctttttcgccatctttggcggggcaggccagccaaatacgatg

SEQ ID NO: 4240 - DNA, 703 bp, Nannochloropsis_gaditana
agtagcgaagacccaatagccgctgcggcgggaaacagaggcggaacaggcatggtaatctgtacgacgaactgtgggaacacccgagaggggggaggttaatggtgaaatcttgtgtgcaccgttgtgacgacccctgaaagaatattcacagagtccttcagacatgctcgaagacataagagacatgcggcaggccgggtcaccccgcctgtccctagtgccagaaaggccgcagtgttggcaggggcacgggggggccatgtcggcgggggcgggagacctcatcctgcggccctccgagcctgccagccagccacccagccacccttctttcctcccgccctgccccgtgcctctgtggcctcatggacgcgtcattctcccttagcatgctctgtaatatgtttctttcgaattctgtgtgactctatctttcgttgacacacgaatggcgatgaagatgctctccttgtggggcgctaccgctttcgacgagacgagcggtaccgtcatgcccgtcttgttcagtaatccagaattatactttcgaggaaattccagcggcatgattggagtggtatagaagtctaaaagaggtgcacgacagcctaaccccccacgccggagtgcgttgatacccattgctctgttttctccatctcatctcctccccttcctcctccatcaggcatccaccatg

SEQ ID NO: 4241 - DNA, 703 bp, Nannochloropsis_gaditana
gtgactgatacacctggagatgccgtccatcaatggcacacaggactccctggtgtttttgcaaactaaatctctgtaaaaatctaccgcatcgattatttatcgataccagggctcatatcgttgaaagagcttacaggcagccagctctctgggctgtcccttgttggaacatacatcttcgtcctccaggtttatgtgtcctcgcgtcctcccaaacgtccacgaaataggtatcgcctaagagatgtcaaaaaagtaaaatcgtaaacgtcggtgatgcgagtgagtccacgacagtcccctcaagtgttcggaaaagcctgggttccggtccgtgtttggctttgtgaagaacggcaatcccaaggcagactaggagaagatgaggaggagcgttactcctttcctgtgcatgtacacatcccttcctcccccacaaacatacgcgcccaaccgtctttcacacgtctcatacaccaccgccgtcgcaaatgaaggggaaaatttctcacgtttcgcctattccacatgttcaggtcgcgtgctttgcgttggggtcgtcgtcctcaagcgtaggaggagctgccgcctttgtctaagaaactttggttgtactcctaagaggacgagacacgcgtgtacagtgtgggacacaaaagactgaatcacgacgacttgtagctttcttgggacgaggatg

SEQ ID NO: 4242 - DNA, 703 bp, Nannochloropsis_gaditana
ggcgggagggagaggcattgtggtccaggacgtgcatgccccggcctcagtggtaatgggccgtattttagacttcgataattataacaagatggtacccaacgtggcgcagtgtggaaattacgctaagcgcaagctaatgcacgtgagtggccgggagctctggaaagtgcgggatgactataaggatatgaggaaacgaataaacggaaatgcatgcgaagcagtgagaatacattgcattccaaggaacatgtggtgtagagaccggggaggcgatcgagcggaagtgctttgtcgcccctttcctcaacccgccttgccaaccgatttctcacatttcgtttctacgtcccactcacgtgcagggggacgtggagctaaggacacgctacgtcctctccatcgtcgggttcaagctcgagtacttcgtgaggcacctctaccggccctccatacgcacgctgacatggaccctggactatgacagacagtcagacctggaagacacggcgggttactggtccgtggtgccgctggacaaggaagggaatgcgggggactggtcccgtgtcttctactccgtcgacctccgcatccccgcctgggtgccccagctggtggtgaacatcctcaacacgcaggcgctcacgactgcgactgcttgggtcaaaacacagagtgagagggcgtaccagacgac

SEQ ID NO: 4243 - DNA, 703 bp, Nannochloropsis_gaditana; identical to SEQ ID NO: 737

SEQ ID NO: 4244 - DNA, 703 bp, Nannochloropsis_gaditana; identical to SEQ ID NO: 739

SEQ ID NO: 4245 - DNA, 703 bp, Nannochloropsis_gaditana; identical to SEQ ID NO: 742

SEQ ID NO: 4246 - DNA, 703 bp, Nannochloropsis_gaditana
tataggaagctggaggcacatttggtggtggccctccccgatggggaggggggggaggaggaaaggaaaacgccgggaaaggtgtggcgggcccggcacacgagaagcagaggcacgcatgcgtcgactcgccaagaagattatgaagttaaatttagggaaaaggcgaacaggaagtttcacaccggtgaagtggatagagaggctatcggtggtcatgagcatgtgaaggagaagtggccagaaacaacgtggttcgagtaacgtttggatgaatgaaggtgggaagtcactgacggtatgaccaaagacgagcttttaccgatcaaagtcgtcgtcccatgggaaactctacggcaatatcatccctgtcgctccatcactgaatcggccttgacggtgtgagaactacatgcgagtacaggacgcgaagtccgcagaaaaaggaacaaagctgcgacacaaagtaagaatgaaaaatgttggcctacagagtacttgaaaaacatcgattagtatttatttttatggaaaaaaacttcgatatttcgagctatcgaatggcatgcgggaggtaacttgacatctctgctctgacgctctttccccagagtcttccaagtgaatgttctatttccgcgaccacgagacttactccaacgccccttttcccggacaggatttcgaacgagagtcgcacatg

SEQ ID NO: 4247 - DNA, 703 bp, Nannochloropsis_gaditana
ttgtttattttaaggattagaaggataaaagcggagctgcaaaggtgaaacatgcctgagaggactagaagacatacggagctgaagtgcggggaggttaaacccgatgatcccattccttgcatttgtcaaggctcaccgcattcatagttctaaaaagaaaatatttccgaataatgttaacacaaaaataattaaatactgttctatgtactccgttcatttgttgatggaatcaaaaggccagaaaaaaagggggggggactccaagctgccgcagacgctcgcctcgtctctcgttcgcggaatgccggtcgtggaaccgctgtgaagataccgtgccttggggatcaattcacacattgacgagggcgcctcacgccgtggcgtacttatccgggccaaaatgttatttccaaggggtgacggatggcatgctcgactcgtgtgatggctgatgcatcaaccctttcaatgctccttcctacttcctcttatccactggtagtctgtcatgagatgtggtgaaccgcgtctgtgataatagtgttctcatttaacctaacaaccaacacaatacaaaacttgattacatacccagtgcatcgaattttgggtgccttcaccgacaagcttgcactttctcgagggacgacaacaacaaaccacctacagcattaccgggcaatagcagcacaccatg

SEQ ID NO: 4248 - DNA, 703 bp, Nannochloropsis_gaditana
ccttatccgcttcttcccctccaaaaatcgtgtcgggacgtcgatccttcgccatgcttcacgtccgtctaagccgccagcgcgtcaagcgcacgaagttgacttcaatgacggaggcgtttaagagagagggaatgggcttggtgtcctcttgtccagtttgttgactggcatgtgtttgcagactttttggctagttttgattccctgcctggctgtgggcaacgctgcgacgtcatgcctcaaggcgattcacggcccacagtcgttgacttacactctaccgtcccatatccctttgatttctcgtacacaggtcattgactcgaaggtcaacccgaacaacatcagccctggcggcctttagtgtaggcaggtgcctgtggacgaaggagacatcccctccttctttccgcccgccctagcgcaccggaaggattgactctttgagcggtggtagcggaggtcacagcaagcgacgggccacaatcattgacaccacctttaactgatcaaagctatttctagctatctatataccgtaactctggattcttcgatagcaagacagccagatcctctcaggcgatcgtcacaggctagccaaaaacgaaccttcaacaccacaatcttggccgaacagagataaaattcgcaattcttcccattttccttcaagcaacacctatatcgacacacaatg

SEQ ID NO: 4249 - DNA, 703 bp, Nannochloropsis_gaditana
gaaactgtcacagcacttgattcacagatgcccgagataaacggagctctgactcagtgtggtctttctacaagggcggtggtacttagctggttcacccactccttctggggggctttgtctgtcaccgaacttgccattagcgagactctgtacatccttcacggcccagctatgcgggttggtgtggcattgagcctcttcaagttcatgagggaagatcttctggtggcggccgcgcgtcaatacgacgtaattcgtgtgagtcacatagttgaggcaagcttgaagcggttcgagttcacgccccaagtaatggagggcttacgggaggcgcacgcaagactagaccaaaaggtccaaaaaagaatgtaactacgaaaagactaagcaattggcaaatcacggatttgtgtcgttggcacagggtaggggaggttttccagctcgaatgcttagaacgccacttgtcgcttttttcgccgcaaagccgtgctgcccgttaagcgggagatcaacaaggtccttgccatgctattgctgagtctctggtttatatgtacatatttcagcacacacgctctccctcactacagattgtcgggcggtgcggggccaggaattgcttgggcagagggtcatagaaagcggctcccagtttgaggtgtatcaagcaaatagcgatcgaaccttgatgagcatg

SEQ ID NO: 4250 - DNA, 703 bp, Nannochloropsis_gaditana
atcccgtaccagtggtagcggcccaatgaagtgcattacaaccgcactaatcgtactgccatgtatcgtcagtggctttcttgttccagctgtacctagcatcaccttttcggatagtcgtgcacccacgcgcctgtacgtaggctcaaatgccaaaattgatgtcccgcccgacctggaaggaagactcgatcccaagcggtaagcccatcttcttaatcatttgcagcgctgaaccattcaagctttgccattttttaactgtaatgcgactgtgactgtctacgtccgtgtatgtgctgatatatggtcttatacctcgatgcccctggctcgttcccattatcgcaggcactgggatgtcgtgatgagtctgaacggcgaaacgaagacagtttccgtcagtgaaggcacctcgcttctagatgccgcggaagaagccttcggcgaccccccttgcatgtgtcgaaatggggtgtgtacaacctgcgctgcggaagtaactcgaggcggacatgggtcgtgggtggcggccatcgaatccctttcaccagaacagcaagagagcggctttatcctgtcttgccaaacatatccgtgtggcccgggactggaagttcgcctcaacgcccaggaggaagtgtacgagagccagtacgccaagtatgagaagaaagctcacgaggaattggagaaaaagaaa

SEQ ID NO: 4251 - DNA, 703 bp, Nannochloropsis_gaditana
catattgtcatgaagttatagttacatgtggggcaagcacatacgggaggagagaaagcggtgatacaggacttcacgttgcaatacagacgacgggagggagtgtcagaccgtctacgagtagctcgacgcgaaaatgatattcactcgcctcaacatgtggcgcatatgagctcatgacaatggaatacatcacattcgccatggtaggagcacatttggtcggcatcccccattttcttgcttcggaaaatttccattttttaatgcacgctgtctgctcttggcttcttgttcgttgacagggacaacgagctcgtaatcaacaccacgcttttcaactcccaggtagccgcttgtttgaggataaaacccacttatgtgatgtgccacagatgtacaacgacagaacatgacatagtctggatgttgtctgtgattccctccttttgacctggtgttcttgctagctacgggttgggggaaaacctcctctggagtccaaagcatgatgtcacattccccctttttattttacgtcctcaatgatttggaggggggaggcgtcgacgacattttgcaacatggttttaatccttttcagaggaacttatagtttatgtcctgcattcgaatgtttttctacttcactttcaaaacagacgggcgccgccggccttataattcattgacccgcaggatg

SEQ ID NO: 4252 - DNA, 703 bp, Nannochloropsis_gaditana
gagtcctattggggcaacgtgaaccctatcgggccccgggcgtgctacgacgagggaaagcgggtggcggagacgatgatgtacgcgtacaggtcacagggcggggagggggactcgagcatggaggtgcgggtcgccaggattttcaacacgtttggaccgcggatgcatcccaacgacggacgggtggtcaggtacggagggagaccgggacgaagatgggagggaaggaggtggagagggccatcaggggagggagggcgccagaccgtttcgtcaattcttctcgagatggagtggtcgtgtctcacgtcttgtcggtcgtgcccatgattgttttccacccctttcctctggctcggacgcgatgcctctgcagcaattttattatccaggcgcttcaagggaagaacatcaccatctacggcaaaggaaggcagacacggtctttccagtatgtggacgacctggtctcgggcctcatgaagctcatgaacaggtaaggacgtagacagaggaggggagcggagaagggggcatggaggagaggacaagggcggtcccacaggcggcaaggagagagagagtgcgccgtcggattacgacgctgtcaaccccactggtattgacctccacctctttgcctatctcccgtgtttctcgtacgtcgtatttctccctggcagcgactacgaactgcccg

SEQ ID NO: 4253 - DNA, 703 bp, Nannochloropsis_gaditana; identical to SEQ ID NO: 1111

SEQ ID NO: 4254 - DNA, 703 bp, Nannochloropsis_gaditana; identical to SEQ ID NO: 1113

SEQ ID NO: 4255 - DNA, 703 bp, Nannochloropsis_gaditana; identical to SEQ ID NO: 1114

SEQ ID NO: 4256 - DNA, 703 bp, Nannochloropsis_gaditana
tttcgaggaggttggcgagggcaaggacgacgggctgatctcgacgcaaaaccagaaggtggatccccgatgcctttctgtgataatccacgggttccatattttaaacctctgcgtagatgcgcccttccttccatgccactgtacaattgtatgggggagaaaaggcgcttggcaaaggggcggggacagcctcgcgggtttttgccggcgcgtgcgttgcacttttcccatgcacttcaactccaggccctacatagccacactgttctgtttcccggaaccggaaaggggcccaccggggctccgagcatgcgggcacgctcgaattttcttaatcttggggttgcttgtgtcatttatcctgtcttttttcgcttttcgttggttgtacagttttgaatcatgcttgacatcattacccttctagctaatcctatttcggagaaggtgtcaagagattttgcgaacattctttctcacatgaaaaggtcgataaaccttcaaagtgttgaatttggtcatagcttaaatttcaatacggacatgaggtcttgcttgcgagattgcattcggtattccaggaattgagacaagaacttattttcctttttccttcccacaggcaaacatcaacgttctgtctcttatcaagtatttgtactttgtccagaacaagctaaccacttgcaatcagacaatg

SEQ ID NO: 4257 - DNA, 703 bp, Nannochloropsis_gaditana
gtctaagcttaaaatatcctcttcaccccgtgaatcaaccatttctccgtatcctgactcaaaaccctccgagctgctggatatggcggatgactttccagttaacgaccaaacacttgcgttggtcttcaaagttgagtttcgaggtgcatcagaacttcccaaaagctttctgtttttccgcatgatcttgcccttaaaagaggacgataactttttcaattgcgaatacgatgacgaaaggtagggcgatggcagatccccaacgcctaaaaaaaatgacattagactttcgaaatgatgtgccaaaaatatgccggactcgtatgttgaggaaaaatctgccaggcatcttcctgaattaaaagagggatgggcccgtggaacaatcgcggtaacggcgggcgcgcaacggccgctcgcttgacggctcgttgcccgtccgttgctgccaagccctgaatttcaaaggcatctcgcgcagagcagctccagacctcagctctttcgcttgaccatgcttaagagacacgaaaatggatccactgaccttcaattttgaaacagcatggtggccacccgtagtaaggcaaaaggggcaagtggggctctcgtctcctcgccttccccttcggcgagtagaagacccatcccatcagacttgtccaaccgcctgtgggatgccttttacgtggtactgctg

SEQ ID NO: 4258 - DNA, 703 bp, Nannochloropsis_gaditana
agcaagaagatgaggggaggaagcagacaggcggtacatgaggtgtgtagccgggtttttcttatgcgcgtgatttcccgcatatcacgccccaggatgcgtcgcacactcatagcgcacgagtcacgcctggttcgctcccatggcttccacatcatccctgtaattaccaaggacgtgagtgaaagaggcaagttgacatggggccgcgggcccggcggcatgtgggcctagcgcctgatcgatcattctagttcccttcgccagccccgctctgtggctgtggtggcctcgctccgcccactccgtggcggtggtgggcggggacaggggaccagaaacgtgccaggagtgagaacatttcattgtagagcttggattcggtgctgagctgtggtatggtcggaggagcggatcgtgtaacctggcggggaattgtgtggtggttgagatgatggcagagaagctccctgcttcttctccagtttgcgtgaaccgctcacaaatcgcagtgcctcggaaaaatgttcactacttccttcgccactctcactgacattcttgtggaggtcgtaagcgcttctccaaactgattcttccatcaggggccttctgtaaggagaggccatgcgaatgaagaaacagactcccataaccacccctcttcaaaccctatcctccacgtgccttgacagacgctatg

SEQ ID NO: 4259 - DNA, 703 bp, Nannochloropsis_gaditana
aaaaagggcgtgaagccgcacgagatcaagttctaaggaggtggaagggatgatgggaggatgctttgtgttggttgttgggcgttgttcatgatagggtttctggatcggtaggatccgtctgtcgtcattcttagctctctctctcactttgagggatgatactcatcaacatggtgggaggaatgcggcgcccaccacatccacgatcgaacattagtcgcccccgggcacacgtcgaaataacttaattgaggcgggcgcatattttgtgctctagtttgaatttattcatcgtcgtttatttaataagctggttagtgcgacgagtcgggatatttggaagccaagctccatctccacgaaactcaggataggaaggcgtaagcagtaacactgaagatgtttgttcaattgagagccacaaactttaaatgactggcgtgcgtagtcaccattttcggagccaaatgtccttatcacatggactgtatactgggttacgcgattcgtgtgctcgtgtccaggcgtccacctcgaggccacccaacttcacgatacccggaggaaagaagccacctcgccctcgttcgctgcctcgctcaggctcgttcaaacacaaactcgcctcctcgctcctcacctatcatcccattcataggtctcaagcacagagtcatcgatcgatcgatagtctaacatg

SEQ ID NO: 4260 - DNA, 703 bp, Nannochloropsis_gaditana
cagtatgtttctatgtccatgccaagaggacctacaatttggtaaacctcatggtgctggatgaacggcgtggggggccaattcatcacatctagacagtcaaaacggccgaggaaaaaatgtgcacatgcagggatccttctcgatcccacaatagtaaaaatgttcggggcgccgcgtggtatgctttgtaagacaccccggaaggggtggtatcttgcaagcccttagtgctgcctcctgcgacgataggcagcgaggagaggtctgacatcggccctctcacgccgaggtttcctgctcctcccggcgcccgaaaccagcgcggccgtgtcacccgcacggcgcatttttgtcgcataaacctggggtgtacgatgaagtgcgcgtgcgtcgggcgctgtggcccggtgacgtgcagaccgagacacgtggtctctaggcaaggaacgagacgcggcgtcggggggagcggcaagtctcgtcggcacgagagtaaaaagaaattgcggttctcacccaagggcctgcgccaaatccactcatactctcactttgttacacttcatcaccaaagcagttgatagcaggacggtttgcatcctgggtgtgagggcattctctgagcagaacgaaaagcctcacaccatcttcagaatcccggtttttccggctgtgtactcgtaggcggattgagcatatg

SEQ ID NO: 4261 - DNA, 703 bp, Nannochloropsis_gaditana
ttgatggcgccctgattgctgccatgatggggatgtggaaggttgccaggttcactacgaagggggtctctccgatgggctgtcacaggggatgccgcaggaatttctgccgccccagccgcactggaagagcttggtgcctgtgccgaggtggctacgtcccgttcgtcgtccgagtcgtcgatgcagatgatttccggggttaggggggctccagcagaggtgggaccttcagcacttttccagaccatcacagtgggggagctccttttcgcagaggagtagctaggaaaataagggtcttgaacttattttaccctcaattcgccctggacaaggcagcagatttgggacttccgcccaccgctttgttctaatccgctaactcaggctgacgggaagcagcaagcagcctgtttagtgggataaacaatcgaacgtgaaatgagcatgacaccactaggcagcattgcaggcaaacaatgaccacgcccacactgcttccgcggcaaaaatcaatctcacgacgcgtaatggactccatgctttcacccagcgtgatatcgaagtcattgaccccgccgagtgctctggcaccggcagtcgctaaaacgattccatgacccggcgctttggaccttcatcccctccagtcttgcacatcgacagggcttcacttttgggggaaactccctgtcaaatg

SEQ ID NO: 4262 - DNA, 703 bp, Nannochloropsis_gaditana
cgacaggaagttgtccttgtggctgcatagaggggtgtgatatccgccccacgtgccacagttgaagaaaaaagagaccgcctttgtcgtgaactgcctgggtcaagagcttgtgaccttcaacctgctcgtcgctcacgatacccggactattgcagtaaccatacccctctggtgcgacgtatgtggcctcgccaataataagggctgctgacgcacgctgggcgtaatactcggcattgagaagagtcgggacttggcacggtccagacctcatccttgtcaggggtgccatcacaatacgatgaggcagttgaaaatgccccattgtgtaaggactgaacaactttccaagctccatgtgctttcagggggccacggcgggcttggacaatggtctatttcgacctctctgcatgggatagatgtgcactcagatactcgcaaaggacaaattatgctatccaattgctgtgcctatgcttggctcgcaagaactgagaggttgggaggaagtgaaagcgccaaaatgttccatgttggagagtagcgtttacctcgaacacgacgtcgctggcctggagcagctgacgcccgttctcggttcgagatagtgccccgtgattgtcaccggaaatgtcacaataagacccgtgttgacacgttacacacccaccttgcacgactctacagcattctcatg

SEQ ID NO: 4263 - DNA, 703 bp, Nannochloropsis_gaditana
atagaagtcaacgggccgcccggcatggtttctgacttgacacccgcgcgcttccacggtgcgggatagggaacagaatagcagaatggagatgcagagggagaacatgcctttatatcgatgcgggtttggctcaagagacggcgtgctccagaaagaggcttcaaatgggccttcgccaaggtgccacgatggtgtacgaggaaacagaaggtgcccacggaatgctatcaacgagtatatgattgaaggggatgggtatgcgagtgtgtgcgcgtcgagagaagggaaaatgacagggttaaagtccacagttcttttgccatgtggtactgaggctacagagaaggtcgtcgccgcaaggcaagtgatgcgggatcagcgagtccacaacgccgacaggacggcgtggaccagcgtacgaccacactcacatcaaaattacttgctggaagggaaagaacgtgtgcagctgtgtcgggttttgaggtatcgcgtcaattgataggccactgggccctttcgtggctgatttcgcatgtcagggtcacctatcaggatgaaccagaaactggctttcccgagagcgtttgatggtttatgtgtggtctctgaccgcggtatactcaccgctacatcctttttcatcacatttcccatatcttcgcatggcacaattcagggctttgtgttgggtggcatg

SEQ ID NO: 4264 - DNA, 703 bp, Nannochloropsis_gaditana
atgtagccccgggtacaaggatactgagcgctaagaggaagatgaagaaaagtgggagacgccgctggcaaaaaaaaacggttgacacaggcgtcgtggtgacgaagttatggagggcacaaaagacctttttccttgggcacggaagaattgttgtgtgttagttggctcaggaaacaagtacgcacgccgaagaaaatttgacccagtggggatctgggcgatgggatgcgacccctcgctgccgtgatgtgggttctgcaaccgcgcgcctttctgtagcctggtctcacattcctatcgtacaggtgctgtgcatgccctcctggtggcacaggacaagccatggcgtaatttatctcctcgttgtttccttgtttgcagcctcctcgttttcccctcctacctctcagcgttccgtcgcccttcgtaaacgtcccgccacgccgtgtgtgaaagaaggtacgcggctacacgctttccaattatttcaatggaaaatccgacaattgctgacggcaatgtgtgctcagagtcttccaaggacaagtcatagacaggctccataactgaaaattttcaaccacctccccacctcaatggtttcgcatccctttgcttcctctacacagcctttcaagcctttggtcgaccaaaaaattgcgtcgttacaagtgcacgattacaacagcgcaagttcatg

SEQ ID NO: 4265 - DNA, 703 bp, Nannochloropsis_gaditana
caccaggatcgagtcagacgatgtcgtggccgaaagaaaagctagtagagacggcgccgcagacaggaggtcttgatcctcgacgtccagtaggtctgggaggcatagagatgtgcgccccacagtaaaatgcgccgctacatgagccgctggagtgaccccaagggagagcaagtgcgtcaagccgaacaactgaagtgcaccagaggcgtaagctgccgagacacccccgacatagaagcgaggggatggaggccatagaggaggattgaataccaagaggttaacgtccactcccaaaatgtcctcagccttgctatatgactgcatcgcggttcttcagggaaaggaatgtgccttgttgactagaaggtgtagagctcccccagggggtggggaggttaaaggcccccgcttctgcgccccctgcatcaagttgccctctcgcgtgcccctcccttatacgcctgtacagtgcagagaagcatacaagtatgttaaaaatcgatcaggaatgtacgctggtgagaaggggcggtagacgagaatcacgcgcatctgaggacagatcaaatacgtcgttccaagttgtctgctggaaatgatcgatcttcgcccctccacacgattctttaagcttttgcaccaggcctcggctccatcttatctcaacgttttctgtacacacttcgcacatatgaaa

SEQ ID NO: 4266 - DNA, 703 bp, Nannochloropsis_gaditana
gcggtgcaacgggcattgggcgatcaggttagggtgaagcaagtgggctgacattttttgtgcaaggtcaatgcaaaggtgcaagagcagtcaaatatgcatgaaaatatcaagaggtgcccaaagattgaccggggcattccaaagcggcttaaagtggcatgtccttcttcacctccatcttgaagccagtatggcccctccagcccaacccctctgaggtccaaagcagtttccattccaatttcttgacggtatcgcaaaagaagtggcttgtgtggctattaaactttgtgtaacgcacctgaagcgccatttttgtaagcggctgaatcgagcgaagataaaaccaccgcgacagcagcggggaagtcgcgctcgcaggaagacaagcgttggggggttaaccaggctgctttccaacactaacacctgtgctacgtggtgaaccatgacggcgcgacaaataggaaatatggaaggcgagagacacttgggtgcaaagaatgcagccgtcgcgacagttcccgtgggttgtgtgcaatataaactagaagaaaaggtggcatatcttgcaactgataaatcttagcgacccgctcgctctagcccccgggccgctcagaacaggcacacctgcacatttcacacccgaagcatcccctacatccagaacaagcacacagtcatggcagacgggatg

SEQ ID NO: 4267 - DNA, 703 bp, Nannochloropsis_gaditana
gtgggagcaagcacgggcgtgcttggaacaagcgactgctgaacctcccgcgccacacccgtcctcaatggacgctccaaaaaacgcgcgacggggtgttgtgtacgcgcttcaagagatgggagaaacattgctgtcttcattgcgcaagcgattgggttggcgtctgtgcatcgacaagaaagcccgtctcgccatagtgggccatgggggaacaagcgcagcaccggacctactagaaagacaaattttgtcgcccttgagagaggcagcgtacaccgtggtaacgagtggggagagtgtgtcttctttagaactggaaggtgacgggggggctttattgttggccttggggatggaagtggaggaccgaatggccgccttccatggccatgaccccaccccccgtcaaaaccatttcaaacacttcgacaacgcaggcccaggctctcagccggaagagacaagggtttgggaagaccgttgtcgcgccgccctcatgcttgtggccaggaccccaggccttctttccctccattgctgcgcgctctctctccagcgcttggccgtctcctccccctcctccttggactgtgtactggcagcgctttctctgctcgagcctagctgggaagttgatgcaacattaatagagctgactgccaggccgtcattgggctgtggattacaaggatggaggatg

SEQ ID NO: 4268 - DNA, 703 bp, Nannochloropsis_gaditana
cctcgcgcaatgccatgttatgattcatcagcatgcgtttgaaacgttggcacaagtattgcgtttgtatctccttcttgtgcgccgaggggaaaagcagacggaggccgaccacatcgtgtcatccttgtgcagagatgtggctgatgtcctcagagaaaagtgcccaaggcacaccttggtaaatttagaatcattcatcaaaactttgagggaagaaggaggctatgacacggagctagacagtatttggcctcaaaatgaaatagaaatgggaacgtaaaatagacaggaaatcaagggaaggtttctcctcttgattaggtggcgacggcgagcatagccatgtcggctgcgtctgcttagcctcaggcatcttgaacacactttccaaaaaacaataaaaaacaatatccctctactatcacaagcataggcatcctacagaaaataactgtcagaccgttgaaacacaaaaatgtgagtctcatttcgttttcttgtcttaatgacttcgaagtatcttggtgcacagtttttacctcctacgcattggtaatcatgcctcaaaacattctgccacactaggcctaagcacccaaaagaacgtcgccggcaggccactggaggagaaggacccgtacatcgcacattaatatccgcaaacacctcccttggtcaacactttttgaaaaatccgatg

SEQ ID NO: 4269 - DNA, 703 bp, Nannochloropsis_gaditana
atggctttactgggaaaataaaaaggaggaatagatagtcctcagcaatgtaaccaagcgcgcgtgcttaagaaataggctcctagacccgattccctaagacgactatctgtgtcaagacgtataataccaattgagagaaatcagtaccattagaaacgcaaagcttgtctcactctttagctccgcggtcggggcggagtctggcccctcaatccgggttggtggcccatattcgaattccaaactcatgatcctgtcaaccaacctaaagacaattactccttgcacaaggagatgtgtactacatgcaatacattcgaagaggggggaaaatacaaggcacaatcggagatatcggccaggacaaatgtgggcgttgcaaacggtaaacgataatccgttgcgcattctaaggaggcaaaagcacgaattatgcaccaacgcctttctctcaccactcgggctcccttgtaaatttgaatggccttccaaatacaatcttgacgcataaagcttaccacgtgaatcatcccttttttttgtgctgaggccttaataaagtacctgaatttttctcgttcctctccggagcacgtgggtcgggggcttcgaatacaccccacacggctcgcgcgtcctgaattcccagggctcataaaggcttttacacgtcacaacacatagggaccacataagaatg

SEQ ID NO: 4270 - DNA, 703 bp, Nannochloropsis_gaditana
ttcaattgttgtagagggaaaaggacatgtcctgacctgggaaagggattggcaagcagtgcatgcgaggtccacgacatagtgatcttgaagatctggcctcctttgtcccattgccgcgcgttagtttctggtcttcccaatctcacacagcatttcaatatatttaatccagatgtcgtgttacactggcccggaggtggactcgcctttgcaagatgaccacaagccaaagcgacagcagagacggaccaggccggtgccccgtttgcctagcgctaatcccgtacatcagcctgttactgccaggcgctcagggggcattgggcagaactctatgacgacgtacatatgtaaatggacattggcgtggccgattctcctagtgacgtgttgtgcgatgtcaatatgccttcccagagggttggctgccgcggcggtaggctcttcatcctcctctgcttcctccatcatctctttacacgtcctcgaccgcataagaaatcagataggactcgcctgggcaccgcctccaaacaattacaacgctcatcatccgcagccatcgcagcaagacgccatgcaaccgcaagcgttcgaaggcagtcccgagcagattcaccaccttgaatggggggccgggggcgtcacttcacaagaattgcccgcttcgcccggcaatatcggtatgcgagaaggaatg

SEQ ID NO: 4271 - DNA, 703 bp, Nannochloropsis_gaditana
gagatggtggtgggcaacgccacaacgctgacgtctcccttcgtatcgcagtactcagacgtgacgttggtggagagcagtgagagcatcacgtggcgaacggggaatgccagcctctctgccgatgcggttgcgattgacagcagcgagaccctggagatggtggtgggcaacgccacaacgctgacgtctcccttcgtatcgcagtactcggacgtgacgttggtggagagcagtgagagcatcacgtggcgagcgtcaaatgccagtctttcatccaccattcttgacatccgcaatcaaaacactaccattatggcctacaatgagatagagatcgtgtcaccatcgatcgatatggtgggtgtcgtcacactgggaaacgagactacgactgggcagcttgtcatactgaacggagttcgatctgatttgatggagacaataacagcggatggcaccacaggagagctttcatctggtacgtgtcacgtcattcccatgctatatatgggtgaatactgcgatgcgatctctgtcgttgagagcgacgagaaggtggtgtctcacgcgcagcatttcaaacgatgcctcagtcagcatggttacaggcgatctggtggccacgcgcctgcttcccgggacggctgcgaacgggagtatcacagcgaacaatctcgtgttggaatatgacagcggattg

SEQ ID NO: 4272 - DNA, 703 bp, Nannochloropsis_gaditana; identical to SEQ ID NO: 37

SEQ ID NO: 4273 - DNA, 703 bp, Nannochloropsis_gaditana
tcgctcgtctcttccttgacaggcctccctagtaagctgaggcggggcacaacaccgctcctgatgcctacatttacctccacacgtcaaaattttgtgcaattgaacgtaaacgcgcgacacttcaacaaagttggggttatatttttgaccttcaagcccccgacgccaccctgtaaccttctgatcgctgagacggaacgctctcccgtatcctgctcgctcctcaaaaaagccgtacgcagtcagcaataataatcagcatttcacgttggcatggactccttcatgcttctaaatcgtttgtcatttccgcaatgacgttgtggacgcatttactggcgtcatctgggcaagtcccagcaatgtcgtcggcattgataggaggtcaactattccaagagaggtaacgcgaggaaaaagaacaaataaatgatgtgcagcccgcagcctgacgtactacagtagtacttctatttgactcacaacttccaaggctccgcttggcgctagaaaatgggttgtcatcacatgttcttcacaggcggcatgtttcccggtctcgagcgttgtctttgggagtccttgattcccttcccttgcatcaagcatatactgagaactccacgacatgcatttgtctttcaaaaagacacaaacttgcacaggattttgagcacaggattgaattggagtcaacatg

SEQ ID NO: 4274 - DNA, 703 bp, Nannochloropsis_gaditana
tggagtaccgcaactgtccacatgcacagcatgtcccttataccgccaagtcttttccttcggcatgtcttctggcttcgtcagttgcatgttcccgggcaagaaagtcatttggttgcgccaggcggggaggtttgcgtatgaggtagccatggtaaaatgtcaatccaccaatacccagtcgctgtctgttatggcatgtgtccacgcgggaatgtccatttccagagggggaaaggaacaaaggtgagtctgagacataaaagtcacgtccaatttatcatcaacttaaccagcgagaggggcgagaagactttccctcgcccggctccgcgctcgtatcctacggtgggaaaagcagtaatttggagtgccgagaagtttgattgcagccatttgtcctcggattcagtgtccatcgccattatttttggtgttgttctggtgtatctgggtggtgatagatgtttgttcgtccttaaaaatgtaaagaaggcggttgaattctcacgttaccatggccttcctcttgtctatactgtcttgtggacatttgattgccatttcccccaaatgaacaacgttcccaacgtacttgcgcaatcacatgtattttacagttagaacggtatgcagcggtttatcgcgttgcgaaaattggcagcgggggggttccttacacctgtcttgtcgccgcatcatg

SEQ ID NO: 4275 - DNA, 703 bp, Nannochloropsis_gaditana
atcgacgctctggagatcgaaatgcttcagttgcagcgctgcttcaaggccatacgaatgcgcgaaacccccggtgggcaagtttgaatccagtaattgccagattacccacgagacagtggaaggggcataggattccatggggtgctcgcaggcatacaacgcttacacaccataagttctattcccgggggtgcatgttgctgcgacaaatttctcgatgcagtactttctcaaatgcaaacatgcctgtgtacgaaagatttgttgtacaaagtacagtcaaaattagaagcagggtgacgggtttggacgtcagcatcgcacgattgcaacgcctcaaaagcacacaagctgcagaaaatgtggacataaacatgaactctcaaaaatccatgatgccttcgggatgtcaatttttgtgcgccgtgtacggtttcttgatgtacatgcgtgcaaccaactggaccagaattgacatcaacttaatcgcggtttggctgtcgccactctacaggggtagaaaaccccttatgcggcacttcttctctttgagcccagtgcgtggccaaaagaatcatcttgatctcaacaacacctacgcatgtcatctttcctcctcccaccggtcaaagcagcgcaaggtgcatttttctttggagccacacgccgttcttcctgcctcgtcgagggcttctcacgc

SEQ ID NO: 4276 - DNA, 703 bp, Nannochloropsis_gaditana
tgcccgtcctccgtctcacctcctctccctcaagaaagccgagtgttgtgagagtaaatacagagactgtggtgcctgtaagcgcggcatttatgtgcagtagaattataaagcgagaaaagaaaattaactaatggtttccaagcgggacggctcctataatgcgcctgaggctttgcctgagggagagaaggagtgacgcatattgaaggcttcgacacgcctcttctcttttattgtatccatccccaccacctaaaggacggctaaagcgcctgccgtgactcgagctcgtcctaacgtcaacagaaccacacatttcacgagtctctgcccaagcgggcgtggtgcgggacatgcggggagacgctaccacgtgctgttacctgagaggcctccccgacaatttgcagggggcgggcgagctttttggcttttgctgcctcgcctttttccttgtcgcctctaacctgggtttttccccgagcatgcctctgcccgaattcccatcatcctcgacttacattgaagcgcctgcccaccgggtgcactcaaagtagtgaacttgtgcgaccacggaaccagtacttttcttatctccctcactgacttgcggaattctgttgccggcaacgatacacactagaataacagatagcttcttcgaaattcaaccggcaagatatcccacgcaattggtatg

SEQ ID NO: 4277 - DNA, 703 bp, Nannochloropsis_gaditana
cactgcacggtcgtcttgctttgtagattatggccttggcgtagctctcaacctgtttttcctcaccgatgacaaagactacacttcacagccggcaggtgtcccgtctttacggtcgcacagggggttttaagcgtgattcgagggcagaagagacgagatcgccgctgcctcgctaaattttcacgtttttactgcgacgcccactatgctccctcgagcccgtcaagctagcatcgccctgaccttgctcgtaggggtaacaatcccattcagcgctctcacagagtatgacgggattcatttgggaaaaggtctcctcaaggaggtgactcaggccccctgtgttcggctttttagctcgcaaggcaccgtaggctgccgaactcggagtcgtgagggagcaactgcccctttatactacctcagcggatttggggaggatgaccaacacgagtatatgaatcttgaggagggggtcgctgtggttatgcccgcaagcatgctaaattctaccgtgctcgagtttttgaaagctcagtccccagcacgcacccgaggagtcatcgtactagaagaatccaaagatatggccgcagatttcgagcgagactccgtttctccggatgtttccacgccacaaggcgatggtacacccagtgcagcctttaccgttggaccagatcacgcctggaacccccgg

SEQ ID NO: 4278 - DNA, 703 bp, Nannochloropsis_gaditana
cagcggatttggggaggatgaccaacacgagtatatgaatcttgaggagggggtcgctgtggttatgcccgcaagcatgctaaattctaccgtgctcgagtttttgaaagctcagtccccagcacgcacccgaggagtcatcgtactagaagaatccaaagatatggccgcagatttcgagcgagactccgtttctccggatgtttccacgccacaaggcgatggtacacccagtgcagcctttaccgttggaccagatcacgcctggaacccccggggaagcgggctgctcaatcaaaagcacgacttccccgtcgtcttggcgagcgttgatggcgatagcacaggggttggggccgctcaggtcaaagcatgggcgcaacataacggtggattaggtcgtgctggaccactgccccgttacaaagccaagttcgacttctacttcggccctgactccccgtcgactcgggcggaatcagatttgacgtcggccgactgtttgtcctggagggatgtggcaggcaaccctgccccccagtgcctgcctataggggggcaaagcgtctggggaacgttcggtgggcggacgggcctgcagacgaagccaagtgtgcttcttacaacagccatggacggcctgtctttctttcatgagaggacccctgcggcgaacgaggcagtggcctccatcctcaccctc

SEQ ID NO: 4279 - DNA, 703 bp, Nannochloropsis_gaditana
gtcgtgctggaccactgccccgttacaaagccaagttcgacttctacttcggccctgactccccgtcgactcgggcggaatcagatttgacgtcggccgactgtttgtcctggagggatgtggcaggcaaccctgccccccagtgcctgcctataggggggcaaagcgtctggggaacgttcggtgggcggacgggcctgcagacgaagccaagtgtgcttcttacaacagccatggacggcctgtctttctttcatgagaggacccctgcggcgaacgaggcagtggcctccatcctcaccctcctcgcggctacaagtgcccttaaaaatgcttcacgcgctggagccttggacctggatgcggcaccctataacctggccgtcgccttcttccaagccgacgaatggggctttgcggggtcgcgccgcttcgcgcgggatatcagccctgggggtgtcgactgcacggccacggttcccgacaacagctcgcgggacgggtccggcgcctgtgtggggccggacggcgtctacccgtccatggccttcaaagacctggcggagaagggtttcgtccacgtgctggctgtcgatcaagtgggggtgctgggcaccggcgggcaagcaggctcgctccctctaaccgccctttacgacaagaccccgccgacggccgtactggacgccatcgacagggccgc

SEQ ID NO: 4280 - DNA, 703 bp, Nannochloropsis_gaditana
tgttggccccagcaatcctagctcgcccatctcggtcataatcttcctgtcgaactcctcgtgacggtttgcgtgcaagatgcggggttgcaggctctgttgacagtaggcacgggccatgtcctgaatcatgccttcctcttctgtcagttgagctcgtaagagcaaagggtcctgccaatcgtagcgctgcttatctgtcgaggcattcacggtcggtgggtgctcaggaaggtcaacaggcacagtgccaaaggctcgtgtgaaacctgggaggggacggaggcagacgggtaggatgcgccgcagcatgttccttgcggctttgatagagtgctgactcgcgagatgtacgtagcactgagcttgaagaatgaaatctgtgtggagcaatgtggtgtgtcgtgggaatgtgcctttcaattcgcccgcccagccttcctccggaacactcgaggctcaagttgctcgctgacagacgtcaccgtgcccctggcgagggagctctctaccatagccgccatcacggacaaacattgttacgacgggcagctttacccctcgtagaaatttgtcctcaagtcttttcagccttgatatttgggctttctatcatatcactcagtgacaggcccagctcaagaagccagcaacccggagccccggtctgtcagaccgggtcgatccctctgccttttccatg

SEQ ID NO: 4281 - DNA, 703 bp, Nannochloropsis_gaditana
tttttatctgtagatgtaagtgtacatttcgcaagcctccttcatacaatgtaaaccaaagaaacgcgtgaccacgcccgtcgaaacgagggatgccctctgcctgtcgtatgggccgtcccgctagcacaggctgcggtccagcgagcaagatgaagaggcgatcaaagcggacgcgctgccccactctcgagtgaaatggacatgtcctggccttggtccttgtggtcgttttcccctccaggacttcttgagtgcagaatgcgtgtgtagttgtattctggaagttcatgaacacggcaccgagccagtttgtcatgtcagttgtcatgtgccgtgattagcccgaaagcagtggaggcgttgccaagatacctcttcactctggcggcgcgatgcacgggcacatgtagccgggtccgaagttttgcctctacgaaacatattatctctctcttaaagtgtcgagaagttcatctcaatctcgaataaatggcgtctgtaatgcgaaagctaggagatggttggaaatcgaggcgactgcgccgttcaagagcagagccatggtcccggtccccgcccgcttggtgtatttgtcctcatgtgttgacgaggcccaccatgaagctctcttattccttcttgtgctataaacttgtttttacaggcatccttcctcctcatcttcaccgtttaagccatg

SEQ ID NO: 4282 - DNA, 703 bp, Nannochloropsis_gaditana
agaggagggagaaagtgttcgggccgcccgcggggatcaacccgtagtggaggccctcttgaggcaccccttcacccattccgtccctcccgtacctcaaattcgtcgtcttcctcaagaacatccagcaatggagccgcgtcatccttggcagcaaccttaggctcagtggttgccatagttgcggaaaagggaatcgcgtcgctttgtttgaaggagagggaaaagaagtacgaagtcagtctgggagatggcactcgacgagcccactctgatatggccgtacacaagtgaagtataggaacacgttgcaattgattgccgacgatgaatcgttttgagtgcggggaatgcggtgcttggaagtaggggtgtggccgggcctggtttagagttcgtcgctccctgactgaagccgacgtggagacagcctcaggccgtccacagccaagtccttccatttacaatcatgccacactgcggcgcatgcaacgggaagtttgactcaattctgagggttggaacgggaaaccaggcaggccgaagcgtccatgcgtttttgggtctcctggagtactacttcccaaaaatgacctcttcctcctcagtgaataatcagccctctctctctcatccatcccaccgacatcaaatttttctccaggttttcccctcctcggcacatcctgcctcaataattatg

SEQ ID NO: 4283 - DNA, 703 bp, Nannochloropsis_gaditana
acgcacgtgtcgtgtgtgtattccaggaagtttcgtcgggttatactaggcccagggggggttcccctcgcccgactggccagcggacagcaaagggcaacacgtagccacgcctgcaacgtgaccacgcccatgcttcgatcacgcactgacccaattacacgcgcttcataaacaccggacaggttgaccaggggacaggcagcaactgcctgtaaaaggggtgcgcttggctttacaagtgcttcttccccctcgggttctgggtgcccctgtttgggtgaaacgagcgagagtcaacaagtgcgagcaatgatttggcttgtcaccactcctgtttaagtcaactcgtctgttagatatctgctgtatgtacctacatatctgatcgccacacagcggaaatcgaacgagacagttgtcgcacgcgagttacgttggggtgagatccttgatacattctgtggtacctcatagggtgtgaaacccgcgatttggactacgtttttgaaacctgctggctttaccgcctcctcttgtgtttcggatacctgtaaactgatatccggtagcgcattggtcgggacgacaagagtcgagttctgtatctcctgcgctcttcgacaatctgctcccccaagcccctcttcgcgtctagtcttctagcccaagaacaaaaatatcaacaaaaccggaagaaatg

SEQ ID NO: 4284 - DNA, 703 bp, Nannochloropsis_gaditana
tgcgataaggggagactgtaacctcgcaaacacataacaaagccaaaaacatgacttgtacggtcctgtccgcaaaatggggcttcaaatccattgaacagcgtgtttagctagcaccattctgtcattttcctcccaacctttgcaaaaacatctttcaccaaggtggacggataaaaaacggaatgagccggcagaccgccaggacgacagttcaatgaggggggccaacaaatattcacacatacccagaccccgtcgtctacttagtaatgtatgataccactaggtctacgtgatcacttgagacggccgtgtgcaatggttgcaccaggtgtgcgtgcaggggggcggtcaagaaaagtaagcgtgctcgcgtacggtatcagaggtcatcgtctgaaaggccgccccaagccctttcaaacgcatcaatgcactgccctccctcacattcccgacctcacaccccacaattcatccccaggcaatgctgcatgtagcctctcctttcctccgtcgtcgtgccttggcctgtttttttccgtcttcgttgccccctccttcgtcctggcagggagatcgcgccatcctgtcttccattggctccaccctccccaaatcctttgttggcgatctgagaagaagactactgcgtcggacctaccacggcacggtcccgcgggcgaaagacgtgaccatg

SEQ ID NO: 4285 - DNA, 703 bp, Nannochloropsis_gaditana
accgtctcctccctcatgggcgcctccgcctttgtggcccccgcccccaagttcagccgcacccgcggtgttgcccgcatgtccttcgaggacgaggccggcgtgaccgcccccctgggctactgggtgagtctcatgaaacaggtttcgtaatgtgcatgtgacgctcaagccagtccacccaccctctcctccgtaaatctcacaggacccgcttggcttctccgccgatggtgatgtcgagaaattcaaccgttaccgcgccatcgagatcaagcacggccgaggtaagagatggttaggtgcatggtcgagggtgacgtgacagcgaagaactgtccctgctgatctcgagaggatacctgaagtagaattcggatccaagcatgaactgacttcacctcacccatgtcaccatcatatctgtccggcagtggccatgcttgccatgctccacaccctggtgaccggcctcggcgtgaagctccccggccttgtggctgccggtgacggcatccccgcctccatgcccgcgggcatcaacgccatcacctccggcgcttgggccgcacagggatgggcgcaggtgctcctcttctgctccgccctcgaggtcctggccccccagaaggaggacaagatccccggggatgtgcagcccgacacctctgccttcgccaagctcgaggacaagaccgaggag

SEQ ID NO: 4286 - DNA, 703 bp, Nannochloropsis_gaditana
atccaataaaacttctgaataaaacgcaaataggagacaaaaaatatctttggatcaagctatcagtctcgcttaggcatttaactgtatacaatgtagctttgattcgaccaataggggctatgtacccgaatttcaaacatttaaacgatcgctttcgaaatcaaacggtcgacacgccatcccttgccatccttcaaatgcttctcctcccctttctcctccgtttcctcgcatgctcacccatgtccatcgtgtatctatgattatattatttcacattctatattgatgcaatctgatctgctccatcgtacaatcgcactgtgctcgcgcttcagtcatttgtgacacgtttctaccctcgttagggcgtactcgctcctcttgcatggcgtcgcctcaggactgcttgaaaatagaaagcaatttacgctatacttgttgtccttgcattttgtcacacatgatcgattttattccctcggcatcatcgaatttaatacgtacgggcacaccttccacagaggctgtttaggcattgcacgtcctccttcctgttgagtgtagcacgtgcgcttttgtgtcctcccatagcacacatctaagcctatatctgtctaatttcggactgtgcagagaagtgcgcgtgatactgaagattgactatccagaaacttcgaactcttgagaggtagtcatg

SEQ ID NO: 4287 - DNA, 703 bp, Nannochloropsis_gaditana
ccactgtcgactgcgagagctaccattcgaagggccccaacaccccgcttctgtcgtgtttctgctgcccgtacgggctccttcgcctctttttatgcttttccccgctgtacaatgggtgccgtggtgcgtgtcctctgtgggagggcagtgggtgcttccgcgcgtcattttcccaaggcctcatgcttgaagaacaacaggtaacggtcctcgccaagaaggccgcgaccggcccactgcccgggtgctgcacacatcccgtaattcagtacgccctccctgtcttttgaacggctctaggtcgcagcttaggagatacaggggtgacaccttctttttgaggtggtcttgtagagatttggtgtggctattggacaggtaaagctccgttctgctctgttagccagctctcccctatgcgtcccttgaccccagtccacaaatctaagaggtagctagcggaacaaaaacttctctttcaagacctcacgacgtatttgattcttgaatttcgtgaggaaagaatgtgcgcgtggacgtttatatcggcgtcgaaggaggatcgcgatcgaagatggcttctcccaaaatggactatttcccaacctctcatatacctcgtcgacgccgttagaaataacagttccatcgtacgcttctttccgacatcccatcattccttatacttgtccttcagatg

SEQ ID NO: 4288 - DNA, 703 bp, Nannochloropsis_gaditana
tagcagcggggaagcggcttgttcaaaccgccccctccccggcgacattggcgctgcgtgctcatcgatttcgggatggctgtccgactgccggaaagcaaaagcgggaaaacaatcgtgctcacccagcaacgctgtcgggggaaactaggttacgtgtctccggagtcctactacgagcagcccatcaacggacaatccacagacgtttggtctctgggagtgattctatacatattcctgaccgggcaccctctctaccgttacccgtgggatccggccttcaaggcgttggcggcgggggaagctcggcaagtgcttgcgcattatcgggaggaaatgaagctccgcttgcctgaaacggcggaggacttaatttgtgcgatgttgcatcccgatcctaaaaaaaggccgactctgtcggagttgcggggggcaccttgggtcagggaggtccaggagaggacgcgacgggcgagggaagggagggaggaaacgggatgggagggaaagttcgtggaagtgggggaggaataggcaaggaacgggaggcggcgaaagggaaggaaaggagtaaagggaaggaaaggggaaacaatgtataaaggacggttggcttagatagataggcagatgtgggtattacataggtaggtaaaacgtcgatattcaccagggacatgtcgtgtcagggtttcacaac

SEQ ID NO: 4289 - DNA, 703 bp, Nannochloropsis_gaditana
agagaggaggagggggaggagaggaaggaggaggaggaggaggaggaggaggaggaggaaggcgaaggtacggtgccgttcgaggagagggagacccctttattggaggacggagaggccttcctggcccgccggggggatgtcctgcagggcgcccccgtgggcaccgagggcagggaggtcagagcccagcgccgagggcgaccgcggagggcagagccaggcccggccgtcgtgccagtcccaggcgctcccccctcgtcgtcctcctctaccttcccgcccccgccagcgtcctccgcacgccccagcgggtcctcttccttcgtgggcggtgtcttccgcgccgtcgcccccgcggtcccgcgcgtcgattgcgtcaaggtctacaagggggagatcaagttcgcgtcgggctcgggtgtcatctactccccggagggttacttgatgaccaattcccttctggttcggaacgctctagagctgaaagtgacgctggcagacgggcgcgaatacccggcggagatcaagggcgtggacgaggttttggacgtggccgtgctcaagatcatcccacccatcccgccggccccggcgtcttcccctccctcccttcctaccttccagtacgcgccgatcggggactcggaatccctgcaagtaggggattgggtcctctccgtcggctccccccggtctc

SEQ ID NO: 4290 - DNA, 703 bp, Nannochloropsis_gaditana
cattcgagcttaagcaggactttcactcgtttgactaggatttacccaccaggtctagtttgatgattgaagaagccgcatcgtatgtagcatgcccaatccgtttggttgtttttgtgcgtgatgagtacgtgagcaaacccctaccatagcacaataagaaatcgggctttacataccaggtttatagaagttgtggacaattgagctgtctccaagagtttatcgcgagaggtgggaagtagaaattagaacgtcgcgaggaaaaaatgcaaaatgccctcagaccctctagcatgtggtaacttacgcgccggcgagtaaagagaggtaagcaataggaaatagcgagatatatctgacggctttacccagacgggagactggcggcatagtgtgaaagagacctagtgtttaagtgggaggaggttaatacggaagtcaatcgtggcgttgtgtcttggttcttcagcagtgaaagcagccccttcaagctgtcacgtaatcagtgcactactgtaagtgggacaacttggacggaattctacaaagtccttcatgaagactcctcctcccttccaggctgactgactgctgcacatctcgtcgctgcgacgaacgagggctcgtgctgttcagtataccctggtatattgttcaattgtataaccgtacatcacccacaccactgtcactaggcatg

SEQ ID NO: 4291 - DNA, 703 bp, Nannochloropsis_gaditana
ctgtagcagataacttcctccacattcgtgtatctgcgatctcttgtgctcgtgacacaaagtcaggttcacacagtagaaaaacgcttagcatcgcgtcacccacgtaacaaaaatctatcttctctgcaggagtacattacgcggtactcgctggtcgtgcaatgcatgtcaaacacacaacctgatcatattattcgacagggatccatttatcgccctttttgatattgggcattttttttgtcacaagcttatcgatgaacagcatggagtcgtaaaaatgtaaacctcgaatgttttgcgtcaggtcgtctacttttagtttttctgcgtcttcggaatgccatgcgttgatggtgtcaatgagcgacttagatctctcgatgaacgtggttggcttatgatacccaccgccataccccttccaatagcttgtgtgcagatcctccaccagatacaccccaccatctcggacgtgccaaaacatttcgtcgaaggtaaccgtctgttgatgcattttatgtcctccatcgtcgatgaagatgtccactggggtaggaacttccttcttgaagatgctccagaactctggattttcttgatccccaatagaaatcttcacgttctcagtctcaaactgcttcgtagctgagtttacatctacgccgtaatatctcaatttgtctttgccaaaataggc

SEQ ID NO: 4292 - DNA, 703 bp, Nannochloropsis_gaditana
gtatgtagaacgaatgattaacgaatgattactctaccaagtacgtgtaacttgtatgatgcttgtagtcgttataggcgacgagaggagacaactcatccccttgacaagcagatggctggtacgcgtgtatcaagaaagaaaagatcgattaaggcttgccctcgtcctttaatatactttgattattgcggaattagtacataaattcaaggtaaagcagggcttccaggcgaggctaagctcaacttgtcaccacggttcgagatgcaccaaaatcagcgactcgaccacgtaccactagtagtttgaggcccgcacagctcttcgaagaggacagatatctgaatgcccgtcttttggaggaaaagagacgaactaccagaccatatttcattttttataatgtacagcgatgcgcaggacatcctggaacggcgttacgaccatttgggtgttcctggtcgcaggcacaggtgcgcaagccttcttcactgtctcttcaacacggcctcattcactcctgtcgagagccgcatgtgatctaaatcagaataaggactcccttaagcaagcttcatttccgtctcttcaatctcttcccggtctgggcctcttagcacttaatgtactggccccttctttgattcccccgtccgcccaggccctgcctcagaaggcgcctgaaaccaatgcacaaatg

SEQ ID NO: 4293 - DNA, 703 bp, Nannochloropsis_gaditana
ggtgaagggtcgcaatgcgatgctcgatctgacgcatcctggtcgactaccgatcccgtcatgcacagaagcttgccgccgtggtgaacggaggctttatctatacgtcgacggacgcgggcttcaactggacggaacaaacgaacgctggtattcgtgactggtcatcgatcgcgtcctcatcgaatggcacggtacgtgtttggatggaggccattacgcaagaggcacgatgctcctgtcctcgatggcggtcccatcatgtgtgcatgtcaggtgaagggtcgccatgtgatactcgatctgatgcatcctggtcgactacccatcccaccatgcacagaaccttgccgccgtggtgaatggaggctccatctggacgtcgaccgacgcgggcgtcacctggacggagcaaatgaacactggttctcgtagctgggtatcaatcgcgtcctcgtcggatggcacggtaggtatttggatggaggccattacgcagggggctcgatgctcatgtcctcgatggtggtcgcatcgtgcgtgcatgtctggtgaagggtcgcaatgcgatgctcgatctgacgcatcctggtcgactacccatcccatcatgtacagaaccttgctgccgtagtctttagaggcttcatctatacgtcgaccgacgcgggcgttacctggacggagcaaatgaacgctggtt

SEQ ID NO: 4294 - DNA, 703 bp, Nannochloropsis_gaditana
cacttcaaaacgacagagcgatccttcacccgtctccagcaacatcagggtggggggaggttagcttgtacagggacatgagccgccacacatgtcttggctggatcaaatcttctcaaaatgcaaggggagatactgaaaagaacggaattcaggtaaattgattccagagtaaaaaaatgatttctttgcttaccggaaaactaacaaacgcacaaaggctaatggaacataatacgtctgcttttggaaacattatcataattggacctcattgtgttcgaataacgtaacatcgcactcgacaggaaagttcattatgacagatcctatcaatatgtgcatgacttacgaacagcgtacgctagatgccttgacgacgccttttattctccctgtaacgattattacgggatacctcggcagcggcaaaacaacccttctacgcaagttgctgacacagaaaaaaaaccttagaatagcggcgatggtcaatgatttgggtgatttcaaccacgacgtgcaacttttacaactggagaaaacggtggccaactcctcctcaccgagtaaccacggtttctcccaagccgccagactctctccagataagagtaacgccccctccgaccgcattatggacttacatggcagttgtctgtgctgttcacacctacagcaagaaatgagacagaatatttgg

SEQ ID NO: 4295 - DNA, 703 bp, Nannochloropsis_gaditana
ccaaaatttggtccgtgatgaggtgacaacctcgaccttttgcttgcactgtgagacttttttgcagccacgctgtttcacccttgcaaatacctgttgtcattgttcttcaagaggaaaccgataagctgttgaggaagagggaggagggtttaaaatcaataaaacactctttcgcgcacagtttttctctcgtctttaggcagtcacttctgctgttggcaagtgcttgggatgggcgacaaaaaatgtacacgatcatccccaaatgggatgcgcatggtgggaatacatccaaataaaccgttcataacctcccgcccccccaggcaatgaatgcagcctatcccgcggaatttgtgacccctcctccgcgttgaacgcgtcggtagcgtgttcacatctcatttctattgaacgaattggtaaaaggactaagaacatatttaattgtatttgtggaggatttttgacaagagggcacattgttttctgtcggacccgagacgggcctcggacgggcccgggacgcttgatagagttgaatggatactaaagaagggtttatacatatacatatacatatacatatattgaaaggaacagacacgatctccctgcagagagggcgagcatgtcaagtttcgtttgcttttatgtctctcgtgtgcttaatcaacagaccattttgccttctcgcacc

SEQ ID NO: 4296 - DNA, 703 bp, Nannochloropsis_gaditana
tcgagacccgaaaactgtacactttctctctgcccaaagcgcccccctttaccgacccgaatcaccttacctcgtcgtcgtcatcatcttcatcgtcgtcgttctcgttgtcctcatcctcctcctcgccctccacatagtcctcatcctgtcgttgaagattgaagttatttattgcggagggacttcacatgcatgctttgcagcctaagccgcggagtagggagtaacacacttcacgacccctatcccattggctttgacggtggaaattttgcgtgttgtgcggatcgcaacctcacgggagagaacgctcacttacatcctcgctgtcctcgtcatcgtcctccacgtctaccacgtttttagggacctcctctgaattactctgccaatgaagtatgaatggtgataaagtgacgtgagccacgagtagcgtcgcaatcctttgcgagttttgactggagttaacgtatatcactaggcctccgaattcattatgcaggcggcgtctcccacactcaccatgcttagctttaaatgctgtagataaattctagttggggccgtgaagcgtgcaaataacctgtacgctgtaaaatgggcgggtctttatccattactgggcaagagtgtcaaagcctgggtgtgggcggggtgaatataatccatcgccccgcccgatcgcctcgcttaagggggc

SEQ ID NO: 4297 - DNA, 703 bp, Nannochloropsis_gaditana
tttcctcccacaatgccgacacgttctcctttgttgattttccaattgacaccgcttaccagctgtgtggcgcctgccgcaacggcgatgccatcaagaaaaagctcagcaccctgcgtgtccccataattaggagtcggcacattcgttgtcacagccctcgtttgtgtactcgctttcgaatcagccagtgagatgtgtgaaatccgccacgcctgctctgggtcgcacgagactcgcatgaaggcatgtacagaagtagtggctgccaaagaaaggaggagggcaagcctatgtattctgttcaccatgactctgtctatggggctgtaaatgttgggtgataagactgacgtcgtgactacgtggcggtgatcttgagcagagctcgtgctcttttctactcagggccgtaaggagccaggcccggacaagctggtgcatggccaagcaagagggagcagctcctaatgctaacaagcggagtggcaaagtgtcatgcgggaaaagtatgaagagagccggagactggaagcgcgcaaggcatgtggccggcggcacgggacagccgcgaggcagtcagggcgaggtcacgcggactttgacatcggactgcagcgccactcctctgcttaacgttttctatgcttcacgtcacaggcatctttttaactttaatgtattaacattttctgataacatg

SEQ ID NO: 4298 - DNA, 703 bp, Nannochloropsis_gaditana
ctggctggaagagaatgatgtccatctgaagcggattttaagcctgctgttgaatgcaatgcaacaactcgacttttttgatgacaaggtccgcattagggagggtcagaacacacgcgcagtcaataaattttggtgtgatcattttgactcaataatttttggtctcacaggatccgcttgccatttccttgaagaccttatcttccttctacgtggcatgtcgcgctgaaggagggagagggcgcaatttttgcgctgatttcgcgaattctagaatattccccgtcgccagagatatctgcatatcttacaaaactgttttctttcaaccaagcgggcagcccctcacacatactcataggaatctttacaacgatgaagctgacagtgagactttttgtttattctttgcgtttttatcggaagtgctacgatctagctcgtccgataaaaatacatttctagatagcaaaagaggtaggccaggaaggagcaatgcaagaagtatgactgacgcaagtagagatacattcgcagcctatgtgcggcttctgctgagtgttccacttttttcacgtcgagctaatattgatcattccccgtatctggaggcacttgtctctgcttggggcatcgtagacttgtcgacccttcccccaaatcctttccctgcggcgccgagcattgtcggggtggtttc

SEQ ID NO: 4299 - DNA, 703 bp, Nannochloropsis_gaditana
tgggcatgttcggctcgtgggctgaatgtggcccggactcgaaatgaaacgcgttgtcgccatagaggggccatcgctgaggccttctcgtgagggcggtgcatttgagaacttggctttggcagggcgcttgcccgcggaaagatcgacaccgcgttctagaacgcacgttgtctgtaacaagtgccattatcatgaaggtcttagcatccttgacttttgatttgacactggggggttctaaacgtagcttcatcgatccgaacaccccttctcacttggagttcctcttcaacttccatacttgcttcccaccagctttgccgggacaagacgcagccatgctctccactttttcatcaaatttgaagcggggtgcgtcgtagtgggatattagggccctcttacggttttgtaaacaaattttatcttttcctacgctcccttttttcgcgttgagggagaatgcttccatctgctagtcatccctgatgggtgactgcacttgcccaatgtgcattttgaatcagtatactgcttctgctgaaaagtgtgttgtgttatgggtcaatgatttgaaagatcctcgttcaagtccattaaatagaatacatccggtttacctccgcatattttcttaccagctgccatgcatccgacaatgatgcacatggtacgtgtaaatttggcgcgtgcaggcatg

SEQ ID NO: 4300 - DNA, 703 bp, Nannochloropsis_gaditana
gtagataggttgcgggtacacgataaaatatggcacaattgatcgaggaaatccacaaagatctgctgacggggatgaaaaataaagatatgaaataattaagagatgaagccaataggacgggacgagacgagatgacctctgtggcgaggcgggcaacaacacatcgaacatgtgcgacgaggagggtaaggtcaggaccacgaggtggaggcagacccgtatgcaccgttaagtcactgaagtgctggattttttttcctgcatgacttcgaggcgtgaagtagcgttcgcgggaaatgggtcgatagcataaaacgaagcggcacaattgggcacaatcggtcataacttgagcgacctaaaggaggcagcatttgtgctggttgcgctagcccggctgagcgagcaagcctttcctgacgccaagccgactcctcgcccggagacatgaatcaccgctcgagaacctgcaacggggaccttgagtgccgtactgcatcacactgtggtggcgtacaatttaatggggctatttaaaggacttcaggagttagtcggcgtcggcatggacgcagtgtgacacacggggacatggcacacctctcatcgcttgctagcggcagcccagacatctaaatctcatccacgaacactttcccaatcatgaacacactcttagagcagcctctggtggaatatg

SEQ ID NO: 4301 - DNA, 703 bp, Nannochloropsis_gaditana
aaagtgaaaggattcatacaggtgatcgaaaaaggttgtggtgtgcctgttcctttgcaaaggattgaatgaggaaggagtttccccctccttctcaacccatcccgtttttcgctgcggcaatatgaacaagaccacgcacccaggcagctgtaatacaatcagatcctctgagagaatgccacgcttgtagagagaaaaggtcgcgtacggccattacgaggccccgaaacccggtgaaagaaagggacgaaatttggagcgaccatccgcgcaggcgagggaggcggggaaggaagcgaggcgcgggcgagcgagccgttacgtcgcgtgacgtcacgcgcgtgcgccccgactggcacacttcaaagcacgtgagggaggcggggggcacgatgacccaagccaagattgcttctttcttcgaaatgtgcaagactttgtgtggatcatcttttcccttgctatagctaagggcagtgttcaaaaaaatattttcacgctgttgtcgtggagaccatgtcgctgtagcttggcggctccacgactccttcttcctcgcacgcgcgataggaggtgcagtacggacaagcggctttgcttatgtttgtgcacatatggatttctcaaccatgcaaaactcgtacgttacaggaattgtcttttttgcctataactttcggacgactcaccgcttaaaatg

SEQ ID NO: 4302 - DNA, 703 bp, Nannochloropsis_gaditana
acatcgcctttattgcagcccaccaatgtttccaacccgctacagacagcggaggctaccgccagcggcgggaggttgacagcttctgcggcatccccatctggcgggataaagcccccgtgtatggccagcgaatattttccatgactcctttcattgtttactgcgcaactctggtcaaaagcaggttttgagcttaccagaagctggagaaggatttcaagatcgatgcttccttcctcgacgagtgccaccagtcccgtcactgccagctcttgttgcagcgcgtcactcagcctcgcgcggatgaggagcttctggcatcggcgctgacaagcctccttatcctttttcatgttgtcatccaggctctgtgatcatggggtggaggcacactctgtgagatgctgttgggctatgcccggggcagggcactcgccagacatgggattgaggcggcgacggacgtgcccgctcccgccgccgccggatcgtgtctaagctgtctgcatcgtgcgagaaccagaggctgacatgcatggtactattaactcaaagcacgctgcggcaagtcagtctaatctcgacctaccctctgtctgaaaaaaatcttcgtcacaaagacttgcggtgctcacgcttccctttgcctgtgccccatccacacctacgcactcagctccgcgtcaccgtggaggccatg

SEQ ID NO: 4303 - DNA, 703 bp, Nannochloropsis_gaditana
gacgtcaacttcatttgccttaccgcctcacaaaaagctacgccatgacccttcagctcaggcacggaggagccgtatctcgcacaatgatgagaaagcaagcatgcgccccaagcttattgatgctaccaataggaagtctgagcccacgtcctcagctcttccctcgtcttcttttaaggtgcgccacaagggtaaagtcgaagagcttcccctaggaacacatcagaaacaggaagacgcgccggagccccgaatgctgttagccgtttctggtgtagacaacgatgtgcgctcaaccttggccgcggaggcgcgaaaacttgagaagaattttcttttcgaggggggcaatgtctgtgggatctccttagggccaagaatgctgcacacagatgacccctctgcgactttcacacaccttttggttcccaaggagcgggagtgtcggcgtacgcttaaaattcttttcgctctttgcacgggagcgcatattgttaccgctgactggctttcggacagcgccagtaaagaaacgctcctcccagagaatcgatacattatcagccgctttcagcgccgtgtcaatgcggaaagtcgtcacattgccacagaggagcttgtttacgtgggtccgtgtgaaacgccgtcgcatcgcatattagcgaggctgcttgtagccgcaggcggtaagcagacgatg

SEQ ID NO: 4304 - DNA, 703 bp, Nannochloropsis_gaditana
acgcacattttcttattttgaagtccttgtttggcgtggaagtaaatcttatcgacactgccgttatattgcggtccggttgacgccgaccttctttgcagcattcgttgtcaaaccttcgaagttagcttctgtactggcgtagtcgtgccttgcgaagggtatgaaacggactttcttgtggcccatctttcgactggagggagggccgaggcctgaccctgtttgcttggtccatgcacacatgcaaatcatgtccaaaattcggaacgacgattgattctttccttcaactgtcacatatcaaatatcttgtgttatatggtagggttgggcgtgagtgtatcaaacaatctgtaaactacataaagcatgcacgctctcgtctagacggtttgttacaacctcctacccccgcgcttgatcgctgcctggtggctaggcgcagccatagataccctcaccaaagtaggacgctgtgacctgcctgtcttgccgagttaagtttacagaatggaggcctttattctttgcgatggcatccaatgtcatctttatgactttttggcaccgtatataaccaagccacgatagattgtagctctcacgcctcgtctggatttctctaaccctgcgacctggtacaatcattcacctagtattttcatcttctcctcgtgccatcctacccaggcaaatcatg

SEQ ID NO: 4305 - DNA, 703 bp, Nannochloropsis_gaditana
aattttcttgactttaacttttctcattttgatttcctgtcatttcacttctttctttttttcattgatctctcagacatctacatagaacacgtcgccaacttgctgtcttggagagacgtgccgtgcaaacagaacatgggcgacattattacttttcttgtatcttattatattactgcagcacaccgagccaatcgataagtggaacgcatgttcgttcctattatgatccacgacttcgaaaaactggtcggattgccttgccatgtctcaggtgtctgaggatgcggcccatctctttcttaggagacaggccacatagaaaatttctatcggcctcgagggtacctcctaagctcgtaactttctgtagcttggcatcatatcatttgatatgtctaggtacaacctcaactcgatgtgtgtctagctagctagtatgctaccatactgtgcataaagagcttttggtcatgaaagcagcagtctctaacctcctggcatctcctggggatacttcccaagagtcttcgactagtgaaagcagcgaggcgaccctcgaagccccgttgggccacggcaaagggtcatgacaacaataccaaacatgtggagtaaaaataaactaaatcaacacacaggcttcaatctttgctcctctgtcgaccttttaaatgcatttcaatgaagcagcaaggac

SEQ ID NO: 4306 - DNA, 703 bp, Nannochloropsis_gaditana
gactgcagcgcaactacagccggtatattttttaatgaacgcacagagccgaccataaccaggcgtttgcatcctaaagtacgaatttcagctgctcctactcgcgagacgcacccagggccaaaaattatccgcgccggaggtcctttgacgacaaattcacgcataactgtgcaaaaaacgtggatatgccaagctttcaggtgcaaatgaagcgctgatagaatttgtgagccccttgcccgacccccggggccatcatcttgggagtgacctagcgtgcacatcgagattaatgttcccggccttggctccacaggccgcagcgagtcggcgacgccgcttgctcgcccagactgcccctgtttgaacgggtgcgcgtcgtggtgctccccaacactcacatgcctccacgcaacgtgcaacatcctattattcagatagtgtgaccatgttttcggagatggcgcggctgcccgtcgttcatatcggcaggtcggcgcttggacttcttctccttctttgttcctgcacgttcttcgcccaggctcagaaaaacatagaagttgtgcgcaaaatagatttgagctcagcggttgttcgtatcgatatgacgattttggccaacgacttgaatggtaaatatgtcgtttcctttgcgaaacatttggctcccaaactctctttccttcaaatcgcaatg

SEQ ID NO: 4307 - DNA, 703 bp, Nannochloropsis_gaditana
ggttgcggcgtgccaaacctatggacatatcgggcttggtggctggagtatgtgaagggttgcctgacctccagtttgccagcgcagcgagtattagtgcttcagctatgtttcagaagacgtcgaaacaactatcagatgtgtgtggtcttttgatgagtattctgacgccctacctggaatgcgctgccacaacgtgttctaaagtcgttcttgcttggagcttgggcgaggtgttacgggggctgcaggctataatctcccctttacactctgatgcggttctgcggtccgaggtcgacgtatggatgcaaaaaatgcaaaacaagtggtttggcatcgcagaatcggctctagaacaagcggagaaagaaagggcaactccggagtctcagtgggctgtcgttacctcttcgctatatcttctcgcaggttttccatctttaagcatggcgcgtgcaagcatcttgtggtccgcgctcatccggatcggtttggtgactcatgcatcgcacggaaagtcgaaagaaaacctggctttgtcatctggtaatgggacaaaatcgcgcgtatccgtgatccctgtcaatatgtttgagatggtacaagtggcaaccctcttttggacggttggtctgagcaagacctgcagggagcaagttgcctgccgtcaggcactggaagagatgtggaccaattcggc

SEQ ID NO: 4308 - DNA, 703 bp, Nannochloropsis_gaditana
agagacccatttgaaaattgttacaccagtgcaaaaattacaagcatgtcactcaccagtagtggctccatctcctacgctcaagggctgcagcgtttccataacacccgcagtcgccatgcagttgatctgtctcgaagaagaaggtgttcatgtgagagacatggtttgaatggcgaggactgtgatgaacagaatatgggaggccttccggggagaattccttgttagctttatacgggcgcatctggcaggagagaggtgtttgcgaagcggcgtgacggaggcgccggtgagaaaggcctgcgcgtaagagccgtgaaagggcttcttcgacgtcgtctctctttctagcgagccctcgccccctcaccgcaccgccccaggcatgggcgaggcaccaccgcagcgagcgagcaacaagaacgcacacaggctgacactaaacgtaaataaactaccgctctctgcgctataccaacgcgtgacggcttcgtagtttttgcgaccaggctgcagtttccgaactgcttcagctggaagcgaaacgctatctggacggagatgctatctttacaaagcgaaattttagtccatctgattcttccatcatacttttgacatatacacagacaagccaacacaggagtgccaccatcgttctgtaaatatcatatcgtactggcaccaggacgccatcatg

SEQ ID NO: 4309 - DNA, 703 bp, Nannochloropsis_gaditana
tttccctgccctgccagaatttaaaatctgaaacggcgtgccggttcgccggaatccccctgattctggtcgacctggacagaaatgcgcgcgtaaaagtgtaaaacgtcaatggtgtcgcgatgacatgtagtcctgaataacatggagagaatggagaagaagagcgtttgaatgcaacacgaggagacatgggccgtcgtcggaagtcttgcttggtggccctgctctcttcccaatttttgcttttagtttctctacatcatgcgagtctacttcacattcatgactgaaattataggcactgatgactgttcgtcattgatgaagcggtaactgggtcattaacgttcttcgtatctagggtcctgtcgcgacgaatcaggcatgctccgcatctctcatcgtgtgctacaagcgccgccgccatggagtactttcaaattggccccacgactgccgcctccacttgcatggacttcgaactataggaagggtttttcgacgatatcaacggccacttgcgatccaaaccttatccggaacgtcgcgattattgcacatattgaccatggcaaaaccacaatttgcgatcgactgatgggcagtagcgccgtgacagtggatcgagtcatggacagtatgtctttggaaaagcaacgcgggattacgattatgagcaagtacacgcgagttgatttcg

SEQ ID NO: 4310 - DNA, 703 bp, Nannochloropsis_gaditana
ttccccttttttcgatattcgagatagagtacatgattcttcgggcatctctcgtccggccatgcgcaacaaggtggtgtccgcagggaatatctgagggggtccggcacgcagaaggcgacaagagagcgcgtacccctcctgcatatcctagaatcaacaacgacttaaccacacagaagggaatagcagtacacttggagcgataattgatgaaagggctcagcgcgagtgatgaccagataggtaacataaagcgatacgtggtgctaggcgagagagatgaccagacatgccactcaacgacacgcccaccggcctcatccttgcgtcgtgatggctgaaagtttctcccagtgtgatctccagtcattgctagatgccgaacgaggtgttcaggaaaaatttactcaatcttgcgggagctacctgattttgtgaaatatcacaccatctatgttaacctcctcccctttttatcactaccctctgtccgcttttggccttcccgtcgccagggtgcatgctgaaaaatgtcttttatcaaaatataaaatccatcttaaagcgtggacttcgcagtcgcatctatctgctccttgcgtcggctgtgcctttctcgtcctcctccgccatctcctcccttcctcctgcctctccccaacacgttcccctggccctagctcgccccctgtccaccatg

SEQ ID NO: 4311 - DNA, 703 bp, Nannochloropsis_gaditana
caccctggcagacaccacgcaccttctggcgcgcgccgcggggcacttccagagccctgcttccacggcagagcagtggaggcggttggaagagggctacctctctcagctctccggcgtccttgaccccctcctgacgggtcttcctccctccgtccctccctccctgcctccctcccagcccgaggcgaaggacctgggtggggccgctgccttcttggcccccctggatgccttcgatatcaaggcagtggcggcggtcagtgactcccggattctcaaggggatcgacctctctctccttcccgccctcctcacctcgtcctccccaatgccttctttttcgccccccccctcctcccttccttcctcctttgctgctgccctcgccctccgtccttactgcgccaccacccttcgctacgccgccgaccgctcctcgtcgccttcttcctcctctctcttccacgtcctctccgtctcgtggtcgtcattcctcatcactgccgccaccgggctcagccccgccaaggtcacttgcaaccacctcgtggaggaggtaggatcagacggccgccttcttaccaccggggcaatcgaggtgaaggtaggaggtccgggggggaaactcggccatttccagcgtttgctgcaaggcgcggaggctggacccgagggaggagggcagaaagggcgtggacgg

SEQ ID NO: 4312 - DNA, 703 bp, Nannochloropsis_gaditana
ggagaaatgccgcatgtgttactcgtgactaatcgtaccaaaaaaagtattttaaaaacagcctgtgaattatttttctgggtatgttttttcttatgctgtctgcagtatgttttaaaatatgtatgattacatctttacatgcctttttgtgctgtgtcgcattttactttaaaagcttgtagtagcttccaaaattaacctcccgcccggccgcgttttttcagttaccctcttgtacggtgctgccgcttgtccccgtgatgagcgttggaaaacgtgtttaaaaggcctacagtgtctggttgtatacggcgtgatgcttgcaacgatgcgggggggtaagtattagtgagaggcgcgatgtcaaggaacgcaaaccacgcatccacggggactgcaaacctcccccatcaattaataaatcgcatgtttcgcttcttctcttctatcaacatgaaaagatattaggatgcctaaaaccaatgttgcaagcaaacggcgtgcccgcgctcgagcgtccaatgaaccgtacgcgaaatttccgaatgcctgttctacgcaagttgtcttgccagacccgaagcgtccagagctagcagggacaggcctccaaaaaccgtcacgacatcacaaaatgcttcgtagaatggcatttctaaaaagcatagaagaaaatgcggcggccgcgtcggtggaaatg

SEQ ID NO: 4313 - DNA, 703 bp, Nannochloropsis_gaditana
cgtcgtcgtccaggcgcaccaagatggcgtcgccacgacagagaagcaccgtcggaaagccgcctttgcgcgccttaaggccctgaccaaggcaagcagtgcgtggaggaaagagctgaaacccaggcaggacctggaactgcgacgacaggtgcgctggtcgcaagagaggacggatcgggaggcctttggggcccggcacatgcaagtactcttcaccgagctgatggagggcatgtccttggcgactcgtgcggagggctctttcatcacagaccgggcggtttccccatcccgtggccgctggcgacaaaacgaaccggccgcagaggaggtgcggatggaacggtggttgcaaagtttgatccttcacgtgggagacgcggcattgctgggagggatggaaaatggggttggcgacggtgactattgcgtggagtcggcagaggggcccatgaggatgcggaggaggctgctccgggcgccttaccgtcttggtcctgtcgccaggaaccttgcagcatcctcgtctgcctcacctcggccaggggtgacacccattccggagcccaagcgacctcaaatgagacggcaacgtagtcaatcccttccggcccttcctaagcgatccgtcactttcgatcggggaagtccggtgggcgctctgaccgtccagggaggtctgaatgccagtccgagcatg

SEQ ID NO: 4314 - DNA, 703 bp, Nannochloropsis_gaditana
atttgcttggtaggtagcgtgatagatttccattttgaaatgaacaaaacggcgccgaccgtttccctgggaatcggacaccgggatcctcgttggcaacatgcacacactccagtcagtgttcaaagtactatgtacgtgtagatatatacatttgccgatatgttggtcgctaacttataagtctaggttcccacgtccttgatcaaccatcaatttacaccaggactctaagaaatttgaattcgaatagcgccgttacacgcctggaggccagaaagatctggcagaaaatagatcgcctatccaggagaggaatgtatgcctggtatctagcaggtagactaaaaagcaatgattcgtggctttctggcgaatttaattccgttttatttttctcgagccgttggacgaggaaatcatagctcgcaccctccgctttgaatatgctttattctgatctgttcccttgtactttgcacgttcgtcctacctgtcatttcaatcctatcaattcaagaactttgattacgtatatatatataatcgacgtgtgaggtaataattgcaagaaccaagacgtacggcagtaatatcgattcgtgcatcaacttacctccagcgcacatcatcgcaacataacaggcacacttcgcgtgccaagccagttgaaactgcctcgcatatagaccgtcaacctatg

SEQ ID NO: 4315 - DNA, 703 bp, Nannochloropsis_gaditana
gtccaatctgtctggtattacgcatgtatacgatcatcttagagctggccgaataaaagcgtaaagagacgacactaaaatgtaattctcccgagaaccctctcactcaaccgttagctgcacctttttgccgtaatttcgaatgtggtacaagggatgacgcagtatcgaggtatcgccatagccgttaactttgaaattaaaatcttaaaacattcccagagagcgcagcgaccatgtgaaagacagtatgggaactagaaattcttcaaatgtcccatcagctagattaccaagcattgattgaatcttttcactgctcgccgaataaaagtgcgaaagaaaatacaccaaatgttaagttctcccgagagactgggcgatggccgttagcttacacagcttactaccgtctactcaaatatggttcacggaaatgactttaaaactccatcgatctttctcatgtcaagcacaccttcttttggcaaagtgctgtctaaattcaatgcgcttagtgagagacatgtctacctgatccttaacatttcatagctatgaggacctcgtggaaagatctagtgattccaccagtaggggcataaagatcccctcgtcacaaattaacttgattacaatttaaatgtacaggcttcaaggtcaatactacgatttgaccagagttatgcgttactgcagtgtc

SEQ ID NO: 4316 - DNA, 703 bp, Nannochloropsis_gaditana; identical to SEQ ID NO: 894

SEQ ID NO: 4317 - DNA, 703 bp, Nannochloropsis_gaditana; identical to SEQ ID NO: 897

SEQ ID NO: 4318 - DNA, 703 bp, Nannochloropsis_gaditana; identical to SEQ ID NO: 902

SEQ ID NO: 4319 - DNA, 703 bp, Nannochloropsis_gaditana
cgcggatggttttgaaaagcaaagaccgggcctcactaaaaacttcttctccttgtaaggaggtagacgcggaaaacagtaaaaacctgaccaacgacagccgtcgcatgtggcagattaccaaggccgtcgctacgccctcgcacccatggtccaaattttccacgggcagtctccaaaccctcaaggaggacgtacctcctgcttttgaccttcgcgacgcccttttgcgcttctacgccgagtgagtgggaagagaaagggggccttgagagattgggaagagaaagggggccttgagagattggagccgcgggggcgatgcgggcacatgagtgatctgtaagcatccagcttattctctgtctctttccccctctcattcccgccgatgcatctcgtgtccttgttcttactcggaccccaggcattactacgcggggaatatggcccttgccctggtaagccgggacagcctcgatgtccttgaggggcacgtgcgggacaaattcggtgccattagggacagagagccgctggcagtcagggaaggcgacggagggaggacggcggcagtccggttcaacaaccccttccagacgcgcgttctgcctctggcatccaaccacactcccagcgacggccagaggaatgccctctgtccccccacccccaacccgtcctataccatctcgggcgacga

SEQ ID NO: 4320 - DNA, 703 bp, Nannochloropsis_gaditana; identical to SEQ ID NO: 639

SEQ ID NO: 4321 - DNA, 703 bp, Nannochloropsis_gaditana
cacgtcgtcgccatccgcagcaaaggtgtagaaattatacggacaggccactaaagtatgcgacgcagaattaccgctgctccctgtcttttctactttactaacaatgcttattcccatttggatgatcttgaagcgcgaggcgaccacgcgctgttgtgcgtacctttcttgcatggtgtcagcgtaggtgatgcgcggctgccctgcaagattaatgcctgacatttcaaaatcgacagccacaaactcacagttctgcaatgctgcctctatttcaggcaaaacatcggcaaatgtggcctttgtgacatccattgtccggggcgtcgattcaagactgcctgcaaatggccctagggacgctatgtgcatattgcggttgaggggcgaaaattacgaatggaaaagtaaataagtacgctggtgacgtgaattgattcaatgggggaaagtctggatgagataggcacatatttttgggtaaagtgttagatattttcacaggggaagggtcacgaggccaagcgagcgcacacatagcatcacatgtatacgacgatgtatacgacggtcagaggggtgtgtattcttatagcttctcaggccgaccgaatcctgcgctcccgacagacacgccgtcttcacctgtaatttgctacacagcgttttacaatttcgcaacaggaactttctgaccatg

SEQ ID NO: 4322 - DNA, 703 bp, Nannochloropsis_gaditana
  misc_feature (1)..(506): n is a, c, g, or t
  misc_feature (585)..(594): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctgtaggtgtcggtgttggaggagttgttggagtcgttgaaggtgcttgggtaggggtacgagtgggtcctggagtnnnnnnnnnntgatattccagctgaagaggaatggtacttcctcgcccccattcagcgagcagtattcatagcaagcctccggggtgtcgatcgattgtagctgtcgatcttccggatg

SEQ ID NO: 4323 - DNA, 703 bp, Nannochloropsis_gaditana
cgaaaagtaggcccagagggcctggaggacgggactaggctgtctccattgtttgtagacgctgggacccccaaggggccgccaaatcacgcggaggtggtcaggtgataggtatagctcctcctcgtgggggggaggggaggcggtgggggaggaggaagggccgggcgaggacggcgatatctcccagtgagtggacggcggcacgtacggctccaggtacgtgcgtagcttgggaggcatctgtgggggaaggattgcggggaggtagacaaggggatgaggccaatgcgcgcatagcctgaagcattacatgtgaaggtgaaggagtgggcgagtcccggcgatgtttttccgcagggtcgctgccatcacaatatgatcgcgctggacacaccccgcccgtcagcaggcctggattcgaatgcgctgttcgttcagatgaaaaacagtcctccctcatgcatgttcgaacctggatgcgtgcatttcgctttgttgcttgagtgggagtgccctcacccagcattctaacctcctccccttctcccggggaaccgttcaagcccacaacgacactgccgtctcaacaaatctcaaggctggcttggtcttgatgtccagaaaatccaccttattaccattttgtatcgtgcttcttatcgctcgacgcttgctagctttctcctctgcgcccaagatg

SEQ ID NO: 4324 - DNA, 703 bp, Nannochloropsis_gaditana; identical to SEQ ID NO: 3154

SEQ ID NO: 4325 - DNA, 703 bp, Nannochloropsis_gaditana
agtggggccgcagggtcgcagggaggacatggagggggagggggaaggtgaagctaggtatgtacaagcgaggtattccgaaaagtccgccaccatttccaggggtggcggcagaaggatcacaagtttggccgcctcgtcgccgtccgtcaggaaagaccgtaaagacgggtggaagaagagcttcaccctccgcgtggcagggaggagacgtgcgaggaccgggtcctcactttcctgaggagagagcggctgtggaggaaggggctcaggctccgccctggggggggagcagggcggttctcgctctcttctcttcttggacagggcgcgtcccatttccctccctacaacgtgcggctaagtatgttaaatgaggaagaaccttttttttcccctttgtatctaacagccactctgatggtcagctgcccttcaaatcgtcgccgaggctcgaacttgccgggctgtcaggtggagtcgcgcgcacagagtacagcctctttacagctcaggtagctctataatacttttaaagatgctctcgaaaagatgaagctattgaaggtggttatcgggattgaaagggttgcttgcgacgagtcggccaacacacaatacagctccaacctcccctcccttccgcccgaaccactccaggaatccaaggggctttaaccctgccctgctttcgacggccatg

SEQ ID NO: 4326 - DNA, 703 bp, Nannochloropsis_gaditana
atgaccgcgtggtcgtggtattcgtgtccacagtccttttcccgtgtcgccgtggggtctcgggcgataggggtgtcctaccagcgactacaagcgacacgtgacgtgaaacgaacaacttggtgaagctcctgaatgcaagacagccgtgtcatcccatggatgtgcattctttttacaaattattagggcgaagactttgtcgtggcgataatgcttaggcagacggaagaatcagggcctcctcttgcgggtactgcgatctgaccccggcacaccactcaactacgatgacctcatttccaccatggccgtcatctaaattgatccacagatgaaatccttcgcgtcgcggagacttcttcgccacgcctcggccttgttagtctcatcactaccacaaacagctgccagaggggctttaattgcggggggtgtgctcaaaaggcagcacatccggccacatcgacatcaattccttccggcacctcattttttttcgtcttcagccggccagtctgatagcaagattagttttcaagccctcgtacaggatctcgggaaagcagctgcggcttcggacgctgaaaaggccatcgcagctttgagcaaatttcctcatatgcctcccgaaccgacattacttgtctacaacgtcgctatcggcacatgtgtccgggccggccagatgggaaaagccatg

SEQ ID NO: 4327 - DNA, 703 bp, Nannochloropsis_gaditana; identical to SEQ ID NO: 2920

SEQ ID NO: 4328 - DNA, 703 bp, Nannochloropsis_gaditana
aaaacgcggacctaattcactgcatttaaaaaaaaaaatccatccgatacatttcttttcccgatttggcctccaaagcaacaagcggtcgagtacttgctgttcgtccggttgaaccgagcggacttgagttagcgattcatcccttcgcgtcttttgggccaaacatgcacgcgcttaggactcacgaagcgcatgtgttcggtatgcatatccatccaaagacattgaattacaggtcacagacgaatggctagtttcagagaccaacttgctgggtttaagggcctgagggcgtccctggagaagaaggaacaaaaagacgcagcaatggagcgcaagaatgaggctgcgagattggccagcttaagacttgggcagcgtcttgttaaagcgggtaggtttatccgtaacagtattttgctaaaacgcagtgaggcgagtggaggctgcatcaagaagcgcaggatggggcttctcatcctgatcattgatagcctcccgttcgagcccctgtggcgcgaatggatgcaacgacaaaatggagcgacagaagtcaaagtctggatacatgccaagcacccggacaaagtgacttctccgtgggtattagagaagctcatacccaggtccttttgtcctgcgtggggctcgattgatattacacgtgccgagttggagcttttgcgggtcgctgtggaag

SEQ ID NO: 4329 - DNA, 703 bp, Nannochloropsis_gaditana
cttcatttctcggaagtctcgtagccaattgtcgtcgctgccttctgtttggtcggctaacatattttcgacgtgtcctcgggcgggcgaagacatatgggcaagggaaagcttttggcgcctgtagtcgcgtaaaatccgattaaaaacatgctacgcccctagtcgtgtctcgacacacaaaacatacgtcgtatttctatacagatataccgcgcagccatgcagaagataattttgtcaacgccattttttggcacgggaaacagaagcgtttcgacccctcgcttggcgacgctcgagcgagcgcccgccccaaatcccccccgtggcctctgaacaacaaaagaactttatgaaagcagcggacacaaagtcacatttcttacctgaagcggtacaattgaatgcagctgaggagctgggtggaacgcttgtgccacattacatgtgctggtagtgataaacgttcgctgtcttatacgtacaatatctgagaagccctcctaagtctggtacaacttaagtagtgaaaagccctttaaaaaatctgttttggtcccacatatgcgctagaagaggacgttcaacaagtctgactctctatctccatggccctgtcctatatcgcttgtccttgctcacgacacaggaagccttgcaatcgtcacttacccaactgacccgcacctctgtcgacatg

SEQ ID NO: 4330 - DNA, 703 bp, Nannochloropsis_gaditana
cgttctcacctttgcgatagctagtaccttcaattgtagccgcgttctttctattggttcctgacggcttcttcagaagcatcattccgacatttacgacagacagtgtctttcaacactagccgaacgcttcttaaaagcaacatgatttttatttctatggctgacactgcgcgtcaaaattggtgctcggggagtttcccatattccggggaatcgagggttttgtgtcagagaatggcacttgaagatatgactgtcaggcatatttcaagaggtaggcatcaaggttccagggcgtgcgaaagcacgtccctagagataatagctgcttgcagcgactgcaacaaagcccgctttttataagaaaaccctcgatgacaaaagctgtggtaggtggcaacacttcacattcttttctggttccattaagcatggcatgtgctgcgcacatgcgcgcctgaccttctgatccctaagcctaagcaccaactcaatttcttctcgtcgagcgaatgaagacagtatcgaggatttttccaatactggagacttcgtgaaaccatgcaaactctacagctatctgttcgtatgttctacccttcctcctgggtcagcttgcctttgcttgttattattgattgtacgtccaagcttacaaatatttcgcgatcaacgatcatcggaagtcttttcacagatg

SEQ ID NO: 4331 - DNA, 703 bp, Nannochloropsis_gaditana
gaaggggcgctgacaagcagggcctcggccttcgatactcttgcccacgttgcaaccgcactgaacaaggcaacctgaaggcaaacggggcaagtgccctgtgaataaaaaataaatcagggctgagaggagcttgtgcaagaagacaacgggacgggagaaatcaaagcacaggatggctgtggtccaaggccatgaacgaccctttgcgcatgatgatgagcagggcccctgaccacccgcagtactcctttagcctttacggtaacaacgaggcccagaacatccgttcaagcgctcaaatgtgtgccatcaactcatgcaggcatagaaagtatgccaaatcccgcgcgcacgccacagaggcgggccccaaaccaggcgttttcactcgagccggaaaaggcagacgaaccgatcctcccccttcgcgtctccccgcccctcccccagcttgctcttttctcacgcccgccgtgcccatggggcacgtgcgccttctgcgctgagcgggcagtcctggatagactgggctttgaatatggttttcgctcggtcgcttgcagaagcatgctcgcatcacctaatttctttccccacccaccttcccgggcccccctagacgagaggggaagtaacagacgcaaggttcgagttagaacatccgcccaacgcttccaattcattcccttcagtcatcatg

SEQ ID NO: 4332 - DNA, 703 bp, Nannochloropsis_gaditana
agaaataagcatatgcttgtaatacacttgctcgaccgcaatctcttagagatgagatttctcatggcaatcgtcattggcatatgggtgccgacctctcaactttcggtatccatgtactgtgatggtgaaacgggtttgtattttttaagcatggcctgataatcgacgccttgtggtacataatcttggtttttgcacgctctaagcataaatttttttttggttagggtgcctgtcaaacaaagaaagctcatgtcaaaatcaacacttgcgaacacggtatttgccactaggactggggggtctatgagatacccgaatgcgtccatgtatcgtcctcgttttcgacgcatcggcacagggtaacgagaatggaaaaatgcatttaccacatgcagatttccaaacggcgaaggaacgttcctctggcgtgtccgcacgtcgaacccgacgtgcacgcacggcatggggtttacgtgcccggaggcggggtctgtcggggctggcgagactcggggcgagaaacatcacgtgaggggcccgccctgggtactgccgcggccgccctccccacgggcgtggtggccagtgcatcgtttcacaacgttttctgtcaagcttcacacggtccttggtcatacggtcctacagattgcggacaaggggtgtaggtggtacggaagtttgaactggattcagt

SEQ ID NO: 4333 - DNA, 703 bp, Nannochloropsis_gaditana
ggctggtaggagcctgttgcggtgcaacgatgggacaagcgcttggaaaaatgcatggacaagagcgtacattcctccgacacaaaatagtgatagtacatgcgttttaaatatgaaacaaagatacgtatgttacactcgggatgccttaacagggacagtgacagggcgagtggggagtacccaggcagaggtcaaggggagtaccatatgttggccgaattaaacctaccggtatcccagaatggatccttggagcaatgtcaggatcacgattatgaagatttttttcatgacacgatttgacgtcgtcttgttgattcgatttcggtatcgcatgcctgtagtgttgggaagtgtaattgaagaggagagctgacattgttccacatcttctatggaagggcgtcgactgttgccttattgcgtttatccgctgcaatcgcgccagccaggatcaataccgttcgctctggttggtcttgttgagatgtgcgcgagtgtcggcctaagatgcgcgaatgctttcgatgtgtgctgcaattcttgccatcctgactgtatctatcgccgccgtgaaagtggagcgacgagaccttcgagtcagcccctgcaagtgtctcaggtcgccgcattgaagccatcacacgttcataagcacgtttttaatctgtattacagtgaaacagaacggctcaatatg

SEQ ID NO: 4334 - DNA, 703 bp, Nannochloropsis_gaditana
  misc_feature (1)..(166): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttatagaacaggaggctgcaatcctgtggaaagtatcgatggacgcatgggcaggtggtaagtgacgagaacagagaaagtgacaagccaggaaacgcggccttaccctcctacgagatggaggcccctcaatgcaagaaggcggtcatgggatgagtgcaaaagccattccacgcgccggctttgtgcgagtaaagttggcacgtatcgcgctttgcaagcagccgtcatcccccctccgactcgtcgtgagagggagggcagccccgggaccgtgacacaacatagttccattttccaaaatacaccggacgcaaaccagaacactttcagacatgccacacataaatgtgtcagtcaattgactgtggagccgcgtgttatttgctcgccacgcccctgggtatttccgaaacgtgtttttttcaagagggatgaaagccagccttcgcctcgtgagtatcttgctcatggccttcccttatcttaccttagagatattgcgggcgtgtccgacggatctaagagcacgatg

SEQ ID NO: 4335 - DNA, 703 bp, Nannochloropsis_gaditana
tcgtcattggcatatgggtgccgacctctcaactttcggtatccatgtactgtgatggtgaaacgggtttgtattttttaagcatggcctgataatcgacgccttgtggtacataatcttggtttttgcacgctctaagcataaatttttttttggttagggtgcctgtcaaacaaagaaagctcatgtcaaaatcaacacttgcgaacacggtatttgccactaggactggggggtctatgagatacccgaatgcgtccatgtatcgtcctcgttttcgacgcatcggcacagggtaacgagaatggaaaaatgcatttaccacatgcagatttccaaacggcgaaggaacgttcctctggcgtgtccgcacgtcgaacccgacgtgcacgcacggcatggggtttacgtgcccggaggcggggtctgtcggggctggcgagactcggggcgagaaacatcacgtgaggggcccgccctgggtactgccgcggccgccctccccacgggcgtggtggccagtgcatcgtttcacaacgttttctgtcaagcttcacacggtccttggtcatacggtcctacagattgcggacaaggggtgtaggtggtacggaagtttgaactggattcagtgggaacaaagcattgaggtaagtcaattgccaactcgcccttaaaacaaggaagtaaaaaatatatcatg

SEQ ID NO: 4336 - DNA, 703 bp, Nannochloropsis_gaditana
tttattctaaatagaaggactgtgcaaatgaatggtgcgcctcgaaaaacacgcaagagaaatgagactcacaggtgtgaaataaatcccggagagcgcgtgtggagcgacgtatcagggatttccccgccagtgggaagaactacttccttgcttttcctccccttctacagcccaccctgaaacaagaacctatcattgatacgcaggaagcggtatggcatattctggtagcacacaggcggagaagggaggggaaggagggattgacaagaggggaggggggcttccgtggcaacctcctccccgttttccgggcccactaggtctcctcggctctcgtcaccccgctaccagtgatcaggatagtgctgggcgcacgtacagagacttagacaaacaagagcgccagcagacacaggagccgctcaacccgccctcagggacaggctccaatgcggtaaatgtcaacctcctgccttacttcaagcaaccgcgaggcgcctggcaccagatgtgcgaggattatggcctacccgtctcaggcgtagtcaatgctcaagaccttcgagcagtgctcgggtgtacatgtgcggaagtggcacttggatggcaggacgaggccttgcgcgtggggaaaaaaatggcgggcgtgctagccgccttgaattatacaagcgatggcagcgtgagtgtgacattt

SEQ ID NO: 4337 - DNA, 703 bp, Nannochloropsis_gaditana
aaatagatctttagaccatctttcgttactaattatgaagatccttacacacgcgtagcgctctcacctatatgtacgatgactttggaggccggggaggtacttgtacagtcagcaccgcccgctagtgaggatgacagcaatgtgccatggacatgtgtcaagaaactgcggtctgcttcatcccggatgtcgtcatgttcctcctcagcctctccatcgtcattctcttggttcatagatctccctgtcaagggtgtcaataatgttaagaaaaaagaggacgaagcctcaggggccgggaaaagtcacccggcacttggccccttttcctcccactgataccccggccaaaagaggcaaggttcgaacatgagctaaaccgaggcacaaatactgcagcttcaaggcatcgtttggaatttatcgctattggcaactcgcaggcaggggccgcgtggttgtggtatttgctaccgctcttcgtgctcctcttccccgctttcccccctcttcttctccgcttttatgctcttgctcttttcctgccttggtcatcctccttgcgctcacagaggaaattccactctaatggtcctcactaccctacgctcgtgcacactcatgtaatgtcaacgtacatacacgcataggcattaaactcctggttggtaagagaatcgctcaccaagtcctggcgatg

SEQ ID NO: 4338 - DNA, 703 bp, Nannochloropsis_gaditana; identical to SEQ ID NO: 203

SEQ ID NO: 4339 - DNA, 703 bp, Nannochloropsis_gaditana
cgtccacattgatcaaaaaagaccatgagaggatcacgttatcgtcagcttattcgaaaacaaacttttgaaagtacatgattcgggaatgggggcatatagtttctcaaggtgttccgcatcgaagtttaatcaacggaagaattggcttacttgctgtgaatacccagaaaaattaaatccatgataataatccattaagtactcaacctgatctcctgtgtttttactcctaacctatttgactacagttccaatttatactctttcgaaagtaggtagattgctcagttgctttgcgtcgtcaaccgtcaaatttcagcgattcggactccctcgtgttcttgggggaaattgaaatcgatgcaaaatgttcgcctcgttgatgctgccttaaagggcgcacaggttgctagtgggtagacgcagtctttgtggtcggcgccgtcgttcccaatccaatccactggctacatgagtaatatctcatcgtctttcgtcaggaacgataaccccgcgccggcccatgtctttcattatgtccgactgaatgattagttattacgctttttgattgaattcatgtgggattataatcactttgtagacctttatgctttatatgcatttttttaagattcgtctgatgccatcatctggtcttatcattttagcagaacccgggggtgtgttcgctatgatg

SEQ ID NO: 4340 - DNA, 703 bp, Nannochloropsis_gaditana; identical to SEQ ID NO: 996

SEQ ID NO: 4341 - DNA, 703 bp, Nannochloropsis_gaditana
aggcaagcggattagtgcgtgagaagcgcccgagggcttgcggcgtctccttctccgccataccctctcggcgagcttcctttatcgaggccgagttgagtaaaaacacggtctttctctgatgttaaatgtcccttttttcgatttgttgtatacataggacaagattgattctaaatttacatttcgtagccctgcgcatttatcttcagtcactccgtctgttcatgatcagtattcccggcttgatggagggaggcagaaacgctctaatatagtacaagccccccgtttctatgcacggcgacacaagcgttagcttcgacattattacggaagaaatcagtagtctgacaacagacgacagccgcacgtgtacggtagatgccatggaaagttcctcgacgcatgtagatgcaaaaggcgtacgggtcgctagcagcacggaaatcgtggacagggaagcccgagcgcaacgatgtggtggccgaatgcgaaagccaacgcaacggtgggagcctgaagagtctcgttacgacccggtcttcgctgcacagcggaaacgggcaaaaaactaagtttgcaacagctgaaaaagcaaggcaagctggggaaggcaacaaggagggccaagacacgcaccgcggactcccccacctcccactcactcgcctttttaccactcccttgccccgcaatgccg

SEQ ID NO: 4342 - DNA, 703 bp, Nannochloropsis_gaditana
gcaggagtcggtctttcagcttgcaggaaaaccagccaccaaagcttgcattttgggctacaatggcactgtgttctgctacggacagacaggatcggggaagacctataccatgtttggtcccaatgtggacgcctgtggaagcgacgatgagcatcgtggtctggttcctcgtgtacttgagtatctcttcgcccatgtggcgcgagaggagaggcggaacgggggcgccatcacttacctgtgccggtgctctttctacgagattttcaatgaaagggttttcgatctgctagattcggactctggatgttccgttggagggctgcagacccgggaggatatgaagaaaggcgtgtatgtggaggggctgacggaggaggcagtggactcgccctaccaggctcaccaagtcttgactcgcggatatcgcaaccgacacgtgggcgagactgccatgaatcggtaggagggggtggggcccgggaatctgggggatttgggccctcgcagggggtacggagagagcatcctgactgcttcgactcccggcacccatgcacgcgcctgtcctgccaccctccttcatgaatgccgccctcccaaccctgtctccattcttccacttccacaacacagagagagctcccggtctcacgccgtcttcacggtcgtgttggagtcccgggaggtggacaccatg

SEQ ID NO: 4343 - DNA, 703 bp, Nannochloropsis_gaditana
atcccgaaacatgtccaaataaagagcgtaccgcttaaacgatagcgacagccagctctgcacactgtagatgggaaccatccacagaatgcccacgattttactctgcaccaggggcttggagaaatgagtgaggtgttgctgtatcagagctgccgaaagcaaaactgccattcccgcgcatatgcctgtgatggcaaccacagcgtgatgtagacctcccatttataataggggaacgccagttgccaaagcgagagaggaacgtagaagaagcttccaagacgacccgacctctgctgattcccttgcttcgctgccgccccgtggcagagctgtggaatgtccgatgacagaggcttacatgcggtgcgcaaagcgaagataatgggggggggagatcttcgcacgaaactgtgtgaggcgaatgtaacgtctttgcactgagctgtataagcgacctgatgaaaaggggtgacatcttgcttcagcatccagacgcttggggcgaacgcgtacgtgttctgatcgctgcgaaaaaagaggccgacgcttcaacctctggtatcgtataggacacacctttgtttgagtgagccactcgtcttcctaatgaatcacacacttgcgtgattacaggtttgacacatgctatcatgcggccttgacaggttccctaattcccttcttatttgcatctagt

SEQ ID NO: 4344 - DNA, 703 bp, Nannochloropsis_gaditana
taattcgatgaaggcacggatgctctgggctgcatctgtaagcccctccgtgatcgatgctaccgcggtggggcggtcacctgtgcgcccatcctcattttggccttcagcagcatccaattcgtcgtaaaatgcagcaatataggcatcatcgttagggctgggatccctggatttggtgaaccacatcaggctgcccactgtaaagcgacgtgagagaagtgaaggagtatgtgtatgtcgtcatgcgcagcgtggaggttcagcagtacttaaaaacatagctgtaacaatttggagagcaactcatgcagataaacctgaaatgcttttgtggttgctgtcattgtcacagtaggtggttctcgtgatttctaaaggccacggagacgctgtgacccctcccagtgcaggcgaagaacaagggacatgggcccagccgttgctggacaggcaggagggccgggaggcaagaggcttttgttctgcttggatgcgcagggtccttgtttcgaagccgtgccgagatgcacacggcactttggtgcattagtagggattgggcatgtttattgcacaggtgtcccgtgaaggccattgtaaatcttgtccctcaccttcatcccttcctgtcgttatccccctgcttcctcagagaaccgcttttgcttcgtcgttcttgccttgtctccttttcaacatg

SEQ ID NO: 4345 - DNA, 703 bp, Nannochloropsis_gaditana
atttttgccaggtgcccacgatcaggtttgccatgaaaatctgaggaagaaaaatcgaggcgggcaactcctttacctaccgaagacattgatatatcatctccactcccgtgcgcaaaaatgaatgtcaccacatggagaccttctgtcttcgaaatccctgcagaggcacgtgcacggggtggtaaaggtgcgcaggttggagtaaatggcataggacgatcacatatagggggcacatcgattgcctggaaagagcgggctgtgtaagcgagcggctcaaggtggagatgatgggttgggcgttggaaaaatacgtaccaccgccgggcgcacagcgcgacttggccaaatacagcgtgcatgtccatgatggtgcatagattggcattcattttggttttcctggcatgttatctctcatttaggccacgggtgggcagggccctttcagcttgcctctgatgcttgcggcttttccaggagcgatgctcggagcccttacaatttcgattttgctcctaagcagcgtggcggacgcctttcgtcttgccagccctttcgcagtcaaagcagccagagccgtcacagccgcagacatggacaggtggcggagtccacttctcctccgagtaaggagcagtcgcggcaacagtgaagcttcttcccgaaggaatttttccgactcgcccgtgggaaaatg

SEQ ID NO: 4346 - DNA, 703 bp, Nannochloropsis_gaditana
aatggagctagagagaacgtggacgaggccgtgcctccgggagccttgcatctacctgctttactcttcattcgtttctcgggcgtcgagactcggtacgattgctcggttgccagcggggacgcctttttaaaggggtcccgtacattgaatgttagtctcgatggtctgcaggttgaccatcttgcaaatggagcagaatttccggtggttttgtacttttttgacaagcaacgccagcggcgtgattatgacgaatacgctgtgctcgacttcactttcaaggaagtgtttctgaaccccatcgtgatgggggaagggcggccgctttcctacgtggaaatgttaaagatatcctcctcccgagttcgtgtaggcgtggacggtgctctccttcacacaattcgtttcttccaagaaaatttgacggccacggagaaaggagaggacagcgatgcttcggcaggatgggatgataggcttggcgtgcctcgtatcctttctaacaaagtgggccccgttgtcctgactgagaacgatcagacaccatgcacctttttccaaagcgtaactttcagtcccctgtccgtcctccttgacgcccgtgtttttgttcctggatcgcgagtcttcctaggcctggacggctccccccttttcttcgaaggggttcgcttgaccgatgtattctccactcctcaag

SEQ ID NO: 4347 - DNA, 703 bp, Nannochloropsis_gaditana
acgaggaagtgcacgtcagaaatagtaaagtacgccgacgacgacagtcaggaccatgtcctcttcaaactgaagacgtgcgtccggctttatgccatctacctagtgcatgcatacacagacatgacatttgacagaaaacactggcgaaaaggcgcggacagcgggggggaaacaacgaaccggtagtttgagggcctgtgcaacctccgaagccactcgcatgactaaagcctcatcccgaagcgtggcctcctgcgcagccttgaccctgccagcatctatgtctgtcatcacgggccgcaccctacccagcttgggcagatgccgccaagctgaccctgtaaagcgctcgagctgaagcagaaggagggggaggtgagggcggacactgcatttgacggcctgcgtctccctacattcatgcgcgccactgagcgagagcacacgtgaacgcatgagagaggcaagttaattctcattttaaggatttttgtggttacagaacctatcgattcgttcacatgaaggacgaaggacgaaggcaacgtccaggaaggggagagggggacagggaggcccaaccacccctcaccgccgccccggctttcaggggaatttcccggttcgatttgacacctcaaacggccaaaaacgactggataggacaatcttatacatcaactctcacaggtcatcaatg

SEQ ID NO: 4348 - DNA, 703 bp, Nannochloropsis_gaditana
cccatatcgccggtgacccgatagaaaagctttcgttggactgactgcggccgtctcacgatttattgtacgctagagcctaaaagcctggttaccgggattgactacgccgattcacccgataatatgtcccattcgcacgcacagagatgctctcggggaccctcaacttgcggggcgtttttccttccgccgggtagaagcccgcgctactcgcgacttaattcggtagcatgatagactcaacgttaatcatacatagcgaacgcaatatatgtgatggcactgcctgcgttgccatcctacccaggccaaacacattggagagcagctcggagacccctctcgtgcgcccacttggtaccctaacctcctcctgtcgaagatgaagcggctttgtcaatggtctgccatcaagctgtccaagtcgactcccgaaaatctcatagaggagaacctgcatgtgccaacgcatacagaactgactttagccgcaagtgatccgggattgcccccccttcctcctgggttgcagggtcgagccctggcggctgtccacgagggcgttttacggctgggcatgaggattgtggcagagccactgtcgcccgaccaatggaacctgcttattcggcttctgtctgagtcagagggggggaaagttcagcgctactatcacgataaagatcgccgactggctcta

SEQ ID NO: 4349 - DNA, 703 bp, Nannochloropsis_gaditana; identical to SEQ ID NO: 645

SEQ ID NO: 4350 - DNA, 703 bp, Nannochloropsis_gaditana
cgcaggtgcgtgcttcgggttgagaaattcctgggagcatgtgtgcgagggacaaccctgccaggggggaggtcgtcaggactgggaggtctgtaaccctcgaggcgaggtctccttcccttggtaaggacccccagggctctatagatgatgtgaccgaggacaaggccatggccaggtcggaaacatggtccaggtgtcgggcgcaagaggagggcgtgagctcccctttcttgccgcaagaggtacgacgggcagcatcgtggtggccatgatttcgtttgtggcgccggccctggctcatgcctcagtgcgattgcccgcgtgtgcagagcgtgaccgcccccgtgcgatcggctcgttcgctatttttgatggacgatggcacgtatccaccaggggcctctatgggatggtaggatgagagacagagaggggtaatttgtcaggacttagcgttccatataatcactcgagcacacgcacatgtgcaaaaaggggccatgcatgaggatagttgcttctgtcacgacgtctggagcatattgactagcatttacgccgtatagttcgccttgtggcgtcgtcatttcttggcaggataggttggggcggacacgggcgagcatccagtgtaggaaaggttccgcctgcaattacgatttattttgccccttattcatttaaaaaccacctatacatg

SEQ ID NO: 4351 - DNA, 703 bp, Nannochloropsis_gaditana
agaaactagcccagtccacgctttcgaccgtcatcggatcgtggggccggaaatgcacgatcacaaccagcaaaggcagcaagagaaacgacatggtcagcacttgaaacgacttcgtgcctgcgtggatgggttaagggcgcagtcaacatcaaggaggcgtcgaattcccagggcccatgacggcactctacctcgtcgtgtaataaaccagcatgactttctgcctgcacgctgatctgggtgtggatcatcaggcgagaccgtcaaggtcgtggggaaattgacccgggaccgcatcgtcccgagccttccagcctgtggtggagaaataaatgtcacgggggattttcttagtcgctgcaaaggaaactgatagtcttggcgacgcagtgttttggccgggatgggaacaccgggcgtaatcaggtgaatcagcgacactcctctgaaggcgtggttgcctgactatagccttaacagcctgtggttcttcatgctctcatctcttccgtatattctatcacagagaaaaggattcggtgactgggtactgctgtgccccttccaggtttctacagctttgggatagagcctttaattttgcccctcctcgccaaccactgggtgccccggaccaagatatcacccaatatcggccctcgttcaaagcccatcgtcgtgatcattgccacaatacatg

SEQ ID NO: 4352 - DNA, 703 bp, Nannochloropsis_gaditana
cctcgcgcaaccgcagacctcatcatgatagcaataacctcctctgtaacaatctttctttccccctttcctttcagctccagcttctattaagtatcattatgccgtcctttactcctgaagcgctttccccttatcgtcggttgcatacatttactgtgccgggcatgcaatttcaagatttggtggtcaaagttcttgagaagccccaggcctcgtctacttctgaatcttcatccacctttcttcgcgttcttgtcgggtacgttcgtgcgtaaaattcacatggcaccgaaataaaagtctatcagaaacctcttgataattttgcaaagtgttttcgaggacaatcacagaatgtcatccgtcacatcccaaattcagggacgagactgcggtgatcgagctcgtgtaccgcgccacacgcaacgtcaacgtccgatgcggacgatttctcctcgtctctgggcttgtcaactgtaaggatggcattcttcagctccattgtggaccgcgcgcccaagacctgcagtcgttgcacaagcatgggggtgcatcctttctggtccctcccgccgcacgtgccaacaatctttcggccgttgtgcaccacgtgggggtattaccggtccgaccggtccccttccagtctctgcgtaatgacaatgtccaaaaggaagaggagacgcgtcgggccagaatg

SEQ ID NO: 4353 - DNA, 703 bp, Nannochloropsis_gaditana
tagctacctgccgctactccggcgtcgaacttctactgattgatttgactgcgcttgcctcttcaaggccgctgccaaacctcgacctgttatggtgagtacgtattcaaggacaagtgagaagaagcatcagacacgatacgatgacgggtggaggcaggcttatgagatactcttcagcagctaagcatgacaaacacagttaacactcactaatagacagcaagaataatccttacaggtattcgtaggtcttatgaatcggatgcaccaccgaaaagtagaggtagactcgccactttcagagctccacaagccaccaagacccttcgactggcacctgctacttctttttttttcgcgccaaattccgcaccaggcgcaacgaggccaattttggttgactatgattgtaaaacgaccacagtcccatgcatcttctaagtactattaagggatgtttggtattgtttatcgtcgtgtcttgagaggaccctcatactaaactaaaaagatgcatcaagttatcttaaagctttcgcgccacatttgcttcgggtggaggcaagggcaacgcaattggagtgcaacaatcacgaaaagcatggctttgtcgcaatactttatgacttaagtgtctcatctcttgcacccaggaaataagtattcgatagtcctttgtagaacacagcctttttggatg

SEQ ID NO: 4354 - DNA, 703 bp, Nannochloropsis_gaditana
cttgcgatacaagctgcctgcaaactttgaagagctttcgaaagttatgaccatcgcgcaactagcagcgtacctaaaattcaaggcttttcttggccaaggatcagagatggcagatccgacgggtgcttcatgttggcccgatagagtgagacttctgataacaaaaaggaccaacgcagtgaacagtgtacctaactcctcaatgaagatttgtcttctcttcgtggtaccttgccatctgaggaggttaaagtgaaaaatcgaactcgatgatcgggtggattgaggggcatgcgggtcgatgcttggagagacacgctcggtcttcaaactcactgggctctggctcactcgagacattcttcttcgcggaggctcattgtcgtctccttgacgctttgtgtgtgcctggagagagctcgcgtccgggagaggcggcgaggagcgcgaggcctgccattgcgacatgcagatccacttagatgcgtctacagcctgacgggcccacccactgactgcacgtatgtcctgatctattgtacatgccatcattgcattacgaacgctgactcattctaacgcaaactgccacatgaaacacactccgtaaatgacacgtccctcgcggcgcagtgcttctttgaacaggctcccgtttacgaaggcgagcgttggctatataaattgcaatttttccatg

SEQ ID NO: 4355 - DNA, 703 bp, Nannochloropsis_gaditana
caccgagcagtacgcgactcggtgcaaagccaagacaatgcaagtccagtatggctccttgtccgcctcggacgcttcatatcacacaccctggcccctgcaggcataggacctggccgggccggggcggcgcggcgggtcctcgctgtcgcctgcgggtgatggggagggaggcttcaggcagtggcttcgcccgccccctccttttggagacttgccagatcaccgcggtcccggtcatttgggcgcccgtctatcgcgcagtagactttgtgactcttttgagttgcttgagtgacgggtagagacgcgacggacgattttacctgtttttgggctactccctcctttgaaattgccgtcctgctttctgcctgccgccggctccctttacacgacctgatcatttcatcccgcacctctgcaaaaacctagggccgagctaacatcttagtaacaacaatttgttgaatttgtcagaaaacgatccagttcgcgctgggatttgtcatttcagccagattctggacgtactttgagggaggtaggtaactgaaacgaaatcgacataaaagcgagagtattcatgcacaagttttgacgcacagaagaatcttcgtcctgtgcaaatttcaggttggcggacgaaagcctctgtgtacatatagcttgcaagtagggtcactgtggagcaggagtcatg

SEQ ID NO: 4356 - DNA, 703 bp, Nannochloropsis_gaditana
gtcggtcgtggtctttgctcgcgacgatagtgacgcggctgcgacggaggaagaggacgagttcgaagtggacgagaccgccgcagaagagcagtagcagcagtagtagcagcaggaaacccgtgcctgagggctaggagccgagctggccgcagcatttcaagacttgcaaatggtttgacccacacgcctacgaggaagcgcaggtagggcggaagggccagaagtcgtcccccgcgtggtacttctccatgaaggagaaggcgacgcgccgctccttccgcctcatcgaccgtgtatttcatgacaccagggaaaggcctgtgggatggcgtgctcagctagtgcgttttccccgtcctccaagccgtttcaatgtggatcgagtacaaaagagacagtgcggaccaacaaaaagtgatccccctggcggcgtttcgcgcttggccggcaatatctctcttcttcttgaccccattgaaacggcttggaggacgtggaaggtgcagaagctgagctcgacttgtggccacgccatctcacaggttctgcgcgacgtagagcagcgtacagatgtctaccttgtctacgacggttaggtactcccccacgtccagcacgccgttcaagggcctggccccgctggaaggggtcgccagccttcacccactcgctcctgtctaccactgcatggcatgacatg

SEQ ID NO: 4357 - DNA, 703 bp, Nannochloropsis_gaditana
ggacacagtgagatgggcggcgggaggaaaccctttatccgtgttatgtttttactaattattaccctggagctagggcagctctgggaaaagtatgtctgctatctatttggagtacgtggtcttcaacaacaggcaatcgggtagtttaagtaagaggaagcgaggaaggagaagcggggcagcaggtccaaaagaggcttatgcaagtgtctcgcctatgtacaagtgtgaatgtacgcttgtatagtttatggtgtccgcaggcttttagtcatgatatgctggttgctattggagtacgtaatctccaacaagaaggggagaggaaacagcagcagctgcaccacctacaaaagcgggaaaggatagagaaactcaggctgcaacactccatgactccgatttacatttaatacaaatacccaggtacatacttatcattttcgaacacaactcaacaggcttggcgtaatgcccttggaggcggcggcacagccatgctttgcgacaaagtaagcgaagaccgaatattatccacctgcccgagtctctttattcctgtgaggtagaagtctgaagtgcaagaagtgcggatccgagaccagtgaagaaattccttttcctggagaataaaggcgtcaagagggaagataaacgacagcgttgctcgaggccgtatatggagccgaacgcaggcatg

SEQ ID NO: 4358 - DNA, 703 bp, Nannochloropsis_gaditana
cgcctgtacatttaagcggtcgactatatccatcgatgcgtctccatcttgcgcatcagattccggtacaggcatcgacgaatgttgggccaccgcctctgcagaagcagcagtgaccggcggaatagcggccgaaacagacccgatgcacatctttcagatgcaccaacttgtgtgcaagtggatgattgttttgactaccggaagccgtgcagtcctgaccactattgaaaagaaatgccccccaaaatgtataatttatgattaaaaatggatgtgagggttaatttggaagattttctgcataattttgccactgtgtgcagcgaaggagcctgatctctgcgcatgtttcatgaccgacagtaggaagcgacatgcgtggtgtcaagcataacatgcaggcaaccgccaagaaaatcgtgaatcgttgggaaagaaaactgtaccatttacctctacttaaccatccaagctacccttggccagggaagaacttctgtgttggtgcgtaaagcattttggcctgcatgcggctatggggctttccgtggaagaacgcttttttgaattgacggttactgagggcttgggcttgggctctcgtatcacaggtgctggttccataactggtccccaaaatgctgtgacacgaccccgagaccttcataatcatacacttcatgtaaatagacaggacatg

SEQ ID NO: 4359 - DNA, 703 bp, Nannochloropsis_gaditana
acgcatgatgctggatttctctatgcgacaacccagtgaaactcgatgtttacatctcgcttccgttttacatcaattgattaggcttcttcactaaaagtattcaaacgttgctaattggcagcaagtcgtgcattattttctggtttctttgatttttcgtctctctcttctttattcgacacatttcatcaaaatcagcagcacaagtttaagtagttgcaacatctcctgagggatctgaaaattgcgaccatgttctcctaaataccttgcaatctgtaaacgtcccaatggatgctgtatcgccttcgccggccgagttgtacgcaaccacaaaaggtgaaatcggttggaagcacgccgattccgaggaacagaaaagatacggcgcccggtggggagtcgtcgtgtcgcgagcctgctctgtcctccatccttattgctgcttcatttcttctacatgtgttgttgttttcaatgcgtaaaaatcaattatcagccagaatggcaagtatctttttctaggccatagcctcggagttgtgaaattgtctgtcgaaaatttccgccagcacctggggaccgacttcggagtccttgcctactacataggcacgagcgcgcgcgccttcacgcgaaatctgggattaatttgttaattttgaacctttccaactttcgtccacttaaataggacatg

SEQ ID NO: 4360 - DNA, 703 bp, Nannochloropsis_gaditana
tatgaaagcctgtggatgtcacaaaagttctataaagacataatggtcaagatagcatctacatcgagaagcctgtgttgctttttccagatagcgagcgagtcaaaagtgctgagatgcataactcatgtttatgagaacgtagaaataatctttcttcggcgctgccttcttacgggaaaaagtgttcgttaagaccctgaatgattatgaataacgactttccctcttacagttgtaaacaagtctccttgttcacggttgcaaccctcagtactgttaacggcaagccgaccaacggtctgccgggcagcaacgtactcaggattcgaccgcaatctaatactgcaaatcccacacgcacataacgccaaacaccaggtaacacatggatgatgaagacactcgtctcatgtgcagtgttgctattgcagccgttcgcctactccttttttcctgcagccaggcaacattatccgccccatcgagatctgcatcagcgagaaccatgcctatcgtttagcgcctttattgacgacagtttgaaagcttcagaacatccatccgacgaacttccccccaagtcttatttctttgatgcccctaaagctgtccggttggcagctttttcgtttgcagcttacggtaagccttccgggtcccgctggctgcgcctgtctgatggcacagatttgggttttca

SEQ ID NO: 4361 - DNA, 703 bp, Nannochloropsis_gaditana
tagtccttgatgacgctgaagatgccgaagcgcgtggcctgcgcggtggagacctaaaggagcgagcgaggtgagagaagggacggggtggcggttatcagtgttgtctcggtcataatttcgcctcaaaggagagggtcctaccttcaagatggtggggaggaggccgcggtataccccggagagcttctcctccgccacgatggtcctcacaccgtggaagaatccctggtacttattagtgccgcgaaactatgcggtgaagaaagacgagaagggtcaggtaaggctcctattcgggcgtgggcggggcgcgaaggaaagcccttcctgcgacctagacggacctggtcgtgtatcaacttgatcttaatggtctcctgcggtgtggtcacgaagattgcctccatggttcccgcgccaagccccgccaggaatcctttggcttggcccagaccgtacttgtcccctccgttggcgtcagtgagcaggcccgagaagaactcgaaggagctgaaccggattgctgccttgggtgccgcgaagtacagcatggaggaaagcccgcggtagaagccgaaaaagccccgctctgccatcgtctctgatattacttgttttacagacacaggtctggggctcagctgctgcgtcgtcttgacatactctgttgggaacgtactgcccagcgcaacgcagaatg

SEQ ID NO: 4362 - DNA, 703 bp, Nannochloropsis_gaditana
ctggtgtcctgctcttcctccgacccccgatccatcaacagcgacaataacctgggacacgtaccttctcaacacctgcccgaggggggctgtcgtctgcgccacggctgattagtccgccgtggaacgacgcgatttgcagtgataaagaacgaggacagagggtgcaggtatcaagtcaggagcttgctcctctggccggtaacacttgatccgacacgggggcgaattggaacaccccaacaagtccaagaattatgccaggcctgccctagattcgcataagagaagaagtgtaagccgtgtagggatgtttcggaagacattgagcggcgcgccacgtccgagtagaaagacatgtgccggcaggaaagatcgacaaggcagaggcatctcactacgaccccaagtcaaatgccatattaaagcctgccctggctcgctggtcttcctcaaccccgtcacccaaaaaacatcttccgcaataaatatgatccgctttgagtacgtgtggtttgggatactggggagcatcctcattcatttattcagccaggacgcagggtaaccatctcgagtagtgctgccttcaacaggtagatcgtgacagcctgctatgacagaaacctcgcttttttttccttccacgcgatagaattcacacgatttcataagaatattcacgcctgatacaggaagaatg

SEQ ID NO: 4363 - DNA, 703 bp, Nannochloropsis_gaditana
tggccctttcctccagaggccgcggcggcagcgaccaggcttgacatgactccgcttcccgtcagggtgggcatcgtgggggggccatcggatgccgccagcaacataccgtcgcttgcaaccactgaggcccccacaaggacccaggcaatgcatcggagctgcatgacccccaattggctgatgacccggacactctcgggaagttaagggacctggtgctttgaggaggggagttgaagcgtcctttggccaggctctgtccgtgctcaaataccagcctaaaatcggaccagcacgccctccaagcgacccccaagcctgcacctatagagtattgatgtatttaatacgtatgatcatattcgatgggcgtaaaacgcgatgatttccatacaagaaatgcgagataaaagttgacactccgcccatctcgatcctttccccctgcgagcaattcctgcccctcgccgccccttttactggcaggcgcgagaccaagatattgatgtggctccatcaaactaacacctgccgcatgccgtattggctttaaaatattattatgatctaacttacgtcacgcatctgtgtttcatctccgtttctggcgcgcaggcttaggggcgctcctgtttagcctcccctgacctccatggcccgagcaggtcgtcctcaaagccatggccaaaccgacgagatg

SEQ ID NO: 4364 - DNA, 703 bp, Nannochloropsis_gaditana
ctctaatatagtacaagccccccgtttctatgcacggcgacacaagcgttagcttcgacattattacggaagaaatcagtagtctgacaacagacgacagccgcacgtgtacggtagatgccatggaaagttcctcgacgcatgtagatgcaaaaggcgtacgggtcgctagcagcacggaaatcgtggacagggaagcccgagcgcaacgatgtggtggccgaatgcgaaagccaacgcaacggtgggagcctgaagagtctcgttacgacccggtcttcgctgcacagcggaaacgggcaaaaaactaagtttgcaacagctgaaaaagcaaggcaagctggggaaggcaacaaggagggccaagacacgcaccgcggactcccccacctcccactcactcgcctttttaccactcccttgccccgcaatgccgccggcagaatttggcctgcccgaggaatggatccgcctcgtacaaagcgacccgccccccaagtaccgtctcctgcgtcaaaatctctactcccatccctccctgcggcctcgcaccgcggggagagaggacgaggtgccgctctgctcctgccgctccgatgcgggaggatgcgaccacagctgtatgaaccggcagctcttcatggagtgtccagtgggacggtgcccgtcgttacgggacggggatctttattgcgggaatatg

SEQ ID NO: 4365 - DNA, 700 bp, Nannochloropsis_gaditana
cgatacggatactgagagatagcatgaggggaggctttatctcaaggctcttcacgagcgttgtcccacgaggaaaacgagatgcctcacgtacctttgctcatattggcaagaagaaatttcatgccccgtgatttttctgcttccttgtttgaggccaagtaagctcgcaccttcatagttagggatacattttttttattgttccaagacatgttacatccacccagttggaagcggggtaaccagaatggacgaaaccaggaccgaacctcggctacataccttagttgcgttcatactctcctcgaagtagtgggcatctccaaggctactcgacatactgcttgctgtacacgtaggagtgacggcgttcagtacccggtttgtgcttttaacgccggttccccgtcttttgcaccttcgcgtcggctatcccgatgctccgacgggacactttcggttgacgtggaggggaaaacttaaaattacaatgtgcgaaagggcgacagggaaggagaggaaactagaaggcaaagggtggcccgagacgctgggaaggagcagcgaggcctggcgactcgccatcagagggccaagcacgttcccggtgaactgccccccggtcgtgccaatatcttgaggtttgtccacgcttttgttcatcttttactgctttaaacaacaatgcgacaccatg

SEQ ID NO: 4366 - DNA, 700 bp, Nannochloropsis_gaditana
ctcgcatatcttcaggaactcccaacttctcaaaggcgaggtggaagttcatatgcatggatttggcatgcccgatgtgcagatatccattcggttccggaggaaaacgcgtccgcaccttgcctttggtcacttgtcgatgctcttcctcgagtgccggagagttcttggcactctccaactcccgggccgccaaagagtcttcccctccacctcctgcgcctacttcctccgccattacgcctcacgcacagagcgagtggtcgctggtgccctgccccgcgatcctgacatgtatttttaagtgatcgagcaaggttgcttaatcttgtgaacaacgtctcaactgtcgaccaactagctggcatgcccgaccagatcgaagccgagcctgcaggctacccagctagctagacggaggcgagcacgtctcgcggccgagacacctaacccgtttgtaagaaatatgctccctctatcgacataaattgtgagcctccccggacatgacaagattgtgctttgatgcttttaattgatttgtgtcagaagtctcttaccaccgcgacttagaaccaacgattgactgtgtcacagctgagatctactagatctcagtaggaggactagtagccgggaggttgaacggccaacctttactgattcgaccttttgtttctcaacgccgatcaacctcaca

SEQ ID NO: 4367 - DNA, 700 bp, Nannochloropsis_gaditana
gccttttctactgtatgcaaattttggcgcggtctccaagcctcgtatgctcccttgtacagctgccatcatttctttgagcactgatgcctaagctttgcgccgcaggggccggaggctgcgcgagcaacagaaagaagggtaaaagacaaaagtcactctttccctgtgccgggtatgtgatataggtattgaaatattaaggtccacagtaagcttacaaatgcctgagttttgaacgcggggggagggctgtgctcgtagtaggaaaggggggggggtctgggggggaaaggagaggaagcaggcgagtcacgacactagcataggccgtgaccataacaatgcctccattcacacacattgcgccgctccctgtcatatttcctaccatcttcgcgagtcgttgcctgcactaacatatatgtataatatacacatcccggttccacatttctgcgaactttagccagttcggccgcagacagtcgcatacgtgtcccaccgagacctcctgcataccaacatgctggttcgtgccttgctccgtactggcaaccgcggcactcattgtgcccagcgcgcacatggtacgggccaccctctcatcacacgctgtgtgattaggagaccagcatcaccgtctcttgcaatgctggcggggccagccggatgcgcttctaggagcatcttcagtatg

SEQ ID NO: 4368 - DNA, 700 bp, Nannochloropsis_gaditana
gagcgagagtatagtccatgtcgaacccaatggcccggatctgctgcatattgatttcccggttacaaaaaacttctgtctcaccgtcaagcaagtacttgtcatccctgggcggactgccagctgacattcgtattgaacctactgagaaagtaggaggagacggtagctgcaccgacctcctccccagcaactgtgaggcgcggcatggagccgtgaaggcttgtacggtcagtgatgcaatgctggacaacaccatcaccagagtgaactgccatgacgcttttgcggggaagagagccatacctttccggctcattaccctttgaggcctgtcgggcagatcgagagagtggaggaatcgcaagtgaggggcccgggcgtgtgatatgctcgatctaagcgtagttcgtcccgttgggagcagacgaccctcgaagacataggtagccacactttctcgtccatcgacccgtgtgacagtggccttcgaaagcgggtcagcacagaagggctaatcgtaagagggagattcaagactcaagagagcgtcgcttccccttcgtgcctatcgcccgcccccttcagatgctcgccattttcttcacttccatcctacggacgttctgaccattccatccccacgctacttgtacccacataattgaaattagaattcagacgccgcgtcacaaagatg

SEQ ID NO: 4369 - DNA, 700 bp, Nannochloropsis_gaditana
ccctactcacctctctcgcacacttttctgcggcaagttgctgccgcagtgcctctcgctcttcaagcagcaggagaacgtcctcaccctcctctgcgacatgttggtagagcgctttgtagtgcgcctcatttggcgcgtgggagggcagcgaggcagtgtagtgtgatcgatcctcaattcgtggcacggcagaatcagaagccaatgcgtcccgcactctgaaagcctcttggtcatgggcatcctgctgaatgctctcttcttcacccactgacactgaggatcccgtctgggcagatatattacgcctctcgaaaggaatatgtcgagacgccgatcccgcctccatagtagaaatgatcaatattctaaagtgttgcgatcttactttgccacgactgcccccatgctgccttgcctaccctgccatgcactcgcttgatcgcttcgagaaattgtgggattttgagcgtgagaaatttgtcccgtaattccttgaccttggcgtcaacttaaagggcgaggcgactgcttcaagaagttcggaagcgcctcgcttctaacgccgagggcctgacggctcgagttgcaacgcgtgtttattgtatcccgtgatggcgtcttgaaacgagatttccccctcgtaaattacaaaaagctccctaaattttgctgccacagtaattccattagcatg

SEQ ID NO: 4370 - DNA, 700 bp, Nannochloropsis_gaditana
ggtgtaacctccgtcctccttccgtgagctgtaccatgtaaaagcgcgtgtgtatgttcggggtgtgagcgtgcgtgcatgcggcgtagatcaattggaacgaggaaaggatgtaacgactctcccagggcctctcggagctagcgcggggatagggccaggcagacgtgcggccggggttgagcgatcgagccggatctcacgccttcctcgtctttcccatctctggcaatttaatgtccgcaacaagcaggtcgcaggacctggatcctgctgggcctgggaatcaagaggagacggggcacacccggcaacttgggcgccgcacctcctagccactctttgctccatgctactcataacacacgtgggaaaggaaggaaacacaccgcctccacagcgcccttcattacatacaatgtggtgtctgcgttttatgacactgtgcatggtgcttagctcgctttgcctcagctgtcaggcattcctccccacaccagacaccctttctcctcacccaagcattaagcagtatacgaaaagtctcgagcggcacgggcatctgatgctcatggatgagccgccacatgaaggcactacaagctggtcaccggcgctcaccagacaaaaaacactatcacgttacgtggaagtggaaacttggaaacgcagggaactgacggacctccagcctgtcatg

SEQ ID NO: 4371 - DNA, 700 bp, Nannochloropsis_gaditana
ataagagaggcattgaagggaagtacgaacggaagaagaaaaaaacccatttcagcggtaacatgcatccttcatggtatcacggggattattgacggcgctataatcaccacttcgccacaaagcatggcaacctcgtcgacttgggccgggcgtcagctgtcgggcggtccgaggctgtgtcgcggaagggagggacgtgcatctcaacaggggcccggctcaatatttccagcgcacacgaacactggtacatgcatgcactttttgcacaaatctgcttgacaaaatatgtgggtggtgcggttctttacttgtttaatgaggaccagcttattgtttttcgtccccaatttccttataacagttctctggagaacagtcgccttttcctcagagcgtccctaattttcgttttaacaaacataccaggtggcacaaatgatataaatctcaccacctcatgaaataaaagttaggatttcatatgtgagccacatttttgtacaaccttactcattatcggttttgacattttttcgtgctttctccacgttcgactcatgcagcagctttcccttttgtcaacacagacatctgcatcatgcgtctatttgctcggcggcatcttctttttgccgctctagcagccgttggaatctttcatgcaaacgcacagcaaacttttttgcggtcaatg

SEQ ID NO: 4372 - DNA, 700 bp, Nannochloropsis_gaditana
gattcaaacagacaagcagacgactgcagaccttcgtgcgcggacatgcgagaggaagagcggtcagaaaggggcagcgagggcccgagaaagcgcggccgctgtcacgcgggactggcacgagagtatggagactcgctcgggagggagagggcgaggcttaggggggttactccctgccctcgtggccgcgtccgggcgaaaatgccattttcagggctggtttttgtccgctgctggtgcggttgtagtcgtgtgcgaagtatgacaatgcattttgtgtcgtatcttctattggttcatgaagaagcatgatctcagccgacgctttcagctcaacttgctcgaatgactaatcctcattttatttttttgtgggaaatgaagctctgtgcaaccctgctgtacctacgttctcaacttcgtttcggtggcttgagaggagggacgtcacttcagtcctttccgcacttttgtgtcaggtagctccacattttccgggaacaagtaacttcgacgccgacactggatggaaaatgacaccggcaaacgcagtctggatggacctgcgcctgtgacaaactccgctataacagcccatcctttacgattttgtctcaccttgttggcagaggaatgcttaaagagcaaccaatccttgcctccctccgtcgacctgtcggagctgcctgtggcgatg

SEQ ID NO: 4373 - DNA, 700 bp, Nannochloropsis_gaditana
cgcccaacgcttccttctgcacggcggtcggccttatataacccaggctctcaacacgcgccagtaaccatgatggcaaacggtcgccgtaaagctgtgagaacgtctctgcggtcgtcccgtcgttctccgcgacatgcatcatttcttttcccgggggcagcgcaccatgaacctgatttgtcggtcgccgtgggggcaagctggaaaggaaggcagcatggcgaagagtgtggctcgaggaggccgaagccgtgacataaagaagggtgactgaaaacaagagagtttcacgttgccatagtctggtgctgcgtgtccgattgctaggagcgcagtcatggcgggccatgcgggatgtcgctgttgcagcaacccaagcttgtgacggagggtcgaagaaccttctcctagcaacccccgtggcttgatatcggcatacgctgccctgcatcaaatatgtgccgtatgaccaagaaaagattgagatgatgttggtttcgggagcatcggtggtacaggggtggtgagacagactagtagcgcgggcgacagcgaggttgcagctccgcctctccagtactttgaaggaatccccccaacctctttcacccacgaccacagagcgataccagaaacgcacaattgtctagctccaatcgcatcagggtagaatcttgacacgtggctcgtccaaatg

SEQ ID NO: 4374 - DNA, 700 bp, Nannochloropsis_gaditana
ctactacacgcgcatgaaggatattttttctgatgacacacgtgaaatttccgagacgtgtggagtgagtttggtgacggagcagcatcgtcatcaggagggaggaactctcccgttccacgcgcgaaacgaatctcattttattccatggtccaaccccacacttttccatttgtagaaacacacgcctcttcactccatttaacccgcctctcggcgccttaagagccaggtgcagagggtgaggctcgagggcttactattttatcttccaacattgattttgcaacctccgccggttcgtcctgcggaagtttagctcccacacacagccatgcgcgccgcccatgtatccctcgcttgcctctcccttctactttccattttcgccctgaccgcaactggattttcgacataccccggacaacttgccggctttcagactctgcctcaatcgaggcgccattctcgcctcattcgccaacaaagaggcctccctataacggcactgcgggcaggtgagaattccggcacttcgtccgaggccggagaagctggtcgcggtttcggtgcaagcgtgagaagatcgagtaaaaaggaaggcggaaggagcagcggattgcgtcctcgcgcgccgaatgctttctcctcaataggaaagtcagtgcgccttcgagggaaattcggcggcggtccgatg

SEQ ID NO: 4375 - DNA, 700 bp, Nannochloropsis_gaditana
ccaacgcttcaaagtgtgtaatgtggataaccttttgaaggataaagcgaccgtttttgtgaaagaataaaatgtgtcgtcatttgatgcgtcgaataggcattgaaggcacacctagcctggcgctggcgatgtcctttcatgccgagtcgggggagggggattcgtgctcagcgccggaatgttgactttggaaggattacattttatatcacatggtctctacttctgtgaactagtcactgggtggtggttcattgcgaaaatttgaccttcaaatacctgtgcttcaacgcgaaaaatgtgccggcggttcgtcatcttgcgtgtctcgctgtcaaggatcgatcaggatccaaggcggatccgcccggatcagggtaaactactgattagaacgattcgggttcgtgttcctattcatcacatttgtatcacaaaaatgaggattggacggagtaagggttgttttagaaggccatggtttgctcaccgcatagctcagaattgctgcctctccacttgagatctcccccacatttctacccctctgtatattttaagtttgcgaaacttaaaagatacgaaaagtactctgccttaagttatcagcgttagattggggcaatttgcccagcattaaccaattccttctttctgtcaaacctggcattgcagatacagctctgatgagggcatg

SEQ ID NO: 4376 - DNA, 700 bp, Nannochloropsis_gaditana
taattaattcagtggccgttctggaagcgctcccgtgggctttgtcacatcccccgtacaccacactgccgcccttagtaagtttggagggcgctgtcaaaagcgatttggcccccctcaacaagaccttctcacttccaggtttcaatgcgatagggacaaggcctggactgcgccaatcagcattcattttacaagggtccgaggtaacacgcttgttcatgttgcatcatggcactaacattcattcaggctgagaaagctggttcaacatattcaaggtcctggcaggcagccactctcttttcaagtcagccacccctacttgtattgctttgcttgttggataaaggttgatttcggaaagtttttatgtctgatgcctttccttgaacagtctcatgaacgtgaggggcagcacgcgccgctctatttctggaaagaacaacattcggccaccatcgctgcttccaagcagctacatatgctaacgaaacatagtgaagagaaacatggggcagtggagaggagtctggggggcgtgattgtgaaaggggtacgtatttatggtatcgagtgaacatttttttcatgcaacaaggatgatcgatactcgcttttatcgtaatgctagttcaaaaaagttggggccgtgggattggccgtggcattgaccggtatcgttcttatcgcgggtatg

SEQ ID NO: 4377 - DNA, 700 bp, Nannochloropsis_gaditana
cggaggacaaaggaggatggagcggtaaagcacaagcaggcagcacttataagggttctgctcaaagtcggaagcaacgggggcattcagccacgcaacctgaatcgagagtgaactgatatcaaattgaagaggagttgtgcgacctgcaagaaaaaggaacgaaccaggcggaagcggttgtcctctgcaaggggacaaggaagagagaacgtcaaaattgggcgaggcacttgcccatccatgtgactcagggatgtacgtgcctgcttccttacatccttccttagaaggtcacacagccatcctgatgacagtgcttcgtctccatgtgcgacgaatggctactcaccaacctccccactcgcgacgtgcattcctctgtacctgtaaggatctccaagacgggaccaaagagaagtgtggaacggtacgtatacactagctactcaccaacctccccactcgcgacgtgcatccctctgtacctttaaggatctccaagaagggaccaaagagaagtgtggaacggtacgtatacactagcaagttgcgaatctcatgcatccatacgtgagagtcgccagtacgactgaatgaatgacatgaatgacacggcatcatacgtgaataatagtactggctcacaacgaacactctgcttaggcctggatagattgaggcaagtaagacggtcatg

SEQ ID NO: 4378 - DNA, 700 bp, Nannochloropsis_gaditana
atagcaagtggaaattactatgcaagtatacctaccacccaactccaaaactcgcagacaatgcttgcttttgttgaagagacccttttcttgctccaagtaccttttatggatgttgttatccagattaggcaacggggattaatgaaaaaaaacacccacgcgtacgttcaagcaatattcagccataccgagctagcactaggcctgcactccacagcgtcgacccacagttgtatgatctgcggctctgatgtaggaccaacgtgtggtggcagatatctagcgtgaccgtagtctcctcgttttccctggtcatctgcgtgaagtctcgtgtgagttgggatggagcgtggcgaggaccgtgactccgttgtacgctcgagcaacctcctggctgcaggtctgtccctccctgcatataccagtggccgccgcgcctcctgtcgaacatcccctgcgactacacgtcgtgccccctttctttttcatgtcatgttgtcggtatcgtagctcccaccaagacaaccatgatatccagcatccgtttcacagcacttttctttttttgcctcctatcatgtccaagtgcgttctcttccgcctccttgctcgtctcacattgcactgctcgtgtggcatgtacaatatcaatcaatccaacttttgtaccgattagcaggtattgttagaatctatg

SEQ ID NO: 4379 - DNA, 700 bp, Nannochloropsis_gaditana
ccatgaaacaaagcaaatgctgttaacaagtaagaaaaatacatgactaagtggaacgagagcatagggctatattttgacggacgtggagaagtgtctccccatttcatccctgcatgcctaccacaaaatcttacccgctccatgacttctcaaggcgttttgaaaggcactggcctccttaagctctgcttcgactcggcttcgatcgatgtccatcccactaaaagtgtgaacaatgcccagagggctacgacgggtcgaatgcatcctgttggtgaaggcctgggagctcctacaaaacattaagaagacaagtaaaggctcccacatgcaactccacccacccaatcaggcctgtgtgaaggagtagaatgaaagaggaaggagtagaatgaaagaaacacatattcctgctatttaatacctcacacttcgggattcacgatccgacctccccagttgcctctccagcctggtgcatgcgtatcgttgcgcggacgatgctccgacgtcagaggtgtggtcaatcgcagtctctggccgtaggcaattccacggcctgcctctgaaccttcatggatggacagtgtctacacggtttggtgcgaggggctccacatctatgccccatgcctccggcttgtggtttggaaactcaacctccctcctcaattttcgaaatggttgtcactctagc

SEQ ID NO: 4380 - DNA, 700 bp, Nannochloropsis_gaditana
ttatccgtaacaccaccgagtagcacccaccttcttcgcagctgccggtgcagcatcgcctcccgcggctgctggcgccgccccaccgccacctccaccgccacctccacccatagaaacgcttttcaacttttcctttccgtccttgagcagctcctctacgtccttgccctccatctccttcagcaagagctctacctgcgcggcatcagcctcacctcctgcggatgcaatgacagaggtaatgtcatctgcactcgggtcctttcctccaagtttcagcaataagtatgaggccacgacattcatgattctgtgggttgtaaagaaaagtaagtttgccgcgtgaggtatcgctggcttgcctccttctttctagcgcagtaaaacattgtgaggctatcactgaaagggcagctttcacaccttgtagcgtcatcgacacaataacgcaacctttattaattaacatgccctgttgaccaaactcttcggcatctgcggagtagtttcgctggaaaacagtggtataagtgcccagcaaatgacggccacagaggttgtcgctcctcaggcgcagaagccgaaacgcgggccatagtatggctcacgtgaaagcaagagacaacaaacattgtaaaggtagaagtcaacacacaattcatacgatttcatacattcctctcgtctttgttcgcag

SEQ ID NO: 4381 - DNA, 700 bp, Nannochloropsis_gaditana
caaaagtgatccacaggcgcctgcttgggagtgttgaggaggtacgtgaggaacgtctcgtgatgagcttcgaaattgacccgagcaagcaaattttggagataactttcagtcgcaatcgtgctgaagcatacattactccaatcaaattctatgccagacaaagcgagacgggaacggaagacaaagagaaggctgtggacagtcggtgccctcaaaacagtcggaaatgcgccatcctctttctcgactactctcgaagaccgtaagaatgcatgatcatgggaaaaaaaccacacgtcccgatccccaatcctctggatatagtttagatttaaaggaggtaattggaatgcatttgtgaattgtccttggatggtgattcctgcccagcttgactgccaagaagacgagaaccctcatgaggaaacgcggcaaaaacatggaatcgaaaagaaaaatcatcgccgcgagccatccatatgcccatgcgcgaggtccgaaggataaagcgcatgcctcgctgtgtggtgatggagaaccaggagtgggcagccagctaaatctttgcggcccggcctggcggggggcctcgcttgaacgggaggacgagcctcaaggaaacttacgtgttgctcgccccggcctctgaccccgtactttctccacggaccaacccacaggcagagatcaggagatg

SEQ ID NO: 4382 - DNA, 700 bp, Nannochloropsis_gaditana
ttttgtgatatcagaatgacataaaagatacaacctcaacatttaaatgtaaataatgacggtgaaacaatatatatatctcaaagcagtgatctggagtaagtactcactcagactggaaaagcatcagccaagcaagtggcatgtcagaagcagtcctcaagaatattgagaaagaactgcccaaactacaggctgagctagcaagtataaaagaagctgcacccaaatctgaagctttggtggatcttatcgatcatattgtcaaaacgcacgagccattttacgaaagtgccattcccaaaaacccctggctcaaaccggccaccggcccctgctgctgtttgcagtaaaacgaaagacaaagtcgataatattcaccaaggcataacaatccaaactgaaacaataatacgagcatcaaatcaaagaggagggaattccgatctcggtctatcgacaagccgtcaaggaaagctccgttttgtgagaatttcaagcggcagagctacatcttgggtctcgcggacatcctctggaataaatctgtgcgcatgactacataatgtaaagaaaacgacaaattaaggcctcaaaccgagtcatcatggcattgaagcccacgcttgactctctgccttctatccttttgtcccgtaccctgcgagagacttctttttccgcgaaaacctggtcgctt

SEQ ID NO: 4383 - DNA, 700 bp, Nannochloropsis_gaditana
tgattgttcagttgagcactggcgacgttcatcgacaggatagaggttaatcgattgatgtagtgagagaagcaatgcatcttcagcattggagaaagaaagcacagaaatgtggtgcagtgttggcggtgtattaggcccgctcatactcatggaaagtgaggacaggcgaggactgaaacgctgttgggatgttcagcaatgctgggggtgcatttgaacgaagtctcaaagaagagaataaccgaacacaaccagcatccctcaccgaagttattttcctccacatgagacttaagtctacaaaaaaaatggcgcaaccggtccattggcatgttccacattagactcagtcgattgaatacgggagcaaagggtccacgagcacgttcctggcagcaccaggcatggggccccaccgccgaggcgcccgcaaagctacccggagttggcgagtgtaaaccctgaaactaagtccgcttccctcacgttcgtacacttgcctgcctccctttgcgtgccccgggcatgggacacgacccacgcagaaatttgggtgtagcttggagagcacgtgaattgtggcggatattatccatcgccttgatttatttttggagcccacacacactcaccgtagaggaaactcgcacctcgcgccaagcttcctttcccatcaccgacaaacctcgccttcaca

SEQ ID NO: 4384 - DNA, 700 bp, Nannochloropsis_gaditana
tggggcaattgtggcttgctgcatattttggatggccccccttttctccttctggacggaaattctcttcctcccctaccttgtttggagacgtttacagaggctcgtgtactctattgaaaatgcaaggaatcctgacgtgtcagttatattcggtacactttgagtgcctcagtgccctggcggaacaatgcggggcggggccggcgctgtgacagtgtgtgtccgcacactcgcacggcctcgccgccacacatcacggagaaagaaggcggtctgcctgccccgcgtttggttgccatgccgcctcgtgcggacttggatttttttacactctgtgtgttcaccacatgacatctgtgcatttgcgtctatggagatgctttgcgtggtatgtaaatggctgggcggggctgttgcctccctaccctttgccctcgccgaggaagggtgggtgtggtggatggcgcagtcacgtgcagcctggaggtgtcgcacttccatcgtgatccctctactcgaatgttacctatatgtgtagtcctatgaggggccatggaaggagtggaagcttaatttgtccgggcatgccactctgtccctcgtttatctccccacccaccacctcccacgcaaacgcttttcccttctcatctcttattttaaaggaggccgtagctctttacacactgccaccatg

SEQ ID NO: 4385 - DNA, 700 bp, Nannochloropsis_gaditana
ttttttcactacatcttgctactgattggtactagtagttacaaggaatagtagcagtaacaagcttacaggctttaagctcgtttactttgtatcttgtaccgtgatattgtcagcacccattcaatatatgggttacgtatacttacactttgttgttgcatgttctgatggggattcaacgggctcgtcgttcttgaattcagccagggagttactgacatggtatggtatgtgcccctgagcagatcgaagggcgggctcggacatgcacgcataaatgcaagcatgggctcaacaagtcaagccacacacgggggctggattgtggcacagattatgtgcccacattcaactactttctcagtcgttgtcgcacggaagtggccaggttgtaacgattgactggcggatggaagcctacaagcgttcacttccaggcttaagcgttgcctcctgccttaaataggtcgactgtcactacattctctcgcttttccatttctgctcacgaattaccttgatttctatttccgtatgacgcaggtgttttgagtgtgataagatatagcggttgtacgcttgatttagtgcaatataccgaagtaagggtttccgaagagagtctgcagaactagctttagagggtgcgcaccatccatcgtctttcacttcaattttagacggtcacacccccatg

SEQ ID NO: 4386 - DNA, 700 bp, Nannochloropsis_gaditana
tccgggacctggttcatcgacgcacgctctatcctttgtgaagattttactcccaaatccctctcttccgcgcagagaaaagccattcgttgatctgatcctggagtcagccacatgccctgacagagttgacttcagattgtaagcgccaggtcctggcgtgtcgttacccgaatgtgaaggagcaatggtgtcacgtggggaggatccaaaaccaaaagatggggtcgcgggaaatattcctttgtatgaggttattatcttgtcctccgccatgttgtttacactggtcttagccatggctaggggtagatgtgcataagctggcattcgttttattttgatcggaagttgctatttaaggagcgtgttgaagttcaataatatgtgcctacaaggaatgaggaacgaaatgcataaatcgctcgcaaaacaaaggaaacgtagcgttggtttttaaaatgcgcttttccaaaggcggaagccggcagggaaagcctctcaacggccggaggtcgtaacggtccgttcccgccatttcccccccaggccacaccgcgcgagccttgttcttcacttccttctgtgcccaacatgatcgacaccgtccgtggttttgtcacgcacgggcttaacgaaaaagtgccaacccatcacgacagattgtaagcatctgtctagaaaattggccgcaaggatg

SEQ ID NO: 4387 - DNA, 700 bp, Nannochloropsis_gaditana
gccagaagggtgtccaagtccttttcactcacggaaggccgcagagttgacagtgcctccaggaagtggcggaactgaatgggagggacgtcggcgacagcaagtgcagtgatgtcgccagccaagcccgcagtcatgtcgcggatgggtcccatggccgcctcagtgcagagctgatggacgtctgagccgctgaaaccacgggagcgcgtcactacctgctcgatttcctgcggggtaagctggtggttgttggtgcgcaggagaaggacaattagagcatgtcgagcttccgcctctggcagcggaatgtagagccgcttcacgaaacgccttctcgccgcctcatccagttcttgcggtcgattcgtcgcgcccaccaggaggactcgcgccgccgccgcggcgctgccacagccatcgagctgaaccaggaactcagttttcatgcgtctgctcgcctcgttctcgtcggcactgcgctggcacaaaagtgagtcaacctcgtcgatgaagacaatggacgggctcatgtaggccgccagccggaagagtgtacgcacgagcttctctccctccccgatccactttgacgtgagggaggaggcggagatgttgaagaaggtggcccctgactgatgggcgatggccttggcgatgagggtcttgcccgtgcccggtggtctgaggtgtgtggatg

SEQ ID NO: 4388 - DNA, 700 bp, Nannochloropsis_gaditana
gggtatcaatactgtatgctatcaaccctgggtcatcttcttccgtttttattcttctctgccatgcctcttgtttctcctgtttcccaatctgcccctttcacagcccatcataatccccctatttctttgcgctaggtcggtagtcaaggatgaagggcttttttcgctttgccgtaataaaagccgtgagctctagctgcttccctcttttattttctacgacgccctcttgttctgccccaacacgagatgttatatcaagtccatggcgtcctctaccagcgtatcaaacattatttcaacgtcataacacgttttccttgatgtcccacaggcttgcttctgattatttgaactgatcggcaacctcctggctccggccctaaataagtgcagactgccgctgaaggtcgcttgcaggagatgacatgttttgtcaaacagtgttgggtaatatcaggaatttaattgacacgtgtgcattgcgaagtcgtgtcgtacacctttttggaatcctccaatccaatctttgacatgttctacgagaaccccaggggcctcgccccgggcaacggacatgactttggcgactcgtcgactagaagccaagcctccctcgggctttctcgctgagaggaggaaatgcgaaagacaaggtggcgcctcatgtttgacacgacgttgggccctccacaat

SEQ ID NO: 4389 - DNA, 700 bp, Nannochloropsis_gaditana
gacgtaatgtagattctcttcgaaaaatttgatcctgaggtggggtcgggatgcgcgggagggctggacagcagagatgcaggacagctcggggtaattgatgtacttcccttatatttgggacggttacccattagtttcgtgacagcatgtttcacaaaaacatgatgttcggttgcgaaacgagtcaggggcgatgggacgttcccgctttggcatgtgcgagatccgagcaaccttaaagatcgaagaactaaggagtgagtataaattgagccttgtctgcaattcataccatcgggaggctgcttcgtctccgccaccgcgaggcttttttctaagcatgcttaaatgcaacatggtcgttttttgtatttattgtgtttgctttacggagtgcctgctttcatgaaagttttaaagaacggggggggaggaggttacaaagttgaggatcgaagccacaacaagacagagcacggggagtagacagtgaaaggatgaaaacggcaggcgggcacctgtgttttgttgctatgacatatatcaagactttgcgcaattgctggctctttcataggtccatacgacaggaaagagatttactcgggggtgcgtgaacctcgcaacttgcggcacactcttctttcctcttccttctttgctgagtgttttgagccattactatctctttctcaat

SEQ ID NO: 4390 - DNA, 700 bp, Nannochloropsis_gaditana
ttattgctttagggccgcgggggcgggaaaggagtgtaatagaagcatttgagagtttactcgaacctcaaaaagactgtagataataactttgtaacaaaattgagtaaagtaatgtattgaagcgagtaaattaccgaaaaatgtctttttgcgtgtgtttttgcttcgaatgaagagttgtttgagcagctcgacttccccggcacggtcgctcacggccatgagcacaaggccttctttcttccccccccccgtcgcatcagcatgcacctgcgtgcctatgcttccacgcacaatcccataagccatgaaaatttgggatgatgtaccgtctcgtgcaaagcatagtagagtccaggccgatcgcaactgttcatcggcaagctggatatgatcatctccctccctacagaccatcatgcatgttgtcttacgtgcctctgattatctggccagtctgcactattctcacccacaccaccgcatgattaaacagatacttccttctttgggattacagcagcattgaaaacttcggatcaggacgtttgcacgattgtaaacgctgactttttgggtgcggatagcgttggtgagtctgcccgctcctcttgaagtgaagccgcaaagcgcaacgagtaagaataactcacttgactacagcataagctaactgcggcatccgagaagcaccatg

SEQ ID NO: 4391 - DNA, 700 bp, Nannochloropsis_gaditana
ttgaagtccttcagtaatgccctttctgttggatgttccactgcaaaagcagccttcacgcagttacgtagagtttaagctgtgttggagttggacaacacattgaggaaagaaatttcggcccgtctgagttgccatcatatctccccattcgtccctctctacttgccagggtacacccgcatctcatttagttgggatagatgcagatggttcgggcccggcactatccagtcgtaatcacgtcacagtttcaagcgcgacgcgtcacacttctacgcgcgtcttccctctccccgtggacaagaatttctccgtgcggcgagcaacaccaaaggctacccggagtggatacagccgtttcctcttaaatgcccttaccaagacacggcagccaagggcaatcaccagcgattgaaagaccggcaaattcccattcaagccacataagtcgcttggatgttttttgactatacgctgttgtcatgcttgattttttccagctgcggtggaggccaccaccataacgtcttttttcccgcgcccgagcgaggcaaaacgcccagccgaggtcgacttgcatgccctcaggttcaagttccactcctttttccaacagattctgatccatccgctctaccaatcaaccgcgacttttcgcgccgcgacacatattttattgcattacagggcgcccatg

SEQ ID NO: 4392 - DNA, 700 bp, Nannochloropsis_gaditana
ggcgacttcgctaaacaaggccacacacagagagcgtggagggagagagaaactgtgcccttgtcaatctgacggttaggtcatctctgaaggagtaatccggcatgccgtattccatctgttgcactttgagttgaaaacaagcagatggtaatgacctgctgtcgctgtcatctcccacgtccaacgggaaagcgatccggccgggacaggtcatcagacgcacaatggtaggtggagtgtccgttctgtatgcgcctactgttgattgagaaccattttcaaatccagagtaggactctaagatatgagacggggaaaaatgtgcggctaatgatggcaatgggggtgggggtggaatggatgtcgcgggcacgcgcacatcttagggaagggcatttgtgtgcgagatccctggagctcggtaatggtactcgattcgatgactgatgaaattttacaaaacaaatactgataattgcaatgttagtcacatgatattgggtttttgctcttcttcatagatgtaaatcatctgtcgtacctttaactgcgcggggtacttcaaattttctttcttggacaaaataatttgaaaactccacatttatagggaaaaaagcaaaaaaaagtgtgtggcggcagcgatggtgatagaagaaattgatcggatagggtcctgttcgaacagctgtgtatg

SEQ ID NO: 4393 - DNA, 700 bp, Nannochloropsis_gaditana
tggcgggagtcctctgttgtcgccaaggaaggatacatcataatgatgctgacgagccgtagccgtattgctgaaagcgccgtcgaaagcatgataatgaccactcgttcccttcgcacagcgcttcactcatacatttcgttgtcttctgttgcaacatacgtggacacgaataccttgattgtgtccgattaatacaaaggagcaattcgtactggctttggtcgccttcgcccccctccgtccttgcttcaaggagaggagcctactgaaacccgttgcccccggattttcatatcgcgtgcaagattttcaatcctcatgcgttttttctcagggtgaggggttaaaagtgtgaatacaattcgcgtgataaacgttgcagcatacgttgagtggcgcgacgtttgcttcaggcggcattatcatcctcatctgagtagtgaacacccagcaccacaatctctcttccacacgtttctcctctctctgtacagcggcattgctgcacgggcagcacgcccttcgacgcagtctgccagtaaaaaggaatcttctgcgtgtgatttgacagatcgagatcaaaagataggacccccgcggccagacgcagcaagcaaagtgcggcttgtcagattgaagcgcgtggggccagcaagggtggtgtgaaaaggcaaacacgactttccctcataaaatg

SEQ ID NO: 4394 - DNA, 700 bp, Nannochloropsis_gaditana
atcggaagatcatggccccttgagacccgaaagcgatgcagacgaaacgaataatcaaggagaatccttgatgtaattgattctcaacgtttgagcgacaaggatggaaaaaaataggattagataaggaatcatcacctgctcgcaagcgctgttacatgaagctccaagacacacacaactgttcttccgatccagtgtccgccgtgacaaaaaggatattcgaatatcaaatggacaaaaaaaagccttggtatgtttattactcgtttcaatccgctcgacgtctagtaagctgggaactgctggtcttcttcacgcgcccaacacgcagaccatgcctctgtctccgcgctttttattcccttccactcctagaacaaacaccgagcacggggctttgggatagggtttctgaacacctgaaaagacacctggacttccgctcgtcggagcatacgaagcacatgccaataaattgcgcgacatggccctgaagagccccccccaaaggtcttgtgtcactacgtgaaagcggggaatgcgcttccattctccccttgctcccgtttctgctcggctcatggtgtctcgccaatgcgtgccatgtcgatgcacgtaagacttgtaaagaacacgcccgccaatagtgcctgataagtctcacacccaaaaaaggaacagacggcctgccttcatg

SEQ ID NO: 4395 - DNA, 700 bp, Nannochloropsis_gaditana
ggaggatgcacaacgcgagcccagacacgggcttcaatggaaggacaaaagaagaggatgaagagcgacaggataaggagaaacagcagattgcaaggcggacgcggcaggcaggatgaggaagtgctgcaagccgttgggggggccctgaccgccccttcaaccccaccgggcatcaaaagaggcccgaagacaatatctactttcctagaaaagccttcaaaacgtgcaagcagtgttatgagtaaataaatcgagttttttagaattgcggtcagtgacggcaccggtattgctacgaggagcgatagagccttccccattccatgacgcaacttagactctgcctttgacactttcgtggaatacattatcaccgatgcacactcctccacataataatactaagagcacgtatattcctgtagtgagcgaagcacgccccgtttcatcgaacaaagctgatgactccctcctccctcaaaaagactcgcgctctcgtagacggctggcgacctccttctgtgtggtgctccaccacccctagcgtgtagtaatagtccatcgagtacatcggccccctgacatttttgctcctgtcatacacagatccaatcgtcgcacacattctagagtgggcagtcggcgtggacaagcgaagtattgcaagaaacgtgccctctttcggacagcaaccatg

SEQ ID NO: 4396 - DNA, 700 bp, Nannochloropsis_gaditana
ggctagatctgtgaccaattccgtcaatttattcgaagattggtgggattgggccatcgcggcggacaatttgatgcgctgtttgtggggacgatacacgcaatgatggtgaccgtgacgacattcagcagcctaaaacttggctaaaaaagacaatgcggctaaaatcggctgcaactcgagcaagttccacgttggcacagtgagatcgagacagtaagagggcatactggcataacgggtgacaaagcgtaaaagtcggccagagggataaatcctccccagcttctgcaacggagaggctctgggcgacgatccgttgttctctctcccatgatcctactgtcatctaccatcgggttccgaggccaattccacttccacacgacacgtcccacctccccgttcgcacggcattaaaaaatgtcgtttatggagtgcatggcccgggttttctgcccgggttttccaggctgcatgaaaggcgcatcctttcactaggtattggctatagtgacgtccacccttctcggaagctcgagaagcgcgccttggcctaccaagccacagattcgccttgattccaaggtcccgtctgccatgttggaagcctcaatccacctttttttaatatatgtacccattttatcattctttcagagcataggaggcggaaggaggcggcaaaacttcacacatg

SEQ ID NO: 4397 - DNA, 700 bp, Nannochloropsis_gaditana
tgagctcttggtatgtaaagtcttcgtgtatagcaagctgtgatcatgcattttcaaagtaaatttaggaagacacggtagaaaagtaaactctcttgaatgctttcaaataatcctgtgtcgcgcgctcgttggcaggcgctctcttgtctaagttctcctgggaccaatgatgactatccactgtaacggcccgacacgctggggggcggatttgtctgtaaaatatcgggccgccgcgccaaatgctcttcgatcgtcgtttttcgatcggccaagaacgtttcacggagaaaacttcgaaaagccggtccatcctgtccttgtttacgagcggataggacacagtgccgcaggtagacaggacagggcaggattccgctctccggcccccactcatcccagatgctattcaaaccgtgcacaccatattttcttttaatatacccttttccccaacggtcctcaacatgagcatccgtcgtcgcgagacacataaggcccttccctcttttatcaccttcccccaattccgtgaactctgccatcgtgaaggcaaattcttcttctcgatccaaaaagtcttgcaaattaaagtgcatgacgtcgaagagactacatacaaagccctcctcaccagtagcaccctcgcccacgtactccacgctcaaactagaaatttctttagtctcagggcggg

SEQ ID NO: 4398 - DNA, 700 bp, Nannochloropsis_gaditana
cgtgccctctccttcgttgtcgttgctgtgacggcattgtgcttctgacactgtgtagtgggtgtcttttagcggggaggacttcctgaagtggagcgtcctgcgagacaggtaaattgaagggaaagtgctggtagtattccctgaccactcaattgaaactgcacacgtatccttcgcagtgagtctctactctctgcttggccgcctgtgtgtaaattgctggtggtgagacgcgtaacgaccgcgcagaccgccaagatcaggcacagcacagggtacacagtgaccgtaaagttgctcctcagttacatgttgcctgaagacacgccaatgcctatcatgatacgacgtcattgccccccccccaaatcatccccacctccaccgcaagccaaccaccaccatcctcccctttcttcttgtctccctccggcccgcatgcacgtgacgtgccccgggggggcacgcggggcaggaatgcgggacctggcttgtcatgtccttgctctgtgtcgccgttcgaggggggcgagggccggtccggggccgtgacttttttttcaagcccccggggggggggagaaaagggggggaaataaaacacactcgaggtaattttccaggcgtgccgctagaccgtgacaagtgtacgtgcatgcttgacaggtgtttttgcctgcgggacagagcagccatg

SEQ ID NO: 4399 - DNA, 700 bp, Nannochloropsis_gaditana
actttcatcacttcgtcgcatggacacagtccaacccagaggaccgaatcaacacaaaaccatgccatccatacgtccacgacagcccatgtactctccaatgatgccatggtggcatttaaagtataggttttaggccaaaaaccgaatttccgaacgtgcctgcacttgaaggctcagcgcacctccctcgctgcctcccaggctggcaacatggccgtagggacactaaaaccactcgaaccgcaaggacgcatgtttgtcagtcaaatgaggaaaagaggtcttataagacttgcattggagcagtgaaagtctcattgtgcggcacctggacaattcacccggtgcgccagtgtgacggcagtccctccttgttgacaccaccctcactcttgttctttttggccttcccgactcgaagatctcacgctgtcgcaggcattttttttttagcctttggcacgtctgacaggagggcacggcgatgcattgcatgtttgggaagcgacaagccatgtatttatatgtatattttgtccctttttccctctgttccggttcaatcacgacagatagctagtgccgatagcacgtgacaagtgttattgagtcgcggtgggtgacggagcctgactgggcaacagtcatcgcaacagtcccatcaattgagtgaaaaacatacagacgataaggcatg

SEQ ID NO: 4400 - DNA, 700 bp, Nannochloropsis_gaditana
atgacgccgtcgactccgaggaggaggagataatgacaattttagaggaagaagacgaagaatcagatgttcagttatcagggatggataagaatgggacatgagtgagtcacatagagagatcttgtactaaatgggttgacaaaaacgtaagcgtgaaatataacgaattgctgcacagcacacatattccgtcccgcgcgtttgctacgtgactcgggtacagtaagattattctgatattcaacataaaaaacaacaagatgaacgttatcacatgtcatccactctacagtgtagtatgacaaaaaagaattgatgtcttttcaacaagaatggtaaacgcgtcttttagattggtggggggtggggaggttagaaagcaaaaaaagcgactcgacacgtactcctgccaatttgcagtgactcacgcacacgaattcggcttttcctccaataaagcgcgcgcaaccaacagtcacaggtgtaatttgcgcgcgtgatcgtcccgttaactcttcataccaatcagtgggccctttcaattcctgtacggatgctccgctggctggtccttctgcccacaaggacaagacgagcagtcccatgcccactccgatcagtacatcaagggattgcatgtgcggtagacgaaggaagaagccaatcaaacgtcctcctttgctgcttggctttggca

SEQ ID NO: 4401 - DNA, 700 bp, Nannochloropsis_gaditana
tctctctccaacacgcacctacctcaagaatgacaccatcgcaatcaaagatcaatgcccagtccctgctagctctgccggcagacaaccatgtcaccgtcctgtgtggcagctgtccaggctgtgtcgaggttgcaggcttatagactgaggagagaggcgacacgaaagcttgcgacaaggccacagcggatactacgatcagcaggagggagagagtgctgcctcgagacattcgggagcgtctgtagcaatgaggagactggtctcacgcgaaagctcctagactgtagcgaaggggtaacaagaagtaaagaagaagtcacgaaggcagtcttcccccctctgtcatgtgcgggattgcgggaaatgcgtcgtaagtgttgtcacacagaggagggacgaagtcccatgctgcggtttcaaaaggtcctacagactaccaacttcgctcgcgcatgttgcagactcacgcagaccagtacagcatataaaatgccaatccagcacgacatcatcattctcccacggcgcacattgcatgcgttcgctacgcgtgcttcaaaacagcgtccgacctcccctggggatataggtatgacgtactccttcctcccgcccccagcgcgtcgcatctcagcgaggtctccctctgtgttcctacacacgtcctctgagtcccctcgttcttcatccaatg

SEQ ID NO: 4402 - DNA, 700 bp, Nannochloropsis_gaditana
actccttcaatactttctcccgtacacttaagacggaaaaaatgatgacgggcgtgtgtcctcaatttaagatggcactttttctcacgtcggacaagtagcgactggtttttcggcgaggacagagtacgtctcgtgacgttggcaacccagtcgtcatgacgaagaggaaatcgaaatgaccgtgctccaatattattcacgacgaatacttagcacaggcgagacaccagtcctttgggttgtggatgctactacgcaatcattttccggattcttacgaaagcagctttgctcagaaagtatgaaggaacaccacctggcgatccgggcaagcacgctagcgtgtctcttctgcgtcacgggggcttttacaaatctccatttacgcaatgctccaagaggaagaatttcgccatcattgactacttttccaagtcggctgcatgtgtctgccccatcatcattccgtcggtccggaaagcattgcgtttttgctggatcgattgcgccggcggctcctgatgatttcgaggatggtctaccgcctgacatacacacagccacaccggacactgacagtccgacatcgacccctttccagcgcatagctgacagtaaacaagccgtgcccaccctggcggcgcttttgcgttttactattcccacgctgggcatatggctggccgggccgatcatg

SEQ ID NO: 4403 - DNA, 700 bp, Nannochloropsis_gaditana
tattaattgatgactctaagcggagatgatcgtagccatttcatttcgttgagcaccaaagctgctttaaacactgtcatcatcatcggagacaactcctagtaggtctacaggtaccttctactgcccgacgcgtgataactatatggaaacttgggttcgagtgaagatatcctggggtctcggcgtatcattttcaacagttaatacttgctgagagagatcgtgatcgcacaatgggattaaatgagcacgatcgatggttggttgatttttttaaactctgtttcaagaatgcattggagtagattcgccccctaaaggcatgtacacttgaatgatgaaactcaattcaatagctcgccactagcagaatggcttgatggcacactcatgaaattatgaacattgtaacctgggggttatgtctttaaagggttatgacgtggagctgctcggtcctcgtacagagttttccaaccaaggatgcgaatgatatgagaagccttgcaacattgagggcctataattcatttaacgcccgatatcccaaattacacgtgacatgcaggtcttaataggtgagaccatgcaaacagaggcaaatgcccttcaagacactggcatgatattctcaccattgcccagaatatcaatcctttccttttgcctcctactatcaatatttcctcgaggaatg

SEQ ID NO: 4404 - DNA, 700 bp, Nannochloropsis_gaditana
tcgggcccgaatttttgtttaaagtaggtaccgcggacgcatagcttcctgctccgacaagctgggtcagagagcgcgataccggatattggaacgcgcgtacacctttggacgcgacgcctataacagtagcagaggccagaagagaagttgccctcattcctgtgatttgatcagggtgaattcgagctacgtgagtcagaccgcacgggcggtcaaggacattctggagcgggttggaatttgtccgatgcgaaagcgaggaccaggaggttgatattttatcagagagcaggtgggaatgcctacgcgctgggccctgattatcgatgcaaagcaagagtcaacaggtatcttcatgcagaacatgcaacatatttgttgaggtagctggaagcaaatgtttcaatccttctgcgcgatcgttgctggttgggtcaacatgagagggacgccccccgagttgatttatccaacttctagtctcgtgttgtccgaacagccttcacaggactttataaagcgacttgcctcatagtcatttctggtgtgagctttgcaccagcgattgatctatagtcattctcgcagcagtttttatatacgctgctggtgcttttccatctcacagctctgcctgctccttttacttaaaacagttgagacgttggcctccgtgatttcgcctctgagtaccatg

SEQ ID NO: 4405 - DNA, 700 bp, Nannochloropsis_gaditana
agggggagaagtcagagacaggagagcgtgacaggcatgatgcagaaaaagcaaaatgaaaccagagcgcatatgagcaatgtttgagcgtacactgcgcttttgctttaaaaaaacaaaattagcctcattctacgacagaccatcaagcgaaaatgtaaaaaatattcgtacgaaagcatatctcccttcttacacgcctccacattccaatgttcacgtgttccagcccaaaatatggcggtgggaggtaggaaggttctccgactcggagactccgagggctacggacatttcgcgcaatgtttcaaaacccaaaatgggcctttcgcgcaattttttgaaaccaaaagggagttttcgcgcatttttttcaaattcgcctgcggccccctcgcgggattggacggctctcacactctgcgctttccccctccaccatccacgcccacccacccgcattccatccttttccccggctctgccacacgcacatgcccgtctcctgtgacactcacgcatatcatattttttccccgcacattgacataattactcctttctcgtcatacgcccagtcatcatggtacgtaccgaacgttctgccccctgtcgtcccaaacaacctaagcattctcattctttcccccagcccttgcaactgtacttgaccttaactcgcctctgtcgccctgtacat

SEQ ID NO: 4406 - DNA, 700 bp, Nannochloropsis_gaditana
gttcgaggcagagattgtagtgctaagcgacacccatgggccgctatcctgtaatcttgaaccctcccttcacatccataagacacgccaaacagccaagcttctgagcattgaccaagggcgacgttcatcggcgggtaaaggagagacagtgcactgtcgttttcggttcttgttccatgctgagtatgttcgtgtggggatgatgatagtggtgaggattggacgtacagtagcggtaggctgggtggtgcagcgttgctaatgtggacaagcagacttttgctcgaaaaagggggcaggaggttaaacttctgggtatgtacagctttggcgatgtgaactaaagagtcgagaaatgaagacttttaactttatcatgacgaggacctagaaaaagaaaagtgtagaaagcaagtataaaaagtggaagggatatggtgccaaaaccatttatgcgaacatggcactcttcagggaccatggtgtacgttcctttatagcgtttcctcgtgaccaaggatgttcttgttctttgcgggctgcttcacctgccattcctccacgatttcgtaattagtatatcagatcatataggctatacaccttgtaggtgtagagggcttataaaatgttcgaatctgaccataagtgccgtcagatttcgtctttcctcaagtattgttcctcctcccttagc

SEQ ID NO: 4407 - DNA, 700 bp, Nannochloropsis_gaditana
tggcctccgaggcgcagcttagacacaccatgggcatgctgcaagccgcttttcgcgcgcaccgagggcgtcgaaaaggtcgagagggagtcgtcaactcacccacagcatcacccgcgtcctcgcctcctctttcgacgaaggcgggcccagaaacgcccggctggacaggccggggcgtcgggggcgggggcgctccaaggggggcaggggagggtctgcaagaaaagggagacggttctttgtcggatggggagggagtgagctcctgggacaaggagggagagtcatgctggctagtacggggggaggccgacttggaacgagccattcgaacctacgcgtcggggtactcctcccctccccccggagcggccgcctcgagggtcgcgagacattcgggggcccgggcaaccgagccagagcccggggaggcagaaggtgttaaaaaggacagtgaccatacaggagcgcggagagcgggggagggaggccgggccaggctcgcgccctgtctccccgtcttccttgtctcgagcgtcacgggtcaggggctcgacctcctccgccgcttcctccgcgcgctgccccggtcccccacctgggcggaggcgcgacaggatcggatcgcggaggtgcacattgacgcctccctggatgtggagggcgtgggctgcgtgctagcgggggccatcgaccg

SEQ ID NO: 4408 - DNA, 700 bp, Nannochloropsis_gaditana
ctaatacgacgcggacttgatgcactatctcatccgaaaatcctctgtaacgcgcaacgtcaaactacgccatgctttaaggcagatcgtactcgtaggaccgtgtccgccgcactcccttgcccggcgccttcctcatcgcatggtccgcaaatgcacccatcaaaaatgctgggagatacaatgggaatgtcgcggcaaatccgtacacaaaagctgcgcgtcgggcatgaggagatagaatagctgagaggcctccgcgggccacggccaaggtaaacgccaggcccgtcgcaagattaccaagtttcacactgctggtcacaaggctgtcgtctgaatgcggaaaaacgttggcagcccaggggctgggatggaggaggctgctgctggcgtgctttttcgcgatgactttcgggtaccgtgggctttgaagctcgaatgacgaaggcgcatgggggtcgcggtccggagggatgtcaaaactctcatggccctcccgtagaggcggcatggagactttgcaagcctacctatgcaatagctaggcgggagtgagtggaattacctgtacaaacaatgggacgggtgccatcaatttggagtcccgcagcctcgacgaacaggcgaacctccccacccccagccccggcgtccacccgtccctctcacgccacatttttacacgttcaggcgcatg

SEQ ID NO: 4409 - DNA, 700 bp, Nannochloropsis_gaditana
tcttgagcctttttccatgataccttacggtcggttgcctgaccggatataagctcgaaaacaaagagtgaaaaaaggtcgcatgactgctagacacaaagcaattggaatgcagagcttgttgaacactctaacgtcccatctcacatattactttagagatagaaggagccttagatacttttttaagatcttcttctcttatcagtcattggcacaagcgagttcctattttgagggaggagtttcatggcgaagtccacccagcgtgtcagggttatacagtagtagcatcatctacacgcagtccgcacttttcgcagtcgcctgtccagactaaagatgccacacagtattgtcgctgcatcaccaagcggttttaatctgattgtacgaccaagaacatcgagaagaagaaaagcggttccactataatatgacagagagtaggatcatcagcccggtggaccttgccagccttccccctaaaacaagcgaagtaaaaatcattggcgcgaggatcccaataatggcagcatccgtgacagcagtccatcgcgcccctacaccatacgaagccaataatcacgcgcgcagatgccgttctcgaagcgagggttcccccatcacgcgctctggggttgctccccgcagcgatcaccaacccagagccgataacggttccactagcagcagtatg

SEQ ID NO: 4410 - DNA, 700 bp, Nannochloropsis_gaditana
cttgggaccgatgcgatggcagtgcatataggttttgctttcccttatcacggggcaaagccaaaagtctgcgtaagccctcgcaaagagcaaaccacagttgacttcacaccaagtatcaggcgtccactactttcccccctgccttgtgtccgaaaagaaagattccggccccggggcagccgagcgagagaaagaaagagaaccaaaccatttcgtgattatatagtagctttcatttggatgctgttgtctgaccgccttgcgtgtcggcgcgagactcgttatccaatcctaccacagcgtcgcctcaccacccacaagccccacgctattttgctctttaagatccccacagtggattataaaccattactaacatatataatcattcttctctttcaatcacgtggtgctcaacagtccacttgccttctggcggcacgtctagccagggcaatattcaagttgctgttgctattctcaagctcctcctcgagcagctgctgagcgcattccagtccgtacaaaagcgattttcggatctcctgtttagcaatagcagtctcgtggaattttgctgtaggccctagcggctttgatggcgaggtggtccattttttggggtaattttgcactctgtattatggtcgcttcacctacgctagcttttcgattgcctcccgtacctactaccatg

SEQ ID NO: 4411 - DNA, 700 bp, Nannochloropsis_gaditana
atcaaacaacttcaactagcaagaaggctggcgaccgactagaatgatgataggtgaaagcagcatttaagaagtcttcttctgatcgtgcctgcaaattgtatggggtggggaggtaaaggtaagggggctgtagaatttgccatgcacaaattaaaacaagtacgccatccgtggcgtcaaaggttctatatcctaccaaagttgtacgctcgagctgacaaccctaatgttctcagtagaaatgacaacggagctcgataacaagcatgccggccacggcgaggccccgggcctcgccctttcctcgcccgggggctcaattgaagccgcccagtggatgggtgtcattcacaagactacaagcacccaaccaacatcattcccatatctttgaacagtttgaagaatgtctcggcaatttcgggcagcgctattcgtcctcttgttggtgtctagccttctgacgttcgtgtcagcaacaccatcctcatcacgcagcgccggcaacggcaactccccccggctccaaaaagatagctacataattaaaaagtctcgtgatggcgcttccagcacattgcctcgccgcaagtcccgtgcattgttcgcaggaatccgaggcgggggtgttggcggctcccagcctcctgctcctgtcgcacctccccccggcaccagctcttcagtcgcctcaatg

SEQ ID NO: 4412 - DNA, 700 bp, Nannochloropsis_gaditana
gtataactttacttttgcttcgtcttgttatcgacgcttctttccacaagctcacatgttaccgtgtaccttacctccattcgtcagagatcggtagtgcctgtgaaatgttcaatttggactcattccatttaactcaaaaacttccatgagaggttactttcatcaacataacggtgtgagcggggcttgctagggctggctttgcgtctcagaagtcaatgagggctctctcagaggctcgtctctccccgagcgaggccctattatttatcccggcaatgtatcattacaagacgttttcaatacgcaacatagaccagagtcttatattttttccttacaaccgttatatccgtacgtgttcgtgctgctaggccccctcgccagattttttggggcgacaagcgggcatttgacgccttcgtcttcctagtgcatcaacttcccctaagggccacacttcaaaatcttgctgaggctattccgagcatcgcatttcgcacacgcaggcgtcgaacgcatggctacaccgaggcaactaggattttccacaccacaaagagcagcaacgtcagacgcggatgtctcccatgataaaaaaactgatgtcgcgttcgtgctgcgaactgaagccccagcagcaggaacggcagatagatctgtctcccctacgcccgacgccctacttcctcccatg

SEQ ID NO: 4413 - DNA, 700 bp, Nannochloropsis_gaditana
tgaaaacgctttttaggtgtaaagcgtattcgaaccatgtcttcttttaaagcaagatgatttattgcagcatggagctcccgtcgttatcgaataacgcagatgactttctgcttatttgacaaggattgtggaaatgacttcggagcaaccattattaagactttaaaagaaaaaaaaagaattctgcccgactttctgtatgtaatacctagaataagcacattgtacaataaagatgcaattcaccactttagactcaaaatccaaaaataggcgtcttgtatgatgtatgcacacaatacaccacttacatttagaagttttgtgaagatgggccacgggcatgtcgtgctgtgacgtcaccgttcatcatgaccgaggtgaaggcgctaattggctagacagcgcctcccgcacaaaggaaacaattcgacaaagttgtatgaatggattcgagccgactgaatggagacgataaatgataagagaagaagcttcgccattatcgcgcccgatcataagtcttcgcagtcctgtttcagattgcagcgttacgagagggaaatgaccaagaggctaagtcgcacaagcctgtcagattgcagacgtacagtgggagcccctggtgttggtctcaccgtcggcgtgcacgaaactctcacagatccacacaagcgataggtgcgaacagggtatg

SEQ ID NO: 4414 - DNA, 700 bp, Nannochloropsis_gaditana
actgggaagtccttatcctagaaaataaagtattgtgtagctatgccgccagaagtgatagcttggcctatagtacagcctgtacaatcggctggcgtagccagtcttgcacttcaagtggacagggcaggggcggagcggcgttgataaagagagagagacacacagagccttgtaaagcagggtgcacgcaggatcgagtcgaaaatgtacggtgacggccagggctctgtattattgggtattgtaggatacggggaggcatgcttgttacaaaaggcgtctctcctaggacataaagacgttgaagcaacggagcgatgccccagccggaggataaggagacaaagacaagagattgaattacttctaccaagacgtcttcacccgcggcgacaggatgaaatgaaaagaaaaacaaagcagtgctagtaataagaagaaaacatgcaggacttgcttcagaatgaagcacatacttttgaacgtccgagtgggcatagttttcagaataccccggcagcagtcaaatgcaacatcagcaacacagagagcgccaggccctgcgaccatgcccatattggacgacgaaggggttaatacgacggacatgtgttgaaattagatttcctttcaaacctcgacaggtgataatcacaatagagaccaaagcacccatcagtttacatccatgtccatg

SEQ ID NO: 4415 - DNA, 700 bp, Nannochloropsis_gaditana
ccgcgaaacaatacggagggacttttgcgagctttcgaatgtgggacttgccacataccccctcgcatatcacaagaaagccccgggtatatgacatgagtactaggacttgacggcatgtggatctggctcgaaggagctcgacccctctgtctcaatttgtcttctcctcctccaacattgcatctcaattttcgtcatttccctcccttttcacaccacaaacagggtcgccagattattcatacgtcctggtttccgttggtggggagagatcagtgcaccgcagagtggtgtcctgtctgacgccgtgccagtaagaggggagcttcctaggctcagcgtgcccgcccgtgtgttcccccttggagggcatcacgcgagatcccacaagtgtaccatacctcatcatcacttctacacccgcactgtgcgcggtacttcgtgactgcttctttctccttcggtggactttatcatcgtgagctacatcctggtatttcgggacatagtttctcccttcccttaagagggctcccgcaagcatcacgttgcacgtcctcgcaccttttccttccatccttgagaacgaaaatctgcgaaacgttgcacttcgtgccctttcgtaccgagagtccgcgtcctccacgacgccttcctcccgctgctcccaatttctcggtcttccggcttttccatg

SEQ ID NO: 4416 - DNA, 700 bp, Nannochloropsis_gaditana
gttataacattttctgcctaaaacctttaaacatttgagaaagtctgcacaattttgctcgtcatcggatgagttcaggggtaaccgtttccctgcttgacaatggctttatcctggccacaggtgtcttggcaccaggaaatcatggttatgatggcgtcaacatcaacctgatggcattaaaaaccgagtggttcgccaatggcggcttcacatttgcgtgcgtctgtccacaagtgagcaaaaaggagtacattgtagagtggatgtctccattttttcttccgtggtgacagcaatttggtactgctgtcttcggaaactagacggagcagggatgaacttataaagatcataccgtactcatacttctcacctttaccaaggtgcaagctttgacgatggggactgaatttaaagacagtccgggggacacaatcgtttatcgacttcttttttaacacaaaccatacaatacaggatacaagggccggggcggggcaccagcatgaagttgctgcttcgccaggtctttctaaggcggcaaggcctgaaagcggcatctcgcggaagacggtctatccggccatcatcggcctcatcactgtcaccatcgttcctaaacgtaggggtcttatgtaagcacctgagcgtcgaaaggtatgaaaccgatgcggagctccggaagaccttaggcatg

SEQ ID NO: 4417 - DNA, 700 bp, Nannochloropsis_gaditana
gggggagcgggagggaacaaagggaaacggaaacctgcagggatgagccgcgaagtcttcaatttgatcggaaaagagggcatggccccggttgtggtgagcaagaaggcgataggactcaaggacaagagggagggcacagcgcggacccgatggatttggacaactttcaaaaattcagcacgaaaagaccaggataagcccgagggaggagaagaggaaggaaaggagggggagaatagcggcacgcgcaaaggaggaatcttctatcactgggtaaaagctgcgacagactaccccgactaccctttcgcacgctttaatgtgcagacacctgcggtggagttcacggacgcggagtataagacgtgtttggctgagggtggcaaaggcgcaggatggagcaaagaggaaacgagagtcctattggagctatgtcaacgctttgaccttaggtggccgattatatatgatcgctttcctgatgccgtcgctgagtccgtcgcagggtcgcctgggggaccccgcgagcctgcacagaaggaggttgaagggcaggaaggcaaagaggaagggaaggaggaaggggaaaaggaagggaaggaggaagggagggaggaagggaaggaggaagggagggaggaagggaaggaaggcagcaaggaggcagggaaggaaggagaagccgccgtgatggatg

SEQ ID NO: 4418 - DNA, 700 bp, Nannochloropsis_gaditana
aaggagatggagcggtgtcgttgctccatcccaaaaagagtaatttagctgcccgaatccgtacagatgacgcgctcttcttggatttcattagagcgcttctgagcattcacccagaccagcgacccacggctgcggaggcattaaatcatccctggctgatgtagttaggaagcagaggaggaaggggaagcgcaagaaatgcggctttcctatcctttgaagggtgggaagaggaaccgagaatagtgaaggccggaggagaaaaatgtagaaaagaggaagactgtacgtaagtcaccgtgtcaatacacccataattatgtcacaagccagtatgatatcaatcaatgagcgtggctccacacaccaatgggattgagtctcgttatttccgttttggccctcctctccctcttcttgtacgtgtgccatgcaaagtcacccggaggaaaggactccccgctcctccatcatgcctttcctgcctttgttggcgcccaaggccccgatggcaggtgcgtgaacaccatgttgtcttgctcattgagatgctcatttctttcttgaaacacatgtgtcatgctttgttcacaaaaaaccgattctttccaggcgtatataacgcacggtctcattttccttgtttcgcgctcagacctcctccacgcaactttgccggccttcgtgcaggcaagcg

SEQ ID NO: 4419 - DNA, 38 bp, Nannochloropsis_gaditana
cttggatgagatcaagctgctgcgccttctgcaggccg

SEQ ID NO: 4420 - DNA, 700 bp, Nannochloropsis_gaditana
ccttgggagagaaaaagggaggactgaatcaacacgggacagtagtcgggcgccgagcaggagaccactgatagcacctcctagctaggagggaaattcagcacaacgacctccggaacgctggcatggcatgcgcgcccacgtagactaacggagagaggcatagtacgcgcatgacattgttcctgacacggaacggtggcatgcaagcgggcggtgagggtccattatttaccacgacccccctccataccgtctcgccggatgccagcgcgacgctgtggatacatgaagccccacgtccttcaggtcgggggacttttggtgcaaaacaccggcacggaagagcacagtagagtatggaaatgaaacccttgtcataactgtatgccatacgacctcgtggaaagcacttgtcgtcggaattcattcatatttaaccctcaaccaatcgaccctccccttggcaacggccccctctctccgtcaccttggcgcttttcaacccaactagccttttacgaactcctattcaataccgagacatcctgatcgacgaatacatccattcttagagtttaacagtacattcagccctcgttcatggacccacagctccttccttgttttcccaacacacagattctgttcccttgtctcccttcctcgcactgggcggcgaaagactgacccattcatg

SEQ ID NO: 4421 - DNA, 700 bp, Nannochloropsis_gaditana
tcgctgctcctgttgatttctgaagctaatttacacgattgagaggagaggtagggcttgcagtaagaccttgccagggttcgatgtcaatgcaaccattcgcctctcgactccatcaacagcataaagatctagaggcccatcgatcctccctcgcacccgcaacacgcggtgtccacactggacagggcatagacgggactgccgtcgtatgcagcaggcgaaggttctttttccatcacaagcgggcacgcgtcagctgtcgatcgccgaaagggaaattcgtcggaccacattgcgacttgaaggggcctgccgcaatattgggacaggatcttctgatccggtgggaacgttttgaatgcaatccacaatttttcatacttcacttgcgtatctcccgtcccgaatccacgaaagcccccggttcatgttcagaaaagcagctgcggcccgctatcgtaccgtcgactcttttcttcgtttcatgtcatcatcttctgttcgaccgcagcaacgttatgcatttctcagcgacttaggtttgtcgcaaacaacaacacaaaaaggcgtttgcgatggttattcctggtacgcttcaggtcccaaacattcgcaaattaaccctgcaacgggggaggtgattgggacagtagagttcggttctggggacgactatgagcgagctgtcaaggccatg

SEQ ID NO: 4422 - DNA, 700 bp, Nannochloropsis_gaditana
tccagcatgaaggatgtacttaccggccttcgtcagaacctgcggggctgcgtacgtaacttgagcagtaggaggacgatgccgcacatattcgctaggactcagatgaaattaaatgtttgattcatccagtatgctgcgatggcagaaaaaattacaagagatagctcgtgggtcttgagggtattctcaaaaatgcttcaggttggttcgagtctaatgctaccacaaagatgccatgtaccctcaaaataatcgaaatgtcgacgtttactagtgatggtatcattgcggaagcttacttgacttttcgtaatttgttgttgtccttccattgaaagtggaagagtagtggctgaaactttgtagcttctatgctaccataacccgcttcatattcccgatgacagctacagtccactgcacaaagtttgctactgcgttaaagtttatgtagatattatcaaaatttccagttcgggccttatccaaattatcgaagcataaaagtacacatgctgcgcttttgggggtgtacgctctcccttcttgaagttcgctggggccccatgagcgacaatttatggcatggtgacctccactattgtgtcctgaaaactttcaccgatgcaatccatcaacctctcacaggccagcttcattttatccaaggcatagcgggttttgttcctccaaaatg

SEQ ID NO: 4423 - DNA, 700 bp, Nannochloropsis_gaditana
attcacgctcacactaaccctatgatgtgtgtgatggaatgtgttgtgtggtttgtcaggtgatgagttttgaccccacggagggtctccgtgacttcatatgtcgggctgtacatatgcgatggtgtcatccttattaccagtaccttattgccagtaccacgactcaaaagaaagtttgtcccctttttacatcgaacaaccatgcgaccaacgggaaaaaaaacaagttcgtacccccaggcacgtgacgcacgcctgtgacttcatcgtgatcgaaaagacttccagtaatggtgtcctttaaggagtgaattttacgcgatgtcgccaatcgaatatttccttccaagccgagcaggaaaaaaggagggcagggacgcggcacaccactttcctttttcctcacattcccggcatgtatggtcgctggtgccctatatatctgaagggtattctaataggagcatgcctgatgtgtgatatttgttaatttgtggtatggtggtgcttgttttgctctccatgtggcactctcgctcggagtgcgtgcccgtcgacccgatcttgcctggcccatgacgtgttcacatttcctgtcaagcgtctggcacagcgcaccacatgatagacccgggcgactgctcaccttgcaacatttttcgtactatcagcatttttttggggaaacggaaccatg

SEQ ID NO: 4424 - DNA, 700 bp, Nannochloropsis_gaditana
agctcttaagaaatgaaacaaaattgtgggagaggagaggtgtcgagggctctgttgagagaggaggtggaggatggagatgtaaaacattgtgactttaaaaaaagcaagagacccataaatctgcgtcttcaagcagtcccgtatgcatatcgtagccatccatgtgacatagttcgttgacgaaccaaattccccgttcattggtccatatcgatggccgtacgagctctccttccctctcgccaccatcatcccccccgtcgcgctctcaacgttaaaaatgccacgagtgataggccagcactggagtaccggtttggaaatgtctcttcccaaatttcaaacaagtcatcagatcaaccatcttgactaggctgtcaatagattggttgcttgcctccttttgtatcacccttttcagagctttgaggttgcccttaccccccgcctgagttaacgatgtgttatcactctttcccaccgtatcccgataaacatgcacgcgtatgcgcacaaattgccggcacatcgctttgttgtccaaacaatgaaattttctgtgtctcgcacaagttgtttctgaaaaaccgcatgtttgtccttggtcaacgcgattcctgttcctgcctcacacttcggactctacccatcaacgacagcaaccccaacgtccacggaagattagcaaaaatccatg

SEQ ID NO: 4425 - DNA, 700 bp, Nannochloropsis_gaditana
acttcctctccgctactccctccgtttctcatctcgaattgttccacgaacttcctcgcccaccctcttcaatcccttcagggtcatgtctctgccccctaccggtggcattgactggcgtgtgcgaggatggggatctttgcaaaagtggtcaaaccatgtccatcgcccggcttcccgtctccacgtcgcctgtgccctgtgtctgcaggtcctcctcctttcttcttcccaaccttgtctggcgtacattcgtccgtcccgatggccctcacgacggggggatgcgacgcaaacaccgtccgcaaacccgccttcacgctggtacggtagcgccagctgcagtcgccgctcgacctgtcagagcgcgaggagcccggggagctccgatcatgacaaaaacggtagccgcaaaggcagcagcaagaaaccctctacctctcctatgcgtcgttcggcatactattacaacaacttggacaaactcagccaccgagggaaatcttcgggtcccggacgcgccgtcaaggataacctcctcccttcctcccaggccgctcccgcctctaccgctgctgtcgcctccacctcggccccccgtccacccatccacttcgagctcacgaaaggggtggcgggaagtcgcaagacccaacacgctgtgtccgcggccttccaagcgggaagtaccggggccatg

SEQ ID NO: 4426 - DNA, 700 bp, Nannochloropsis_gaditana
caattgcttttctttgcaattccctggtttgacatttctattctatcaacggactgtgtgacgtctttttcaatctcttgcttcgagcattttgctcgaggagctacatagaatagaggaggttgccgctttcctcgctgaggaggaggcaagatatcaatctccaaaaatgaagactttcaggaccttgtcaagacttttttgtgtcctgattgtgtatatgtactcaatcacgagtggactgcgtgtcccagaccatgacctagcgtatcgtcctcatacccaccccacactttccacaaacgtaggcagttgaagtgtctttaacgaacacgaggggtgggagcccctctaccgtggcgaccatgcgatgtcgcaggaaggcgtctctgatgtccttgccgctgatcttagctgcgatagctactgttgcgtcgacagtcttgccatcctctgcgcccgtgtcccgctctcattcctttccgctcccggtggcttggataaagcatgcccagcaacattcctccgtcctcccagccccgccccctcctagctcctgcatgtccgcgtcgacttcaacctcgaccacaatgatgcattcctggcctaggatgctctcacggcggcgttttctgcccgcgtacggcgccagtgggcgtggtagacgagggcaaccttatggcggccgcgggggaagggg

SEQ ID NO: 4427 - DNA, 700 bp, Nannochloropsis_gaditana
gaccaacccttcctggacagccttgggatatcaagaccggacacgcgacagggtacggagcgtgatgggcgggaagccactccgcaaaccacagctccatccactgcggagagattccattccaccttcctgtgtgggaggcggtacagacgtccgcgaactaagttgtgacgttgtcattgtggggtcgggcgccggtggagggaccgctgccggcgtcctgaccgccgcaggcttgaaagtggttgtgctggagaaaggagggtattactccgaggaagacttcgcaggattcggggagttggactctgaaagggccctttgcgagcggtcggggtggatgggcgcgcaagagttgagtgtctctatattggccggttcctgtgtcggcggcggcaccactctgaattggtgcgcttcctttcggacccccgagcacgtgcgacgagagtgggtggacaagcatggcctgacatgctttggaggcgccgagtacgaccaggctttggacgcggtggcccgccgcctaaacctgaacactcgacactcgcaccggaacccggaggtagcttccgtgccctccctggtcgtgaatcagaacaatgaacgcctctggcaaggcgcgaaggcggtgggtgccaggtgccttcctgtccctcgcaacgtgcgaggctgccaagactgcagcgggtgcgagcgg

SEQ ID NO: 4428 - DNA, 700 bp, Nannochloropsis_gaditana
gcgatactgttttaccggcctttgaggccgaggacgtaccaaaagccatacgagcgtatttgatggaattggtgggctccgatgacctgtttgagaggctgagcacggacatgagctactacactcgtggagccctggatgcggatgtacccgcacgggtgggggacatcgtcgaggaagacctccgtcctgatgcacgaaaaatcgtacgcatggttttgtatgctcttgagatgccgttgggtctcttttttttgactggcgggacctggtatggatggggcaccggcttttctagcatgccctttcgtcagcgggaggcggtcttcgggcgccttcttacgagcatcatcgagccaattcgaggcctcgctattttgataaaggcaatggcgggtcgtatctactttgcagcacgagatactccaccgagcacaccaggcggtactccgaccaacccttcctggacagccttgggatatcaagaccggacacgcgacagggtacggagcgtgatgggcgggaagccactccgcaaaccacagctccatccactgcggagagattccattccaccttcctgtgtgggaggcggtacagacgtccgcgaactaagttgtgacgttgtcattgtggggtcgggcgccggtggagggaccgctgccggcgtcctgaccgccgcaggcttgaaagtggttgt

SEQ ID NO: 4429 - DNA, 700 bp, Nannochloropsis_gaditana
agcgaagacccaatagccgctgcggcgggaaacagaggcggaacaggcatggtaatctgtacgacgaactgtgggaacacccgagaggggggaggttaatggtgaaatcttgtgtgcaccgttgtgacgacccctgaaagaatattcacagagtccttcagacatgctcgaagacataagagacatgcggcaggccgggtcaccccgcctgtccctagtgccagaaaggccgcagtgttggcaggggcacgggggggccatgtcggcgggggcgggagacctcatcctgcggccctccgagcctgccagccagccacccagccacccttctttcctcccgccctgccccgtgcctctgtggcctcatggacgcgtcattctcccttagcatgctctgtaatatgtttctttcgaattctgtgtgactctatctttcgttgacacacgaatggcgatgaagatgctctccttgtggggcgctaccgctttcgacgagacgagcggtaccgtcatgcccgtcttgttcagtaatccagaattatactttcgaggaaattccagcggcatgattggagtggtatagaagtctaaaagaggtgcacgacagcctaaccccccacgccggagtgcgttgatacccattgctctgttttctccatctcatctcctccccttcctcctccatcaggcatccaccatg

SEQ ID NO: 4430 - DNA, 700 bp, Nannochloropsis_gaditana
aagccatcaactcccagctgacaatgttcctgcccaccgtcggggtgggcataatgggagggctctttgctgccctcttcacgtgggcgaacctaaatatctgcaaatggcgaaatcgaaacattgttcccaggccctgggccagaatagcggagcctgctgtggttgccttcctgaccaccaccttggcggttctcatcccctacttgttcgagtgtatgcccacgcgctgcaaaaaggacccaagtctcccaggatgcacgccgcgctatgcgagcagtgatgtgccggaggagggcctgatgcaatatacctgtcaggcggagggtatgtacaaccctgcagctacgctgtttttcaccactggcgacaggactatcgagcacctgttgagccgaaatacccactacatgttcgactacggctcacttatcacacttttcgtcgtctacttctccctttgctgctatacgatgggaatggctccagccttgggttccatggttcctgcgcttttaatcgggtcggtgctaggtcgcatcgcggggctgggggtgacggacatcgtggggattcacgagggggaagaattgacatgggtggaccccggcgggttcgcattgattggagcggcagcattttttggaggactaacgagactgacgttcaccttggcggtggtgatgatcgaactgaccga

SEQ ID NO: 4431 - DNA, 700 bp, Nannochloropsis_gaditana
cgtgtacgccaaactgttgctaggctgttggcccacagcgagatccatcgtgtttctgtcgttgtgagcccctttttgtgaaactctgtgacctgaagggagttgagcgcaagtggagggggccgccgcggcgggggtagcgtcatcgaggggcaccgaaatgggcatgcctgcaaaacgtgaatttagacatcaccactctccccgcccttattaggtcgctgccaagtgggagtcgattgcaaagcttacacctgtctcaaattgagctcttttttttttgcaatcaacggccccctctggaggtgacatagagatggggcagtcgaaagaccatgacatgttgccggcccattagcgtaacgctgatcgagtcccaaattaatacatttaaatgggacctgcgagttaagactcatgctatatctttttcaaaccgtacatggacaattgaagaagatcgagagggctaaacaggagacatttacatgtgagcggctgatgaaaatcgtgcaggcctccgtgactatgtacacgaattcaactgaatttggtgggatctgttctcaaactttctcatttttatgcagcacaagcacgacaggaacacttcggtaagagagaaccctaattcacaaaagaggtcatcttaaacctctttttcgccatctttggcggggcaggccagccaaatacgatg

SEQ ID NO: 4432 - DNA, 700 bp, Nannochloropsis_gaditana
catatctgcccttacacacacgtgtgttccaaaaatggcttgaagacaactggatcaagcgggaatgggaccactgggtaatgatggggttaattggcttttttgtcggcatgcttgggtctacccttaaactcgtcattgaaaaaattgtggagtctaaattccaccacatcacaatcctgctgaaaaaagaggcttttggacttatgtggttcttggccatagcaatgtcaatgtctctggcactggcatctgcagtagttgtagtatacggggagccagcggcggcgggatccggtattcctgacatcatggcttatttgaacggaatatcgatccgcaagatcttcggatcgaaagcccttgtcgtcaaatttttttcttgtgtattcgctgtatcagcagggttgtatggcggacaagaaggttcgtgctgatgtgggggtgatcgaggagagtcatgacgcatgatcgacctgggagcagagtgtattcctggcgaatagggagcatgtgatagagcttttttggcgtctggtgtctgaaagccgctgtcaattagaattccatgtctttttactctctatactgatatattcttccaaacatattccatcatcttcatgtgatgtccctcctacccccaggacccatgatccacatgggcagcgccattggtaagattctcagccaaggtgtc

SEQ ID NO: 4433 - DNA, 700 bp, Nannochloropsis_gaditana
ccgccctcgcccacgttaaggccgcggagactctcagaacacagtcgcaccctggaaatgcgtgaccaaggacacagtagggcgtcgttctcttgggaacaattaagtatgggggatttcctaacctcgcacgtctgcaaagttagaacttcgggtggaaagtccttgaaaagaaagcagtcgactcgttactattaggtgcaagagccaggcaccctaacgtaaatggcccaacgaggctcacagtcgcgaccggaaatcacctgcgactagaatgcatctggcggcaacgagtgtgtccccgcgcgaggatgcacaatcatgccaatggtcttttggtgcccacgtgcctgggctacggcggcgttggacgttccgttccgatcttcccagcctcccctgatcattgggcggtggcatgaccatgtggacatgcccacgcggcgtgcgaccccaagatttggcatggccctgctacttcctaatgaaatatacctccaatacgcacttaagtaagaaagaaaggaccgagaaatgtaccagtttgttttttttccttgcggatcgcctagtctgccaagctccccgacagcgaggacgacgcacgaggcactcggagacgagctcatcgaccatagatgtgctccctgcgctgttacgtttcaatttctcaaccgatctccgcttgacaatctttaac

SEQ ID NO: 4434 - DNA, 700 bp, Nannochloropsis_gaditana
ggtgcgcgcgtgttgcgaacagatccaagtcacaaagaccttttggcaggagtcccaccctttcgtgccacccgtcccgtagctataggtataggtccttataggttgacggtacccaccgggagaagaaaggtacagagaaataccaaataggtaaaaatatgacaacacgttcttcgtgagaaaaagtctatacaccccctgggtgtatcccgccgtgtagtattgcggctcggctcggcctggcacctacccggagtgcactattccgtctacacatcgagaaacatccatcattcacttaaagtccaatcacaaaagaagataaactccgcgattgcgtctctttcacacaccaccattaaaagtctctcctaccataaaaggctttaagaggagtgtagaacatgctcggggcgtggttctcgcatgtctgggccaacactagtagttagtgtaacggctactaacggccggcaaatggacgtgcatttgcccaaacttataaggcccctctaccgcactccagcccctatccgcgggccgggcgtgctgacattcacgacaggcatttatttgtactgacatctaccatagaaaagatcatcgcttgaagatcgactcgaattcccctccaactccccttgtactcctcctgtcggcgtacgcgttcgtcacaagaagcggcctgcaccacatg

SEQ ID NO: 4435 - DNA, 700 bp, Nannochloropsis_gaditana
gtcgaggtcgcaacatcggatgcgaggagcaaggtggcgctacccttgggaggcattgtacagcaagaagaagacgagaaggagtgagtgtaatacgacggagaaaagaagatagcataggggggttgcctggtgaagacgctgtcactcttatgtccgaggagaaactttcttttcccggcaaatgttttcacgctaggagatggactggaacgacaggcaataatgcggcctgggtcaaagtaagtatcattggatgatggtgtctctccagcgcacgacaaggtgtttgtctaatgatcagcggctagtgtgattatgtatattcttttttgaagcatatacaaaggaaagggggaaccgccagccagggtctgggttataaactcaaataaggacacgatgcttccggtcaaagaaagtagaagcataccattaaactaactatcatgacaccactgtatttaattactgttgttgaatattgtagtttgccactgtacttacacactgtagttaacctcctgaccccccgggcaggaaagtcatggttggcgagggtggttgcaaccttcgtgcaaaatcctcttcgcaaacgtatgccacaaccatacgcaactttttgtcctcgaaatagaacacatttacgaatcacccgcaataaatatgcaagcagaaacagcacaggtatcacatcatg

SEQ ID NO: 4436 - DNA, 700 bp, Nannochloropsis_gaditana
atcgcaacaagggttgacagcaaattcgcgcccgttgctgccccacataaaaccggtgcacatttttggtgatgtctaggcgcttcagcatagattgaccgtactcctggttgatcaagggctcccatatgtcatctcgcgttcccagtcgtctccacatgcggtttatgcgacatatgggtgcgaagctccggatggagcgtgggaggtagtccaatacccggcaaacgacgtcctccggcaatgaaaacgagaagttggagggaggcagcaccacaggctggcaaagggatggacgggtgaacgagtgggaggaggatggcgaacctctgcgatgggggggcatgacgcacaaggtcggagttgggagcaggcactgaaagcaagcgaacgagccagtcaattgcctgtctcccggaagcctttcaatcggacactggcatcacataagtaggcctgatcccggcataagcctcccaatgcctaacattgattaggtgatacggggggggggagaaggggttgatgagtattggattgtcttttgaacacccacctgctgcgacgagcatcgggatccgctgctactccgtctcgctatcgcccacagcccctcaaaaagtggtcactgttacactcaggcgatctctgcccacacggacacacagggcttggcttggactggggtgcgaagtgcatg

SEQ ID NO: 4437 - DNA, 700 bp, Nannochloropsis_gaditana
gaggatggtttcctccttgttcgatgggtgggtagacgtctcttgaggtggttcgcaggcgtgcacgctctcagaggagggagccgacggtcgcaggtctatcacctgccccaggaggcacccctcctgcacctcttcctcggagtgatggtgcctttgacttcctacctcgcagctttttcgtcccgctaatattgccgagcacttaccaaagtccatgcgtagactctcctgttcatggggaaaataagtgaggtgatgccggttgcgtcccggtgcgtgcaacttcctcgccagcctcagcgagagcaacgtctgagtgcaacatgatgttctcgcctcggacttaaggataagatcgcacgtcgaccatccaactgcgaattctgcgcaaaaattaaattcattgcctctacccaggcgttaataaacgagggccatcagacttaccgagggaaaagcattctatatcttcctgcgcatcctcacctcggtatcatgatgctccactccacaccgaaccctacgatcaatggcacgatagtcctcctccacacacatcccaaaatcttatcaggccctgataatgccatctccgatgagcttgaccccggcatcgcaagcttttttggcccagatcttccctccgaacgcgccccctgcaagagacatgcctctcgacgtgggtcgggccaagatg

SEQ ID NO: 4438 - DNA, 700 bp, Nannochloropsis_gaditana
gagttgtttgggcccccgcatgggccatgtcggggggtgagcgttcctgtaggatgatttttaatcgcttcttttgtagacgtagaaggacgcgctggaattttactcatgttccaaatcgatttgtgctgcctgctcgccagccagcattgcaaaataaaaaaaaatgaaccaaacgtcgtatattgacctcaacccttgcccgccacggtgccgaggagcagctaatgaccgccagggccactttcgcaagacaaacggtgttaaaaaacataccggcgcaacgacactacaatttctttgcacactgcatcgtatttgttgtcgcaggaagtgtgattcgcacaaaatgcgcgttaaaaaggactaaacctctcccgtagaattcacttccccttcggagagcacctcgagcgagcgagcgcaggagacggaaaagcggcgacagggccttcgtcgtctccattgaaatcacaacaaagcagaaaacaagtgtcaatgtataaatacaaatgtggtttgcgtgcctttgctgcaaagcgggtggtaatggggggcacacgtgtcattcctggcacacaccagcacgggcagctaggaacaacaaacctttcctcgccacccacgagtagtacacttcccaacctgtcttgtcctcaaaccccctctctcattgcccccttaccatactgtgtaaaaa

SEQ ID NO: 4439 - DNA, 700 bp, Nannochloropsis_gaditana
acacgccgacgcttatttgcctcgcctccctctcctcctccctctccaccttgtccaaagctgctcataaagtcttggtattgggacttcaactaaaaatacgtgcgagttcataccaacggtgatgtgggtaagtatattccattttccttccacatgctgactgctcccgggcggtggcttcagcttattctgtattcgtccttcccgccaaaaaaaaagaaatataccctatgaaaaacacaccgccgcaatcatggcgtgaaaacagtcattgaggagatacaaaggcactgttgtttacacgccctcactcaagccgccagcccaacctgcccccgccttgtgagtgcaggtctttgtggacatcgtctgctcgtcgtcgctgggagggtcgagcgacgcgacggcgatcgcgacgccagaacatgccattcgggggcttttgaacgaaaggcccttcctccgctcttgatttcctcgtcgacagtcctgcgggttcaatgttgcatttcggggcttgtggaagatattgcattggctgcactgagttcgtcattgcttttcgctttttttgaatgctgccaatgaggtgcccatgcccatatcgtgtctagcacttgccatgacccgcatcacgctcacaaattctcatgctcgccacgcactccagaccctacgagaaagtaccataaagatg

SEQ ID NO: 4440 - DNA, 700 bp, Nannochloropsis_gaditana
tcttgcctgcggaaaagctggtcatggttacggcgctcgggccgtaaaggagcgaagagcgaagcgaaaccaacgacgatctggctcaagtctgggacaacaccttttgagtaaaactgtgcgttgcaagtctgctgcagatatcacttcatttaaattagactgttgatgatatgagctgtgcatgagatttggtggatctgtctttgctgaaagccagtgcctttttttcggtctagccctcaggctttgcccctgctggtatctcgggacaatattcacttatatgccgcccggcccgtcctattggcagggcaatctcacaactctctcctttcaatcgcgccatgtgagaaagaccaccaggaaaaccacagttataactttccgtcagtaggtactggtcgtgtagcggagtggaacgtttgtcatggccttttttcccgcgtgtaaaaatgtcctgtcaagaagatgatccgggtgaaggagacgggacttgacgtatgccttttcgtgaatgctggcacttcttcacgcgcggtactactccatttcatatgtccttagatgaggcatgaaacttcaactgtgtctcaccaggcgaccaaattcgcgggtggctgtcatattcactgttgtctcactcaacatatttatctccttcagcacctccgtgtcacaggcgcagtgcaggcgcatg

SEQ ID NO: 4441 - DNA, 700 bp, Nannochloropsis_gaditana
aaagtgattagatatcaggtgagtggaacgtagcctcgagaccgttgcgaaccgttgaggagacgcagctgctcgccgaaaatttcaaattatgcgaaccaccgcagtgcatcaagtgcgaccaccccgacggtcgggtgcaaccatggccttgccaaaattggacaagtgagaagtcattttgaatatagcctgtcacttctcttgctgaagagcatcatcattgcgcaaaattctgggacaccaacataatacctcaatgtttgctggtcgtggccttcatttcgacaccgaggcatgcgttctgtagctacacaggtgactccttgaggctcaaacaattcgggcatgagtcttagtaagcattatgaatgaatttgtgataagcatactgatacggaaaatatccgacttgtttcagagtctttaacgtgcatgacctcaccctaggcatgcgaagcacaccatcgtcgtcattcaaaatcgaaacactcccaaaaagtattctgccttcccgagtgatttaaattaattcttgtcattgtgcaaatgtgcaagttacataaaaaaataagtctttggttcgaatgcaaccatgagtcaattgtaggtgcttttgtatgatttcttgagcacactaacagaacacgcatgccatatctcgcacagaccacgaagacaaagaaatcttgtgaggatg

SEQ ID NO: 4442 - DNA, 700 bp, Nannochloropsis_gaditana
attaaaatgtcgacgagatggtctcatcacgaaagaggcgacgggactgatcacactgagacagctgagggcgacattttcaaagggcgcgtgatcagtgcatgtaagttttccccgggaaagagtgcaaaggagccggaaagacatagaaacatattttcggaactttcattgctgtcacgtcgtccatcgctaataggctgtcaacatcctggaacacttgacaacttccctcgcgcttcaggaaccttgaaaagcagggaggcccgagctgcacgcttcatgatgctacacaatactgattatgaaaaggggacccgagttgatttttgtcagtgcagaaacgctaaaagtgtactacgcagttcgggcttcgtagagtttttcttttcctgcttgtttctcgagccctcgtttactctgctgtttctagagccctacgtcttaaagcacaccaagaggtgcccaccgcctgtactgcggaatgaagtttactttgttacacatcccgcactcaagcatagaacaatcggaatacgatttaacaccaccgtctcccagggagcttctcgccgaggcgttacacgcgacatttgagcgatgccggcaacttccttcttgctcctttcccgccgcagcaagttttcaaaatactccggctcgactcatcggatacatgtaatcaactcacggcagcatg

SEQ ID NO: 4443 - DNA, 700 bp, Nannochloropsis_gaditana
ttgtattttcctgataatagctctctttagaaagtgtaaaagtagaaaggtggagcagcatgttgcaggactgtgtgaagcagtactgcacaatatgactatcgaacgtgaggcatgtcaaaaagcagtgttaaaactcgaaagaacgtagattgtaaagtaatgaggatgaagcaatcagttataatgcacataaaggaggaggctagaatttcatgatggaggaaagtagagcgtgctatacaaaagcgccttgtcgttcatacatagttatttgttcactctttccttcattttgctgatttttcacgccatgtccatgtcgtcatttgctgccctcctgtttgctgaagccgcagcactcgtgacttcttaagagcattgaagattgacacgaatcgtgtgacgagtgtgcgcgtgcatttttccagtttcgaaagctcgtccactagctcgtttactctcggactcactggtcttacggacccagtgacatgtccgaatccctggtttccagccgttaacgcgagcgaacggattctcaagtaggcgttacgcgggggtgccgcatgcacaccgcttgtcctttacctccgagccgttgaagctgcaccattattacaaagaagaatgttaatatgaaacaaacatatcacagtcaccctcttctgggttggagtgttcccgttaaaacagtatg

SEQ ID NO: 4444 - DNA, 700 bp, Nannochloropsis_gaditana
ttacttacttggcgcatggcgggcacgtgggaaggggggggggggcgatcgtgtggggtttctcttccaaatctaatatcatttctcgcgacggccgtggttgcgatgcggggctgaaatatgcgatgatacgttttaagtcaaacaagcgaaatcaaacgcggacgcggcataatttcaaaacatcgaagagtgctgtcgattcccgggtcttgcattcctccttctaagagggacttaccccgtgagcaaatcactgcggaagataaacgctccatatatgcccaacaagaatccccccaaaaatgtcatcgcatgcctgaaatatccatgccttctggatgatgttctgtatgcgtgcctctcattgtgcactggtgatgagggaacccccccgaagtgatggtcacctgctcctccatcgtctgatagcttcgcgtgcctagccatcccgcttgcgtcttccaagacggtccagactgtgtgaaaagtgtaataggtggcaatgagtggtttgaacggcacagtccggagattcaagtaacttcctttccgcgtagaatgtcgtgcttttttgaaatttagcgagagcgtcagactcggagtccgctttgtctttcatgttaccatgccctcaaccaatacatgcacgaacccataccacggccaggctggaggacgaccaccttttgcaaacatg

SEQ ID NO: 4445 - DNA, 700 bp, Nannochloropsis_gaditana
aaactttgcggataggccgaaacctaactgtacggatgcagtccatacatcgattcaagaggaattcacatatccaaaaatctaattaaatgcatagttattaatatgttccaacgatatataatacaatttacgtctttcccaccgcacatggcggtataaagcgtccgaaggatccggagggccgtaacggctgcctgatgacgatgctagctctcgcccacaccacgcacctttgttccacctccaggccagcaccactcctggcatgaagtgttgggccgcgtgtttcgcagcgtatagcagaaagctattgcgatggaatgagagagacttggactggtggtgggcgctatgctttgtcgcggtgtcgagggtaaaaaaaacaggcggccaagatccatagtgcacctgccagctcctgctcgccacctaggcaactcccaaatttgtagctgcatccatatcagtacatgatttgtagattttccatcttctggcctgtgcttgaacagagaactcagtaatggaacactaagtttgtgtttttggatatgcaggtctcgaccttatgccccctttgacgtggatgtgcgccagctgccacgcaatctgtaggatctgtcgtattacgcaagcctcttcgcttcgaaataagtcatagtactcaccttaccgtgcactttcgaacagaaccatg

SEQ ID NO: 4446 - DNA, 700 bp, Nannochloropsis_gaditana
aaacacaccagcgcacatatttctaccatatgtatatcgtggcgtgcaaagatgcgtttctatattttaattgaaacagaaaactccagacatgaccccgggagaagtgttgggcgagacgtaagaagtactgagcatcccctcctcacaataagtaccaaagaccacctctccgagacccataagaaaaatttcccctcgttggcgtacattgtatggtttgcaccattgtctccaacaacgcaagaaaagacatcaaagggaaagaaatgcggaaagtcgcggcggcggaagacgcagggcggggggtggatggatggtgttgggagagggacagcgagtggccgggaatgatggaaaacataccctgtgggaggtaagatgacgatgatgatggtggaaaaggaccttttcctggtcgtgccgatccgtccaccgatctgtccgcacgtccgcactggcttgtgacctcgccgcacctgaaaactttacagaatagcatgaaagaagagaaccgagacagattgacacgggcagattattttgagcctggtgtaaatcgttcccgtgctccagcactcaataacgtttccttctttcaccacttgtttactagctcagaccatcctcacgcgtcaaatagccttacatttgatgcccgggtgttcagaccgcgtcatgccttccttcatttcaaatg

SEQ ID NO: 4447 - DNA, 700 bp, Nannochloropsis_gaditana
ttttattatcgtaatacgtatccttggactggagccaaaaaagccacaaatgatgctgtcaagacgacatctatgaagtgatttgattgtttttgtcataagggatgtaactctgctggattgttttgatcggtgcgtcaccttacatccttagctataacacctccgcgaagcttgcgtacttttttttcctgtttctttcatgaatgatgattcgcatggctctggtgtcattttagatttaaaaaatgtactcttctccatgtttgcatcatgaaagattctgcatcattaatgtttgcttccaatggtgctgctcttaagccacagatatctcgacgcccatgcccatatttcatcttcacacacaggacacctgaaaacaaaatcaatttgaaattcttcaaggaataagccgtagcaatggaaaacgttcccaaggtaggcaagaagattttacactcttgtcagctatcgaccttgattgtatcgcgcttcccattagtgatgttcatttctcatttatcgtcttaattcttgttatgacacaagaatgcggcaagccaaagtttgttctaaaactaagcatttttcggctagactttgtttctgttcaaatatcgaaataattgctcaccccaaacaggctaagaaaaagggtgcgagtgctaaagcgtcagcttcgacagccgccactatg

SEQ ID NO: 4448 - DNA, 700 bp, Nannochloropsis_gaditana
tcgcgcgtacttaccgttcaacgcgagcctgatgcttccatcggaaccaactctgcttgtcgatattcggatgcacatcgtcctcgtcgtctgacagctccaatttgtcccattttttatacttgtccgttaggctgctagccataagtgacccgattggaatgcgtctgtgcgtggatcagtatggatagaatgactccctttttccatgtctatggcatcactagcaagaggaaggagacctggcgaagagcgagcgacggggtcgggtccctggcgatggaacacttgacggagcttgaaaccaacaaggaaagtttatgtaaggaaatggctatctccgacagtggctgaaacgtggtagtgtccgaggtcgtggcgcgagctctttcagcagaaggagccatatcttgcatccaagatattatctctccaagcaatatgcctgttttttttttgcatccttaaataactgtaggagcacccaaaatattttttttacttccatcaatatctcagagagattcaacgaactttctgtcgatggcagagccaaaggaaggtacggtgactttcgacagaggtacgtcctccactcctccagccatgtgaggtgtttgcctcgccttcccactttatcgaacagccaagtgatccatactgtgagactgagcacgagcgttaccgcacactgtcagat

SEQ ID NO: 4449 - DNA, 700 bp, Nannochloropsis_gaditana
acacataatacaaggctcgcatgtaacatatacgtcacattcttggaaaacgctggggggatgaccccgggccaatatttcatccacgatcaccagttcggcgtgtcgcgttccgttcttggtagcattggtgcggttgtgtcccttacccaggatctctcctcggccaaaaaatggaacactgctgtcaatggagcaggcagtatctttgagggggtccgggcgatatacgaaaaccacccccacgggtacttccccctcctcgattgctatctgcccctccgccagggcgattttcataaaatttatttcctccgctgtgaattctaccatgtccaaaggccgatatcgaataccaatgtaagttttcccctcatctttttttgcctccgtgcacggcttctcgatctgtggatgtatgctgaaagggaaatgctggagggtggtctgcttatcaggggtggggaggttgcttttgctcgatctgcccgcaatgcgtgaaccgcccaaagcctaacaatatgtacgggcagatgctatcaaggaaaaatgctctgttaccagttgtaaacacatggaaaccctccttttccatcctggctatgtccggacaaagtgaagtcacgagacaaggctttgtttatctgaccacctctcttctcgtttcactcccccccttcgcgtcgtcttccaacgcaaa

SEQ ID NO: 4450 - DNA, 700 bp, Nannochloropsis_gaditana
ctgaatcagaggtccccgagccctcgctattcatgtctacatgctgaagatgcgatggcaaaggctcgtctccatccttcctctccatttaatccactgccgcggtcaaaagcgcgaccaccacatgcccacatgcgacctgtctcaaatgtagggacgtgagggacgtcgtatggtccttatcgatcggggagggcgcttttaccccccgcgatacggcttcatagcactcgcttgtcaggctatcgcctcctgtcggttgctgggtcggagagctctgggcttctttctccctatgttcctacatacccaagcaatgcgcttgcgcacggccacgtctggccgggatgaattgtgaatttaatgaaaagtatgggcggactgaccataactagggcggtttttagtcgcgtgcttccgagttcgcactttttagtccccagacgaatcaggctcacacgaaacatgcttcccgtccacacacaatgaaactcattcgaatgacacacattcctctttgcaccataaatacgtcaaggtgcaggccaataccgcatcacaatcggcttctcctgtagctccagatttggccgtccccgaggttccttcataccaacacaaggaagtcgctgaaggagcttcttaccagggtcgaccccaccctttgcgcgttcagcattagttggctacattcaccatg

SEQ ID NO: 4451 - DNA, 700 bp, Nannochloropsis_gaditana
aggaagcacatccttggcggtgtgaagaggcgtgaatggcagttttactttgtggaatggacctcattgacgtcttgaaaattgtgggatggtctctaatgacctcacagcagcatctaacgggtcacgacagcgcacgttcaagtaaaaaaggagaacttgcatgactctcaataaataaatgtgcgcgggtttgatccattccaatgtcacaaacatgcacagatttacaggaagatctcctttatttggccatgaacgtcacgttggaccggtttcctgattgatgaggttcctgccttgtcccagccccttggcaagtgtttcttggctttcacggtgctatcctcatactatccagcccgctttgattggcaatagcatcgacagtaaaagatggacatggaatctcaaggttttacaatggaagtcatcccagcgaactatatttcaatacctgtggccgcctaaatccggcccatcactttctcatccagcaggaaagacagatagcggctcccaaaatgatgtgggtggggacaatggacaggacatttctaaatcacaaaatctgtattcgcataaagacctgtacaacaaggacacattgtggggcgcgaagacaggcgtcgggagtcgaatgcctttccctcccaaggcggaagactccctgcttgaacgtttggaaaaagcgcacatg

SEQ ID NO: 4452 - DNA, 700 bp, Nannochloropsis_gaditana
caaatgctgttgtccaagatcgacaaggataccattttctttgtcatgatgatatggaatagaatccgaataaggcatgaggtagtagttgcgtgctcggaaaggaaattcatggcattgggagaaggtcggttatgagagctccaagcgatatgaggaaacagatcaaaggcttgcacttttttctccttctcctgaagtgcgtgccttttgggtcttgcaacacctcgaactatccacgggcggtacccctggacaaagtctgtataacaggccgaacatgatcgtattgtgtcatttcccttcaggacatcccccctgaacgggtttggacaccgcggcttgagactgctttttttataacttttttttttcagtgcggaacaaatgcgacggagcttcaattttaattgcggcaatgttgtttcacggcataagcttgcgttgtgcatgatggggaaataatttctgggcgttgcccacggagcttgatctaaaagtgttgtaccgtgtgcaactcttttcgaatcttgtcgcggtgtaagtcgacgatgaaaaaaaccccgcgtgcctccgaaagggtccaaattaaaataccctgtgaacccgttttcactcaacaggttttggcatttggaataagacggccttattcttgttgacgctgctttcctcctgtgctttttgatccctcgtcatg

SEQ ID NO: 4453 - DNA, 700 bp, Nannochloropsis_gaditana
gcaggcgcaacatgtaaggaggatcactggcatctttaggcttgtgcccgcccacttgatagggcatgggaagcacatcgtaggtgttccccccagcacaaccaggcaagcgaggatcatctactgactgcatcggtaaccttgagagaataagcatgcttacgaggaggtaccgcgacttgcattgctgaattgttgcgactcatgaatgctcaggctcaggaaaagatgacgacgccgtttgaatttccataagatggtgtatgagtcggtgaagtgcaagagtcagagagacgcaacctggctcctgtgtgcggcagtatgacaggaaattggacatgatttccgtaagatgatatgacatgattaaagactatcttgtcatatgtgtttcatcacttcagtggtgaaattatgagaaaaaagacggttttggaatagctcaacctgtacttgagcctccccggttacccatcatacaatgatgcgttttggcggaaagtatgcccatattcgcgcatgccatgcatttcacatgttttcatcaaaatgcacgaccatgacatgcaataggatgagcagcagaaggaggagacgcctattgcccgtcaacttgtattccctgctgcttttcctgtttactacctcgcttcctgtggggtactcttttttcactcctagagcaaattccataaattgt

SEQ ID NO: 4454 - DNA, 700 bp, Nannochloropsis_gaditana
cgaagttgattctttgccgctgctgctattaggtgtcgcattttatccttgttttctcaccgacccgtgacagcgcaggctggccatgtggcgtgcattgaaccatgtaaaaatcgatctttattgcacgcagtgtcggtgtcttgcaccatttacggaaagaccaaccgagttctagatcgggagacgatttcgttgcaaccctccggctctcccgcatccggttgcgatatacccatattccgagctcttgtttgttcagaggcaagtggtcatgccgagggcaagagtttgccatgacggccgatcggcgggcacgaaaagcgttttgtacgtggtgttctgtcggcatgtgcgtgtgccatggtcgtgtctggtgcagttttggatattgcggtagttaatgcggccgccccaggcgggaggtaccctcagctcgctattctttccgtctttcttgagcgactgcttcgcgagcttaaggatttgtctcgttggacggcctgtgagcctattgggttagcatacacggaaataaaagggccagtccaaggcagcatgcaaaatcttccttcttgctactctttgatgatttttatttcaccctttgtatccccgatcccacttaattggcctcaggcggcgaagcactcagcaagaggttctccctttctatggagtactagtttggataaatcca

SEQ ID NO: 4455 - DNA, 700 bp, Nannochloropsis_gaditana
ctggaagccaagatttcggaagctaagtccaagaaggaccagatgattgcccgggcccgcacggcgaagacaagcgagaaggtcaacgacatgctctcctcggtgtccggaacttcaagcatggacgccttcgaacggatgaaggagaaggtagaaatgctggaaagcaaggctgaagtggcggggcagttggcgggtgtctcagattcttccttggaagggaagttcaagttgttgggggagagcagtgcggtggatgacgagttgtcgaagatgaagggcatgatcggacaaggggagaggaaaagcgcaggtttcttgcctccggggatggcggaggcagaggttgactctgagttggaggccttgagaaaggaaatgggccagcgatgaacgaggagaaggggagacgtcgagggtgagaagcgggggaaggggggacagaggaattcgggggcatcactttgctcttgttggctgtatatcgcgggtggcagagtggtgataaagtctgatgtccgagtaggtagctttgtcggagcccatggaaggacgtatgaacggtagatgagagagggcagactcgcgggcctacgcacaggcattggcatgttacactttacgtttgttcatttttggggcatgttttaagaaggccagatagaagaaatgtacactccttcgccgcatcactgcggtg

SEQ ID NO: 4456 - DNA, 700 bp, Nannochloropsis_gaditana
cgtctgggccggcgccatcctcaggttgccgccagacgcatccccccgaagacccgtcggccatgtcaagtggacaaaatttgacgtggcaggaagactggcaacaccagcaaccggtgagtcacggaaaattgccctgaacgagggcagaatttcgggcttcttggtatttccgtcctattttacctgtagaaagaaggggggggggacaatgtgaggcgggacgggagatcaacaagtggaaaagccgtgcccaaaccagtctttgccggcgcactacgctacaaacagagcctttcattcctttgttcatcgtgccatggatccctccgggaacattttcaacaacaccgcccgacctggggcacaaccctttttataactctcctggggtaagcattcatcgcgacacccgtctgcagcgtctgagcgagccggagacaagtatctagacgaggaccgtcgtccttaccagatcagaaacaccaggcagaagcgcccagagcgccaggaaccacgtcccacggtggctggttttcttgtgcatggcgtgccatgctgtatttctcatgtttctctttcacagcacagaaagttgcgagccttcctgggcattctttccatcgtgcagtctccgtctgccgtagccggaactttcgttgcgtaccgttacaacaccaacagcgtcaacacaaccatg

SEQ ID NO: 4457 - DNA, 700 bp, Nannochloropsis_gaditana
ggtttggcatgaacgagggcatttaaaaaaggagaagttgggatattattcccgagggggggaacgggcgagaggcagcgagggcagccaccaacccccccccgcgctttaaaaaaaagcaaaaaccgttccttttggccgacggacgggtcaatggccgagatcgtgtgatgtccttgcttcttgggcctgacttgcaaccctggtttggtgtatgcgtcctgttcgtgtcttgtggttggggtcacgcgggcccactgctttttccggctggcaatcggggaatcaacacatggcttattgccagctgtaagtggattcccctttttccccagacgacaaccgcacgtgtccatctcctgtttctctccatgaatgtcgcccggaagtcgtgtctttttgcttatctgatcttcccacggggctatggccttggaaagacatggataacgacgccgggattttattaggggcccaccctcgattgctccaccagaacatctgatgtcagagagcacataaaaccctgaattacccgaccgcggagatgggttcaggccagcaccctcacactgcacctctaaatttctaagacattatgactgactcacgtttgctccttttttgctcatagacgccttttttgaacgttgggtggtgccctgtggcctgttgttctgccgagtggcagactgacatg

SEQ ID NO: 4458 - DNA, 700 bp, Nannochloropsis_gaditana
ttgtcatttcttatccgaataacatggactcgtcgtaatatttaattggtttgatgaagccggtggcaagactcaatgctttcgtcgagcctgaccaactctatcgaggaggcatagatgtttttttttaaaatttggaaaatccgttgggagacacacgccctggcgcgtgcttgcttctagcgcctgaaagggcccgtaggcacgagccccgggcaacttttttcatccgtcgcttgttaggtatttctatttctactcttttggtcatgtaaaatgcgtggttattgcccaaccttgtcagcatcgccctttattttctcttgctagtcggagcccgatcgtgctggggcgactcgttacttgcttgagtgtttcgtgagcgagttatacacaagcagcacgcgcagcacgcataagatgccttattttccgcattaaattaccagggtatttcgtgcaacgctacacaaataaaattatcgccagcttgacccttatacattattgtactgctcctgaaaattgttcgtagtgacgccgaacacatgacatccaaaaagtgtcaaggttcttcccgcccctgacgggcacacatggcaaacttttctcaccaaatgtattttctcctccaattctgtttcactaatcatagactttccactgcttcagctctcaaacaaggtcaccgtcaatcatg

SEQ ID NO: 4459 - DNA, 700 bp, Nannochloropsis_gaditana
ggtgcaaaaggatgaaaaaggtgagcaacactcgactgtaagaggctttcgggttgtgaaccgaccggcggctctccgatatccagctccgcacgctggggctcgcgcttaaagcgataaaaaaacagcatgtctcgcaggtacaatgtttgatcctacagcgacgcctgaagtacaattcctaggcctcattttaacgaggctgagagtttaaagccttttcatggccattgcgcacgagccaaaggacatggcgggagtgcacgatggacaatgccaccaacatgatccgctttttctactttgtgggggatggggacgtgggaggtgtctgatcatatagatcaaaataccacgcaagggcgtcgacacatctctgcgcaacgttcctgtgtcaggaagacacgaaaaaacttggcattcatggccaagatcgcatgcgaaggcagaaatgaggaaggatccggtgtgccatttttcctgtgtgtggtgtccttcaagttatctgcttgcacttaggtcacgctctcagccccgctcagcccgtcaaaaatgcgccgcacacagacacatgtcaagtcaacctgtgtgccatgcctcacaacaccacacaaatcacacaggatctggtgctaccaaagggagaagctgatcattggcgtgctgcattaggagtgctggcatcctccacttcactatg

SEQ ID NO: 4460 - DNA, 700 bp, Nannochloropsis_gaditana
tgcggcacacacctacgaaagagggtgtaaggccagactgagattgtatggttacaatattgaccacaaataagctgggaatgctgttcatacgaaaaagtaaggttggtatttgatacatgagaaatggaataattaaccatctataatacgaaatacggatcaagtgctttttgtactcttcgtgccgcatcaagttcgcaagggtttgcagtatgagcatcattcaagaatctcctttttcaaacctcgccattacagaaatctcatgggcggcggtcgaacttttcgtttatcccttggcggtaaaattgtcgttctctctactcttctcgggtctacaaatgcctggcgctcgccacctcgacttcacacacccctagcacactttgagactctttcaacgtcgtcagccattgatgttcattcatttccctcctcggttgccagccggcttggatcagccatctctggtcgctttctcgaaagcgtccttctcctcctccctctgacggtccttcctccgtctgcctgtgccttcccgggcctggaggattgcaccagtgaatccaatccctctttcaccattgtgacctgcgatcgttttggcatagatcctgtcgcgggacggccgaagcgctgtttgtctgctgaaaactgcatcagttccacgagtgtgaataatcccagcaaatacatg

SEQ ID NO: 4461 - DNA, 700 bp, Nannochloropsis_gaditana
accaccggcagtgattccggtgctttgaacgaagcggatggagtcctatggtacgcgggaaaatggttcgtattttggacggtgagtctcaaattatccttgggcgtgagttttgggtcttttcggagtggtgtcagtgcatccactcgccttctgctgtcttgaagttctccctccagcattagggaggtcccaacaaaatacttatacaatgcgaccagacgacgtcggtacaaatggatttccgtgcggagaattacatgcaggggtagcaggagagatgcggcggatgcttcgggatttgattcgaaaaaaattaagggcaacgagtgtcttctttggtgatacgatgagagcctgccccgggcgaaaaagatgacttgacgtgacaagtgtcttgggagagttggcgtcgaatgtttcggcacaatatcctcgtagattactatttattgacagcttgcccccctcgttaccatatttatggcacaagtgggatgaaaactgtccattttcctctcaaatctgatgacacctcctgacgcaaagtgccaacgggcactcaatgctcacatgccgctttcatcttatccatccataaaagcagcctccacgtctctagaatcaaagaaccgctatattgtgtagcttaccacgcagatattacggtgtcgccaagaactaccgtttcggcagcatg

SEQ ID NO: 4462 - DNA, 700 bp, Nannochloropsis_gaditana
ctttgtgtacccttctcgtgaagaacatcggcctttgtccccggggtcacataaaaaaggtaaggtgaagctagagaatcaatcggccgggatatgatactaacccgcaacctctccgcacaacccgattaatcccacttccacaacctttatgaagccgccatgaccgcacgcccccctccgatatcacaaagccttctttcacgacattgagtgtcctcgttttgccccaagtggccatgtgcgcgccgtaaagtccacgagaccgggaggtcctcgctcgccctacggcctcgccctacttcaaaggttgccaccaccaccgtggttggtgaccaaataatcgcctttctaccacatccggtctcgcgtgttcctcccaaaactgcctgagggccgtcgaacattgggatgatcggtcctggccaggaatgggaagtggacgatcgaaagtcatggtatttacgaccatttttatgttgtctttgcgcacactacagatttgttcatctctgaagatttaacctgaaggcgctttggttcctctttgggaatggttgtttgaaattccttcccgcagaaattcgatcccggagcaaaggcaatcttttcgagatcgagaacgtggactgcgtaggagaggtcttaagcgtgattcatacaagctggtcatcgaagtacagaaccgccttgcaggatg

SEQ ID NO: 4463 - DNA, 700 bp, Nannochloropsis_gaditana
gggttaataaaccacaatggggatttatagttttaatttgtcggcaacaaggagtgcttgacaactcacacgccgtggtgtgtctcgcgtgcgcgcaaggctgctttgagagctccgattgcagaatcctctcctgctttgacccctgccgcttgtccaatactgtatccagcacccagaggcattgtgaattaccagcgaacatatagggacggcaattcagtgcataagtatgtggctgcattgaaaagcggggcgaacgtagagacgcggcgatatatcgcattcatatgcggctgcattacagagcgggagacacgaacgctcttgccatgctcactttttttccccttcaaatatcgtcgcctttccacagcagggtgattgaggcatggagacgactgccattccgctgacacgaacagcggcccgtgttctttgccctttgtgtggtttgtccatggaaagtaatgctgccaaccgctgcggaaattgcgtgcgaaatgagatcgatttgcaaggggaaatcaagccctcccgtcctttgatccaatgcaagcaatgctttcactggcaggccaaatcgaaacattgggtggcggctgaacttgagtcccgcgaactactggcattggtgctcaagtttgtcccgggccttcacaaaggtggaagtgggccgaggggtggagacggacctatg

SEQ ID NO: 4464 - DNA, 700 bp, Nannochloropsis_gaditana
atggagccagaatacaatggttactatagccagttgatcacatttatccctagcagcatgtggaatgcaagcgaccgtcgaaagaatggtttcggaccggggtggaatggcccggggctggcattttattgaagcaggcatcgccacgcacatgtttccatgaatatcagcgagggaggtttccttttgcttcaattacacactaaaaataaaaacagacgtcatcctggacgccgaggtggggcgtatgagtgcggcagcctcaaatttatgccgtaacgtgtaaacaattgtgggtgtggatgaaaatgtggttgggctatcggacaacgaaaatacaaggaggaggttccttgttcctgcctgtcacggaacgtaattgggtcacatgcatgcaaccatacgaagttactgggatttacagcgatcctgtctatcaaacagattgacaaatagtatgctcctccgttctccgacaaagctggtcagacgtgggcttgtgcttcgttcctctctcttctctcgctttgacgcagactggcgacaacgacactgcagcacgacggctgagaccatggatataggaggagtcaccttgggttttcttggcttagggcaaatgggatcacgcatggcaagcaacttgctggataaaacggaccttccagtcgtaatttatgacacaaatcctaaatcaatg

SEQ ID NO: 4465 - DNA, 700 bp, Nannochloropsis_gaditana
ctgtcagggggatccttttcttcgattctccccccccccctctctttccgactcttccctgtgttttctcttcccctcactcctgcgggaatgcgcgggctgatatcctcacatttcacgaatatcgcacaccgaaatgtttggttcactcaacaggtgcaccgtgctgtggcatattttccatcatcggcttcctctttttgatcatcttggggataattgttgacaaacagcctatcttcgtgcatggggtaactgaaccgcacagatcagccgtggcctgttacggaggcggtacgtgacgcgagatggtctacaagttgagggatagatgagaaggcaaagagccagggaatgacacggtctttgcaggctttgggggatcgcgggggcagagccttcaaggaagagagaagagatgcaggcgggacgtggattgcaggacgccacaacgattatgttctggtctcaccccttttcttttttctctctaacgattggcacagcgggtatttacgcgggcacccttgctctatgtgtggttgcatggatgtatgacaagaaaaagaaggagcaccgggccgcgacggcaggtttactgaaggaggaggagcacgtctctctcaacatccagcgaccaggatcatacggtgcgaccactcgctagccccacttgactaataatgtaggcgtccttatg

SEQ ID NO: 4466 - DNA, 700 bp, Nannochloropsis_gaditana
tcgtgtcaaagggtgaataccatttggaactaactaataatttacggcacgggcttcatcgcaatgctccgaattcggttcctcgtatcctttttgacgtgttcgaacactctccacctccgcgctacagggcacgtacagcgtgcacagttgtatatcggcctgatacgacacatgagaccgtgaaatactcggggcctgaggtgccgtgtaaggttttgctgcactaaaagcgacacggccgccgtcgccggatccctcacgctggagcttttctgggcgatgccgcctaaaaagagacataggttaaatattcactcccccctcgggcttttatttatgtgtacaaaaaaatataccaaaaaatcaggtcacacacacccggcgtttgcttgaaaaggtgtgttgaagccaaccggaggagctgcagagctgggggttagggcggggggatgccctttacgctctaccttattttaggcttgagtttcctggtccaaagcactagcatctccgcattccaccactttcattcgtctgttcaactacttgaggggtcacgagcgcagcgtcgtggtcgccggagtacgacgctttcactcgacaaaccattgctcgctgaaggcatcaatatacgcagcctccctgcaggcgtacccccggcactccaacaaggccagatcctggtagcaaaaccatg

SEQ ID NO: 4467 - DNA, 700 bp, Nannochloropsis_gaditana
tggatcccgcaagcaccacattggtgtctcgataaaggttaataatataagagtccatatcgccagccacggcaggatatatcctaccgtacgaagacgttgcctatgagcccagttggcccatggacttccaactacgggatgaaatcgaattaatcgatccagtccatctttgatacaaaatacggccttctgtacagtatcttcaaagttatgcaactgatacggatagccgtctggctcgtgctgtccttctccccgagtcaacggtgctgttgccatagtggagttcagaggcgtgaatcgctgtcaggagttttggggcgaggagacctgacgccagtcccaccgcaaattggcactactgctccatgtaatgaagtgcaaagggccctggaaaatagatgagcctgccagtgtacatgttggcgacgatgaaatcaaaaattagtcgtatgttagtggtgtttccggccgtttgcccagtatttctcttcgcgacctcgcatgctcgctggcccctgccgatcgatccattaaatcctcatagcgccctgacgcctatataccagtggtcccaagcccccacacgacgtttcgacacggttcccattgctcattgccgtcctcaacgttcctaggttgtcattgccaggtatccacacatattggtgcgtgcgaccgctgtcgacggcagatg

SEQ ID NO: 4468 - DNA, 700 bp, Nannochloropsis_gaditana
tccagcgcacatccttttccaaggagagagcactcactcgcattgtacgtcacacaagagcttgcgcgtagagtgtaatctactacttttactcgtcctttcagccatcctgtgaaaatctctttaatctgtacacccacaacccccagatgattcattcatgttaagtccacactattgtttgagggtttgggctccctgttgctgcgacagaacctggtaatcatggcgatggccctaataagctgtacctcgctgtcgcctcgcttacttcttcataccgcgttactgaaaaacatgtccccaaactttgtcaatcctgacatgaagctgacagccacaaacgcggtgaacgagcatgcaatgatcatgttgtgaaaagggagggattaagcccaaacggggcaatttgacagtgacatagactcaggctagcgtgacaggactcgaccaacatcgggtaggtcacggtggaaggccacgcactgtaaaaaggataactttatccaggttgcccattcagtccgcgggcacatgaattgacaccgccgtcaacattccacgaactgaatcctattgccagtgattttgacgggcgtgcacttacccgtctcgctacctcacagaaggaaaagaggggcttaacgcagtcatatcttaagccttttgctccattgtatcaaggcccggtaccagcatg

SEQ ID NO: 4469 - DNA, 700 bp, Nannochloropsis_gaditana
ggctgcgcagctccctgaaggaaatcgtgtcgtaacgtgatttgaatttacaacagtgagagggaaaatttttcacactcctgcatggctatagttgtagtgtgacgcgaagttttaaaaagcctccctacccaaagtcatcgtctgaaggaggctcatgttgtcacgtaaagacatgtagcaccaagcgggcgacgacccggaatgggcccctcatctcctcgtttttaaagccgacaacgatcactaaactgacaatgggacgaacaaccgtctccaagtgatttaatttgtcgatgatttcgatcaaggactcgaaatttgcaaactataatgaaagtttccaagtcaatgaccacgacccagccccatgacttactctcgagctgcaaaaaatgggtcctgtgccattttgagaggtgcgaacaagctcttggtcgtccggtcttgtcgcctgtaatcgttaatgaggaacacgtgacgggcgtcgtgaaggaatctcgttgagggtggagacgtgggcgtgggctcgggatgcagggtcggcggccgggcgggatggcggcgggtgtctcgcctcgctgggggccatcgaagaaatccctgctctgcccgcgcgctatatgaccttcggccaccgccttcgcttgcgtctctctgccgaaatctctttcacgagcgtacatgtacacgagacagg

SEQ ID NO: 4470 - DNA, 700 bp, Nannochloropsis_gaditana
agttgacgagtttcgggggtcatggagcaggtagaaaagcggacagaacactcaaaagtagcgcttctgattggtgtcaatggcttagtcaaaggcctagcgtatatttttttcatccacaagaagatcggccgcatagtcgaataatgcattcgcgggaaggtgctatgtctcgttactcagtagttatcgcactcgctggggcgggaggttcgcatgcttaacttctttttaactgaatactgtcaagcgatcatatcctgtcgaatttgcgatggaagggggagaggattatttaatgtcgcgtgtgcgaggggccgctctgtcgggccctcccggtgcatgagccaacgagaatattactagtagggaaggacacaggaaagccccgaattcccccacaagcttttgttgtgcaatcgtaaccgcagtgcgatgaccagacggtaaaatatcaaatgagcgacatccagctgcccactgctttcatggttgcgtttcccgttctctcattacagacgcacggagagaaaagcgtatgtgcgccgaaagctgtgcagggggggcagcgaggggcggtatcatgcttatgcggaggctcgccgggaggctggcggcacgtgtgatggtgatcaggcgggagtcccgcgagcactcgatctgcctcatccatcgcaattgtctctcaatgccacagcag

SEQ ID NO: 4471 - DNA, 700 bp, Nannochloropsis_gaditana
tccatttcatgtttttgctttcttttctttggtgcgattcttacctgggcaacctgccatccacacgagccggggatctctccgtggggaaagtgtaggaggcgaggaccgtggaaggactcctcgtcttgacgtgccggcgaccataggagtgagcctatacgagcagaaagcgtcgaccatagttgtgcttaacacgacaagggccattgcacccatcgcggaaaacatgattttgaaaatgctattcatccttgtctggattggcgtgtcggtgcaggagggatcagcagaggaacgcggccttgacgaaaggatcccagttttccggccgtcgcctccctgactctgtcccaaacaggaaattagacagtgtaccagcctgtgcgggtgaaatcgtaaacaggttactcttcttgaaggattgcgacggcccggagtgcatgccgctgtgcccgcgtggctcagctcgccgacaggggcaggcgagcagcgcccgtcgccagttctccttccccctagcaggaaccctctctcttttttcgcagtcaattggatctcagtccgcattttcattctttcccaatattatccgactctcaagcggtcctcacacgtctgcaagaggttgcacatcctttgcatcggctccaaaaagacttttccctcttgcatccacgtctaacctcccgacttcatg

SEQ ID NO: 4472 - DNA, 700 bp, Nannochloropsis_gaditana
gttgacgtgcaatgtgagaaagcaatgcatttacctcctcgctcgccgttgcctgttgaacgacgcaggcggcattcaccatctcctcgctatgctcgtacaaaggcctgaccagtatatcttctaaaagacacacgtaggataatgagtgcccgacatttaaaagcgcttagaatatctaacctgggcttggcggatggcgtggacgcggaggttgcggaggacgcggacagtcccgtgggaggctgccggggaggctttgacgtcttgatcgggagcagcgacgaggaggacgacagcatagaggcgggaaaaggaaacgacgaaaatatcgatgaggttggcagattttctcatgagctacggccagtagccctactcaagccaaaagcaaaacggaatgacgcttcgaaagaggaagacgacgaggataagtggtggcaaattgagtcgtgtgcgcggggagccgaacgggatgagaaggaacgggtaaatgttttaagtgacaagacagagtgttcaggcctcagggctcttgtaatcgataggaaggccctcaatcttgatagggagctaatgtttcgtttcgggcaggaggggctagtgggaagggggggggggagggggagggggaggctcgggcaaccgttctcgggcaaggacaaatttcggtcatagtggaggtactttgtcacgcatg

SEQ ID NO: 4473 - DNA, 700 bp, Nannochloropsis_gaditana
tgctctactaagacttcagaaagtgcacgctgtacgtaacgaacaatggtctcttttctgtggtcaggaatgattctaacgtgtttcttattccatcgttatccagctgcttgtgtttgggttgctatcatgcattatagttccttttttatgttagcgttcagtttcagagccaatcgctgcttccttcttgacagatcgctcagactgcgttctcgttcgttgtttccagaattgaaggccttcttcatgccgcactccttccccccccttttctttccctcattctcacttttgcgagcgcgttgcaccacgactccgtgctcatcagcagcttaaagtttcatggcatttcactttatcgtttagagcgtagggaagaaactctgttgaatgtgcccgtcgccctgtaataccattagtttacttactactgaggttttacgcttacctgtcctgatattttaacatgatccgctcagcggtcactaagactgcttagctggtgttgtggtatgagatctttctggcaaaatttctaagataaaacggatgcctctccgtcaacccatgtagctctcctcagacttggtcttgtaatcctgttccctctcctacacaggttacgtcgccaatccttcccttgcggtctccgtaacattaattcattacaaccttagaatcgcgattttttgcgatg

SEQ ID NO: 4474 - DNA, 700 bp, Nannochloropsis_gaditana
cgtcgcaatacaatttcagcacacagaggtatggatgaggaacttgagacaacatctgacggagaatgcgccactgcatctcgaccaccactttcttttgtccttgttgaagtcgtgccggtgatgagcacagaggtttgaggaaaatcaaggcggggaataaaggcctgtacaactttggaaatcatgaagacagcggccacaaggctagaagacgccgcgaggcccttcatattggtggagaggacctgtgcatgagtgggggcggtgagggaagatacaggtccggttgagcctcgccagaccctcgccctttctcccactccgccgactcctcttcaagtgccccgagtagcaagttcccccgtggcgcccttaaaatgcctttctgccctccttcaagtgcctcccgtgttctgcgatctcgctacgagccgaaggcctgagcggccccgcgcgctagctgtactttagtgtttgttgggcttgaagaggtctttctgcttcgtggcgcgcggctcgattcagcatgatggttgggagggaagtctagcagcttgatacttgggagaagacgtgaagtatgtgttgattgtaaggggtttctcacaagggactggcattcagccttttctttgcatctcgactcatttttttatcattggcaggcataattgcatacgccattgacaaagttatg

SEQ ID NO: 4475 - DNA, 700 bp, Nannochloropsis_gaditana
taatcctcctcgtcgatcacttcttcgtaaatgtggcgttgttcgttctgccctgccgaccagatttcggaacagagtcgaggaccctggggcaaaatgatcgcagcgtcggtaggtgcgagcgatgaatgatgttgaaggccaatcatttccctgtcatgcgagccagtgagagtagatcttcggggggtgctgtcagacctccgactagtcctgttcccgcggtgtgccgtactggcacgggaggtagaggagcaagtcctcgcggtgtgccgtactggcacgggcggtagaggagcaagtgctcgcccaagggcctcggcgacccttcctccggccacggcctcagcgtgggcgcccccacctgcccgccggccttaactcgttcgctccaaaggaaggcgaccatgctctcagccaggaagacttatgagaaggatagagcgtactcgactcctcggggctgtgtaccttgaaaactcgtgctcggtttctgtacccgtaccaacatcgctagcatatagggacagcttatatattgtgtagcaacccactcatttgcctgtccacgaatgtcaattacagcttacacctaggcacagtcttcgtattcacggtgtagagtttattgcccacgtgcaattgttggggagcaaggtggcgaccaaactattcggtcatatacggcgttcgtttgatg

SEQ ID NO: 4476 - DNA, 700 bp, Nannochloropsis_gaditana
ggtataaattgtaacagagatagcaacttgataagcgaaatacaactcgatgcccgtaactcaaaagaaggcagcaaaattgtagaaaatcgttctacagagaatgttagacccccgagattcttttccaccccaaacacaccagaagaaaagaaaatcggtaatttgcgctttttttccggagaaagggcgggctggtaagatccttcttactgagcagagattcgccgagcaaagccctgacgataccaatatctgtactctggaatgcaacggccaggaacacggcccccgccgacgaggtggcggtaacataatgtgtgactttttctttgtgcggctcctggaaccgacgcgctaccgtgggaattccacctatacccgtggccgagacttattgcctgagcttccctcccagcgaggatgagatcagctgtcggggctgaaatatgcggccatattttgcatctcgcatatttgccagccagggtggatagatgttgtccacataacatgggaattccatcacacagattattagaccacgacgcgctctcacactgtttttgttggtttatttgcttcacgcaggcggtgcgaggaggttagtgaccgcggtcccccaggtcaccgcacgtcatagaactcgcaagctcaagtaagagcaaaagcggtgcaagaatctcttcctaagcctatg

SEQ ID NO: 4477 - DNA, 700 bp, Nannochloropsis_gaditana
tgcgcccgctttgttgtccaaggagccggggagaggtttatttcgcacggtcattggttgcggggggagggggtagacgatcacgtccacgccgaccgttggaacatattgtaagccgtgcaagggttcattgaaaaagcgacgaatgaagcttgttttgccaaccgcggctccgcccacaaggagaattttttgagtaacttcgagctgaacgggaggaagtggattcataagggccaaggaggggcgcagacgggccaaaagctcagtgtccgcagaccatgtgtatataatccatttaaaaagtgctgtttttgatagatgcattggaaaaatgagggtttcgtggcattcaaagggaagggaaccggaccaggaggtgggctgaaagtgaactccaggaacattaaaacatcgtatgcaacacgacgattactttcctgtctcctaaccaccacaagtgcctgtataaatgctccgtacatatgtatccgtccgtcgcacacccttcccaggcctcgcggagtgacttccatgcaagcaggggcctgtctggccgcctgggagggtctcgctaagaaaggaaagcctcgccagcccattccatgcacatttcaacctcgacctcttctaacaagaacaccccattcacacgctcattatcccctccataccctcttatacagcaggacagtccatg

SEQ ID NO: 4478 - DNA, 700 bp, Nannochloropsis_gaditana
gagctgcaacgattgttggaagacctggcgcagggaaacaaagcaagcttgccattcttccaccgcgtggatccagccaaggatgacatgccgggttacgcctcgattgtggaggagcccatggacctggggacgatcgtgcagcggctcaagactggttggtacgaggaagaggcaatccatcgagggaaggtcctgggggaaggaaaggaaaaggaggagccgacgcaggcgaagcaaaaggaggaacaaatgggggaggccggaggggaagccccgaaagaagaggaaaacggacgcgaggctgctgatcctctgcccgcaggaagtggcgtggaggatacggcccaaaccgtcccctcaacggctgctgcaggagaaacggtgccttcctttggatcgcgggggctcagcacccgtagcaaaggtcggggggcaaagggtgtgttggatgatgtgcgtttggtctgggtaaactgcgaacagtaccacggccccgatgccgcgttgacggaagtggcacaggcgctctcggaagaattggaggaaaaaattcagacacgggttctggagccgttggagagacgggcaaagtggttggcaggtgagggaaggaaggagggagaggtggaggacggaaagagggaggaggaagacagggttttgggccttggcggggacggggagggggaagacgggg

SEQ ID NO: 4479 - DNA, 700 bp, Nannochloropsis_gaditana
acagtatgggcgtatttttgcgcggaagactttgaatttcaaattgggcgcgcagcggccactttaaaaatcaagataagtagagcatgcacatactgcatgctgctatcaataaattccccccaatttattcaaaataaagcggtttgattcactgggagcaggcacggcttaaaaagtgcctgtgggacatgggccacggcaccggggcaaaggggagcttatcgcttttggggacattatgtgatatcctaggccgtattccatcatcctcctcctccaccggggaataaatcagaatattttggtcctcggcatcggtctattcggtatcctagccaaagccaggtcacaaccaggttcgggtgcgcggtggagaaagcttgcttgccgtctcgcggtcttatcctgatttcgggacggttttttgttccagcattcctacacatttacttttctcaagtatagttcacgtgctcgacgtgggtcgttggagtttttgcgcggggcaccgcggttgaatctgatggttaagctgtgagacttgcctcgtttgcttatcttctccaggggcgtgcgggggacgctcctttagcctccattgctcgcctttatcgggctgcgtttttgcttttaaaagaggcgagctttttttttgtttcttttcttcttggctgtgtttcgtggagctgccagcatg

SEQ ID NO: 4480 - DNA, 700 bp, Nannochloropsis_gaditana
acgccctcctggctctggtggaggcttgcctcctgcgtggagaccgtttctatggccttttcctcacgaccgccctctttcttcgacataagactgagattttgtgcctgcaaggatctgctctgcgcttatacctggaggaacttgtggcgggggggaagggcatcgcgcagtgttaccagccgtctttgtccggcactccctctaccatgacctcgacctctgcctcttcgacggctgtggccaggtggatggaggaggctgctcgagtggaccgaagcacgcctatctcctttcgggtgaatctgacagcatcggaattgttgagtcgggagaaggctgcttcgttgctcggtagcccgggttctgtgccggaatattctccccgtgcagaagcagcagatacaccagcaacgacagcaacagccatacccgcaggagcagatgcgacatcgccccaagggccggaaggggccatgataggattgcagaagggcatcggtgctgaacatcctccctctgcgtgcacccaggagcagcgtgcctacgatgttgacctctcctccctcacgcttcccctccagcggttaatcgacgctctgagcccaagagtcaccgacacggcctatccttcaccctccacgccctcctcggttggcagcatgggtcctcttccgagcagaagaagcgaccaggggca

SEQ ID NO: 4481 - DNA, 700 bp, Nannochloropsis_gaditana
gctagaaccagctaagaattgcatcactgagacaagacaacggatgtaggcctctgcgaatgcacacgacagtcgtctttgtggatcggcagcatgatattggtactgaacgctgcctcagtactcgcttacagtgagaagggagatcgaagacatagaggaggttgaattgcggcgtacgtctaagcaagcaaacgagtgtcagcacggcatgcaaaaaggtaacttcactcatgaagacaacatttctcaaaagtttaacatttattcccaggctcgcaaagcaaatgcaccaaatacagagcttagagagggcaagccacccgttacttcggcttccccgacaaacgtcgaaagggtgccgataagccacagtcttcttattctataccgctaccgtcccgtggcacggaatagcatgatctgggcacggcgtttgctacagtctcctcagtggcatcgaggttcttggcaccggaaccttttttatcccctatctcggctggccttcacgtcagcggccgggaatccgtctcccgaagctgccacgcatccccatcaatatcccttaaagaagtgccgtaatattggaatcattgcacatatcgacgctggcaaaactaccaccacggaacgtatcctctatttggccggggaaacgggccatgttggtgacgtggacacaggcgatacggtcatg

SEQ ID NO: 4482 - DNA, 700 bp, Nannochloropsis_gaditana
cgacttgcttgttttaggtcactagaaaagtttgcatgttttttttagcggccttgcaactctccgcaggtccaaacccgttgacctcctccctcgtgtcccttccccagccactcattacgtggtttccatgcctgcaatgccgtctcctgcgaaggacaacgtgccgtacgtctcctacaccatcgttgcttcttatgaatgcgagcaccgcccaaatgcgggcgtggagcgcgtccgactcgcatgttctattggaatttgaagcacagcctcggctgcaaagacaagccgagcgagagcagccagcaaggccgaacaccgggctagatctatgacctgctcaaaacgaacactttcctcaggtcgcgctttccccacatcatgaggtgtttcccgtttccttcatggaaatggtggatctttctgcctggatgtgcatggccggtgcaagggttcttgccaatcgcgtggattgtgtgccccacgagatcaccttttagcctggtgctggcctcctgctctgatgaggtagcattttgccatcttctcacacatcctcaatttctcttccttcataatcaggtactctgtggcctaggcctcatataaggaccttggatacttgacagggtcctgtcgcgcccacccttgtacatctccatcctccttgtgcctgtttccagaaaaacctttcatg

SEQ ID NO: 4483 - DNA, 700 bp, Nannochloropsis_gaditana
gatatcttccaaattctcgttagctattagtttctggtgtaaaagtcctaccccggagactgcagccagagttcgtttgcggccttcccttctggccttggcaggggccgcaagaaatggcaacgaaacgagagcaagaggaggcaatggagatttttacgctttcttggcagaccagcagcaacgcaagcgagtcaagggtcaggaaaaatgtattgcatgataaatgaggttaagtttttcagataatacgaaatataggagcgaattggaaaagaacagaatttatgtccaaacccgcttactcacgttgaagccgaaagcaaatttaccacgccgcatggctcgcctttgaacacaagtttctcgtgacatacacatcgggctcagcgaatcgagcctgcacgtcccttttccactcattattgtgaacgacacaagtgactaaagccaaacttgcggacggcccatatgtgccctgcggagtgctctgtcggcctcctgctccctcccctcctggctgcaatcttccacttgaaggaccgtccttgcactcacccgcatttaaccccacagaggtgcctaccatacactgattcggtggttgtacgtgtgtattaatcaagatattgtcatttcaccgcctggcgcgcaagattccaggcgtcctggtgaccacggagtgacatgtcatcaaatg

SEQ ID NO: 4484 - DNA, 700 bp, Nannochloropsis_gaditana
ggcggtagacggggggaggaagaggaggacgacaacgctcctcacgcactggcaaggcacagctaattgtggcaaccaaacccgcccttacaccaagctactcctatccctttctggtggacgtgtgtattcctatccacgactgcgcgtaccatgaggttcgtcgaggtggagatgaaggattgaggggcttcgggcggtaacagcatcattctggtcgcaaccttgcccttgccacatctcgttggaattctcaaatgaccattgagcccccaactgggcagaacgaaggcatgtgacagcactgcactgaagaaaaggagagacaacgtggttgcaattccttgtcttagacccatcatgagcatgaagacggcgaggcggagggaaattacgactgcgaatcacggcaggcacacccgaaatgtaacgcaatcctctaacctgcagtaaaggaaaagttttgcgtgagtgtgcaaagtacaagtagccttgtcgccaaccagaaaagtttcccagacagtgatatcttacgggaccgtgcggggtggaaactgacgaagaaaggctcgcctgggactcacgtcgtcacatatccattttaccgcaataattgtggttttatcaccgctttgtacatgaaggcacgtttctaaggatctcttttacgcgacctcatcaaattcatagggccaccatg

SEQ ID NO: 4485 - DNA, 700 bp, Nannochloropsis_gaditana
gccttgggtttggccgacaaaaattcctttagctcttcacgagagctcacaggtaggatttcaatcatgatttagagaggtgagggcagaagagataatggcaagtagagggcatcacttcctgtgagtgtatgcagtgccgcgattttcctgctctgctaccccctggcaggccaaaggcgaccagatgcgactcagggtgtgtgtttagcggaaaggacacctgcgtaattaatggagtgacaggaagccgctgtgaaaccatgaaaaggcaccttttggcatccccccaggccgcgctggaacaagtgcatgggggtggggcgggcgctaggacgtgctgtgtgcggtttgagtgcgtgcatccaacggctggcgaggcgcaatggagggcgaggaggccgccgccctttggtccctgattatggcatgaaagtggtgtttgtttgggtgtatgctgtaggattgttggcggacgggcacattttgtcgtgcgtcgggagttggttgctttgaatgacagaatgacggacgattttgtggtgaattttgcttgagagttactgctcaccacgttttcttcagtcgaccctctccccctgtgtactgtaagttttcaattacactgacatctcattcaccttatgcccactatcacctgctttataaaatttatggcatacagttttgcagtagcatg

SEQ ID NO: 4486 - DNA, 700 bp, Nannochloropsis_gaditana
ctcggcagctcctccgccatgatccgctccaaggccctcacagtccccgcgtccaggtgccccagcacctgcctttgcaagcagcacatcagcaaaagcaccaaccctgcctcgtctgtccacaagactgccccttccccactggggccgcgttgctcaaaaagtatccggacctttttcaggtactccagccactccaccttcccttcttccccctcctccaccgcctggattcccaatctttctgccaacttcgcgcccgcctccttatccagggcctccgcccacatcatcctcagttgctgtacgcaccatttggcgggttcagggagaagggcggcgccggcggagggcaaattcatctgttgcgtcacgtctacggccggaaacacccgccgttgcgcgaggccgacgttcaaggtgatggcatggtcgaccagggaattgattcgatgcgccaggccgtgacccccgtcctccttccctccccccacccctccctcctgcccgcttgtcacctccccctccaccacgaccaaacccgtcatcgcacctcctcccttggcatcagacatctgcgcgcacctctccaacaaaggtccgtgcagagccagcccatgctccacctcaggcttctgcatgaatttggccatctccgaataagccgccgcatgcctagacaggtcatcgcagaccacca

SEQ ID NO: 4487 - DNA, 700 bp, Nannochloropsis_gaditana
ctgtcatcctcttcccccgcactgccggctttcccgcacaggagcgtgcccaagcatatttctggctgttccaagtctgacaatgcaacgcgcacacggtgttttcgttttttgttcaccatgaaggcttgagttgaatagtggtgcctattggagtgatggaggtaggcatcaggattgagactgagagaggaagcttggcagccacagcgagcaatccgaccgtaaaaagtattgaaaaagaacattccggtgcttcaaatgttcaatctactttgaataaatcaaaagacatttttaggtgagaagataagaggaaaagacacttttcttttttacacattggggtgataaggtctgtggcaggcgacgggagcgagacgagcgaagctttgggcaccggaaagtatgtttttgttcctttcaaacgcaagctgaccaccccacccacgcatggacgaccccttcccacaatcaggtcttcacatctctcctcaccatcgatctgttgcgagccctaccggaacgtcgtggcctaggcgtgtcatttaactctgtgtacgcagggtttccctgaggccttcctcgctcaaagagcacctcagaatcgagcgagtccattgtcgaggattctagttcccctttgtctgtaaaacttatcctgtcgagtcaactaactcgtcccgttcagtcaaagatg

SEQ ID NO: 4488 - DNA, 700 bp, Nannochloropsis_gaditana
aaaacttctcaattgcacgaaaaatgaggtctagcgtgaagctttaaaagctcgcacaaaatagatgaaaatccacgaagtggcgcaattagtcccccagtgcattagtatgggttgggttttttaaacagatgtcaccacttgtttaaatatcttctcacgcgacgaaagaaattgtttactgtctacctccagaatgtctggtactcgacaaagcgatgtaacctcccgacccccccgccacccaaaagcaatgccccgacagtatccttcctattccttccctcccttgaacttaagtaccatctcccgaattcatcagtcacgtaaaatgcgtaaaatctcatatttccacaggctttccatggcagactacaaaaaagttcgacacagacagcggcctcggccggtggagcggcccaagcccgatgggaatttctggagcaaatttatcaaacccaccgatctgtcattcccaggggcagtgtatgctgtggattttaatcccctatctccatatgatgctcttgttacagcctctgcacgcttgtccctagtctcgctaagtcgggggtccccgaaggtcagcaaaacattctcccgcttcaatggtctggcttattcgggcgtgttccggcccacggatggaaaattgatcgcatgtggagacgataatggtgtcgtcactgtattcgatatg

SEQ ID NO: 4489 - DNA, 700 bp, Nannochloropsis_gaditana
tagttggatgcatgttattggtcgtcgtcgtgcgctagcttgtgtatggtacgcgatttcctaaaaaatgcgcgtgcacgtaggctcctgacttgcactgtaacaaaaatagatagatacatccgttcgacccctagagacttcaagtaagatgttgtaaacgcctttacaacttttcagacaaaattttcccgaatatgaaagggaaaacggtggacaatgtcaagggtatgtacgtcctccatccgtgctagtcggcattcaattcgagaggcccctttcatggtccacaacgtagactcttacatgcactgaagccccaaggaaaacaaacttcgcttccttcgcgatacaccccatcgggcacccttcacttgggctcgttctcgctacctcgacgtgcggcaggcgtcgattgatccccatctccccgccgccggctcgcctggggcccagctcgctgcccgccctcgttggctgctagtctccgaacctcccctccccctctacccccctcctatccccccgagcctccctcctcgcacatgcctcttctggccacgtcccatccgctcgataactagttaaccctaactagctaacattgggtgtgctggacacttgctcgctagttcgcatctttctattcccttgcctgttctggccgacataacattgtaggcagcaagcatcacatatg

SEQ ID NO: 4490 - DNA, 700 bp, Nannochloropsis_gaditana
gagaaaagcaggagatgacaaaggagtgatgagtcgcgtcgctgctaaaaacttctctcttcacattcacgtaccttatccgctacattgatgtcgaaaaaaactttgtgcgttactttcgtgaggtcatcagcttgactgtaagtatggcaaagaattgtaaaagatcaagaaaataggtcttaaatgcgattcatcgggtttcgcgatcgagggatgaagcaccatggccagaggacctacacgaacctgagagcgaaggtggccatgccgagcatgaacgcaagagacttggcaaaggccataatagctggatgggttaaaagaggaatagcaggaatagaggtgggcgtgccgaatgcggatgtcgaagaggaaaaagtaattcggcagaacaaagacgaagtcgccggagcggcagtctgggcgagacattcgatgctgacagctgtggcactcccagcggcgccgagatgttggaccgtgccgtgacttacggcgaaacgtgccgtgcgcacgctgtcacgcagaccaagggttccagattttgcacgaccttgacaatgtttgactgacagccgcatgttcagcaagttgtcggtcggagagtctagcaccaggtccgtctttcgcccgctgtgacacgaattatataaagctttctatttcttcatcataggccaaaagtaggccctgaatg

SEQ ID NO: 4491 - DNA, 700 bp, Nannochloropsis_gaditana
tgggcctgcacattcctctgatggctccttcgaggaaagtcgggaggtaggggaggtaggggaggtaggggaggtaggggaggtaggggatggtaagatccagcgtaatgcacgcgtctcactcggaaaggacaattaaaattacaagagaggatatacatatcgcatctatcatcccgtgcctctctaaggcatttacaagaagttcctcaactcgcatctctcgcttgaggctagggatggactcgacccccaccctcgctgcaaacctcccgagtcgccgcctacggccatgtccttgacctatggcgcaacgatctcacactacattgctttccacgttgcacaggtagcttacagcagtacggcagaatcgatgaggacaagcgcgtcacgtccacctcattggcggtggacttcatggtttccatcttcccagcgtgcttcctcctcatggcttcccctcctgctcgtcactttccttcttctatcgccgtacttagccgcgtcttcctcgcgacagtatgcttccagcactgccaccagaacatcgcttagtctagaaacgaggcgacttggagatgatgtcccgtccaaatttgcgcaaaaggtcgtcggaagaccttctcgaagaagacagcgacgtacatctatcgctcttgccgacgggggtcgaatacaagagcttctcgcacggatg

SEQ ID NO: 4492 - DNA, 50 bp, Nannochloropsis_gaditana
tcgagcacggtgcggcggacgatgacgtcgaggacgatgatgtggaggtc

SEQ ID NO: 4493 - DNA, 700 bp, Nannochloropsis_gaditana
taggaggctgaagtccgcttcatctacagtgtagagtatgctccacttttgaagccctagcccaccgtaaggcctttccctggtatgattcaagagagcacgtcggttagaatgttgtcgtgcacagcccttttaattccacgaaaactttgcgcacacgctcgaggacagggacggcgcgagcagacaatgaccttgacatataaggtatttgggcggaggagccctgcagactacgactgtaaagctgtcgtcgttgcggggtgtccgccatgacttccctccggtccggcgccccaccggtcgggtcgctcccagcgagcttgaatcaggcatggccgagtttctaccgaatgcacgcctgggaccaggactaccccttttggcactccgatacaaatttggcgagatcctcgtggcgcattcatggctagctttcgagcaaaactattgctcaaaaccttccttggccggctgcttgtcggcgcctgcgagtgagcgtcagggtcaggtggtaatatgcccgcttcgcaagactcgcacgcatggcactctttttaaaacccggcgaaggaaaatttgcgtttaaaattttcacattttcctaccactgtgattatttccctgtagtcgcgagcgtcacccagacacgaattctttggaaagcgctggagagcttgtcacctagagaaaagtgatg

SEQ ID NO: 4494 - DNA, 700 bp, Nannochloropsis_gaditana
cggaagtgcgagctgcagtgcgtggtgctggagccaacttgcttgcaggcataaagcccagggctgcctgaagcagcagaaccgaggatgttgcgaaaagtagccgtgccatatcttcttttttttaattactgcgaaacctgcgcggtgaaattatcaacgtggaaggtgagtcgtgttggagcagtctgttgcacttgaggtggagtgacgattttgtagttggaagagcacatatgacatccgatcaggtcatcgacaccacacttattcacgctctgcattaaaaaagggcttagaaagatgtacgcaattccggcgcggctctacagctctaattgacatcagcgccggatccccaagtgcatctagtggacggactgagtcaagatatccaagccacacaggaaaggccccatgactcatttcccgtccccaccatccttcctatcacgtcatgggaggatgacatgtcgaaagcgcgggggccgcgatgctctccgcacgcccctgcgtaaagccagtgtccgcgcgactcctgcctgtccaaacccgttgcttgagcctggggggccaagatgagggctcgagccccgctcgcctggtcctcgccgtctcgactgccctcccacacttacactccgacacccgctctcaggcacagcgtttgggacaagagcctgtgcctggtgtaattatg

SEQ ID NO: 4495 - DNA, 700 bp, Nannochloropsis_gaditana
aaagatgttccgtcgaagctatctacgactgttcccaatgcccctttttacgtgcgctgccgtttcaaggtccgaaatgtagtccagtccttgtaccagctcatcaccgtccttgcctgtggccgggattgcgtatggctcaacttctccgcgctcaccaattcaagtgcttggaatggcttctccttatagcctcacccccacttgctatccccggcattgctccttcctgcgagccccagcgccgctcgtagttgggcatcccctgagcatttgacaagaaatgtgatcatcccatatattctggcgtgaaacttgtttcgcacctcgttggacaggtaagtggcaagcgtggccagatcttcaagcgacggtgctgtgcgtcccaggagcgccatttgtggacagacaagaaaggaaaagaagaaatttgcgcgtccgcttgaggaaaggctgtgctgaaagatgccacatgcgaaagagcctgtggccggggcccggttccagtcgctcaggcggcgatatcaacgtcatctcttactcgcctggccgcattgcgcttgactcagttgggtctcacagcatatcgacgttcattcgtactgttctgtggtcaagagaaataagattgtcatcgtcgctcgccctctaactatctttctctcacctgtgttgtacccctccgtagcacattaccatg

SEQ ID NO: 4496 - DNA, 700 bp, Nannochloropsis_gaditana
ttaacgtttcaatgatgaaaactacttctctgttgagcgcatagcggccgcgggggcgacgggcgtggctggcctcctcctagccatcgagaagcggcgaggttgtgatggaaaagacctcaccttctatacccgtgactaaatgacctcacttacccacacgtgcgtcttggggcagtatgcccgttcccactcttgataagaataccaagcaagtgggtcgcatgtctattcatcccctacattatatgtctatctgcgtcgttgttgcagttgacgggtagagaaataatataaaaaacaactcggaaaggatgaggtatcgtttccttttccttcgtggttatcgatgccggagcaagaatttcaaaaagagaaggccactgactgcttgtttgtctgcttgtgctatgtaaatcaagcgccctaatgcccctgagacccctgtctatttttccgcacctatgtgcattcaaacctcccgtccccaccacacctcccttaccccggcagtggttggcggagacaatctgtctaagggaatatgacgcgttcatcagtatcacttattgaggttggccatcttgcagccgcagtaaacgctggttcccttgcgaatggcgaagtgcccacgaaagaatctacgacccccccctcaaccagccatagtgaagacggaaaaatgagtgcagtaagcatg

SEQ ID NO: 4497 - DNA, 700 bp, Nannochloropsis_gaditana
atacctcccattgtaacccccactggcggcaagttgaaccgaggcgacccgtcgtgcgaggatcccgggggctttgtgagacaaaagtagaaaaaaagaggtccatgaaaatcccgctctcgtgccaagtcaatgcctcaactgttattcatgttgggtacaactttatgtcacagcgatgcggatacgcatttccccactgggtgaacaaaacctcgtggcgaggtatataactgcccgccacctcacggatgcagcaacacatcagccagccgccctaccctcaacgcaggagaagaaaggacgcaacggcgaccaaaactcttctcgaaggaaaaggtcgagacagactcatgcatctggcgtgtctgggcgacaatatctgacgcacccaggagtgccagccgggacaatgtttgccagggaggagatggcgatgaagaagcggatgatggagacaaaggaaggagtacaaaaacatttggccaagcgtctaggctctgctgatgacgtgcttgaagagcaaggggaggacgcccaaaatcgcatcgaacggggtcgaaggaccggggtagcttccctggtcgaggagcgaatccaattaagcatgattcgtggagaatttgccaacctgaaacgcagggggaaattggaacgggagcgcaccccaggccttgatcgtacgacagacatattcatg

SEQ ID NO: 4498 - DNA, 700 bp, Nannochloropsis_gaditana
agtccccagtgtgccatctggtctgtccggaaagctgtgggcgagggggacagaattgagcttgcgccctaacctttgcacttgacaccttcaaagtggacagtccatgcacgtcgcgagcaaccattgctggaaccttgcctgccttgcatcttgagctgacttgtcgtatgtgttttcttggagtgcgcagccacgtcgcggcgaaagatacagggtgcccgtgtcctcttgcctttctcttggctctcctttgtttcctcatgaaccttcgttttcgcgcgtcggaccttttaagacttgcatatatctgtcgtgtttttccaaattaaatgtgtactgcggccgtgagacgctgaggggcagtggttcatcgcgctatattttgaaaggcagaaagctgttgcctgagtctggcccccaaggatttgaagaacttgtaacatagaccatcaaaacctgaaaacttgcaccctcatgactcacccctactcccatacatctctccaaccgaagggtagtggccgtagtgacattgcaacgctacagacaattctgtcgaatcggtctataatctcagcgtgtcaagtcaccaaattgagatctttcgagaagcagcatcagtatttttcgaggggcaccacagacaggcggctcaattattaacatctcagacaacacgcacgacgtttgatctatg

SEQ ID NO: 4499 - DNA, 700 bp, Nannochloropsis_gaditana
tctctcgtttgcggccgtgccacctttttttctcccgtggtgagagggaatggatggtggagaggccttctgatatttttttcgagtgacctatcaaaaagcgacgtgatgtcttctcccaccgttagcaagttcgcactgcccacgcatgctcctttcatcatccctctcactttattttgcttggttgtctgacgtgtgggaagtaatgtcaaccaaacgacgtccccagccgtgcgaacaaataaaaaagcaatgcgtgaggtaggctcctcctctttcttggcgcggtactcgacctcatcctgtaacatcaacctccacaaaagaagtagcatccgcaccgtaaaatcgttgggccaacaaagcaaacgcgcgaggtcacctgttatagagtcggatttctatcaggtgtggtcatcgcgtcactttttcaggtaagtggttcgatcatcgtcgtgcccccatttgaacctctgatctgtccgggtccatgtcttgtgaatcgcggccgatttgtccctgggaagacaatgacaaccttgcattcacaatcctcatgattgtctaccgtctctttattcatcgtacgtgtcggatgctaagattctcaaccttcctggcctgtgaccgaatccatctccacccgtctcactgctcctgtatgcccacccgttcctttcacaatctctgcagcatg

SEQ ID NO: 4500 - DNA, 700 bp, Nannochloropsis_gaditana
acttgtcttcctttaccttcctgcgttccacctgcccgtacatcatgtgtatctcgccggtgggtgaagacgcaggccaaggacgaggagattgcaaacgcgaaagagcaccgttcctttgcgcctgtcacctctttggagaccctctctgagcatgacgcggccgacacaccccgttcgctacaggagcgggtgcgtttgttcgcagccacgaagggagtggattctcgccagctgaattttttgctgaacgtgggcctgatatccgctgtcgcggcgctcgtgttggcgaaggtggtcaccgtggatctggacgtgtggcgcggctggactcccgccgaaatcttcacacgcattcccctagacaactgggacgggtacatgaacgtgctgagcctgcatcctgtcttcgtcaaggccgtgaccagcggctccgtctacaccctgggggatggggtcgcccagctctacgagggcaagacgttgggggaaatcgaccgcggccgcgtggctcgttccggtatcgcgggcttcgtcgggcacgggcccctctctcactggtggtacggagtgtcggaggattttttcgggtggctgggctgggaaggatggtggacgaccttcccgaaaatcaccgtggaccagctcgtgtggtccccgatctggaacgggtgctacatcttcctcctggggggccatg

SEQ ID NO: 4501 - DNA, 700 bp, Nannochloropsis_gaditana
acgcgtctaaaacggcccagcctccgcctggttttgacggtcaaggcgagaagcttgtgtcggaccatttccccttgccggggtccacgacaagacgtgccaaaaacaccggcggcaacaaagacaggaataagagtaggggaaaacgcctgctctgaaaagttgtggagaagcacaagtaacagtcaatcggactcgggcagtctctcatccggaggggaggtcagcagaccaagcagagtggtggtgagagtgcaagcaaccctgaggctcttccgggacaccacaacattctcccctgctgcattgctgctgtcgagggccttattcgctccattccaggacggcagagccaaagaaaggtcttgctgattacgtgaataccggacgcactcgatccccatcgacccctcacgatggcctctcccatggaccaggctgggggatcgagagatatgaatgcggtggtgggggacagcgggatggaggcgacggaagaagaaatggtgggcacaacgagcaagaaaggcaggaggggcatcccgacccgccgcacctaaatcccggaggtggaagatgggagtgggagcagccacgaaagccacggagagagcagcgggacagaggcaagcccattccaaagcccccccttggagctcgcaacgccggcctctctgcccgaaggcgtctgcgaggaatg

SEQ ID NO: 4502 - DNA, 700 bp, Nannochloropsis_gaditana
acgttctctctcaacaaaaagggcaccattgcgatggatgtccatttttcgaaaggatggtgtccattttcgggtcaatcggggtggcggagtgcaggacttgcggcctctccattatcggggaggagccatgttcacccagagccagacaaacagtaccctggcaaaagacaggcgtgatgctgttgcggatgtgcaaccgactggccaggaaaaagcacccaagacctcacgacggcctccacagtccttcctctttggtctacgccgcagtggcggcgcctcagaggcgacagagcgagcaacgacacagccacaccacagccaccacgctccccccaccgaacaaaatccaagtgctcccacggcccagtcgactcctacggcgtcgaactctgcgtcctcggcagcacccccatcctctgtcccttcctcccacgcctccccccccctcccccgcccccaagccacaccgacagaagcaaccccacacagggctccacagacacacaaagactcattactgccgcaacaagtatcatcacaatcaccgccactgccagcgcagcagctctcatcgcattttccccctgccgctgtcgcgtcggcaccaggcctcgggcgggaggagggctctctctcggcatcagcgtcatcccttccttcccctccatccccacctccttctctttccacgatg

SEQ ID NO: 4503 - DNA, 700 bp, Nannochloropsis_gaditana
ggggttgctcctccacttttgaggccaggaacaggcaggtggtgagcacaacgtcgaggcgtctgtttctcgcatactcacgtagactccgcacggcaaaaaatcgatgaaagatcaaagctgccgtagcaatagtttcctaaattgtgccaatgatgtaaaattatgatggatcgaagaattgaaaattgcaaaactaggattataaagaagaaggctttccataagagcagatgttgcttaaaaagaactgcccagtgaccacgggacgaagcgatcttccttcatacctgcggtagtcggagacgtcttcctgcatcaagaagtacccttacactatcttgtcgaatgtcagtgagcttacgcccacctggcggagaaggagttcttactttgtttcttgttggtaggatagctgcatggtccccccctcgcgcagccacagacatttcagtgagcgactgggctctgactaaattcaaaacatgtttaagtagttatagaggtggatcagttctccgactccaagcttgtggctgagatatggagggttttgtcttaggggggtataccagctgagtggggaggttggatcatgtggcatgtactgcaaagcgtccaacaagactgatgcacgaacgatcgcaagcatttacgaccccaaatacacagcacaggcatatccttataaatttccatg

SEQ ID NO: 4504 - DNA, 700 bp, Nannochloropsis_gaditana
cctgctccatctctttggagatatactcgggcacgtagaatactccgtctggagggccccgtattgcgtgctttgagagatcacactctgtcgtcgcacgagtgaggtattcaggattcaaacgggcccgaaggcaatgccgcacttgttcgctttcctccacaactttagccgccgccgttgccatgatgtccatgtctccgtcttcgggagcggctgattggacatggcttgccattacagagtccaacaaagcatccatgcgtgcagcaaaattaaagcatgtcgtgtcctccttatcatcatcatgatgttgatggccttcctccgattcttccgcgcgtggactcccgctatgcgttttattgtttgtttgatccatctcgtgacgcaccctatttcgttcctgcctaagcaaggtttggaagtcaagcgccggcattatttgcctgcctggtacactgtacagaagcacagcagattgtggagctgtagacgaaaaaaaaacgatgtcgggctgtcactgcgcggaaaggaagcatgtgcgtcaatgtggtctgttggtactcgcgtctcgccaagagacagctagcgaaacggcagttgaaacaaaaaagagaaaatgggcagacggcattggggggctatttcgaccacatctttgacaaacaagaactaatttatacacagagagtttatg

SEQ ID NO: 4505 - DNA, 700 bp, Nannochloropsis_gaditana
agtttgggtacacgagagatcatatcaggcgccaagcgccttctgtttgctctcttcctgctcgccttccctatcttatcggtcgtgattgtcccttcatgcacgtactcgtcgcttttacattaaataatggacgtgcaagacatctccgaaaatgatgacgtaacgcctcgatctcttagaccacgaagtttccaacagccctacgagccgtcctacctgactttcagacgagagtgaacgcaccaccaatgcagttggcaaaagaaaagaccgctcactcggactatcggtgtctccattcttcaattgttcttcttcgtgtctcgaagtctcctccattgctgccccccgtgttttggacggcacgaatatgaaaacaagctcgaatcagagcgagaagaagagccgcaagtgagtagtgagccaacaaatcgagcggtatttttcccttctgctagttttttgcctgtaagaaagtacatcgagtcaggtacgaaacatttaaatcgtcatatttgcatcttgaaaagtcgggactgcttggaacaaggcatgagcgagcattaaatgatggcgtcacactcaagcatgtgcatcaacgacaacttattgtgccgtctcatccattcttgaactgctttttccaaacgacaggtgtattgaggagcgtgaatccactgtagattctagcggaatg

SEQ ID NO: 4506 - DNA, 700 bp, Nannochloropsis_gaditana
cttctgcctttcaatctgtgtatcttcgcaaaaacatcgtgtcgcagcaaacgagcgcactgcatatgtacaccactttctaccgctcaccttgtccgcacgaggacctacctcactctagaaaatctcttgtacggctgtggcaaattcgatccgatcagcagcacacggaggattacttccgatttattgaaggaaaagaggtatggtatgagtggaggagagagcagtatcgagttaaagaacaacaaccaatgcaattgagaaatcaaatgtatgataatttgtatcgtggacatctttacataaagttttcagaaattctcaaagtagtgcgaaaagaattcggtgaataacttgcgatggcgtcattccaccccaccatataatattccgccgcgtcttctaataattttctatttgtccttgcacataaatttttacccaggagcctgataagtgtgaccaagccagcgtgattattggaaagggtaaacttgggcaagcgctggttcagtgggggggtgtgggacaagacgatctgcttctcgggcgtgacgactgtatacccaccgtcttgactgtctctaatggctgtaccttgaatatgtttcctatctatgtatgtgtaccagagtgggaggtggaaagtgtgatccttggttgtcccaaggagaagcggaacgacttggtgttcatg

SEQ ID NO: 4507 - DNA, 700 bp, Nannochloropsis_gaditana
cttcacaccagagctggtgctaaaagagacgcaagaggaaacattgcctagaacttgaagacccagcattaccttaaacttagaccaaagatagacacaagatttgtacacttaaaagactaaatgaattagctatgtgatattttgttggcaacacatcctcagagcctgttaaaaagaaatatcatccaggacacaaatgtaaggattgaccctgcgacccaagaagtcggaacagaatacatcaaagagtaaacatattgccacatcctgcgcacaggctgagaaaagtagatatataggtttgaacctgctctattgagacgtgctatatcaatcagagctgagttgggtaatctctagggctcgcatgtctctatacacgcaatggctggcgggctcggaccaagcgggttcagacaaggtcggagtaaatcaattgacgctaccgcaaaattaaatttttgcagaagtagaccgctttcaccttaccttttcgatgtatactaaggtggaatgaattatcttctgtttcatgtcgtaatgtttggaaatgcgaggaggctgtactagcgaaggagtgccagggaccctggcccatcttgcacttcaagtaccctgccaggatggtcagcgaagcaatccgtcaaaggccttccagtacccggcgaccgaggtatctgaaacttcattcaccatg

SEQ ID NO: 4508 - DNA, 700 bp, Nannochloropsis_gaditana
taagatctatcaataggattgatgcttgttgcggtgacgaaaaggattatgggacgaaaactgtctaacgagcgtgagtcacccgatcgatcttgaagcggacatggacggatgccaactaagggcccttccgtcagaccaaggcacctgtacgtacccgcccatcaatttgccgaaattgggattgcgttcaactcctgacatctgcaatacccggtcgcggacgccgcatctcgagcgcacaggccgggggggcggggtcaggaaagccagggaggaggtggcgcagagggcgaccgccaggagggctacttgtcgcatcatttgtcgagtgggacgagatctccggtctatgtcaaaaaccaggtatggaggcggctgagttatggtggacgcctgagccggcatagtgtggctttgaacagagataacgtgggggcgtggataggttgagggggtgggtggcggcggctgcctggctgagcgagtcttcgacgcggcacttggctttaaggcgagacggacacaatgaacgattgaggagaagcgtcctttaacaacggcattccatctctgattcatgtacacccaacgtagtacagggcccacgataggaagttggtggctctcgcgccctaggacgtggctgcttttcgttgcttaaactaaaatcactctcacaaccagagcgtcaaccatg

SEQ ID NO: 4509 - DNA, 700 bp, Nannochloropsis_gaditana
acacccatcgacaggccacgtcgcattcacgattttcagcaccctttcttccatgtggttgagaggtatgcgtgtatatttgccgcattgttctgagatgcaaagtgcttcctgagatgccttgtgtcctaggtccaatgctccccaacaaattgacgtgtcctcgcagtttttgtggtcatggtcgttgcctgtacatattagccgcgtcttccattgtcgctttggttggagtattaagctttgtaaccatctttcctacattcgtgtcgcctccgtccatgtcatcacttcttgcctcatcggtaactaatttgcccaactcgagcataccctcctcccagccgcacaagctatgtattttgacacgtgtgcgaaacactcctaggagccttgcagaatggttggagtaccaccatctgctgggcgtgggacattttttcctggtagatgattgtacgacgacgaaggtagaaccgcctgggtgctcgacacgtatcatcgcctaggcctcctttctgcttacaacgcaagccatgtaacccaatggggatgcaagcagtctacatcttctatttggaaaacaatgctagcaaggtttgggtacaaaggccgggttaatgcaggctgcgagtacacgtgcggcgaaaaccgggtgccagatgaaggtcggctcttttcctttctctaccatcagatg

SEQ ID NO: 4510 - DNA, 700 bp, Nannochloropsis_gaditana
ctatttcctcactcgacgctatgacacgttcagatgctaaagatactatattttcatttccatctgaagaaaagtcaccacttgtgtagtcaggacgctgcaaaatattcgaatggtgcggttgggtttgggcccttgtaggaattaggaggcacacaaaaagcgctgtactgaccacggctagcaaaccacgcaaattgtgtacattctgcatatatggaaccccgaatctttgatattctgtgggtagagtgcgtctaaattagtatcgcacaacgtccaaaaatccaaggtagcaaatgctcaatcagcggcaaagcgggaataaattgcggaggaacagatcgtggcattttcaatttggcgccaggtacaccttctcttttcgaaacaacaaagtcccatgcattatttttatcctgctgatcgtgaagggtgggcgctggctacatacaagagaaagacttaccgatgccacgtttttagagggatcttcttgtcgggtttggacatggtcggcttgaattgccgaatccctaccccccccccctttttttttcgtcatttgaattgaaacatagatctctatttttgagtcttcgcatttctgatttaggtcagtttttggaaaagtaaacctttttttaattctaaattgactgcaatgtcgacatcggctatcacagtaccgcatgtaatg

SEQ ID NO: 4511 - DNA, 700 bp, Nannochloropsis_gaditana
aggaatgaacgaaaatatgttatatattcaaaggccttcgaaacgtgcatcgctgtgttacatgatccattttcctcatacctctgtaaatctataggtgtgctgcaccgtgtgaagtttgtttggtgagctctgcacaatttttgtagttatatggcagacatttggagctgccaacctgagcgcgttgcttatcgctcgcgcatgggcggaacgaaatctgtggcatgtgtttaaggggagaacgacatggtcagaaaggattatatacactgtctactatttgcactactgtgggaaatggtttttgttggggctcgcggcaaattggaaaagcaagcacaggactcggcagcgcgagcactcgttcaagtttctcagcgactcggcggggcatgcgagcacccgggttcatttcaggccctggtaataggaaaaaattacagtctcaggtctcaacagacgcgttgccccagtgatcaggcaggtatgaaatcgctgtgcgatcgtggacgctcacatattttcttcctttcaaagatacattagcacggggatggtatccagggtaggaagcaatggcatggtctattgtgtgctgctcctgttgctcttgttccctcgcacgacgcaaggatttggggcgtcgcccaggaaacaaaaggaagttaacttaggtagatgcgcaaagctctcaatg

SEQ ID NO: 4512 - DNA, 700 bp, Nannochloropsis_gaditana
atgcgatgattgcgtcagtctgacatttttgaaaattactttgctcactcgtccgcatgcacgtcttatgctacacactgccgagcttgttcacttgccgtcaagattatgtgtcgcgacgagcagttgtcacgtcaaggataccttccatgttgtcatgcagcacgtctttacacaggcacaccttacgttgctgtaaagcacacactgccttcgcatatctatgacattccctggcgctgccatacttttgaaagggccacagccagcatttgttccgtcaactggcgtctacagtgaccgccctacctctacactgccttggacttaccatgcgaggtttacagaagccggcaatgcgagagcagaacatcagcatcaacacaacctgaagcaaccgcggcattcgaaggggctgtatcaggtgtgtgtgcactctgtgaggccagtgtgcgtgcttcccattttgtcatggctctcttctcgctgatctctgtgatcgtgctcagtaccagcagtgagaacgagggttcaccctgacggcgataccctcccacccttcgctttctggccactttgcgccccgtccctgtccttttttgcggcaagctaaagcctcaaggtagcctaatgccacctctcatgccacagggaagccaggtagggcaggcgtgggctgtcggagggcgtgagagtgatg

SEQ ID NO: 4513 - DNA, 700 bp, Nannochloropsis_gaditana
agtacacgagcatttcttgactcctcggactttccatccatgcgtatgggtcgctgcctgcatctcgacgcggtgtcggtggcacattagtcggtggagatggcccctgagcggtaaacctcaaattagaaattgacgagattgctgcggtccgtgatttcactagcactagatctcgcatgcaagaattccatgatgtgagggcttgatattgcgccctataccattgtcgccgaggaaacattttcagcaagctcactcctttgcgtagcaaaaaataggtattcgttcgcggaggacatttcgtttctgtgtgcagtatgaagagacgggaatggcagttaaggagacgacgggctcggggaagaagctgcctggatggatggttgcaaatatgcattttgcccataaaatgaatattctgataattaagatgatttaggtccggaatgaggtctgtgggtatgatacagcatgagatagaaggcaaatctgtttattttggatgtaaataattcagtagttggcgatgacgtacccctcctccagcaagcagatacgacgaccgcgcctcactttgcgcttagctccacctcatgaccgcccatcattccccaaatactccccatagtatcttatttttcttattggcacagtttcaggagatttgtaaaaggcatcgttgcagtggtgcctcatg

SEQ ID NO: 4514 - DNA, 700 bp, Nannochloropsis_gaditana
cttcccaaatggagccgaaggacgtgcacatgcatgcatggagccccgtacccctatttttacgttgaatcattcttataatttttaaccaaagggcctaaactctgacaattgttgacgtaccgtgaaggaaacagccttttggtcccgcttgcaaggggcgggcaagtttgacctcattgaaggagtggacatggcccacttcaaatttatggccaccattaaattttgtgagtccctcccaattcgagcgtacgtacggcattctatccttggactgtattaaaaattggaagaagggaaatggtgtggcagagtgcgttgaatctgtcgcagactagctgggatcgcgtcctagtagagaaaggggctcccagggtggaggagaggcgtatcgatgacaacaaagttattcgcttgtaccacacgcacagtttgacatacaagtcgcggaataagtccatccgttattgatggcttgcatgtagcctaaaaagaaaggatattcttagcgagctgacaaatataaggagaagcgtggtgcacttcagagataacacagcacacctcaacggctggttgaccgttagggttttgaaatccagcctttcgcgcaagttttggaccaatgatccggccttgacaaaacatgaagccagcctcatgcgttacagcgtgcacacacacatacactcctaga

SEQ ID NO: 4515 - DNA, 700 bp, Nannochloropsis_gaditana
actacttggcaagggtaaagaagtactgcctcctgatgaaaacgccgtgttctttcatgctgtactggtcgccctgacatcagtatcttgaaataagtgtccacgtgccagctttcgcttgttatgctcgccacaatgggtcatttctcacattcaacgttccctcacgcagagcgtagtgactcgagttatggcaactccccttccgcccgaggccccaccggtacattctctcatacagaagggagcgatgttgcacaaattctctgtggttgacgacagcagtaatgcaaccttgattgggacgtttctggatgacactcaaggccctccaagtcagtcaatcctcaatcatctcatatgccgcaatgagtacgagaagaaccttcccctcgttacctccctcagcttttttggactcgtggcttattcgaaagagaaggattacagacgtgtgagtgattttgtcagctatctgcagggtcggaagaaagctgccaaggttcaattggataaagtagggacggtcggctacctcttcccggggccctcccccaccactcccagcggcgttccctgcttgcggtgccactaccagcccaaccacccccttccaacgactgacaaaaagaagcgcgctgccccgacgtcacctgcggctaggaccatagatccaaactcagcacacgacacgggcatg

SEQ ID NO: 4516 - DNA, 700 bp, Nannochloropsis_gaditana
gcgattgcgtcatcgacaccggggtcgcagtcaatgatgaaacgacgacgaggaggagaaggtgtcggggcggcagccacttcctgtgcccctttttgaggcttccctgaacgcgaggaaaagtaggccatgcccgatcctcgcaatgcgcggagccgaatgtacctaagtcccaaaattttcctggacgcagtgtatttgttgttatttttaatatgaaacaacggagtgtgcctccgcgtatgtgcgggaagtcatgatatttggcgacggaaatcgtctcagtgagggcttacaagacgaagccccaagcaacttaatacggtgtgctacacgctctggcaacttgaaagggtagatggacgatatatttcaccatttgaaaggtcatctgagggtgaaatcccagcagcggggatgcaacatgacttaccggacaatattaacctccccactgcgtccctccacggcttacttcgaccacaacctcagcaacttcttaccatcttcaatttaaataacttgtccaggcgcccaacatctcttcattttagcaccaatgtgttcagtgcacgtactttttaattattttgagtttcagattccataaaacacgcgatctagactttcttgccttggtatcttacacgagattctcgatcccgattgacgcaaacaggtctccaagccgacgataatg

SEQ ID NO: 4517 - DNA, 700 bp, Nannochloropsis_gaditana
tgccaggaagcgcgccaccgacgcctcataaaacgcgtcccgcgtgcttgcaaggtacaaagatctcatctgagcatgtaccgacgtcccacggcgcataggatctcaaaatgtccgtgaatgtcgagtgttcctaccctcggaaaccaccgaagattaccaaagcgatcccgtcactgacgaacgagcttctccgatttctttgcacaattcgacgaaaacaaaagaataccagatggttagcacataggcgttctgccatcatgtgccgacgaatttactgccaaaaagcctgaggaggtatatgggcatgtaatgaattggccataaactttccaggccggagccgtgagcctcctgaccatcccaccaacatccgtatccacgactgtcgatgttcgtcttccgaatcacttgcttgttcgctgaactacttatgtcgtgcactgctcttcctcgctttgttctacttcaacgataggaaaatgtcatatgcaaaatcgtaggaacgcatgtgggacgcactatgaactttccactcctctctgcatttaaaataacatttactgactctatgcctggcttcgcgcactcgattttttctagcaactgggattttgcgtggggcatacataggagtgtgaggcagtcacacccgtaatacgcaccccgatcgcacctgctggcacgtctcggaatg

SEQ ID NO: 4518 - DNA, 700 bp, Nannochloropsis_gaditana
gttatataactatattcgagccgcccaccaagcataattaaattcccctccaaccttgttcaagtggaaggctcgaaacaagttgaagttggccgttagcgggtttcgacgtctctcggatctggctcgagcgagtggtgagagcgtttactgtccacgtaggaattgtatgttgactgcaattttgcccagtctttcaatgaaggagtcaaagcattgctgacttatttttggagttctataatgggtccttctctgtgattcttgtacgaggggaggttggacaagtatctgcggacctccaaatttactccgcttccgtctctgaatcaatcagccaccacagtggcactttttctccagggtttaagccgtggttagcggcgtcaaagatctcacacgtcgatcatgatggtcgtccatcaccttcttgtggtatttttcttgataactctgaatacaagtactactgcccagaggcttcaacattctttacgagcaatcacaccggtacaaggatatagcagcaacacagcggttcatttcaaccgaacggcgtctggaaatccttacaatacattagcgacaactctagtggtcgatggaaacatatttccggagttattgtacaaacaacaacgcgtagagtacacctttgccatccccgtatcattagctcccgttgagctcctgacagatg

SEQ ID NO: 4519 - DNA, 700 bp, Nannochloropsis_gaditana
cttgagcctggacgacgctcgcgtcacaaaacgcatgccgcacttttgaagcccctttgaagcccctttgtaagctgtattgctttcaatcatcagaaattagcggcacatacgcaacatggggcgacaagagagcagtcgccggtcccccaagccatcctcctctctcgccgtcctacacgacgtcgatgccgtcgtcaggagaatctaggttggcgccgcgaggggagtttctttctccatctgtggagactctgtactaggtgacgatcaaccgcgactctgtcagacctgacttgcctcttacgcgtctcgaaagcttactgactccccgctcgcttccctctgcgagccttccctacgacgaggccaccgaacacttacctctcacctatggtgttattcttcccgtttttccaactccgatagcagccgcaaaaatcgacgaagcgccgttggagtcaaaattctttcttatagctagtacaggcggaaagggttggcgtttgtggggacataattgtctttcagcagccacaattgctgtcgcggggggagcaggaggttaagaaagtagataaaataaaggaaaggcgctggaaggactttgcatcttcatgctttcagtcgtctagctgacttctatagtaagattgcatttctataaatcggcggactccatcgtagcagccaggacatg

SEQ ID NO: 4520 - DNA, 204 bp, Nannochloropsis_gaditana
tgcccatggggccgggaggacactaccccgcggcgatgtacggagggatggggatgggtcatccgggtatgggcgggcggggaggacgaggagggcggacgtcccaagggtgaccggggtcgtggaggcttccttgggggcggaaagggcctcgcgggtggcccgggaagaggcactgccaaggcacgagggagcgggcacatg

SEQ ID NO: 4521 - DNA, 700 bp, Nannochloropsis_gaditana
ccagccattcagtggtcacaagtcccggtaggtctgggacatcgatgctgcgactagccgcctgcaggtcaggggcgacccctgatgagaatggaaccaagtccctgccacgctggtgcagtcgccgcgacagcgatatccatgaatttgagacgtcgtattgtacattgggtgaaaactgcgatacgaaggcatcacatactccaaaggagatgatggcagtcggaaaatgcggccggacgaagaagaggagaagtagatgcgtcccgatggacgcgaggtacctctgagaaagattcagtgcctgacggccgcctaacatgtatggagttgccctgtgacacgtttttggtcgtcaagacggtgctatcagcataaaaacatacccaccgatttagaatcgttccgatccgttcgagccaaaaacgggcgatgacatctgcgtggaaatcgcgggccttacgccggaaccccaggttgaccatggcctcggcgcgcgtgccccgcgggtccgtcatgcgatagttcgcaatcctgttctaaatgaccggaagaggtcgaatgagggggctcggttggacacttgtctggttttcggtggtggacctcggggggtaggacgacgggagcggaacgccgtccagcactgtggctctggctcttcgttcactcatggcaccatctttgacatcctttcatg

SEQ ID NO: 4522 - DNA, 700 bp, Nannochloropsis_gaditana
cgacacttccaccttcgtcacgcgattagatgcaacgtcagcatgtatttacggcagtaagacttatccagcttttataacttttctttcatcgccttctggccacgacttgaatgccgacattccccttgaaatggcagaaagggacatgtgcgagaaaggttggtttgcccattcttcgacggcaactgagaaggacgaactgaaagcttcctatagcctctcagtctcagggcatactccttccatgtggctttctccaagacaaccgccgcgtcagcaacttcacgacctggaaagctcttcaatcaaagggaaagtcttgattttcaaatgccgggaggatctgcgacaggatcaactcgtgcttcagcttttcaatcttatggataccattctgaaacatgaactgggcctggatctttgtctgacgcactacagcgtcatggccatggggccaggagagggagtggtccagtacgtcccccacgcctatactatagcagacatcttagcttcggctgaccttacaagctcagtttcggcaaacaaaagcaagattatggccttcttcagaaagcatagcactcgatttagacgagataacggagaggagaagatacaagaaggagaggaaacgaatgttaaggggggaagggagggtcgggaagagggtgatggaatggagaatagtgcaatg

SEQ ID NO: 4523 - DNA, 700 bp, Nannochloropsis_gaditana
gcaaggcctaatagcccgaccttccgacgcgctgacctctgaggaagcagacttgctctggcgccaccggcacacagtcataccacaggattctcgagcactggtgaaattgttgcgggcatggatgctttcgacggcgttccaatacgatatgtgcacgcagcagcgtcggcgtgtgcaagatccagaagcgcacgtactcagggcgagtggggatgactttgaggaatctgcttccgaattttcaagtcccgttctagaactattggaaatatggcgtactggacctaatgacctgtccttcatggacgccatgaaattgttgggagcgtatttcgtccacccggcgattcgatctcttgccttgcagaggttagaggaggctgcggacgaggaactttctttcttctcgctccagttggtacagctactccgctatgaggcgacgttttcgatcgttccctctcctgatcctgtcattggttcgacgccgacaagcatagatgtcacgacctccctcggggggggggaatatactcatgacgccaagatagatacaagccctactactgtcttcccgcctacggccagggctaatcggctggggcgtccgagatcccttgggaaacttcttatagaacgggcgtgtcgtaaactggaattagcgaacgcgctgttttggcacctggaagcacagatg

SEQ ID NO: 4524 - DNA, 700 bp, Nannochloropsis_gaditana
ctcgaagtacctcacagcgctaagactcttgatagcccgaaacgatgctggcatcctacagccctctggacaaattgacagaattatttgttgagtacctgagcgtgtttgagatgtaaagaccagcattgacatgtatgaccttcattcgccaggtgttgtcaagaatttgtcttgtacgatcaattgtgctcctttttcttgttggtgaggcccgccagccggggatcagaggaactgccacaaccaaataaaaaaccgtgcgaatttcacgatctcctaaccatattcatgtatcgaccaaaagatcaaggaaaaaaatcactcaaccacgcagatcttcgacgctggcacggaaagagcaggtcgtaaagctattaatttgcgcttgggggcagtatcttggatggtaaagaaggcgaagctcaggcatgacaagccaggaaaaggtgggggagacgaaggaatccacggccctgacaatgttgaggtaatcaacaacaatatgcccatcacgacggagcggccgtcctcctcttctttggcagggcctgctggcccaaaacatgacaagacagagcgcctgaagagagaggcgaggcagtaccgcgacgaaatagcacgtagaggggtcgtatatttgtcttctcttcctccttacatgaagccggcgaaggtaaaacatcttctggaaaagatg

SEQ ID NO: 4525 - DNA, 700 bp, Nannochloropsis_gaditana
ccaagctgacaaaccctttggaggtacgagcccaccgggacgtgaccagtgccgtgcataacgcccatcctgaagcgaagattgccatgcaaatcttacacgccggccgctatgcttatcaccccttcttggtggggccgagcgccattaaagcgccgatcggcatgtattccccacgggctctgaccgaggcggaggtcgagcggaccattcaggactacgcgcactgtgccagccgggcccgggaagccggttacgacggcgtggagatcatgggctccgagggctacctgatcaatcagtttttggtggagcacaccaacaagaggacaggtgcctggggaggcccctacgaaaacagaatgcgcttccccgtggagattgtcaaggccgtccgagcggccgtgggagaagatttcatcatcattttccgcctgagcatgctggacctgatcccggcgggctcggcgtgggaggaagtggtgaccttggcccaagccctggaggccgccggtgcgacgatcatcaatacagggatcggctggcacgaggcgcggatccccaccattgccacctgcgtcccgcgcgcagggtatgcctgggtgacgaagaaattgaaggaaacgggggtgttgggggttcctctctgcaccacgaaccggatcaatatgcccgccacggccgagagggtactggccga

SEQ ID NO: 4526 - DNA, 700 bp, Nannochloropsis_gaditana
gagctgaccgatctcagatgggaggaatgtcaaggagttgcccatcagattgaggatccgaaggctgcgcatttggaatacctctgcgggtacagcagtcaggccttgacacgccaaatccctcttgatttcttcatggcagagtgattgcggttcctcttccttctctgactcttgcgggcgtagcttcaaggcgcaatattctaaatactttttctttttgctgttttttttcatcgcgacgtaagcactagccagaaaagtgagcaacccggctgcgagtagcacatagcgccggcgctgggaaaataaaaatcccatgatgccaattttgtaacccagagaatgatggtcgtagccaatgatatgtactgtcatgtgtgtcgcgtggaaatggtaagaattattaagacctgagatggttttttgtcatgttgatggtcgatagaaagacgcaggccgttacctgttgtgagttgaagcattcgcagtggcagcaagtccaacttgctgactaaaggcgcttcttcgcaggaattcacgctccaatgtagctataccatattgaaatgctttcttttgttcttttgttccagtacgacaggcacgtctctttacaagtgcagggcaagcgaataagtggctcccgcgaccttgacgtccggaacgaaggagtacgccgtcatttcacccgatcatg

SEQ ID NO: 4527 - DNA, 700 bp, Nannochloropsis_gaditana
gttggagccccgatgtgcatgagctttgagtctcatgatgcactcgaggctctccgacaatttaaccccacctctgacgctttgcgcggatgggtgtcctctttggccggctcgctcgtcaggtcagggagatagtatcataggcgtctgcagtgctgtttcggatgcatgcacaattgagaagggaagagccatcttcgtgagcccaacaattcttcttaatttttactagctaatcattcgaggtacaagggataataagtcttgcatcaacgcagccatcagtgaaaaagttatttcgagcactgatcaatgcatcggtcgatatgataattgcagcaattgagttggcgtcttcttccagtcaaagaaaggctcttcatagcccatacccgctgtcatgcccttctttgcacgcaatacacgggcatgtaaagcatttggagcgtctcgaggccattgactccaaaaggacggtcagacctcgtctcgcgctgggattttttacatttgatggtatcgccaagaaaaaacgaggaagctgcgacgggggcaacagccgacctctgccctgacggtgtaaaagccttccttgctaattgcatgctgagacatacataaccatcacgttcatggatgcacagggacgaaattgtacaggctctatcgttctccggatttttgaaccgcaggcggcatg

SEQ ID NO: 4528 - DNA, 700 bp, Nannochloropsis_gaditana
cccttcggccacgcccctgccgcgtcttctcctccctcgcgtggggtcgcccgaggctgccttttcccgcctcatcctctcctcgtgggagcaagaagtggcgaccttgacccgggaggcggcggagttggtggcggcgcgggaggaaagcgtcggggtggagggcgccgagtggatccctttcatcgacgaggccttgaagatgctggaccggcggcgcgagaaatatgctgctcggaggccgggaggccagggcctggtcgagggaccgcccggggcgcgggcggggatgggtcgggaggacgccgccggaaggggaggaggagggaagggagggaaagggggagggcccgttggaggttcgggtcccgcgcaggcgtcgacgccgcgcccgtctcaacggccccgtgggcatagcgaaggcacgagcgagtctgggggagggaaggaagggggagggaggagaagagggggagggggcgagccaggggaggggggcttttccgcctcctgccccgccgacggctttccctttcccatggacgacgtttcctccgcccgggaggacaaagcctgcccgtcctccccctcggcctccctcggcccctcgtctctcagcggggagggcctggactcgcaggcctcccacttctaccagctcgaggacggccagctcgccttcctccacccactgaccatg

SEQ ID NO: 4529 - DNA, 700 bp, Nannochloropsis_gaditana
atcaaccaggccatggtgctcgcgacgtgtataagacaaaggggacaaaggagggacgaaggcggagacgcacacgatgctattgaatatggaggaaacaacagcgaggaaaaacaaggcgtgcaaagatcgcgccatggcttgtgggacgccacgtcgcaattttgtggtgtgatgaagaagaaagaaggtatctgctccttgttctcggaagccacggcaaaatgcaacgcagtcctcaaaaatgaagcaaagccttaacacctgttgtacattacaagaaggaaaaaaatgaaaagtgagagcaccatgtgggtaaagggtggttcgacgcggtctagaaagacaaaaaagcacgcgggcgcagccaccgtgcaaatgtcccttcgaaagaagcgacacaccatgacagccagaggccgtttggggggacgaccggaatttttaataaacacatcagcatttgcaatgtcatttccctgaataccgtcacaatctgttcgacatgcaaagttgaccaggctaattagggttgcttttttcttcacgtccatccttttccttcttggcaactacagctcctagtgagtagcagcgttagtctggttctcaccaccttggggtagagaggctcctgcagcattccaaagcgctttctccaccatccaggccttgagaatacaaccagtgttacagcatg

SEQ ID NO: 4530 - DNA, 700 bp, Nannochloropsis_gaditana
tatcttatcaaatttgctatttgcttggttttatggaactaaaaatcgatgcttgctcggctacgatctatacttgctaggctgtgatcgatgcttttgactgactccgttgtaagatacgtcgacaatctgttttgcatcattaaaactgctttgttgttcgctccggcacgagctcgatataaaggatcaacaaaccgatgacacgtaccaatagtatgaggtggagagaggagcgcgtctgcttcactttgtgcgatgctgcgggagcagactcgtgtgaatactctcatctatttttaggatccactggtatgacatatggatctcgctctattcatagcttaaagggagattttttcaagcatttgttggtgctatactttttggcactacctgcttcttgaagtgccctgcacgatatgagctcgctccctgcgatcgcaggtcgtaccactatgttagtttgacaaatcatatgcatggtgtcactttcgatcaaagactgccgaaattgatcatatacgtgagcaagccgatgatgatggcaaagagtggcttttaacgacgtgaactccctctttcagccccccatccggaccgatttcttaggcacgtaaactgaaattctcttcttacacatttctggatagatttgcaccgctgaaggcagagaaagcgggtggaaaattccaccatg

SEQ ID NO: 4531 - DNA, 700 bp, Nannochloropsis_gaditana
gacacaggcgtggcagtagacgtagacaaaattgatgcttgcatacgagtaaaaggcagtcgaagcggagagcaaggagcaaaagcagctcctatggcccgatggtcgagatttcgtcgtagcacgggtttcgcccaaaaagaccaggtgctactccacagacacgcaaaatgaagcagcacaaatatctgccgtactccagtccaaggcagatgcatcgatccaccgcgttttcttgttttgtgggcaccagtcgggtcctcagaagcgctcgttcgtgttgtactctagggctcgtgtctgcagtgctttagtatccaaccaccacggaataaaagtgcgcagacctcgacccaagagatgtacgtgccaaaggcaggcaatttaaatacggctgccaagaatcagataagccgtaaaaatggttaaatgagcgaaaagccgcgtccgaggaggacttcactaaaaacatggcgggcgttcctgctccccgtcttggcttgcagtaacccccgagcgttgatttctcactgggatgtgaactttccttcaatcactacgtcccgcacattttgacatgctttctaatcacatctgactcatacctctctcaatacacagattgggcctcgtttcctaagatagctcgcggccagtgtaaggcgtaaggcacactgcctcattggagggagctgcgatg

SEQ ID NO: 4532 - DNA, 700 bp, Nannochloropsis_gaditana
ttttcatttccccttcgccctagcacctctgttagaacgtctcaattgtaaggaagagatgtattgatggtgcaagcggtcgatataggtgtttgatgtgactaagaatgcggcagtgaaaatagggatgtgatgaggatgataaggttaagcgcgacgtccgcaagaaattgtgtttctggccggttggggtgcctgcgcctcaatgcagtggctcgatacctagctgagtattaataacgaatactgcatggtagcgtgcagtcatgaaaaatgtcccttcaatgattgcgggtcttccacagcacccccaatcttttcaggttcctctctcattcatcccctttctcgtcctggtttccgaaaaataggtgtaaaggacaagaagcagcagaacagggcaagaaccttgaagttaaaatcagtaaggagcagcgtacgcatcgagggatcgagaaagggtaccagatgccgatggtctcgcggtgttgaagcgcgatacggcattccagtgtaggaaagcggccaagataacgctgacagcggtacaggagctgcacctcgcagtaaaaccagaattcccgtccagaaagaaatcgctgtggaagtagcaaacagtttcgggccctttatcccttctacctacggcgcagcacctgctcacttcctaatcgcgacccgaaacgtctccagtgccatg

SEQ ID NO: 4533 - DNA, 700 bp, Nannochloropsis_gaditana
ctgcttctggagatggagctaaagtgtaataaccgcgaatggatataaaacctgctcattagatgtgaacatacgtgggcatcctagtaaaatatagttactgcggttgaacaaaaagacatggtggtgatgcgtggcaagggtcaagccataataaagcgtaaaacgcgatgtcaagcacggagcttcttattcgctcctttccggcgctgcggggtcgtatcttgcgggcatagaggcgcgtaccacgtatctgacgtggagtagtaaagacatcttctgacagccactcgcatttacgatagacttcacaggcatagactacgttgcgtcgttcttgactcctcatttggctgagcatccgcggggctccgctcaccatcgacctcctcacccccctcccatccacccacaacagacgatgtcgctggaatgctactggaagctggtgtcgaccgactcagacaagcgcatccaagcgggctatgagcttgtcgagtctttgtccaagagttttcgtcccaaggaaggaaataggcgtccatctcctttgccttcagaagttgagtacgccataaagcgcttggtccggggcttgtcatcttccactgaagcagcgcgtcaagggttcgcctcttgcttggcagaggtgcttgctgttagaccggatgttccactgtccttggtccatgaacacatg

SEQ ID NO: 4534 - DNA, 700 bp, Nannochloropsis_gaditana
cggggttgccatgatcacggggactaaggttttgtgtgcgcctgagttcaagcactgctgtcgcattaccctgcagatacagtccacacccttatggatgacatttctatcataatgttcccctccaggcgtctttcgggcaaatctcgtctcacccgtactcacgcacgggtcttgcgccgatgcatctgggaggaacgaaagcatcagcttagtggagcataggaatcagcagcagcatgctgacgccagagcgtgaagacacaccgtctcctcccctcgcccagagggttcgagcaaggacacgaaggtagaccgccttcttgacactcgattttttacattgcatgtcccgtctttgcccctccgaaaccatcacagttctcaacatgtcaaataaaagagctctgcctttatttttcagcgtgttggcttacaacttgtgtgttagagattcgaggcagggcatcttgacgtcaagtaaagataactcccgatccctcctgtgcgttacatagcacgttgcttccgcataccattcacacgcacgctctcccaacgaacgacagttggcttgctagacaagcgccgggcggggggggcatcatggacgaggagcaagcgcggagacaccggtcaagagtgtttcagatgggcttgttcatgtgctttctgcttttattcgccgatcatcgcaatg

SEQ ID NO: 4535 - DNA, 700 bp, Nannochloropsis_gaditana
aaataatgcgcttattaaagcacaaatagcagcgttcttaggatatgacgaataaagtggggcttgtggcacctcagggataacaagcaatgaatgttgcgaaattttataaccaaaatacatatatgtatatttataatatatatattggatatatatatttctttagtgtgccgtcggccttcttaaaggaattcgagagaatagtctgccaaaccctttctgttagtccaagacagctcgcagtcactttaagcagccctacctgtcgctttctgtgctcgatctcgcaatgagtattgggagcagacctgataatttacagtatttaatacacttctttgaagaatccgccataaatagcccggcagctatgagatgttgtctttttcgcctggctgataacctcctctcccctcgttgctcagcgagacaccccccggttgctccattccttgccatcgccctgcccatgtcgaccaccatccctacctcttcagtgcaaagcatggggagatgggagggatccaacgaccattttttgtgcatcttctggttcgcgcgatgaacgtcattttgccggtagcatgttgtcgcatcccggtttggaggcgcgtcttgccctcggataataacgcagctcaatggatttatcatttaatccgcactcactgcacacagcttagagtcaaacccgatg

SEQ ID NO: 4536 - DNA, 700 bp, Nannochloropsis_gaditana
aaataaatcggtgctatgtccaacaaagctgtgtctgtagaggagagtgtgacaggttgctcgttgtgggtataccgaagaaatagcaagtgcggcggtgtgttttgaaagcccggtcactgagctgtggtcgctcgtaggcaggcgtagaattgtgttgcgctctcctcgcgcgtgcgtggcccaaggcttgcttgccggccgacgcagaccgccgcaatcgtgcaaatcaccaggcccagcaatgcctgaatcaataacacgcaaagattcacagtgtttgaaaaggagggaagcgtgactttggcattgcgcttcgtcacgcacttgggtacgtggtttgtttcgaggcaatagcccgggctggggtggcgttttactccgcagactgtgaaccgcacggggcctcccacgagcccgcgagaccgtctcgtccgctgtgacccgccggcgtgtgcaaggattgacgggctctcgagacgcgggttggctgaattacaagtcggaatagcagtccgtatacggtcaggaaagttagattttccaagttccgagttgtgtgaataaatgcggtatgacggtgtgagtgcttctcctcatgcttgaagtgttgaagctcccttgcggcattattccaagaaatctcgtaagcatgtcgacggacacgacgatcaagcctaccattttcacactttcaaaa

SEQ ID NO: 4537 - DNA, 700 bp, Nannochloropsis_gaditana
tttcctcatgcacactttcacattcatacttaccatagccgtctcgcgcgctacgaagtgaagcgacttcgcaaccatggtaagcactaggagaaggcgctcgcctgggagcaaaaaggaaaatgctgcgacagctcctgaaattagaactgttaggcggcgtactgtggctgctgtgacgtctagtggcacggataacatcccgttgaccccaacctccaagattcttggaagccctcctcgaaaaaaggcgccaaaatcacgttctattgactcacccctatcagaggaggataatgcgcccactcgcccgaaagccacgaggaaaaaaccgatgtcgaaagcactatcagcctcagcaccttctcatccaccggaagctgtggcctcgtcttttaagtacgagtttggcgggccttggggtgccctggggatcgtggtcggcctgcctgtagtcgtgatggggctgtactatttttgtccaaactttatgtcttcggcgtccccgtcatcatcgtcgtcgaagtaccctctctccttcagatcctccacttctcccctggcatgcctgcgttggactgacatggcccattttctgacctcaacgctgcctgccctcctccgagcgctgccgagcaccttctccaccttcgctttgcaagccaggcgctcaccgcacaacacggcaagtgccttcatg

SEQ ID NO: 4538 - DNA, 700 bp, Nannochloropsis_gaditana
ttggcaggcgtaaccgcggccgacaacttctaatggtaagcgcccaaggcccgcgcccggcaccagtactctctgccgacctcgattcgagtcatccacgggcaaaaactcaactaaagcgtccagaataacatcaaaacatgcagcacgctcaccggccccctcctcggaccattctcgcatgcaactgtggagggtggcataaattttggtcatattcgctgggcttgttagaatttgtcttggagctaacgttgcttgtcgcgctagctgtttttgagcttggtccagtatgccctcagcaggtgcaatttcatggacacctcttaccaccgcatttaaaaaggcttggttgtcaacaatggccttgcggtgctcccgcagggcgggtgccaacgagtgaggaggaagcaatttagcgtagtgctccggaagacggcctaaatggacccatcgccgctccaactccattccagcaaatttgctatactccaagaaggcagtaaccacctctaacaaatgttgttgctccttgtgcatctcctccggagtggctaacgacgttgaggtcggtggggggacgggtcgatgtgctacgttttgctcgcaatttcctccgtttttcccaaagccactgcgcagtatttcaccacagcctccacttccactttgataatcatccctccccgtcatcacaatg

SEQ ID NO: 4539 - DNA, 700 bp, Nannochloropsis_gaditana
gaggcaggagggccacaagcgagggaggaccgagggcggagcctgtgcgccgctgcaaaaactgctcttgccgcttttgttccttcacctgccgggcacgattcaggcgatctcgcttgaaatcgttctcaaaggtacgttgtttgtttccttggcgctgttgtgatgtcgcagacgaggcgacggagacatggctgctgacagcagtgaccttgccgccctcatcgcgcttaaccgcacgctttgacgcaaggtgtcgacgcgctttgtgcttcttgttttgctgcttgagctttccagcccggtgatgaaacatctgacgccatgatatgcattccatatacaagaacggtgagggatccagcattgtcgttgaaaaatgggatatgtatggggaccagtcaagttactggggccaacctggatggatacgattcctaataattaaggcccgcagtgtgtccccaaatccgggcaagcagggtgcacacgagtcctacaacagggttttatcattgaatggacgattgatctttgatgggggttcgatcattgcttaagtccccgtgaaacatgtgagaagggtttgattaggggccctcgccgacctcccgcctcctccagccaaatactccccaggtacatggggcagtttgcaaaagataagtttccacgaaaatttgtttacctttcttcaggc

SEQ ID NO: 4540 - DNA, 700 bp, Nannochloropsis_gaditana
tccttgccagcgattagagaatgatacttgtgaagcgtgctttatcgctctcctcccgcctacttcagggacagcgctagaacggtcgacttcagagcggagaggactgtggttgctgctgcgtccattagcttgcgtttttttggggtcttggatcgggttggaaataacttcacatttagaaaacattggagtagacatttgcttgtctttttgccctttcagtccatttctagcgtcatatgcaaacgtgttttttttacgaacttgtcttgccatcatgaatagtcctccgcagataaagaacgacaacccaccaagacaggcgactaagagaaagactatggaaaacattgcatactcgctcatgttgcgtacaatcagctgccaaacagctgggtatatatccggtgattccccagaagcatcagaataatcccaggtagaggtgttcccggcgaccagctggatttcgagtaccacaggaacttgataaacgaagccttgattgaggtaagaataggattgagagaataaataaataatgcatgaaatgttttatgggaatggaggcagcgatgttgatcccttaagaagagaaaagcgcttgcagagtacaattcccgtcgtgattgtactttcttttcttacctgaaggaacaatagttcgagagccaacttgctggtgaggggggaaatg

SEQ ID NO: 4541 - DNA, 700 bp, Nannochloropsis_gaditana
gccggtattgttcgtgttcctcctttattgctgttcggatcaacgcagactcctttgctatgacagcgcgctcttcggccgccgttttgcatgccctgacggcccgaatcaactcgcgcagcctcatagtcatggtaacacgttctgaagtttcggtttatgtaaggataaaacatatgcggtgagagaaagagtaggaaaagaatcatgaatgagaacaggagggagcggaaatgggagatgggaccatcacttgaatgaaagaggatgggtgcaaagctgacttttgtagaaaagcgagccagagaatcgaacccgccagtctctccaaaatccatcgagaagttaccgaccgaatatgccacccacgagtgtcccgagcgtcaaaacccctggttgcacggagtgcaagctcccaagtcgccaagccccgtgggcgagaggccctcagcgccgtccttgccaccggggccctgtccgaccccgctaatggacaagtacaggcaagatttggagcgctttgtactacgcacccaaaaggcctacctgcggtttgaaagaaagctaggattcagggcgtcggctgcgaaattggccttttttgttttatttcgcttttatcgtaaagttgaagggtccttactgaggactcctcaacctgtccatatatcatttcccatcgcaactcgccgcaggcatg

SEQ ID NO: 4542 - DNA, 700 bp, Nannochloropsis_gaditana
cggcgagacctttaggtatacgtccaggcgaatttccacgacatcatcgtcagaaagggtggcaaattaggatgaaaaattgacgtgtgtgtcagttaggcgacttcttgtgacgacggtatgcgtcctgcgtgctccatgtgcatcgtggaaattatcgcacaagcgtctcaaataacaaggtgaaagacaataaatagaaggtcaaatgggagttaagaaggttcagtgtagttaaaggacgtcgattacgcgttgctgtggtctcgaaaggacctgacggtggtttatggattgcaggcgttttaaagtaagaataactccggcacacgcctggtcaaagagatgttctgagcgcgtccattttcgcgcggacctatcgcatgtgcattccatgttatgccataaacacaaggcgatctttggtggtcgaggcaggcgagtaaaagaaataaagcgtggccaggtcagaaaggcacagcgattgcgaaaaaattggctcgaccacagactataacaaatacaaagcactgttcttcacaccgctgtgctcacattccccgccagagccacaattccaagatgctacgatcggcggtgacgggagttatacacctagaccttcccaacatatcacgccatctcaatacccagccgggaaattcgccacggtacccatcttggtgatgggctggccccg

SEQ ID NO: 4543 - DNA, 700 bp, Nannochloropsis_gaditana
ggggcaccgtcccaaaccccacgaggagaggttacggcccggcccgcggggttcgagaaggggaaccatacccggagaaccaccttccaaccccccccgtttggtgccggcgcttgcgcgcggtgcaggtcgtacgccgcaggcctccgacaggcccacccctgaggcgggcgcattcttacgaatgaatcatgactgttctccgacacgttggccgctattcatgaatgacaatgttagtaggggtgacggcccaatgatgatggattcctactaggaggacagccctgatgatgtcgggtgcctaaaacatcacacatttggggtaggagggaggtggacgatgatagccgcacgctgtccggtcacgacccttagtatgagccatgtaatccgtgtacgcttagcgtgcgattgcgtgcatagatgcatcacggacacttcttatgcagcacgcaggggtatgtctgctgtgttgaaccgccgcatcgtttgtccgcgcccctcatatccattcatcctccggcgcctccgtcctctcgatccccgtcgcctgttgtgcgtgtgctgacgagcgaccgcataggctgggagaaggggtgacttgcaacggcggcatcacggtgctgacgagatcctcgccatccatacctcatcacagaacaaacaatctcaagatttggtgcgagtcttgctcatg

SEQ ID NO: 4544 - DNA, 700 bp, Nannochloropsis_gaditana
ccccctacagccctcctgtattgaaggatgattgtgagtggatatttacaggctgtggcaacaggaaaaaatcagccacctcgtccgggcttggccccgagttcccgagatcgggctttcggctatctaactcactgtcagcacgagctctcgctttaggcactaccatgcccgcgcttgtcctgccccactctcggaaaaccagcactcctccgccacaagtcgatgcccatcccattcagtccagtgggtgggacaggtcaggtgtcccgttcccgagtgtcacgacctcgctcgagcgccctagccagacttagcgagggagggagggagggcgagtctgaccggtcatcctccctcccgccctcccaggcctgaatccatggcgggggatgggaaaatccggtcgggcatagagccgctgcccgggaatgcagggcgtgcgtctcgtgcggcgtgtgcacaagcggtgggcacgatgatgtggcaaatgaggggatcctgcgagacggcttttgctgtttcctttcttcgcttcctcggagttgcaggggggggatctccacaggcatgccccagccgggctacttctccgcgtgtggtatattcttgtcaacttaccataaattattgtgtgtacaatacactattggacaggaggagtcatccagggtgttggggtaccgccttatcaaaaatg

SEQ ID NO: 4545 - DNA, 700 bp, Nannochloropsis_gaditana
aggatgtgcgacccatgtcgcggaagtcaaggcggaccaagggtcggcaatacgtgtaccagggccaataaggcataatacaaatccgtggaataaatcctttcataccttattgaccaccgtttcacaataatgaaacccaaatgagctgcaaactgccaactgttgacacgccccttagcggtgaccctccttcgcgagaaagtcgtgtgacttgctttcagggcaaattagatttccttagcaaatcctctgtatcatgatagctgttccatcaaatatcaacagtatgctgaacctgtggatctatacatcaccagcaagtcaccaagacacaggttttttggcccttgtcggcatccggcgcccggagattgatgatgatttgtgatggaaaagacttcatagggggggcgcggtgccgtgctggggtgcctttagaaaacatgatgcattttttatgcctacggtttcgcgaagctctggctgttgacatgcatgtgtgctaatcatgggcacctcaaagaagtgatagactgtccgagagctgtgttagttcaaccgtgaggacgcatgtgtgacacgcgaaactttgaggcaatcaccttcgtggggatgtagtttggcgtttcctacccgcttcacaccgaaaagttcccatcaccaatcataggccgttgtcggagcgtcaaatccaatg

SEQ ID NO: 4546 - DNA, 700 bp, Nannochloropsis_gaditana
caggtggtgatcagcgccgccagaaaggcatgaatgaagggccatataaaaaccatgccgagttgatgtggggggatgagagggtgctaggagacggcgcgggtccgataggggcgcgcggccatccctgtgtgcttactgacgtcgtatggacgagaccaccggttaataaagctcatgtgaatgtgcatgccctccctcgagtccgtgtatgcgagcacgcggaagcgaaagcgttagggaggaagcgggagagagaaaatgccggcgacgcgaggagggaaagtcttctgagtggtctgactgaaagccgccgcgcaaagtacgagggcacctaggggtcaggaatgctcacagggtacacgataaggatgcaaaggctagcaagtggttcacgtgcgggtgcattgaccacaacccccgaagttcctcagcaaacgtggtggatccagctccggcgtgtagggcagatgcaagaacgaagtaaagataggtcaggcatgtggtccaaacgctttaggggtccgatttttgcccgctgccgtctcgatgactacaaatttggatgtacttgtgacaacatcgaccctaacccacggcttgctgggaatgtcatgttcatggccaaaaagatcttacatttcacttctactcctttcctcttcaacacgcttacggagacagcaagcaccacaacatg

SEQ ID NO: 4547 - DNA, 700 bp, Nannochloropsis_gaditana
ttaaagccttccaatcagctattttcgcgagaattcctgttaaatatgccgatggacgtggtagagatgcagtgtgaatacaattcagcgcagtacgtatagatcaggcgacgctccgaaggcggcaagcattgcgccgtcgatcgccttgggtcaattccatcacaccccacatcgtcacccaggcggtcgatccgtcggtttaggtcaattccatcacatcatcgagaagcgtcgagacgacagggtaagagaggcgagatggctacccgacacgagacgtgcattgcggcctttgacccctataactcgactggacggcgccatgcatatctatcccgttatatatactgcgctactccccgagcgcagtattcacatagttttgtcttagcgagaggactggtgtgtcggcggtttgctgcctcgtattctgcgagcgtggtcaatcgaatccttcatacagccaagtatttgctcgtcggtggggaagttgtccgtggctgatatccagctagatgtgattaggagatttagccttgcaagttttcttgcgagctgcctgatttggtagtctcgacagagccttgttttgggacgtctcttcgttgccctgctccaatctgactttctcttctcgtttcctacaatcgaccaaaacacttcgcaacaacctgctaccgccaagaaagaggatatg

SEQ ID NO: 4548 - DNA, 700 bp, Nannochloropsis_gaditana
cacattaacctccccgagagccatacttccgcgcccgggctttccccactctatcctccgtactcaaccatacgagcacatcaggggcctccttccttgacgggaaatgcattattgttctacctctcgacggcaaggcggtgcttgtgagtatacccttggtgcaaaggaatctaagcgcaagcacgcagacagtgggcacgtacggtgcaaaaaacggtactctgcatctagcatctgtatcaccttgcgcaacaaggctggcactaaattttgcatgcggcattctagaggtttatgaggtcgttatgaacgcggagggccgtaatgtggaggctgtgacctttcttgcgtcgactcgagcagagaggtgagtctccggttgttgaggtcgaggagggtctagtctttcgtgagtcacgagtctccgtactatattatcccaagcaagaagatacgaaagctgagttggcagtgcacttcaaaggcagcttatctaggcgtgtcagatgtccgacgattgcgcgtctatgactgcagagctggaggtacgggtggtctggcgctcgtccacgagacgatactttcagagcccataaacgactggtcatggctggactcccaacgaatcgctttattgttggataatggtgtgcagctgtgcggtttgaggccgaatgctcggccggttggcgtcatg

SEQ ID NO: 4549 - DNA, 700 bp, Nannochloropsis_gaditana
cttttatagtagccgcacgactccttgtccaagtgcttacctccgccaacagcgtttctccaaggtctaaagctgccaaaaaaacttgctcgtaaactggccatgctgtaccatgcaagttgagagtatgctggccgacatcagctatgcggtcgtcttccaagagctattacaaggacccaacattaccttcgattcctaggcttgaacctttccctttggcaacgaagtcctgtccatgctgaaccacttcagctgaagcacgaatctatgttgtgtttgaagggcatcactaagacttgcaggattgactgggctaagacttgcctcggagataaggaactcacccgattgtgccgtaaatagcggagtatggcgactgagtcgcccctctccagcacctggtctagttcctccatgtcgtgctgtgttggaggcacgagatgattaggctgagtcctcgcggctgcatctcttgcctgccgttgtaggcttctctgagacgacagcgagcggccgtgctgcccgtggagttggcaccaggttatggcctggataagacaaggcgcaatggcctagcgcctctgggtgctttttggttcgtccagctatctctatagctcttaaagaatgcaatgcaccatggttacgcctggacttgtcacatatgtcgtcgatgcaattctgtagttgtactatg

SEQ ID NO: 4550 - DNA, 700 bp, Nannochloropsis_gaditana
agccaagacgggaacagagaacgtagaatattttgcgccgctttctgagtaccaactttgccactggcagggaattgtgtattcagtttccgaatcaattcgatgagtccagcaaaatccttgcttgccgtatccgacccacccagctgctgcaccaatttcgcccggaaaaaagcataaagtaatccatcgaaaggtcttctctgcataccgtactccgggggggcatctatcgggccacggcgctgcagcctcgtggcagctatcaaggtttgaggggagatgtcccgagcggagggaagaatgaagaggggaataacggcagtagctgactttttggcatgggagtgtagaaaattggacaccgatatcaatgcactgaagaggagtaggcagctcctgccccgagccattcctgtgagataagcaccgggaaaaggagacaggtcgtgggggaggttaaaggagggattaggcggtgaatgtggccgccttgctaaatttgactgactgccagggcatctgatggtgtcattgttaaatttaaagcttgaattataaataatgtaactctgctcgccgagggaggggtcgccggttttcacgagaaaggtgcttgaccctctcatcctctcttaatttcatcgcatgcacggcacagacgaggatgagagcgcatgccgtccttttacttgccatg

SEQ ID NO: 4551 - DNA, 700 bp, Nannochloropsis_gaditana
tcccggggggggcgacgagacggcaagcgcggcattagcaatgctggctacctgtctctttccaagcgaaacaggctcaaaaactggcggaagccacatagtaactttgaaagcgccaaatccatctcaagaagcctcaatgagaatgactggatacaaaagaggacgcaggatgtgataattctagcgtggtaggccgcgaggtagaggcactacaatgcttttctttttgaggccggcaagccttcagaaatgatgcaggtctgcgcaacatccttggggtaagccgcaatgtcttgcacgtagagtaatggctgtgaataacgaagacggattacccacgaaattattcggagtatacaggcaagcacccctttgtgagccgtagacgtgcacaagccccccgcgaagctgaacagtctttgagagctacaagcgctcaaatcaataacgcaaagtcacgaactccacctgcatgcgtgagaccgggccacacggtgcatcggtgactcatgcgtaaaggaattggcattcgacacgcgcggccaaggtgatgatttcacggcgagcggggcgacgactcgtcggagaggcgaccccgctcctccacaattcttgtcaagacacacgagcaagcttacacgtgcccatgctcatcatccgtacagggagctatgaagggggggggcgagcaccaatg

SEQ ID NO: 4552 - DNA, 700 bp, Nannochloropsis_gaditana
cttgggcccagcgggacatttctgggaagtttctttcaattcacgacatggcgtgctcacttatcgccccagacgctttccattcactcacaccgggcattcccccttctgtcgtatttgcgccttctaatgttctatacgctttgaaacacgcacgcaggatgattccggaaagtaatcatcgacaggatggttgcacgggccggaaagagcgctctgctctacgccacgtctttcacgatctgcaacaagcacctgctgacggcttagcatgcagttactgcaaaaaaataagtccgaccctggcagcatgctcctggtgcttgtcaacgctttattgtggtacgtaaatactcgatatcttagtggcgtcgttccttgtcgcggcattctttcttgtagtctcttttgcaaactttaggtccggtttctgacagccctgaagagcaatgtctcatccttcttccgtttgttggatacatggtttttataattcacaggaaaagactgtcagaaaaaggattggatagctaagcatcaacaagagtgctcctctttggcctttttaggcttgcaaaattttgtccaggcgattgaagagcaacaacgtctcagggcgtccgacatgcaagatggtcgcaatcacaaatgcgattcctacccatgccactcatctgaacaattttctggtagcgaaatg

SEQ ID NO: 4553 - DNA, 700 bp, Nannochloropsis_gaditana
cagtctggtgtgatgaggccatcagggacatgtcatgtttcagtgccttggggcgattttcatcatttcatcaaggcgccagtcgtaaaaataacaatgtgatctaatctcgcaaagtcagacgtatggatacgtgcgctccctctagtacgccgttgcggcaaaagaaagtctcacccgtggcagtgactgaggcggaggagacacgacttttgaggtaagagatgatgaaatggtgaggggggaaagccagaaagtgactgaaggtgtcaaaatgactaaatagaaacgaagctgatgtacaatttgtgcattgtttttcacgtaatacatcgccagcatgcagcttattcagaaacgcttactttctggtcaatactcctcttttctacaggactttggcgttatgtacggcaggcatccttctccttgatatctggagctggatttggccgggtgtgctcggagggtctgagatggtgcgtacgaaaatgtgacattgtatgggatatgttagaagtgaggtattacatgaatgacgccacagacaagtaggcatgcgagtgaaatgttccgtatgcacgagaagaacgagaacgtccatgccgtgctgtccctaggatgtttgtcgtctttctgcgcacacagaaatgtaactccgccgtccatgtcactttcattattcctctttcccccaatg

SEQ ID NO: 4554 - DNA, 700 bp, Nannochloropsis_gaditana
cacactctttttctccgccatgaaccacgagtcccactccatggctgtggaagatggactcgagtcacttaaacacgaagcgacagagcctgtcacggaaggcaattacaacttcttcgacagctcgttttaagacgaggtccaagagagtttgcagtccccggcgctagacgatgaggcctgatccaatttcgctgacggagcgatgagaagggtagctatagcggaggtcttggatttgcctttcaatgtcttctttctgatgcgaagagctgactcgggcttaggtgacctcttccttttggtctggttgtttgtcattgtcaccaaatttaaggaaacgtttgtccatagaaatctgtgttgaaaagggcagtattagaagtcgtcgaagaaggtgaacgataccgttgctacagggagtcatagcaatactaaaaatagaaaagcgcaacaatactaggtactgagtggtagctacagggaatagtgggtagaaaggaggttcgggacgactggaaaagcgcacttaatagtaggtaccgagtggtagcgccgctggtactacatttagtagcaagagaagacggaaaggggtttcaggacgactaaaacagcctactacttcaagctactgagtgctgcttttcattgcttgtagctaccgctacttgtgggtacgcgtaaccaaaagctagca

SEQ ID NO: 4555 - DNA, 700 bp, Nannochloropsis_gaditana
gttgcgctggcacgtgtttgccgatgcaggcaacctgctgccctggtcggcgcctttgaccagcatgctttcagatatgcgagtggcttgtgggacgggtttggcgattagcttggggatggcacgcgtggagatgaattattcagtgcccgtcaagaaggagatgaaagattttgagcaacggtggcaatttgggctagccgctcatattggctagtattatgaataggacttgcgtaagtacataggtgcgttggtaggacaatgaccgttcaaagtatattacaattcatagagctgcggattagcgtacgaaatcttggcctcaaatttttgttgcatgtcacccttttcgacggaaccgagcaccgtgtgggaaaaaatgtcgaccccgtgcgattatcagaataaatcgaagcgataaatgttttgtgttacacgaataacttgtggtacttcaatcaattgatgcaatttggtctaacaagtacacccaagggatgggaaaggcaggaggttagacactgcatgggccatcgcccggacgacagacgaaacaagggccttgtggctgtcatacaaatgcttctcgtttagcatcatgacagaaagtagaaaaaacctcaagcattttaatgctgctaatgctggtccatctttgtcacaggccgaaagacaatctctaaaggatactttgatg

SEQ ID NO: 4556 - DNA, 700 bp, Nannochloropsis_gaditana
gccacacacggtcctttggagcgcagcacaatacttcactgatgggttgcttgtctgtcacagcaaaaaaggggggtgggggaggaggtagataaatgtgcgagcgtgtgaggaagaaaaatcggagcgcagtcggcttccaagaaaaaaatgtgggaagcccttttggttgtgtgaggagatacacccaaaacctggaaggaaagtaagtcctcaaggaccggggcgggaaagccatacgaacgacaacggcttcctgactataatttccatcacatgatgctcgctgccccatgtcctccttctgcggtttgcttcgggccttttagctcgcagcgctcgacaatatttactgcaaagcggtacaaatacaacgaaagtgacctaggctagcttgtgcatggctttgtgtcgttttccaaagcaattttactctataaatgatccgtaacaactgttcacatcgccctcgttgtcccgacaaccccaaaagagcatgtatttttagtcgacaaaagcctgaaaagaggtgttcttgatttgacattacatgaaaaagagaaggactacgtattttggggaaaggtcaactacgtggatggccaaggacggcaacgtcccttgttctccctcttccgtccctcacgatcccccccacgttcgcgttccaaccacgccaggacacaaatcgcaggacatg

SEQ ID NO: 4557 - DNA, 700 bp, Nannochloropsis_gaditana
ctccaaggcacgagctgctctcacatgtctatgtacattttttaaattcaaacgtaagcgtactttttaatttatctactaatccaaaatcatgcgtgaccgtctgcgcatcaagattgccggatggttgatgcgtggaagggctcggcccacgcaagatcgtgcgttcgaaacgagacaaaaatcaaataatcatcctcgacacctaaaaaagccttgttttggtatatcacatacctgtgtgccaaagctctgtttggtgatggaatgttgcactcgatggactggcccaacaaaggcggtcgtagtggaagctagaaggagccccagccctgttataagctgatgaccgcgcatgctctggtgctaaaattcgacctgtgaatcccgaaaagatccctgtctatgaacgcaaataatatgaccatgtgagatgctataagacccaaagatcggcttgacaaggacgaaaatccagcgcgggagggtacaggggtcctggggggggtgcgtcaccctttccccaacctgctggccacgcgttcgccccgaccagaagatcggatcgaaaccttactccttgtgtctgtgtcgtcacgcccgtcggatgaacgactactcaccatggagagctcgccttgtctcagggaaaaattgtgccgcaggttttgacgcctactctgttcctacgttggctcag

SEQ ID NO: 4558 - DNA, 700 bp, Nannochloropsis_gaditana
aagcaaccaccgcccggcacgcagtttgaaggctccatgcgggtgaccactccttcttcaagatatcgaggcagatttcacccgtctcgaagtgaatgtttgggtgaaagatatgtgtgacgaagcggatgacaggaggacggatgggatagtccgtgcccacttcgatgcggagctcaaaagtccccccttcgaagggggtctccccgggtccttgtataatggcatgccacagtcgaatattgtcctcctggggccaaagttccatgtctgtatcggaagttttttctatagcctggagctcctggtgcaattgatgtctttggttgagtcaagagcgcggatggagagggaattctcacgtttgcggaaggatgaaccgaggaaggcttaccttgcgaagcctttttaaggaacccatagcaaaagctgcaggaaattcttctccaaaaagtctgactcttctatcgttgtaaatagggatgcgttcaagtcattttattcgccggtccgtgcgtgaaaactcctttttgtccccacgccgaaggagtaacctccccccccttgaggcgcctgcccccagctcttccttcttgatggctgtctttcgtccccgctatctatcccactctcgggcttgtgccacgccactgccttgccctcactactttggtgcgctcgcacggaattcgtgaagatg

SEQ ID NO: 4559 - DNA, 700 bp, Nannochloropsis_gaditana
gagaatctaagagggtcacgcgcgccctgcatgataatacagttggcattgtagggattaagcattatcaaaccaagggcagtctgcatgttcatagggcatcaaagaaggaatactcgagacgaggccatcgcctaaccctagacctcacaaagatgaggttggcgaggcactcgagacgttctctttttttcctccgaaacaatcatttccctgacttttgctcatttgcaaacgtatgaacttagttcgaggggtctcacgctgatgataatgacattcagtgcagcttctcggcaagtggtacgagaaatctaccactgggatcaataggagggtggaggagcagcctatcaggaaaaataaactcagctatcagacaaatttgtcggtctttttatgtgagaaataattgtgtccaatactctggaagcatgaaacactttaagagagctggcacggcattctttgaccacacgaactgcgcgcgccctcaggacgatgttgatgactcgaaattctttccgtctttcactcgctctttggaggggctgagggagggacctaggcacccaagcggccttcatgcaagccatatgcgcgtaatatgcctcagatacattttctatacctatgatctacattttcttaggactcacgggggcgagctggcaaggccaggacgtctaatttgaccatg

SEQ ID NO: 4560 - DNA, 700 bp, Nannochloropsis_gaditana
tccgagaggcgggtgtgaaccccgacttccacgttggaccggaaggggcttccttgatctgcgatgggacgacagtggtaagggtgaaggacaataaagtcatgctagagggcccgcttagcgagacttacttcaaagttcggcaagccatctattcgcggttcgtggctttgtagggaggatgggccagagggatgaaaagtgaagcatattgccaaagcacaggacctggtgtaaagcactggaattaaatcgattaaaaggaggttcatacactgcggtacgattgtttacatttttctttcacgcagtaattacaaataattcgcaagtctgcatctcagccacggctgtgtgatagttttctctgcgcataagtttttttctaaaatcgcccgtcaaaaaatggaaatccgatacgtgacggtggcaattgaaatcagtccttcgaaaggcaacaatttaccaaatcaacaaatggaaaaaaagactacaagcatgggcatgagcagaccgacagctgtctcgtcctttcctcccgtcatcaacctcaagcatcgtaaggccatatttcttcacgtcgctcgacctggactgtctcacccaattcatgatgcactcacgtccatgcaatacacatatgatagggcgccccgcggatagttttccgcttttcgtccttgtgaagcaaccggtgcgc

SEQ ID NO: 4561 - DNA, 700 bp, Nannochloropsis_gaditana
tgtccaggccgaggctggggccggtcctgacgcctcccgtcccgcgcccctgcttcccgctgtgtccgcccaggtgcctccaccacctccagcagcctccgacacaggggagggcctgacattccgggtcctttacggggtgctcgagcacgaacccttgtgctacctgttaaaagtcggggaggcgacccttctgctggactgcgggtgggacgtgcagctggatgaagccttgctcgagcccctgcttcctgtccttccccaggtccagctcgtcctcctttcctttccagacctttcccacatgggggccttgccctgggtggccaagcacctgcgtcccggcgttccaatttacacgacccagcctgttttcaagatggctcagatggtgctctacgacctgtacctgaacaagtgcatggacactgccagcggcgccgccgggtgtcccgcctttacactcgacgaggtggacgccgccatggcgcgtttccagcttctcaagttctcgcagccgctggaagtgcggcagcagggccgcttctacctgagtgtgactccttaccctgcgggacgcatcctgggcgggtgcttttggcgcgtgaactacaagaagatggaggagatcgtgtacgcggtggacttcaatctcaagagcgaacggcaccttacgggggccgtggaggccttcaatgcg

SEQ ID NO: 4562 - DNA, 700 bp, Nannochloropsis_gaditana
caagcgatcgaccggaagtgtttttttaagcatcgccaacattgtctgcgtggatgtggtggtacggcatcagcattagagagcatggttggattacatggcatcggggcggtgggaggagcaggacaggaggttactggaatggctttgaacatccgagtccgactttgccatgtacgaagtagaaggaatgctccagatgtagacctgaaatggtgatatttgactttttcgttgcacccttcttaagaggatgtctgaattgcatgttgttgcgccttacgctgtgcagacagtaactttcctcgcggtcaatacgccccctttccccccccaccccagaggcaaattagcatgcccgatggtgcaggtcgagccgccgccgccaagaacgagggaaatagcgatgtaaaggacctcgacgtggaaccaacagcggaaaatatcgctatgtcgcccggtgacgctgccagagggactcctgacgcgccgggagaagaaacgggttccacggccagcgccccctcgcctgagatgtcatccgccgtggaggcagagttccccgctccaatggaggtagacgaagctgttcttcccagcgagagtcaaggaagtgccaacgggggcgttcccgactctgtccaggccgaggctggggccggtcctgacgcctcccgtcccgcgcccctgcttcccgctg

SEQ ID NO: 4563 - DNA, 700 bp, Nannochloropsis_gaditana
gcaggtcagcacctcccaaagccgcacggaccacacaccctattcttgcccaccagcaggtatattctatgtcttaaatctgaaattcgggggaaatgagttcatcaatacctcatcttgtacatatcatgaccattttctcatgcctcatcaacgcgcgcaggtacgcagtgtcgcgcagttttttcttattggtgtcattctaggcgtgtggatgtcgctgaaaaacctcccgtcacccggaagactgaccatgacttggtgtttctagtgtaaaatacactgcgctcaagcgttgcccggaaccaatatccttcatgcgtccatagcgattcattaacatatcgcgctggtcgtgtgttggctcgatttttcctcagactgtggacgttgaagtcctcagcgactagtgctggaatggcttgaacgagacccgtatcggctgttttcataacgtaccctggacgtcgacaacgcagtaaaactagactgcatggtttgtcgtcaatcatgacacttctacgctaccgtttgtgcgtcgttttcttcgcgtcccacattcacaactccctatctgatgtaaactagcggatgttcctggcagtgtgcttccgggtgttattgtccttcatctcacgctacgagttcaggcccagcttgctcaccatcgtgcaaaccaactctaaaacaggccatgatg

SEQ ID NO: 4564 - DNA, 700 bp, Nannochloropsis_gaditana
aaagaactgagtacaagccacacgggttcagccagaacactgacggaaatcaagcatggtgcaaaatttttattgcgccgtgtctcgcatttacatggactgttctcacacgatacaagtcacttaaacatttcacttcgaaaaatattattcattcttattgtggaagatataatctgggtactttagcaagaggccgacacttgtatgctctccgggcctagtaggtcctgggccagaggaggtaatacatgcaaggccaaagtcgggggaaacttgtccaggataggtaagccgccgacaactccaaagtcgcagattatgcaacgtaaaagaggggtacacacaggggtatgcaatatcggacagcgcttgcgaaaacaaagtgaccaactgtcaggcttgcaccaagtgtcgtcattttttaatccgagggcctcggaattggcggaaacggtcggaaaaagcaaaaatgcgtcaacggcccatccctcttttcaaggatccttcgaggtggccctcgcttgtttctcccgcccgtccttcaaaaaccacacaattatgtgccagaaagtcaaaatgaaacacttcctttgactactctgctttgaactcgtaattcactccgtttatgtctatttatgttgttcttgccacccttcttcctcagacaactgtcccgaaatctaaattaattatg

SEQ ID NO: 4565 - DNA, 700 bp, Nannochloropsis_gaditana
ccttgaagtatttttttatctgcgtggtgtacattgctgagatatgcgatgagtaatttactcggtaccgaaaattcgtgtacttttgcatgttatgcgtgtaccattttgtaagcctggagtcaggagggtacatgggccctgccctgtgctttctcgctgctcggacgtcgcccatgatggagtggcccatagataaaccgtcgattcaagtcgaccaaaaccacacataaagcgtgctcccctcaaacccagacacgtacggggcaaaacttcctccatttttttatttgttcgattcttcttacgtttggccgcggcatcttatactcgacccagttttctggctgaagacggaaggtccttgacccttcggccttgggcttcgactcgactcactcgccgaaaaatgacgccactcaaggatactccgagtccgcccctcgctggaaaaaggcaagacagacatcagtgaatcagaggaggggatgaagccttgcggccgagcccttcccatgtacattggaatcctgcctttggcgctcggtagcgtacataaattctcaagcctcacattgcgcccctaattgtttctcgacagttcatcggtgggagaaggccagcttcgcgcacgtccgagggtcagtagaacggactatttcttcgctgcacgccttcgtgttgcgatttgaccgaaatg

SEQ ID NO: 4566 - DNA, 700 bp, Nannochloropsis_gaditana
gtatgttctttgtttcttgactgcctcagcgctttaaaaatgccatcggtttcaaaagtgatagacgatgagaacactatgcccttaccatggtgctttgcccggccttccttcttcccagaccgaggccggtggcctgagcaacagctcaacctttcgcagcacgtccgccaccgcaaggaaacaaaaagtttctgtagaatctggctggagggatgccacccacgaaatgaggggtaaagtttaggaaattgtgaatcaaatgccttcatcttccttctccttttcctcccctccctccttgccctgttcgcctcctcgctgaagcccgtaggctatgtcacgcgagggtcaagtaacacaccccgcagtcccgggaaaatatgcctttcaattttcaatcatgtgctgtggatgtaggctcggtgaaccaccgtctgtccgcgcctgcgggtggtcgtgggcttcgacagacgtgcttcaatttaggcacccagcctcctcaatagctcagcttagatcttacaaccctgatctatccctctcacgtttccctttccccccctttttcacacgaatctccgcgcggccattcttccacttagccgacagctgagcaagtatgtccagttcctcctctcaccatgccatgcaaaaagtgggggtggtgggagccacaggggccgtcggggcagagatg

SEQ ID NO: 4567 - DNA, 700 bp, Nannochloropsis_gaditana
accgaggcgtcgccgtcaggaggactactaggtgaagaccaaaatccatgtgaaggagcaggcgaactcattcagcgccacagaaaagtgcaaacatgaacatgtgacctatgtggtgttgttgtcggacgaatttcttgaaattaaagttatgcaacgcaaccatggagagccgaaaccaggatgaggaacgttgggcacggcagccctttttcttgtgataaggcgtttttaaaaagggggaaaaaaagatcactgagctatgtttgtaccgtgctatttaaaatgacatttcatgctgtaaaatgaacattatgtgtttgtcacattttttcccggaccaaacagcttcagcatatcaaaaagaggggaaagcaagatacggcaagcgtgccctctctccctccctccctccctccctccttcgctccttccccctttattcacgcagcaagcaccatttcttttcccatggcgtcttttgcttgtggtcatgactgcgagtagaaactggcatatattgatttgaatgtcgggtgtccgtggggcaggaaggcaaagatgcgaataacttggccgcgacagacgtccgagcccccagatgccactgtgagagtacgtactactcctttgtgcctgacttgaccaagcaacattcaatttgatttcccccccattcgtacgcaagacagcggccatg

SEQ ID NO: 4568 - DNA, 700 bp, Nannochloropsis_gaditana
ctgtcctgcctagaacaaatgggcattaagaggcagggagaaacttgcttgctaggaaaagctttgcaccgtcctcttttttttctcctcgaccatccgaccacaaccacagcaaagtcagtcttcacacacctttttttaccttcctgtatttccctcctgtgactcgtggtcttggccacgcggtattaattctctgttgggcgcgcttcaacttcagaaacgccgtctgccgccgactgcgcggggcccacatcggccttgacttcatcgcttttcgaacccctgtccccgaattttcgtattacgtgggtgttacggtagctcttgggtccatcgggcttgacgttgacttctcggcgctgcgcggcgtgttcttgctttggatttcgcttgataggcatttggggcctcagtctttccttcgattttggcacagcaaatcttgcattttggaggcgggcaggacctttatccaagttttttccccccacgccgttggccgagccacaaaacgtgtagataccgaatgaaggcccaaccgtcgcaaatcaaagcctttcagagatgcatttgcactcgccttcttagaactaatttgtactatgtatgtaacattgccccctccttttcatgacttttgaccctacagcagctccgcgacttcgctttgatgaggagagggccgctgcgaaggatg

SEQ ID NO: 4569 - DNA, 700 bp, Nannochloropsis_gaditana
cacgtgtgcctggctggatgtaagacagtcttttttattacgggaaaaccagaagtcttgaaagttgttggcacatttgtgcgtgaacgttggcttctccacctcttccccggtaccacagtcacgttcaatcattctgactggacttgtgtctcgcttgcttctctcagcactcattgtacaggttgttcgcctggggtcccaagactaggtctttttaattcatccgtcattttttgtcggcttgtctggggctccttctttgaatttaccacaacgaagttaagtccgagcttgactatccaaaatccaaagggaaagtggatactggcataggaatttgtgattccttccgtcacggtcaccactttttgtcctcttcggggcctccctcctcctcgtcctctccttcccttcaagctcttcccgcaccatccaccacactccgcaatatgtctgggactcgcctctgtcttcgtgtttttatcctcctcgccatctcccactgcacagtctcagcccctccgccacccctcgagagatcaggcgccctccactctgctctccaggcagaccaagcatcagggcaccctcccaacaatgccttagtctcccacgcccatgtgccctactcttcctccctccctgcgtccccgttctaccctgaccgcatctcccccagccccgggaccgaccgatg

SEQ ID NO: 4570 - DNA, 700 bp, Nannochloropsis_gaditana
ggggaacttttccaaatcctggaccagcggactccctttgcggccgcgatgcatcaaaaggcgcaggaggtgggggaaaagaaggacgggcagggcgaggggagggagggagggagggcgggagcgaagatagggaaggtggggaagcgccttccgattctgcgtgtgcatgcgcgatttgtggcaactgccaactctttctcttatgtcgacctttcttcctcctccccttcttctttcttctcctcccctttccccccttttctctccccatcctcagtctttcatgaaaaagagggatttggagctgatcaagcaaggaatcaaacccccattgcggggaggaggaggacggggaggagggggagggggagggggagggaggtgggtggatggggctggcagcaagactcagtggcagtcattgttgaatcgtttaaaaaaggaagcgcttctgccgagcgttgtcttcaatttcagcaagaagaaatgcgaggaatgcgccgactatttggggtcggaggacttaaatgccgccaaggaaaagagtcaggtggagccaagggagggcgtagggaaaaggggagggtggagggaaggagggaggaataaagggaaagagaggggtagagagagggggggtggagcagggataagatgactgaagcatcgctcaataacacaacataccctatctatg

SEQ ID NO: 4571 - DNA, 700 bp, Nannochloropsis_gaditana
agcgcaccgtgatggctaatccttgcacaagccaactggtcactatgtaggaagcaatgatttgatgcgaacgtgtgccaggtggagagattggtgagatatgtggttgcctttttgttgttgcgttgctcaaaagagtctaagtaaaggcctataagggtgctaaatgggtcgagttgccggccttgccagcagaccgtgatgtagcatttgcactaggacgcatgaaatgcccggctttatgcgtgtgaaagcggaaacgcttgacatgtttctgttcgaccacttcgctcagtgttcagctttcacggtatcgcgtctctccaacgactcgcccactcgctttcttagatcagcgtttggaacccatacccgcgctcccgatacacaagcaatcatggcggaaaacacataaagtgtgctgagctttgacatacgcattccggttcatggattttgtgaatttggttgcagaaagggcatttccggcttcatttactctccacttctcgcatactcgcctcctcactcacgaaagcctctagcactgattgtactacaataattgtggcaaggccgacgtgaccgaaagcttatcttttcagacgacaaatacccgatcccaacacttcgacagggctccctatgtccaaggtggtggtgaatatatactgagagaaaggcttggttgaataccatg

SEQ ID NO: 4572 - DNA, 700 bp, Nannochloropsis_gaditana
gtccattctcctatccacatgacgtgtggccgggccgtctcacgaatccggtcgctccatgtacgaagttcatatggtgcacgcgggagatttggggcaccacgtctggtttggtgcaggcggcccggttattgcccgcgtcagagtgtattgctgctctcccagagccggacatttccctccccttgaactttgaggctttagctctgcatacgacgaaactatcgggctcgccgtacggtcacttggcatgggcgtgattacccccccaaatgccggcagtgacgcggggccgtggcctcttgggaggatggaggggcgtggtcgtgtgtgtcgtgtggctttgtcggggcagacgcacgtcacgacaagaaagagagcgaggaagtggtgcgtaggccccactgccgcttccgtcagcagttcctgagccctttctaccgggcatacggaagtcgaaggccacgtttttcgtgcattgtgcctgacgcgtgacgtaccatgtattgtaccaacaggtgcatgtaccgtgttgttgcgctcttcggtcaaggcaggggacgacgagcttaactggcgcaccccgtgacgagagcagggggtggagtgggcgaatactacaacacaccgccatcaacaccttcagaagctgagcaaatcaagcggtaatcagagagaagcattcgcatcgcttgtcatg

SEQ ID NO: 4573 - DNA, 700 bp, Nannochloropsis_gaditana
cacggcgtgatcacatggggcaagaacggaaatcctcgttcttgtgctttgctcatggcgtaagggtttgcacgagcacatcgcttgaggtttggagggagcgagggttagcttgctgccagaggcggaaaactaaataggaggattgcccattgaaaagcagccccctgtccatcatatccgtgtggacggtggggggttgacacagggtgccacaaatcatggctcatcccgttttttgtgcaaaagacgtttttgggattcaatccatgtgccgctgcggttgaggaaatggtaattgttctattcgatccgcttcagtcaacccttttgggaaaaaacgcgatatatgccgacatgcacagacattgcgctcaagagcctcgtcaatgcatcttcaccacgtagaatgatacaataacttgcaattggaagggcaggatagattctgccccgagttctcgcgatttctgatccctccttgcctttgctcaacacaaatacacgacacaaagctccgagtgtcggttttcacaccatgaaaaccattcgccgcatgtgactttactcctgctatttaaggagcatgggagagaagccagcgcaggaccttcgcggaggtgtgtcctaatcatttatcgatctgaatctctatatcggacgtcttccctccccactgtccagactctacaacacgatg

SEQ ID NO: 4574 - DNA, 700 bp, Nannochloropsis_gaditana
ttgagtcacaaagccattggcgtcctctgaggacgacgtggctctccatagtgcctctagcgcaggcaggtcacttggaagactattgccgttaaatgtaattaaacatctattcagaccctcagtgaactgtgggcggcttaggtttcctgttttgtcgcgatcaagtacattaaaggctttgacgattgcttcttctgaggagtcaaccctcctatgaatccccggcagcaagcttccttcaaggttcgcttcatccacaagatcaagccaaatgtattcaggtattctggccatgtccacagcatccgagactgtggatgtagcgtcccggtcattcttgtttgaggctgcggctttagatattgacggcattggggatgggccgccggggccgttctggaggaggtggttgaccgaagttgaatgggtggggcactcctgtatgggaatcgcaacgtcaagtgtatgacatactcttgaaggtttgtttccaatgggtgtggcaatgtgacagtacaatccgtgggcgtatacgccgggtaaccccattcttcggtcaaaaggcggtgtaattatgaggcacagagcttgcggatgaaaccgttacgcactctctgcaaccctggcaacaggtgtgaaagcctctcatttgcctgcctagctcaccagcgttctcattttgaaaaacaggatcatg

SEQ ID NO: 4575 - DNA, 700 bp, Nannochloropsis_gaditana
ggtaggaggaccagccagtattgaagcatattggcatccatttccggagcagcatttctgccacagcacggcgagcaaagctctcaagagtctcgttttcctggcccgaggaagcagcaatgaaggaaacacgcttcaatgccacacgaaaatcgtcgacctccatctccatgaggcttgaagaaaagtcatgtcctaccaagacgaccagaaagggtaaaaaaggcgcgccgggcggcctcaaggaggagggtatatcagggaaggaaacacgttcgaacccttcttgccaccaggctagtcggaaagcgaatggtgccagaacaacaacgcccgcaaggaaccagagctgcgtccatagtcgtgtccctgccataggaattacgaaaaaggagacggtcgggccctgatcagcgagcttgccatgtcgaggtagcgaagcgcttctgagtcctgatctggttcctgatgcgcgcgacgctgtgcatagtaaaaaaatcggaaaggcaagtcagtggtaacgaggcagtaacctcgcctcatgcgttcaaaaaaggacaacaaagtctttctctacttgcacataatgacctccccgctcaccgtttccgggacacccctttttcttaatttccctttttttagagaaattcccacccgcacaatgtacagagcgcgatggccacactagttcgacatg

SEQ ID NO: 4576 - DNA, 700 bp, Nannochloropsis_gaditana
gtcaggtttcaccatccttctatcatcctttcaacttacagtgtgcgtgtggagctggagcggacgttgtgatcacgggtcggtctccgttgcgatgagcctgtgcacggggtctcgtattagtcgtagtgctcttcctctcttccatcaccttcacagctcaatcacttacatctgatccgctcccaaggtccccagaattgggaatagagtatattggtcttatttctgttccagatcgcaatggctgtttttcctcctgagtcccatttcttgttggcatttgcttcagcgctcgagaagctttgcttgtcgcgttcgtgctctctcctcgaccgtggaggcaaaatccaatgctatagctacgagctacatggtaagtagtgtatggtagagattataacaagtttcctgcataaatctggcaaaggtctccccggagagaccacaaagaacaaattccgaggccatcgaagatagcgcggaaaccctagcggccacagagacctgagatgtagaggaggcggacggcgcaaaaaggcaatcacatgcatctctggcgcacaaaacgttggataagcccctttcctttcccaatctatcaggcatcctatgtatggtttccgcaagccactgctgttcattttgaaggacatcaccatctcggtcgacctcgcgacgtcgctgagggcaagagatg

SEQ ID NO: 4577 - DNA, 700 bp, Nannochloropsis_gaditana
ctctatttctgcgccactttgctctgaagtaaacgttagttctctctgtataggacccccaaaaaaaaagagcttccgccttttctttaaaaaaaatgataaggcctcttaactcgattgtcaaaagtataccaatcttgtttaaaaaaaaaaagattcggcttcatcctcgaggaagacgcgtcccctgagcgctggctgtcagtcctgtgtctgtcacgtaacggcccctctgcttcgagcctgtcctcacgccttcaacagaaatgcacatcattcttcaacaatccacttcgataccaaccgtcttgaacacgcttgagccgtacaatacctccatgatagcgagatttacagctgtgggcatttcacgagaaaaaaagtgagaggctcggcctgtcatgcggcatgacagcacttcatgtgcgatagaacaggcacccttgattgatggtctcaagcacacattaaaaaaatgtatggcattcggagtccatttatttgatccaatactttgtgattggccatatgcggctctcctttgcttcagggtaccagtcggccactggaaactggctcattgctccccagtcccggacttaccgtttgatctgactgacacgtatttcttctttctagaggcacaggaaggtggcactcgcctccgaccccttcgcactcgtcgccgcgtgaagaaatg

SEQ ID NO: 4578 - DNA, 700 bp, Nannochloropsis_gaditana
tcagcatccctcacgcatagcgccgccagtcagggtcttagacccgaaaaagttggcttccgacccaccggatttgaaccagtgaccgcccgatacggaacttcatcatctacagtcaggcgctctaccaactgagctagggtcggtatttcgtcagtttgagtcgttctgccttactacaaagggtgttctaagttcccaccctaggttcctcctcactcgtgcgatatgttggggactagcggaaggaaattgatggatgtggctgctttttcggcctacttcggtgcagtgagagatggttaaatatcggatggggctttttagcaaacatcacggcgaaggaaggctcttaaattttcttcgactaggcgtctcaggatgtcaaaatgttcttcgaccggatttctgcgtgcaagaagtcagaagtccttcgatgatatggaagaatggctgcttgctatgtatgtatggacaaaaattgactctggcataaccttccttcgctcgtaattggcattctcgagcggggtctggagtgttgccattgcggcatacggagcacagcatggaaccctctggcaatgtatcgcagtgctgggcattcatttggctcaagacacgctagacacgacatatttgatcattttattatttgacacactgatgccatggcacaatttccgcacagcatcccatg

SEQ ID NO: 4579 - DNA, 700 bp, Nannochloropsis_gaditana
tgtgcaagagaaaaaacatgattcggcccattcatgatgctttttcacatctctcaagcatatgtatcggaaagtaaagtcgagacgacatgaaaacatgctgaactagctgtctatgggatacatgacgctcaagcaattattgcgacgcttgaaagtcgtggtttcgcgtttcttctcacgagggttacgcagatcctgccgcttcggcgtgaccgttactccttcaacccatttaacggctcgggatcgaccttgggacaacccgcgggaggtcaggcttgaatccagtcatatcctggaaagtcccaacgccagggaaaaagaggagcatgtgactgtcacaaaacccttacatcatggcactgtatcattcatatgacaggaaatgagcgctgcatgaaagaagccgtttggcgcgaaacaaccagtgtcatagcagaggaagacggataattagtcattgcatcgacaaatggtcattgcgacacgcgagcgacgctacaaaaatgtgaatgcgcctagaattctcttgtagaagccgctattagattacgaaatcgcggtacgcattgaattgaatttggctgtcaaaaatcgaaatggcaaaaagcgcggtaaactgaaaagcttcagattgtcagaagcaggttacgacgacgaagagcataatactgcgttggcgacatcactcgaaatg

SEQ ID NO: 4580 - DNA, 700 bp, Nannochloropsis_gaditana
gaaatgaagggagagggagggctgctgcctgaataggagggcgatgccatgcatgcgagccctcctttgtacctaatgttttgctttgagtgacactgcgaaatccattggctttgatttatgtctacagcaacatgtacaagagaaacatgctaggaaccttggcctctgattgtttgttgcaccaacccctgccaacctccccccatccttcctccggcagcctcatgttctcctccgacttcttcggcacggacttcacgaagaacccgctgggagccaacaagccttccttatgtcacgagcatgcagtcgaacctactcccataaaggcgcatgccgagcggagctatcctttcgttctcctccagttccgcccagcttttgcacttcaactttacttgcgctttgtgcgcgctccatacgtggttcggaacctggaatatccggttttagagactgtgggacaacttcctgtcctgatggatgggcagttcctcttgccagaagaagacgccctggggtaccttcgtgagcattatcccgccttggacttggacgcgaaactctccggcgcccgacgtgcgcaggtactggcattgcacgccctcgtacgagagaagttagctcctgccgtgggtgcttctcgctaccgggacgaacgcaattttgtccaaaatgtgcgggcggtcatcttgcg

SEQ ID NO: 4581 - DNA, 700 bp, Nannochloropsis_gaditana
acggtttaaatgctcagttaaaccctttcttatcgcctttgttcaagacgcatggaggggctgcaggaaaaagtgccatgtgttgactaggaatcgtgcgtgccaatgctgacatgagaatgccgctacgtcttaatgaagacaaggtgtaaaaattggaacgatttcggtgcctgctttctgtcatgtctttcatcccaatagaatggtgtgctaggacgtcctctgcaacgtttaaaaatattgctgtgctacaccgaagcctgaatgttggcagccgcggtggttagagcgaggtaatccctcggtgcgaggggaaaaggcgagacaacacggaggcaagcggaggcgataactgcgacgtgcagacagttaatccccctccgcggtgccttgtgcttgtgaaatggaggaaatgctctcagtttgtccagcacgtgcaaaaaatgtttttaagtagtggtttttctggtattggaaatgaagggagagggagggctgctgcctgaataggagggcgatgccatgcatgcgagccctcctttgtacctaatgttttgctttgagtgacactgcgaaatccattggctttgatttatgtctacagcaacatgtacaagagaaacatgctaggaaccttggcctctgattgtttgttgcaccaacccctgccaacctccccccatccttcctccggcag

SEQ ID NO: 4582 - DNA, 700 bp, Nannochloropsis_gaditana
tctcatatcgcttacataatgcgtccacatgctgccaacattttcttccatcattttcaccagtccttttcgattttttacccccgctatgcataaattcgtatagctttgcgtagtgttattctgtgcacgggtctggcatggcaccgcctggccggagaaggctagtcatcctcctgcgccttataatgggggcattagtatcattagccacctgtcaagcttttttggggttttcatattcttcgcagcgcattgctacgccaggttctactgcattgcggatgcatcagctacagccgttattgaacacgccgctgcggtttggttgcggatctagacgggtgttgcggctttttgcaggggagaagggaggcgaagaggacgccctaataggagtaagggggcaacggggggggtgggaagaagttagagaacgagcgttggcaagcagtggaaagagaggagatgtgccttgactagagaagagaatgtatttgattgactgatgaaagaaaggaacaaggatgcaagctgcttcagatgcgatgaggcggtgtcagcgtcgagaacggcaaaccatataaaaaccacaaggatcgttctggaaagaaatcgtcgataataactgtctcatgcctcatttgtcgctcctttttatctggcccacccctccttgtcatatccttcttcgcaggac

SEQ ID NO: 4583 - DNA, 700 bp, Nannochloropsis_gaditana
aataaagaaaatggtaaggaggtggaatactgggatcgatccacctgcgaaacatattcataacacaaattggcaagtaaacgcagataagcttgtaaggacgtggaaggaggtgtgcgagcgcacgaaaagtgaccgggaaatgagtaggggagggacgagtgtagccgagacgtcatacgtcatggcgtgtgatgaaacggaaatttgaaatttcaagatttccgtgctttacctccgtccctgtctgttcggcttggaagaggaaaaaaagcttaacttacatgaagtgtgctgtaatacaaatcaatgataattacatgatatcatatcgggaaggatagttgttaacctgcctttttgaagcccgaaaacgggaatctcttgaaggaatgcccgcggcgattactagactcccatccctcgcggatgtttcgggatacctttctgcttttgttgcgcttgacttgaaggtgtgcaatttatatctaaactttattagcgcgcattttatgtaagttgttcctgcacgcatactgagacacgaaaagcagtctactgtcttgacctcctgtctccttgtcggcttcctttcctatccggggcacgcgctctcatacccgcattcatgctctcccgaccaatgtcctacatgtaggtctactcacagctttaaggctctgtatcaagaatatacatg

SEQ ID NO: 4584 - DNA, 700 bp, Nannochloropsis_gaditana
gcatcacgcgctcacgcttgtcgaggtaggaaatacccaaaagcaggcattgggcactgccatgcctcagccagtcagtcccctaatgccagtgggtgagccacgtcgtaaactaaagcacgcattaagccgtcacacatagccaattttgtgcacatctaccattcccaccccgcccctggctaagtcatgccatgcgcctatcgcactagtccaattcgccaaagccggtcaccttcatgaagttggcggcttgagcgatgatgattggatcgggtcatttaagtgacatggggccagatacgacgggacgtcatgccaccgagcgcccccacggcgccccctgcaacacgaaggacgggccgtacgagccatgcgatgacgtgcatgggcatggcagtgggtaatttgcaccctgtgtgcctctgcatgttgacgacaggcgtggtttggcatatggctgctctttttcttgttgacgcggtgccggcgcttagccgcgcatgagttgcaagtggatggctgtcaggccaagttttgggcgttttctggcaatgtggtacaaagtccatttcttattagcgtcacaatcatcacacaggatatagcgtggctcaagtgcggtattaagtcgggctggaacctggtggtccccacggaggggatcgaaggtggaaaaggtcttgttccggaagacatg

SEQ ID NO: 4585 - DNA, 700 bp, Nannochloropsis_gaditana
gggcgtctaaaagtcatcgccaatataggcgaccgtgtcgaccttgggcaacattttcttctttggaagaacatgtaaccaggtgttctcaacgaaaacaaaaaaggaaatttcaactttagatacagcatattgtcaagatggttaaatcttggggatgggaaaccgacaaccgatgggacaattttgcgattccgaggaaaatacgcgacctactgcatcgctgcctgctagattgctgtcgccttcaacacaaaaatatgccaggaaaaacgaatcacttgtgaatatataagtaacttctcacttaactgctcttactgtcaggactgactgaattatcttcccttccaacactccgctatgatagttcatggcggaagcttcagccacctcgcgacccagcactacctccaggcaacgtatggcaggaaagaaagcgtttagtagcaggtccacagaggtgcaaggtagtgataaataatcatagcaaatccgacgatccagtgtgtcgcctcgagtcgccaggcgcctttgagtcgtgggaggctaaattcatactgtcgtggagtgtcagtcctgactgtcgaacactttctccgttctcacagcgtcgttgaacatcgtataggcaaaaaacttagccatctaacacgtgatgcgtttgatcccacgatatataaacatgcacgcaggcgac

SEQ ID NO: 4586 - DNA, 700 bp, Nannochloropsis_gaditana
cctccgtggccaggaacgggggccaacgcccgttttgcaagagtacctgcagcagctgaaggcgatgcacctggctcaccgccggtctcctcagtcccacaatttgtgaagaatgtgataaaaataaaggtcgatggtcatttctcggacgtcagacaaccaaaacgtgaataatgtagtaaaaaaaaggaataatactagcatgtcctttcagcagttcctttttttattgaagggtgcgacgtgggcgattcgtggttctttctcatatacgtagatgtacgaggccaggtaaaacctgatccttccttgtacatactgaattcggaaggaataataattcacatatctaattaacctcccgttcgcgtctctttctggccccttctcacctctcgcgtgagtcatggatgttgacggctgccgtgagatgccattcctagcaagatctcgctaccatctttaagcgctcgacgcgaatcagaaggcatttcaacgtaagaacttttgcgcagtaaagcgccccactctcggcggcaagttcccacgtgagtgacagttggcgagtcgctaattttgcctcaggtcttcttgctttgaaatggtgtcttcaaggaggaggccacgaggcctaccacaggacgcgcggcacgacattgacctctcaaagtcgaattcgattcattaaataggggacatg

SEQ ID NO: 4587 - DNA, 700 bp, Nannochloropsis_gaditana
cgtctgaacccctcccctcgctctctttcgtcccacaaagtgcccgctaccaccctagtttaggagaaatctgacgataaatctgaaaacgactacgtctggtctttttgtgcgccccgtgtggtaaaatattgagaaaattggagtccccaaaagctggcggatgcaacaggtcctgtggggggacctgggtgggagcgagccctcgctgcataaaagtcttcctcgttctttgaatgccaggcctcgccattcgtcgccttcgggcgctcccaaggcggaacacgccgaagacgcgcaaactgttaaggggcgctcagctgccaaaggtggtgggagtatttatgactgtcagagtacttacgtttccacgaagaaacaggggttcctcactttgtccgccttgaccccacccgtgacaggctgaatgattcggaagcgccacgcggctgtcggcccagccgccgcccttttgcggacttcctcaggagccataccggctacacctttctctttcttcgttccttcgtgtgaaagtcgtccttcatgcacgtggaccgcgagggggatgccctcccgacctcttcatgtcaggcaagccaaagactcagcttccgtcgacagagccttggtggccgcggccctggcaagtgtagcggctgcctcctttatcgcgcagccatggacaaaaagtgacatg

SEQ ID NO: 4588 - DNA, 700 bp, Nannochloropsis_gaditana
atttgggggagatagtgagacatgaaaagatgaaatatcggaatagatagacgtcttcgaaaaaacacgtcagaggagcgaagttccgatttttctggttgctaagacaaaaagggccctggacgcggggcgtatgagtgtgggtggaggcgatcgcggcaccgagatagaacacgcaggactgtatcccgttcatagatgtccatcggatcggcgcgtccgggaggggggaagaaaccgtgcggtgaatcgtgtcgagaagaagctagaacggcacctttccagctttcgggaggaccgtgcccctcttggcgtggatttgtgactttaggactttgcccgggacgtgggagagatgagagtacacggagcttcttcaagctatacctctgagaagcaatcagccctgtaacgtaaggcacgttcagccgtctcacttccccatctccgtaataatgcatctgacaggagacatttctttcgggagacttgagcctgagatcttttccatcaggctttcggctttgagacgccatcgtccgcgttgaaggagggagcatacagcctgagggaggcgccgtctgttctgccctaactgaggagagctctgtgcaacgcgaaggctataaaagacactttgcggcaaccaaaaatcaagcttcataaagagaagggggatcggtaccttttataaaacatg

SEQ ID NO: 4589 - DNA, 700 bp, Nannochloropsis_gaditana
caggcctcggatcttcttctccccgtagtgctgctggctccccgggagctccccgttgatgaaacgcgagacctgggcctgctcgaagccccactgctccatgatggactgctgctgccccccccccgccaggagcatgcgcaccgagtggttgatctgcaggatctccaccagctgcgtggtcaagtcgtcctcgttggagccgccccccacctccatggccactgaaggccggatgggcacgggaggcaccagaaggttgtggagcagcaggtcctcgggccggccgtgcttggggtccagccaaaggacgaccgcgtcctcgtccgtgatcttctggaagagctggtacacacggagggggctcatgtcctcctgggccttgtccaggtggttcgcgatctcccggttgtgggcgagggccgtcttcatggcccgagccagcgcctggtgctccacccctccgttccgcccactgtacctctcgtgcacgagcttgagggtggcggcgcccgcgatcttcttgatcttcccgttcactgccttgcactcgaagcagtacgaggccttcttgcacttttctaccacccttttaaagatgccggctttgcggagggcatccgcgctgggccaccgcatttgtcgcaagaaagagcggcgctccgcctcgggtaggaggacgcgcccgcaggtcttgcat

SEQ ID NO: 4590 - DNA, 700 bp, Nannochloropsis_gaditana
gagaacgacgtcctcatccaccatgtgccgctccaccacgtcccccagcttcagatcctccgccatcttccgccgctgccgctcgtccgcgtagctgaggctcttggtgaaggcattgtcgcccgaaggccggatgatgttggcgccggggtggtgggaagggccgttcaggacaaggcgcttcagacgctcccggttcgaggccgagacgcgctcggggtaggtcatgatcttggccacctgcaggggcactcccacctggtcaatggccaggttagggtccggggagatgacggtgcggccggagaagtcgacgcgtttccccgagaggttgccccgaaagcgcccgctcttccccttgaggcgctggcacaggcctcggatcttcttctccccgtagtgctgctggctccccgggagctccccgttgatgaaacgcgagacctgggcctgctcgaagccccactgctccatgatggactgctgctgccccccccccgccaggagcatgcgcaccgagtggttgatctgcaggatctccaccagctgcgtggtcaagtcgtcctcgttggagccgccccccacctccatggccactgaaggccggatgggcacgggaggcaccagaaggttgtggagcagcaggtcctcgggccggccgtgcttggggtccagccaaaggacgaccgcgtcctcgtcc

SEQ ID NO: 4591 - DNA, 700 bp, Nannochloropsis_gaditana
ctgacctcgcagggatggtaccaatggggctcatgctgcacaggtcgctgtcctcagtctgcggatggaattagaaacaaattattgacctcgtcctacacggaaaaattccattgacaccgttctgcccaaaaaacgcgacggaaaatcgcctccgggactttgtaggcctccatggccgggcggggagacggcgagtggctgcattttatggggcggcaagcagcgagggccgttggaggagggaggaggttaaaagttagcctttgagacccggaaagtgatccaggatggtgattgagcaattataaaacttgatttggattgattaaaaccaatttgacaatgcggtggtaataagtctggtggtaatgcaggtaattattagatcttggcctagcaaacgtatggcgtcacaagttgatcttccaagggccatgtgttcttcgtttatctccctctggttcaggttcacgctcttccttcagcgtacgagtggcatgtgtttctttttttgccggttaaacatgtttcaaaaaccgtcgacaacagtaatcacgcatactctagagcaagtgagcaattgttgcgtgataattcctactgaatctgcagtcctcactgccggatcgtgacatgtcccttccttctcaatgaaaagcacccagcgacctcgagtcaaacaagcaccaccaccatg

SEQ ID NO: 4592 - DNA, 700 bp, Nannochloropsis_gaditana
aggcagtgcgaggcgggggggtgcctgaaggggtacgggcacgattttggtactaccttctgtacagtccctcgatcccatggcggccgtcttttcctcttcgaagcggaagagattctaatggcaaatcgaagtcggcacccgatgcatgggccggaagcagcccggtccacacgcttgacctgaaagacgaggcgaccacgggggcgcatggagggcggactctttcaggaccccgccttccggttccaggcctttaccagtcattggttgcgcgcgctctggagcagatccgccaatatcaggaggcagggaggatggcagggtccggctcccctgaaggcgtcttggaagaagccggcggcgggtctgccaacgaacggggagacgaacaggaacctcagcaggcctcttcgggcctctcgcgggaagggaatggagacgaaggggggaaaatggcagggatggggcggtgcggaggaggaggaggagcacgaggacttgaaccccgcgagccgcatcaccctcccccccgcatgcccctggcgcgagccgatacctacggccagtatcgctccaactggataaacgagatcgctgtggatgtggagaggacctatgtggtcgaaccagacggagacgcgcgcgaaagcctgtgttttcagtccccgacgccctcggaggggtcatgcacccccga

SEQ ID NO: 4593 - DNA, 700 bp, Nannochloropsis_gaditana
gtagcaacaccatccatggcaatgcaaggtaccacgtttgcccaatcgaacatgtcctcgtacccttagcaagatgggcagaggaaaaaaggacgtgaagcatcccccaactattctttctcatgacgggacggctgaaatttgaggtcgcgcacgactaactagccccaatgcatcaaaccatgcggtggctgcaacacacttacaggaaacctccacgtcttccggcataatattccttaaagtaccacaggagtgttcctacgaacgctacgaaagagcgctgcccgcacgctcgccaaaggttcaaaaagcgggttaaatgcctcatctttcaggcctggggcccgttaagcaggcattaatggaatgtgaagcgcgatcattcgctgcttgtaaggagggaccgggtctcggggtgctcggacagagagggggcgaaaagccattttttccggggaggtcgaatgccagcagcgtttttgacttgcatttgtcttgtacattcagtacgaatgtctcagcggtgccaatgcatgctgatgtggagagtccaaagtgcaacgggtctcactgcgcgagccgctccctgttcttcgaacggggttggacttttccccttttaccgacaggcattcactttctaagcactcatttttcttgtcttttcttcagcacacatcctatatttctgaccatg

SEQ ID NO: 4594 - DNA, 700 bp, Nannochloropsis_gaditana
attcttgatgatgaccaatgacgagtaccacttattcaggctctctttcaaggtctgtagtgctctcaaccccccctcctcatctggagcctcgtcccatgatacgttacgaacgtagttctggtataccaaaagaaataaaagaaataggaggagcagtctgcggagacaagtggagcacataggcatattcgcatgaaagtggctgtataattgtaaggatcgatgttaggtaggcaggaggttgtcggcctgaagatgataccaaggccaggctagccaatgcaacaaaaaataaaatactctggcaatgactgaactaccacataatcatagatataagtgcctggccgaaaatcataatgagtggacgtagacagtgcagaagttgcacaacaaggggaagacgaatgttcgctccccgagtatttcgagcgagccggcgatctcctatgctctgtttcttgcggacataaaggtaacaaaagttaaacttcagtcattgaatacaatcaataaattggctgcctttcgaatgcacagttacacgcaggtgcaagtgcatgttgcattctgtaccaggcatacttgcctccagggcctcctgccgcttttcaatcagacgtactttccaactgaacgcaacgcagcggttcccaactcagcctttgctccaacacaaaagaggtgcgacagcatg

SEQ ID NO: 4595 - DNA, 700 bp, Nannochloropsis_gaditana
ggatgacgctcggcatctctgctttcggaagaatgagaaggtgaagaacaggcgccagccgcgcccccccccccccctcccaatctctttccactctcctttccctccgtatagctccacccctctcacatccctatgcctgctccctcaaatgctgtagcgcctttgccattaagcgtcgttgacctttccgactgtgtcttccttcctttctatccttctctttctgttgttctgaacggcttgtctgttcaaattggagagtaccgtcctcgccccacttgaacatgatttaacgcacgtccattcatcttcgcccaccctccggccctggctttccctcccttttcttgtccttcaaggtgaaagcggtgaccctctccgggtcggtcatcgccaaggacgggaccatgacgggcgggaaggtggaggaggcaggcgggggaaggaagggaggggggggcacgaccgggaggtaaggagggccagcgagacaaagggggcagagaaggggaacaaaagagggtgctccatggggtagagccatcctcgccgatgttagcgatctcagccccatgatttctcggcgtcgtttgtgtgtctggttcctcatctggcccagtctccttcatgcccgaagccttactccacccttcttctttctttcctctacgcacccagatgggacgcgcaagacatg

SEQ ID NO: 4596 - DNA, 700 bp, Nannochloropsis_gaditana
agagccggtatgtcgatagactgaaatggaatcgggacatgcagggaggaatggtcgcccattgtggagggacctctcacgtggccgctcccctccccccgtccccccttcccctcctcctcctcaccctctcttggctccccgcctattcccccagacaactgcgatccagccagatgaaggagctcatcttccgcgcggacgacttgcagggcagtgccagtcgtcgggcctttgtggagttgatctaccagatggacgaggtgggtaccatggagggagggaggagggagggaggaagggtgggagagaggaaggtatgagggggtcgagggtgggccgctgcgcgtaagtcagcctgactggctgattgagaagcatgggacctatgcaatttgaggtcttcatcctgccttcattctcctctccttccctccttccaccatccccgcctacgtctccctcctaccttcccctttactcgtaggatgagaccgtgcctggctatgaaacaggcgcttctctctcctttaagcggacaatctcccccaccggagtgggctcctaccgaattaacgagaaggaggtcacgggcgaggttcgtgtacctcccctcccccttccctccccccctccctcccccccctccctccattcctcccacccacgccctcgtccccccttgtcctccttcaaggcc

SEQ ID NO: 4597 - DNA, 700 bp, Nannochloropsis_gaditana
gggcctcgccgagaagaggaagcggcaggggcgaggcgggaagtggtgaaggtcgtgtttggacgcaaataaacatgaaatcacgctccctcgtccactactcaatggtgttgtcatagctctttaagtttaaagctcagagaactgggaagcacgtgactgagtcgcgcgtcgagcggttgtggtgctgaacgccgcggatgtgaaggaacagagaagcagttcctgagcgacaagcggcgaatgcctacaccccaacgttcccttgcccctttttagttgccaagcctgtcgcgaggctataatgagtcaaaaacttgaggagtcttcagatatttgcgtgaaacgctagtcttgaccccttgtccggacgaaagagagagcgacactcacttgcttgccttaccttcatcttgttgcgcgccatcctcgaactttacgtgctttgttgtgatttaattgaaaaagcgcatgtatacaagcgggaagaagtgacaacgacaagatatttcggactgtgcattctttttctccgaaagcgctaagaaaggcttcaatttccgttttcttgtgcctacctcttacctccctgcttccctcccatgttactccttttccctctcgagcacaggcgtgaatcgtcgcccctttcctcttccatcccacttttcttcacagaagagagagcatttcgaggatg

SEQ ID NO: 4598 - DNA, 700 bp, Nannochloropsis_gaditana
gcacaggacaatagcggggccacgttgataacatttgcctcccaagcagacagaggaatgaagcgacgctagtaaagttcgatctcacgatttttttgcccatacatagcaagcacggacgagcacgacaaggaaaagggttgagcgctgcgcgaagaaagatggccgccaaggttatgtgaccttcactacctagtcatgcacgtgatctcgcgctcgcaatcctctcgacagcgcatccagcactttgctggcttttctttgtccctttttgcagtcaaaacgtcgacagcatcgctcgcctgattcctgttagcgaggtatcagacctctaccatgtcctcctgctccctcccacacaaaatacacgacccgcccagaccacaaaaaaggcgtcccatcccaccaccatgtcagatcggtataattttcctctggacacttctggtcagatgattctttggggatgtgatactcgtttcgttgtcgcttgcgcaaggcagcagctacctggctgagtctagtctcatttgacgttcctcctgtttgcaggtttgctcagcatggacgcaagaagaaggagaaagaggaatgagagctgcccgctgcaggaaatattcctctttctttttgtgctagggctcgccgttattaaggacgtgggtgggtttatggtttcgaccctgtgcaagcggccatg

SEQ ID NO: 4599 - DNA, 700 bp, Nannochloropsis_gaditana
cccggaaaaagagccttggagagctgggtccgggggaaaccaatggagaagaagggatggagggcgaggagaaagcgggcggggaggaagtattaccgaaaaagccggtgtgtatggcctgccggggctccagtgcgaaggaggactcgagtcctttgggatacgctgccttcgtccagcgctcgaacgtactgagcaggtctttaccccttggggagttggacgcctgtccgacttcctcctccccgcagaagcccgggcgacggggaaggcgaggggcggacgggaaatgcggacaggaggaggaggagggggaggaggagggaacaatcgagggagggcgaagtgcggcgagaagtgggaaacagggtggctttcaggaacggcgagaaggcttgattgtgcagctgtgtggtcacgcgttgcactatgggtgctttgacgcctactttgcctcggtggtggagtcgagcgaggcgatgggcaacttgatctacaacgtgcaggcgggcgagtatccctgtccatactgtaaggccgtttccacttgcttggtgccgcacattccagtggtggaggacgcaggccttttcggaggggtcgtgattggcgcaggggcgggtgtaattgatcggcagggggcaagaaagggcaaggatgggaataggggaaccgtcgtgtggcgattcgaggatcactt

SEQ ID NO: 4600 - DNA, 700 bp, Nannochloropsis_gaditana
gatgtatgccttcaatgtgcagatctctctctgccacgtcttggactgcttattgagctgggtcaggacggcgcccttaggggtggctaccgcggcccagactgagagtcatggcataaaagatacagatatggacgtgccagtccgattagctaagcaagaggaatggcaggagcgaggggacaaaggggtcggaacgagcgacttcggatcgcaggcatccgtggtggtggcgggcattcaaatcttgggggcaatcaagagctggcaagagactttttgaaagcctttttgtcccagggggttggatcgctcgagaggtctgggaggaggctgcggaggaagaggaagaagggattgaggaggaggatgaggaagagaaggagggggaggagggggcggctaggggaagggggttggaggaggaggaacacagcatgctatcaccaccagaggacatttctgacgccggcggcagacaagcggcaagcgccgaatccagtgagcgtgggttctcagccgcctcgtccagcctggagcctccgacaccactgcttcccgggcccgcggcagaggctaccgtttcctacccctgtcatcccaagggtaccttacacctccttcgtcttcccctccgtcgctccttccacctgattctgcatcgggccttcgccttcctcgtccgggaggcggtgaaaaa

SEQ ID NO: 4601 - DNA, 700 bp, Nannochloropsis_gaditana
gggaatactatttgaccttgcacaacgacgacatgcacagcaaacgggaagtggtggaggtgctgcagcaatgcctgggtctgaacctgcagacggcgcgggtcctgaccgacgtggtgcaggagcagggggaagcccggctgcacttcgggagcctggaagaggtgcggcccaaggcgcgacggctgcaggcccggtcgttgtccgtgtctctggtcacgcgccggctgcacaagatcgagaaggtggccgtgctcctggtgcaatggctgtacacgctggcggggatctcggggggacctgccgcctggtcgttgagcagctccagccctccactttgaaccgtctgatggtggcgcacgggcacctacccaagcccttggccacggccctccacgccctctacctcttcctgatggcggaccagtcgttcaagaaagcagtggcgcagagctacgcggacacctaccttaccgtcacctcctactacgccgcgggcatcggagtggccgagtcggccctgtacaccctcagcgtccaattcttgaaccggtccgcctttgtaaacgacttggttggccaccgtcactttctggaggtactggtgcaggccctagcagacatgatccagcgggcctccggcccctcttccagtgccacttcccccccttcctccccgaccgccgtgaccgcgctccct

SEQ ID NO: 4602 - DNA, 700 bp, Nannochloropsis_gaditana
tgcctttcctccgggctcgtccagcctgggcgcgatggtgaccccttcccctcacacgaacagggccaaggacagaccttcagaggcggtcagggaggtagtgcgggcgttgcgacaggaggaatccgtccctgtcgcggacttgttggcacgcttgcgagcagccaagggggaattggcgtcttttatttttagttttcccgtccctacccggacgggcatctcactgaaagcgccggtccgattgcgcgccatgcaatggctcctggttgtggactatgccacggagctccaacaagcaggtgcacagccgcacgagccggagatggggggcgagcaggaaggggaggagagggaggagggtctggtccctgccgatccaggggtcttggtcgagcgcgtgggggcaatggctccgcatcggatatgtcagttcgcattcaaacggaacgacatcgtttggatctgcaaagattgtcaaaaagacgagacctgcgtgctctgcaacgactgcttccggctcagccagcaccaggggcacgaggtgtatttctatcagacgcaagctgggggttgctgcgactgcggcgacgacgacgcgtgggacaaggcgggtttctgcccccgacacgggcaagacgggaacgacccgttgagccacctgcctccctccttcattgccgggagtcggtggacgatg

SEQ ID NO: 4603 - DNA, 700 bp, Nannochloropsis_gaditana
ttcccacaaaggacatagaaagattaaaaaagggaaaaaaaaaatagatgagcaatgctgagatttgtcatgcccgaagggttatattcgctgtaatataatcctatgatagaaacgaacggggccaccttaattcgtggtagtcggagaaaagtattaatccataaacccggcggccatcttgtcccacagtattgctgcttaacattctgcctagcttctaagatgtgtggaaagactgcgaagacttaccacgaaagcaacataagtttccgaaagtgtcgaaccctgtatatttctcgggatatgatatcgtcaagactattccgtaccacacgacgttttgtattcgctatttcggtttacgtgagctgttgcatatgaagagcgagtctatgatctgtgatttattggtcatgtttcgtccgtttccacgtcgaattgggggcttttggaagccgcgagaatgatcaggctggggtcgagcacaggtgtgtccaagcccgctgagcgatgcctcgagtggaggtcaggtccttcccaacgaaagcctgtcctccagtactttacacgccacgcgtccttgccaactggtcatttcacgatcgattcactttaactcttttatggaacatcgtctaggctcgtgtatcgattgtcaaagtttgctgccgctcctcccttgtctcctgaacccatg

SEQ ID NO: 4604 - DNA, 700 bp, Nannochloropsis_gaditana
tggagaggagctagtttgtcgattacgtaagtcgctatacggacttaaacaatctggacgaaactggcataagaagattgatggatggttccgaggatatggtttccatccttcttctgctgatccatgcttatacgtgaagtttggatctagtggtgaaatattggttatcgtcttatatgtggacgatttaattatcactagtaactccagggaaatggtaggtaaattcaagcacgctatttcgagggaatttagcatgaaagacttgaaggagcttgattggatacttggtatggcaatcaaacgtgatcgaggaaagagagttatggaaatctctcaaacagcctatatcgatatgatgctggcgaaatttagaatggctgactgcaaaccggtcctaacgcccatggaagggactctgacaaaaatggatggcaaggacgtcaaaccagataatgaatacatgaagctagtgggtagcttattgtatgcagcactggtcacgcgtccagacatcgcatttgcggtgcagtcgttggggaaacacttgcaaggatctaatgaggagcattggatcgctgcaaagcgtgtattgagatacctgaagggtactcgtgaggttggactcaaatacacaggtaattctacgggatcgtttaccctggtgggatacgcggacgcggattacgctggcgat

SEQ ID NO: 4605 - DNA, 700 bp, Nannochloropsis_gaditana
aagacaaaggctcacgaacatcatcgattggatgatggaccagtaactatgggaagcgatttggccttcgctgcagcctcagaaatcgtcaacgaggactatcatcttacggaagatgagaatgaggtgcgagctgaaaggaagaaagccaaggatgcgaagtaccaggcgcatatgaaaaacggtacatgggaattaacccctttaccgaagggagaacgatgcatctcaagtggctgggtggaaactgataagcgagatcagaatggtgttattgtgaggagaaaggcaagatttattgccaaaggttatagtcaagaatttggctatgactacctccacacttatgcacctgttgcatcgataaccacgattcgtttggtattagccctagcatgcatattggatcttgagctggataacatggatgttgaaccagcttaccttcaatcagaccttgaggaaaaggtatatgtcaaacaaccacctggatatgagcaatatggatcaaatggagaggagctagtttgtcgattacgtaagtcgctatacggacttaaacaatctggacgaaactggcataagaagattgatggatggttccgaggatatggtttccatccttcttctgctgatccatgcttatacgtgaagtttggatctagtggtgaaatattggttatcgtcttatatgtggacg

SEQ ID NO: 4606 - DNA, 700 bp, Nannochloropsis_gaditana
tgcctcggcgggcctcgggtctcggatgggcccatggcccggcggcttcgcagatattggagaggggagtggcgccagagaggagaggcttgcaagggctgccacagaggtcgtggcggaagtaagcccaaggggagggcgggaaagtaggcaggaggaggagtgtgaaagcccctcatgtcgcagggaggaacgcgaatagccgcgagcaagtcgagcctgttgatgccaggaccttcgcgtcccgagccgagtccatgacctgcccgcccttgtccatcgtgggcgtcggccgagaaggagcaacgggaggagggaccgacccagggcggggggagggcgggagggaggaaggggggaaggaggcagggcacacgagctcttgtcgttggagggaagggacgttctgaccgacgaattgttcgaggagatgcaacggcataaattcaaccatccccgcctcaatatacgcgcgtgtttggactgcctcgttccgttgtttaaggtgccttcaaccgcgggtgccttggcggattttcgcgcctttcttgaagggcaagggttgctttgatttctggggacgaggaaaaatcgtatgatgagaagcaagacaaaggctcacgaacatcatcgattggatgatggaccagtaactatgggaagcgatttggccttcgctgcagcctcagaaatcgtcaac

SEQ ID NO: 4607 - DNA, 700 bp, Nannochloropsis_gaditana
tgacattgcaaaagcaatgacaatatatcgtttccttcttaactcgcgagtcttccatgtcaaacgtaagaaagagtactgaaccttttcttgccaggaaatgttttctcagaagaagacctgccaatttgctttacgcctatggaccaggaaaaaaagcaatattgtgccgtgcccaagcaggcatttttcatttactgccagaggtcaaacctcccccccccccccaatattgatttccatcacatcccatgcatgactgccacaaagtgacgccaacgatgacgaccctaaccgtaccaggtatggtttagcatgcatttgtacgaagcgatcgagctgccccatcaatagattggagcatgtgacccgtgggtaatacatagtctggcacagacggggagcatgaagcacgtgggacagagggaaagcaccagtaccaataatactacttgcggcggcgattgactccctgcctcttggtcggtatatgcgtgcataaacacgaaataattacgaaatgtttccaaactttatcacttttcacagagcaaccactttgttaatccctcggtctcgtaccatgcctctgctccgctttggggggctattcacgcttactttattgtgtgttttatcgatgggcgagagctgcacgtgcttcattgtcacaccgggagcttctcaagttggggcgatg

SEQ ID NO: 4608 - DNA, 700 bp, Nannochloropsis_gaditana
ttccttcttgtcttccatcacaagtaccaaaacgtcccctcccacttcgtcctcatcttcctcatcctcgtcctcctcatcgtagcatttgttgactccgtagccgagggctgaatctgagtttgaacttagatcttgcaaaagatagaaggcgtaagaaatgcaagtggcagaacgcaaagcgctgtccaacctcccctctgtaacgatttgatgcgcggcgagatggtgtctgcagaccaaactgcataattgacggcgcaaatatgtattcgagcatgtaaaacaagaagttgtcagtaaagtgcgtagtcatataatcgcagcctacgggaaagaagagaaaagcacctcgggttgtcgcagccctcgccttgccctccttgtggaccgagcgcccgagtcgcagccagcggagctcaggggtacgtgttttccgcgtgcacacacgattccgattctaccgagccgccatctcaggcctggccgccagccatgcttaaattaaaccgagcaccttgaagctcgcgacattcctatctcctcgccttctgtcggagacaaatcgaaataatgctctagacatgaggaaaggacttgccgagaagccaatccagtttggacatgagcacctcatagtttcgaagccagttgatgatccgacttgactttcacaaatacattaacagtccatgaaatg

SEQ ID NO: 4609 - DNA, 700 bp, Nannochloropsis_gaditana
acgacagcgacgccgacgtcgactgcgtggtacgcttgagaaatcgaggggacggagtgaggaagtcggcgtagaagcgagagcgtgtagcggaacaggtctcaatctcgaggaccaagcatatatcttttccccggctcgggaaggttggctgataaagcgaggctcgggcgggttgcggatgtggcgtcgacgctgggtggggctggccaataggaagctctggtatgccaatggacctgctggtcccgggggtgggggcgggaactgtgtcgcagggagtcctgagaagggatcgattgggtgcatggaactcacgcagtggagccaagtggaagaggttgctagcgccgacggcctggtctttcgcgttgtttttggcagcccagaagacacagaagccgataataggacgggaggtcaggcggagacgcacagtgtcagccctgaagccgagagcaggcctttcgccgccgccggccgcccgccttctttcctggacccggtggaggagctcgccagcaaccgccgtgaagacagtagtactactgagtggccggggcaacccagccatccaggcttattggaggccctggctctagattctgaaggcagcggctccgtctcaagacagggacatgtgtcgcaaggagggtggtggtttcgagccgagagtttgcaagaaaagctggtgtggatg

SEQ ID NO: 4610 - DNA, 700 bp, Nannochloropsis_gaditana
tttgaagatggtgttcgtaccatcggtggaaacgataagagtagtttttaatcgcgagtccggtattctcatattttcttaattgcccccttaacgaaaaaaaggtaaaatgaggaagggatgtcgtgacgtggaagcctgttgccctgaaggacaagcattctcacttgaaaaagaaaattattcataagggagggcatctttaaaagttcgcgatgtgaagatttctcaagatgtccttggatcctcgaaccgcaaatccgtcattgccgccaagacaaaggcaggaatactgtacttaatttgtcccctcccagcaatcttggtaatttcacatgcgttgctgtaataaataactcatcacggcgaagaccatgacagaccgatcgcaatgctgtgtgcaactagacaagtcctgggccgtgggaccaatacagacataagacggcatgtctcctgcgccgcagacttgactgctcccgagcttccggtgagtagtatcggaaaagggtgctctctgcaaatacaacctgatagcttcgatcacgccggccctccaacgagacgaagagctcgccgcctttcgccacctgccccgcaccctcgcgagggcgcctgctttctattgcgaggggcgttgctgtccagttctctcttaaaaaatgtaaaagttgcagctcacggaaaattaattgaacag

SEQ ID NO: 4611 - DNA, 700 bp, Nannochloropsis_gaditana
tcgctgtcccggtggacttggcgccttcctcctttgtcccggggttgccagtgcccgtaggcttgcaactgatcggccgccatctgtgcgagcaacagttgctgatcgttgcccgagccttggaggtccgatgtaattttagtgagagaatacccgactatgtcgtaaaagccacatttacgtgatgcatgggggaaataaaagtccttctgacgatgcggtcgcgaggatggttgactcttctgtcactacacttgctttgtcacattgtaaatagcgcacgcgtgcctgcaagcagatcgtgtcaggcttcgcattcgttggtgatttttatttttctttccatgacacgaactcggtgatagcgagctccctcaggccaggctgccgacgcctgtggctctctctgatggctgccattaataccgtttcttaccgcgaagccacgctacagtagcaacaggttggcaatacccgtgctgaggaatcgtgccagatcatatttgcgtagaatcttggggcgaaatatcatgcgcacggagttttcagtgaggcttctcaatttcctcttgcttcaagtatcttcgtacacgtacctctaggctagctaccgtgtggactcttttacgagaagcttcgggatgcccgatagtgtattcatcaacttcctatttcaataattacagccaaaaagaatatg

SEQ ID NO: 4612 - DNA, 700 bp, Nannochloropsis_gaditana
catggtaggggacgctagccttttgactttgtccctgcgacatgagatatcaggcatgctagacacaacaacttgttcaggaagagaattcacggccatttggtcatgagtaattatgtgtcttcgcttgttacgaacgcaatgaaactcaacggccccattcccgcacccctccgccaccctccccatcgatcatcaatttatggtgtgcgcgacagcctcgaggcatatacttccgagtcgcaatcgtgacttcccattcccatccttgaggccttcctttccggaaatcagatcggatcaaaaccacacgctgtggtgcacatcctcacggttgcatacatgcttttggatgttggcaagtaaaccgctctcccatttgcctgccacaggggggttggggggcttagagcgcctctggagcaccccagcgtgtttcgcaaagcctcacgctcacaccaccacttcaaacaaaacagcacgctcactagtcaatgcaatgcagcgtcgactcttgccctcacgcgcgttaggtaactcacggagcagaaagaggttacgagatggccctcggcgccctgtcgacatcagaagagcgcagcatgcctgtccgagctctccctcttcacctcccggcttgcaacggagagtgactcgaacgaactatagcacgcaatcgcaacagtctgctgtatcgatg

SEQ ID NO: 4613 - DNA, 700 bp, Nannochloropsis_gaditana
tagattcaccgttaaggatcgatgcctgtgcctcaaataagggtacaacgagcttctttagtggttctccagggtgcagaaacagggaagccgcaaatcattagccagcgagcgtttcgtgctaccctttcacatataaattaattatcgtttcactggtctcttatttttaaaatccattgccagagaacagtccggaaattttgttttagtagtgcacgggagaagccctgtcctatttagcacagtgcccccccaaaaaaactcttagaaatcctttgcagccgaagctgcggtcagatgactagtttatgaattgttttggcattactgttctctgttagcaggtcgcaaagcaaagcgaaggatagattcacaccttttcacctctctttcttcaccttgcaggcggaggcttgctttccgcagttgagctacagagcgttctatgcatctgcacaggtttacggtaaaccggatttcgttgcgcttaaccgtggcgtgtgcgtgctgttgtgtctttgccaatacttctggaacagctgtgagcgcagcctttgtagcggtcggtttctcttcatcggtttcattccggcttgcgccttctatcgtcccgtcgcggaatccaccggtgctcggtattcagtctggaagcgcaagggcgggtaaggaaagacgctgccactcagctacctccatg

SEQ ID NO: 4614 - DNA, 700 bp, Nannochloropsis_gaditana
aaagaggaatggtggaggccgagcgggacctccccataatggaaacaaattgggccggtatgagcgtgtacctggcaacccctacaatggcccagagaaaggcgggcgcattagtcacggacggggaactggaggccgtggaggccgaagtggacgtggtcgtggcaaaggattgcacggcggaaatggttgtcgctattgtggaagcgcagaccactggggaaatgaatgccccaagaataaaacggagcattcttacacatgcttgttggcaaccaagaaaagatatgaaagtgttgtggaaccacaagcatcttcggtaatggtggatagcggagctacatcccatatgaaaagggatactacaggattgactaatgtcaggcgacattatggtcacgtatatgtggcaaacggggagaaactagaagtacataacatcggagactggcttatggatgttaagcacagcgatgggactgttaaaggtgttatgtctaaggattgtggtgccaaatctgagtcgtgatttgttatctatggctaaaatagataaggctggtgggaaaatcgttatccgtgaaggaaagggtacgattgaaatgggtgacacgtgtttaccgatgagaaaggtagataacatgtatatgttagactactacggaaaatcacgtgaggaggctaatgtagttagctgacc

SEQ ID NO: 4615 - DNA, 700 bp, Nannochloropsis_gaditana
gcgtgggccggagctggagtcgtgtagacaacttgatgtgttgaagaagtctgttttgtcgtccgacattgcttgaaatctgccgctaccgtccgggaaagttgtctttctcctctcaaaaatagatcttggtggatttacgtgttggaacgcggctgatctgttggacaaaagaactactacgacgacagaatggacgaacaagagaagcctgtgggatggtatccgtcgacgatcacaagtcttttgataacgtcctggaggcgccatgtccagtgtcaaggaacacctgtttgaaaaacagtaaaattttgagcttcttaatattccaggacgcaagcaatgctctggtggctttcgtgtcgacgctgtgcggcccacgcaggtacgtgaagttcctcttgtcttggctggtcgatgtgatggtttaggccgcaactccctcccctttagtccccttccttatgatgtgatggtttaggccgcaactccctccactttagtccccttcctgatgacgtgatggtttaggccgcaactccctcgccgtcgctcttcgctccctgtcgcgaggatcgaacgacgatgtgttcctgtaggcaaacagccaggatcctgttatcccgtgcaacaaaaaaggcttctgataaatccaatacatgtcctccacagcagcgttggtatcagggagactagcatg

SEQ ID NO: 4616 - DNA, 700 bp, Nannochloropsis_gaditana
agcctttgcacgcccggtacgcacagagtgtcttccctcgtgccttaggaggggtcaatacagccattattgactgttcacatgagaagctacccacaacacgttgcactctcgccgattctgcttcaaaagcaacatcatcatggtagtgggccaacatcctttctctgtcgtcgcttctcacaccatacgccccatattatacggcaaatacacaaaaaaagaaatgttcaaagttttcgcctcctctaccaccgggtcgtcggccaaagcaatctcagtggcgcatcagcagtttgtgcagcggggtctttcctccctaaaatccctccgaaagcgtctcgtgcttgtaaacgtcattttgacctttcttcttcttgcattagcgttggaatctcgcagacaagggcgtcgtcatcgtctctccagaattctttggaacctgtatctcaaagtacagcgtttcatatggccctggcaggagcgtttggtacgactgcaaggactgaatgcgggctcgcgattactttgggctagcactggcaaatgcaaggctttctcctgtgtcttcttttggggaggcgcagaggatgaggatggggggttgaaggcgtcgttgagtaccggcgatggagatggaggacaatgcacgcgcaaagtggtcctaggagatcggggtcgggcccgttgttcctggatg

SEQ ID NO: 4617 - DNA, 700 bp, Nannochloropsis_gaditana
aacatacgtgcagggatagcgaaacgtgaaattgcaagaaagttcgggacgtggagagaagagttgatttgcttataaggaagctaatagggaagaatcaaaagaggaaaaagctgccttaagaattggagcctctggtcataaaaagaaacggatccatgagaaggcatccaggcctagtcgcgaaagtgttacactacgggagtcgtgagcaaaaaatggatcgaattagctcacaaacatgaacaatataaagaaggaagaatagaaaaaagggagcttacaacaagaatctggctcgcaatgtctttttcgtcactcaaagcctcctggccccttatcgcgcagctccagcaaatggtgaattttctcgaacggtgccttggtggctgccgatgacattcaaaagaaacatctaagttgatagattaaaacacatcaactcaaatttctcccatggatatgcaaaataaggtccacatccgtggtgccctccctcgtgcggacgaagatgtgtcgggaaagattacccggagcatgccatggcccctggttgagctggacatcagacctacgaggtcaaagatttatcagctttctagtgattgagtctcactcatagcccattactgagcaggtataaataaagtttcaggattgacaaatttcctgtgacttatctgccctctttggacctcag

SEQ ID NO: 4618 - DNA, 700 bp, Nannochloropsis_gaditana
gacccggcggcgccaacgacgggcccatttttgaaagtgaatccatgctagtcgcgggtcgctttgcagttcatatttggtctgtatcataaaagcacgactctttcaatctgtcaattgtggattttcgagcaggatgtgaaggccgcgctcagtcagccacaatttgtgcgtggttgttccttgcttgaggttaccggccggcctggccgttactttttggctcgagctggggagggggagagaaaggaagtcggcagagacgattcggccacgctctagacatgcctgaatcataattctggagctgtctatgtcgttgctagtttgataaggcatattcgatgtctacaatgtggcattgggcatgtaacaatcgtgtatggctcgaatctgagccccacgggagcaatattcgccttgcctccctgggccctccatccacatgctgccttggcgtctgtgatttagttacgaggagacaccacattccgagaaatttcatgtataagatgttgacaagatacacgtaatgtgcaatggatcgtatcatactcggatgcgtattcgactgacctgggagccgcgaagtttgaggattatcatcacttgtttacttatgggcctcagctgtccctccggttgcccccctccccccttcaagccaaaaaacacaacagcgtatatcatccatcaaatg

SEQ ID NO: 4619 - DNA, 700 bp, Nannochloropsis_gaditana
caactctttgcttgcccctcgtaaagccggccaatcaaccttgggcagtaagttctgcacgaattctaggggacggtgtgattttttttaggacaaatgcccatgatcaccgtgcatacatacattaaaccaacatttatctccaactttagccagggtccaaccctgtgtcttccatcgacaagtgaagccgccttggacgtacctgaattgaactctgtctccttcacttccaccttctcagcctctattctcagggggaagccattgatcaccccttttacgttactcttcagcatattatgtgtaatcagccgcatgactacagttgtgggtgcgtgttggtgatatttttttgttgaatttaaaggtattcggggaggtcgagagcagggcggaataagcgagaatatctctagacagccgacaagaagcatcaaaacaaccttcccttgagaaattggatttttcatggccagtatacaaggaagctatagaaatctgcaagcaagcatgggcgagcatatttgctacaagatggtagtgtggtggggagcaaacgtcgttgcctcacagtatgatgttttcctccatgtcaccttctgcgcttctcccaccgcggaaaaaaactagaacgcgatagacactcttcagccgcttgccgcctccactcaccctcgtgccagcccttcgattcatg

SEQ ID NO: 4620 - DNA, 700 bp, Nannochloropsis_gaditana
agccgaatttcttcatggttagttttcgtacctggccgttaaggaagggggtcttaatttgtatggaattcgcgtagcgagaggctttgtcttcttgttgaggctgcgcgcaagcagcccaagcaaagaaagggacctcttgagagtatatgaaaacggtgtttttatgaatgacagaccagctaccgtttctggcgtccaaaagcgggttgtccggacgccgtggataggttgtgccctgaccacggtcgggcccataagcgttgtctccgtcaagcatcggcgcgcgattcgtgtcgctttcccagaggcccagactgacagctgacgccctctgatttggcgaggcgatcaaggtacctaaagcgtcattctccggcggttagcaatgacggttcggtgcctaaatcatcacacatagaagcagtagagtcgaccaccatccaccactcgctccttagtgtctttcctttcttttccatagatggggactccctctgcatgtaggactttggtgagatgaagtcaggcacaaaatcgagacgtacttcttagtgtgtgatatttatgtatgggtgcatagtgaagacgttcttttgtacggtcagcgtcttaactacatcccttgtcgctgcctccctttgccccccttcatccacatttttacaggtcacactctctcccatcgttgagaaatatg

SEQ ID NO: 4621 - DNA, 700 bp, Nannochloropsis_gaditana
tctgcacgagggaacgtatttcggggagcacgggagccgatggcatcacagggtgtgtggccagcccgcaagcctcgcctacgcgcttgcgtgctaccaggcacagacacatgcggtggtgtgcggacgaccccaagaacaaagcctggctgttctggggcggtgcagttaaaaggcatggtcagatgaatagcccaagtatctgcctcaattattgaaacgccggacccgctgcgttaggcctgtgtgcatgttagatctggcgtatccaggtttcggggtctgacccggctcctgtgttctttgatccgtgctcatgccccctttctccccacccactccttatacagaacgccacaaggttgtaggcgcgctggtgaattcgttactccgtggtcttaagaaaaaatcaagacctaagtttcattatttcctcgcgtcgcacacctcctcacgcgtgaaaccgagcctgcaggagcttccgcctctgatttagagcgacagcagtaaagccatgcagcgctctgtgcaagcagcctttctagcctgtatcttaactgcttcctacatagacctagggcatgcttttgttttcccctcttcccggccacagagcaccccatgtagcatagtctccacctccccgtacaccgccagtcctgatagcagagcaagaataactatcgcaccctcctggatg

SEQ ID NO: 4622 - DNA, 700 bp, Nannochloropsis_gaditana
gcaccgaatgatggattccactttgatggctgccttttcatccttttgctgtgcaaggaggcttgcaatgtctcgctgtgtaattctgccagagttggggtataaagggaggggaatgagcgggccataagtatttgatcgaaaacttactccttacacacagttttaaagctcatctaacctagcgctatttctctcagtagcagaatatacgtacttgacagctgccgtctttttgttggtagcgatttggatgcgctggatagccatcttcaggaaaggcttgagcttgttcacgtcgaaggacttgaacgcctcgaaaaaggaacttagcattttaccgactttaccggaacagacgatccctgcaaaagaaaaatggtacccgacattaatttgtggccgaatatcgtcttacgagcgttggtgtgcgtacgatatacggcgttttgcctgagcgggaacaggggagggccagacgactgtgtctttctagttggggaaggtcgtcgccgagcgccgagcacttgaagcaacctgatagatgacactcctttcgagcacactgtggctgtgcagggagtgtgaatgttggttatgtctccattttgactcgatgggtatccttgaattcgcaggctgatgctttctgtctccgtgcccatcattttacacatttaatgcacgattgccgattaac

SEQ ID NO: 4623 - DNA, 700 bp, Nannochloropsis_gaditana
gtcttgaagaatgtattgatatttgatttagaaaagcatggaattgcctaataatgtctgatatttagaaggcaggcatcatgattgaaaatgcatgtaataatatgattgtcatgaattgtggcaaaatgagccagaaagcgaggggataagagcaagttgacttcagagctatccgacgtccgagtgaagttgtttgggaatttaatcgaacatgcatgagttcgaattcgtaatgaaactcgtgtaaataatgatgcaataaattgtcattgtccatgggaaatatttgcgccttctttgcattctataacttatgtccttgactcaaaacatctgcggtctgtcactggtcgctgtactggcccgtggtccctccttccagacatgtgatacctaaacaggtatgtcgcgcccaattaatccgtcatagaacgaagaaatacattgtacgcaagctgggccggaataagttcaagtcttaaatcggcctgggtgggcctggctgacgtacccccccaaggagtcgcttaccgctatcgctgccctcaaaaaggctttttcacatgacacgtaaaagcaggaaacttggcatgctcggaggaaaatttccacgcatgcaatagaattcatgaaacatcaccgctcgtatgcacaccatgttcatccaagccaatatcaatacgcaacagtggtgatg

SEQ ID NO: 4624 - DNA, 700 bp, Nannochloropsis_gaditana
gccccgcgcatggggcctccctggggccctcaccatgtgggtgtgggcgatcccacgtcctcctcgctttgaccacacgcccgagcttcgcgttttcccacaccgtagccgtccggacggccgctttcgggtctgtggtttgggggaggatggtcgtgttgaatgtttgagacgtggttttgtttctgatttgtgagcactctacagtgaatgatacctctttggcagtttttgagaacgggctggggttaatcgttagaccaaagagtacgcgcgccgtttaaggccaactccccggggatcacgccggtttctgcccttcgaatcaccaccctgcaaaaatctcatgcacactcacacccatgaccaatttacgtgcatacagtattgaacgcatcggttacattctcgctgccgctgatcgcggcaggctttcggaggaaggatagtagagtcatcacaattctggccgtccaggttctgtaaacacaggctttaaataagcctgatattcaagtctacgtcgcgctcgcaaatgatgtgtgctcccaacagccttgggagtaaaatggtgggcttgccggggacgataggaagcaaagggacgccaagtgtggcttcccgtactcaaactctgataggccagtgcgagaatctcgcccaaggcggacgcgcatttgtgcagcaaattcaaaagatg

SEQ ID NO: 4625 - DNA, 700 bp, Nannochloropsis_gaditana
gccggatcccgaagagaggagaagaaagtgtgtcaaatggttgagcaaaaatgatgatttaagtagggccaagtgcggaaaagcacgtgtgaggcgggtaagtccaccccacaccctgaaacgtcacaggtgtagatgatgaagtacaattgaagatggtcaaagcgacactgaggctggttattgttctgttcatttttcatttggtgataaattgcagtaaggctttacagcgcacagctgtccatataaagattcggctacagcttttccaaattcatgtttgtatcttcattccatacactaaaagggcacgctatttgttcggtgaagaaagtcattttagactaaatagagaggacagtggtcaggaggatactgcaagaacatgcagccacgacataaacttcatgagaaagcgagggcggacgtgcgaaaagcgaggagttctgccttccactctgtccactaacacctagaacgaaggataccagtcaaacactggaacatcgaccttgtttatttccatgcggggcatgaagccacttgagacacttaagttatgtgctgtaagggactgtctttgtctaaacgagatacctgcaggggctcaaggcgtacgtcactcatcccccttcgcgattctggctttcttttaatagcattcatagtcctcaccgtaattgtttcgaacctcaaa

SEQ ID NO: 4626 - DNA, 700 bp, Nannochloropsis_gaditana
cgaacgttctcagtcaacggagaggagtgacgtctcattactcaagggctggtgtccggtggcgtgcctgttcaacacatttgaatgtaaccctcacgatgcgtagtggacattggtttatgcgatactcagcaccacataagatttacgcacaagagtggggagatagttgaatttctgtggttgttttgccgtccctggctggaacaccggacggcgtgagtgacgacatcgatcataaccatcgaccgattccccccccggccggcaccataagaggatgcgcttaacctcaccagacatcccccatatcaattgacagatcctaaaacgaccagctgctcgctctcttatcggggaatcccccctcccattgtcattacaaaggacgttttgtaggaaaagtctcgttttttgggcctccctgtgcgactcctcgaagctcgttggatatgtcctctgcctctttttctctccaacgtcccatttcctccttgcttcccttggtctgcctccttctactctccctccttctcgtcaccacaaaggccttcacttgcagccccgcccatgccctctctgaaagcgtagggccaaacgggctttgtgagtgcaaccccgggtggtacggcccgacttgcgagatatgcacgacggaccaggcatgtggcattttgttgagagactcggatggaatatg

SEQ ID NO: 4627 - DNA, 700 bp, Nannochloropsis_gaditana
aggagtacgctgaaagctttaatcctgacatgatcgaagtcttgtacgcatggacgttgggtgccaaatttagcgaggtcataaagttgacggatactttcgaaggaactatcatccgagtgattaggaggctggacgaggtcttgcggcaactcgcgtcagcatcgcatgcgatcggggaccatacattgaaggagaaatttgaggaagccagcaaggctataaggagagacatcgtcttcgcggcgtctttgtatttgtaaatgcgaacagggaataaacaaaagagatgtgcagagcacgaggtggccataatacaccaggaaatcgaaggtaaatccgctcccaacgagcgattaccaacataatcacgttctgagtcattctaggagttttaacataaccatcaagcccaatctaagtcaagaccgggcatcgcatctcacaaataacctccccactgataagcctcgccaagatcaagtccgcgattccatccccacgtgtagtataccatttagtaatacaacatcacaaagggcaacattttacaagctcttacagcccattacctatactcataaatttctttacgtcttccaaggctgtgggaaagcaccgaagagcactggaccgctggtgctggctggcagaggcgagctgactggtcccttcgggagggagttcaccccagagtatg

SEQ ID NO: 4628 - DNA, 700 bp, Nannochloropsis_gaditana
gactttttcctttcttggtcctcatatatcgttgaatatgtccctcaatgccgatgggtacaccgatggccgcaaagagagcacgtggttgcacgagcatctgtgttgcaggctgcggcaaccatcttgcccgcacctacccggagattggactcgaggtcaaaaagcacctgctaacactccacttaggttcacgtttctgcttcattgtcttgagatacagcgggaactattctcaaatcgttagatggcgcgtgggcagtttctttcttttgtgagacaggttgaaatgcaaataaaattaggtcttggccagggctcaaggggaagtactcgtatccatccacgccagacgtgcgttgcaacagcagcaccttggccagaggaagagccgtcatccttagcccttttttatcttagccaaaaattggagaggtgtaaaggcatcgatttctatgctttattagtcattgtcgtgcgaaatattgagggattgcctttttcgtgattattattggtacaaatgaccattgccaaggcgcttccaacatccttagttgcatacccgcttcaaggccccatgattcttgacccaaacttattcgcagtgcaactgaccatgaatttgcctcaaatctttcacagcacatattggagtagcattttgcgcgtgcaaatttgtggccattccccggtcatg

SEQ ID NO: 4629 - DNA, 700 bp, Nannochloropsis_gaditana
cgattcccgccatcattccctgatactctcgcaaatgtacggtgtgcgtcactgatttcagcaacggaagcaagcctgcgatgcccatgcttggtcacttgtttacgtgacgggttagggggtacatggggtggtattttgacgaggacaaagagaaggaagtgaggggaggtagggtgtaagcagggtgtgaataagtgtcagaagaacagaattcagtggcctctactcacgctatctatatttcccaaagagaacacgcaagaacgacgaaaatagcggacctggacgcgggtcgagcgcgttttggtcacgaccccgaatgtcagcgaggaggcgagggaggaagggagggaaagaggatgggggagagagaggggggggagccaagataaaatgtgggctatgccagcgtctcctcccaggggagggtctcgcgtgaccctgtttctcgtgggtttggcaagcgctactgttgtgacttggaaggtcgatcgcggtaatctgcttggtgtttacacaccggccttaggacgtcattcctctagcattcttgtctctgaagtgcacgagagcagccccgcgccctcagcgcgattatcccgcaggtcatctcatggccattggcatttcaactgctcaccaaaatgtcatcaactcacactttcacgtagtagggcacgtgggtaggagcagcatg

SEQ ID NO: 4630 - DNA, 700 bp, Nannochloropsis_gaditana
agagatggcgagatgatgaccacctaaagcaataacaaacgtgcacgaacaactcatgcggcacatctcaaacatcaaaaagtattattgtcctgattacgccttactgaccgcttagcatccggttctgaaacggacatatcaagaggcagctcgcctcctcgatcatcatcaagggaactacgcaccagccgaacaaggctccgtggtaccttggctgattatgtgggaacttctgcgtgagttgtgtacgaatgggtcaccagttctatggtactatctttggcgcactgaggggctgagttgcgtttcgggcgcaatttaagaggggtttacgtcgcttcgacgtccaaaggcaagcaagcaccccggtttgtactacacttgtagcagcccacctggacatctcttctagcggctggtgggacggatcggtagtggtgggaccgtgttaagcacgaatgtttagtatacccagtaaacaagcatactcctcagccatatgcttagttgtacgtcattcgggcgcctctggtcgcatggtttgattttgctggtccctggtatcaatcagacctggggcggccaaatatccattctgtcccacacagtcaagctttaccaataccttcccaaaatctttccacaacataaaaggcccggtagatacagaaggagcacacgaaggaggcacactatg

SEQ ID NO: 4631 - DNA, 700 bp, Nannochloropsis_gaditana
cacgcgtgggcctgggtcgatcggggggaatggcttcgggtcgcgctctttgttgcactctcgctgcataggaaaaaattgacttggaatcagagggagattaccagtttcccatgcaagaaggtggcttgaaagacggcgaagactggtttttgggcctgagcactcctcgactgcagcacgatactgtcggagccgacttgagggcgcacggatcgccaaggtcggtctggcgagactttccctcaagtcctgcatttgacgcccccccatccgcgctcactagacacgatattcccattcacatcgtaggtaaaaagtggcttttgttctaggcatcgatctagggggaaccgcggttaaagctggccttatacctttcgcaattctggcagcccccttgccatcagccacagcctcgacgggcccttgccatcctccctgcccaagctcccctccgccttttttttgtcgaattcctttgcctgaagcacgtgacgggcgaacgccagaaaacatcgtccccttgctcttcgaagcatccagcaagttattgacacaagccggcgtagattgggggaaagtgaaggttgttggtttgggctatcctggacatgtaaaagacgctgggactactgcgggaggcgccgccaacctcagtgatgaatggaagacaggcattcccttgatcaggttgatg

SEQ ID NO: 4632 - DNA, 700 bp, Nannochloropsis_gaditana
ggctgtgagtgtcaggctcgcggccctcctccttctccttgaaggggagggttgctgttgcggcttcgttgaggaaagaggagaaaacaaaacttctcgcctcagctggattggggcccagcaacaagtcatcctcaaacacactctggcttccttcctccgtgccctgtgcgtggtggacgtatgacagccataagcatgaaaagtcacggtgatggtggggcaatccccccgacagcgtcagagcgagcagtgccacaagtaccgccttggtggccatcaagcgtcacattttggtcgataccccggcttatggataacagccggcgcacagtccaaaatctgccaccccgacctgcccgtgactgcgacgccggcgggcctttattgcccagtgatccgagggtcggctgcctggagcgatcatgacacacttcctcgttgggagtctcgagtggggagaggcgaacccgcgacgcatgttccgggaaaacgcgcagcatttccaacccgcctctaatcatcctttctcaatattttcattccgtattggttcaagtgctttttcctataggtcaggtgtcaagtggaagcaaacattgcccggtaccgctccaaagtatagtgagcggggaattcaaacagcgcgagcagggagtcttcacgccacttgaagtgtttccttctcgtcacaaccatg

SEQ ID NO: 4633 - DNA, 700 bp, Nannochloropsis_gaditana
cacttgaaaaagtgaaagttaacaaaaaatcgtctcccagccctaaaatccttgggggcatattttcgatcgatggcattgaactccacaacattatctttatgtctgcacgacacgaggatgtgtgtctgtggtccgatttgaccaacatttttggcgggggctgtaaagaaagtgtcgccttcgcccttcttcgcccgcggtcgctttgcttgcctgaaatttggcaccatcaagagtccatcgggtgcatcggcaatcggtctgctattggcgtggagaaattggagcgtttggcctgactcagtgctaccaagggaggtgttactttaaatgtgcctcaaacagagtccacttccgaaggtggcattcgaatgagaggcctcgggcccatggcgcgttagcacacttacctgcttctcctttaaggccatacagggaacattccatgtttattttacgcatgatcatcacgacaatgtcatcgcttcttcttcctgacagtaccgtgatttctttgtcctcgggtcacctatttctattaatcatactacccaagcgtggtgttctctgacaaatgcgcagcactgatgtgcgaaaaaggaattgtgtggcactcacaccaatctctttatcacctttcgtcacagtagataaactcgtcccgactgactttttcgggttcgcgacatcaagcatg

SEQ ID NO: 4634 - DNA, 700 bp, Nannochloropsis_gaditana
aattcctcgaaaagaataacgcattccggtacagaagtcgatgaaaaacgaagcacttctgatgaaaacccgatggaaagcgtatcctacaccgccgccttcgcttccatcgtccgtagaaccttttaagttcctgtccggtttcaagtgtttattggtgtgtgttttgtggattaaagatcatgtaggctgtaataaaggaaagggaagtggctggcggggtatgtgacatcctcggcatccgcgctaccacgaggaaacagcaagacacttgcgtggtcatcgccccaaaaccatcgcatcgtacgagagatgcatgcaaaatcgtaatgtgacacgagggaatgaccctgggaacctttatcggtgggcctttgtgttacccttgacgttcctccttttctcgccgtcacgtgcgagagccgcttgccgaggaggtgaaggtaaagacaagaggtcaaaaaccatgccacacatggagcaatacacgtcctgcctgtccattttccaagatccacaccctaaggacatgttgtcttctgacaccgtacggccatgccccaagcgggagttttgacggaagaagcgtgtgagccccaaaggcccgtcatcgcattctccggcgctttctaactccacgaggctttaataccccactcatccattttccctctttcctgcgtcttcgtcggcagtcatg

SEQ ID NO: 4635 - DNA, 700 bp, Nannochloropsis_gaditana
tttgctccatggcaaagtggcctggggcctgcgcatccacctcgcgtgcgaccaggacggcgatcccgtggacttcggcaatcgttacacttccattattatgggtcttccccgtattctcagagaactcgatctgcaggaggggtgcatgggaaatgagccagatcgttcacacattacgtagcgcaagtggatacgtttgaaaagctctgctcacatgtcgctgtcattcatccatgcgtggacatattcaatcatccggacttccaccgcagttgctgttttgttgggcgaagtgacggatgtcgagatattcgacaacaaaatatgtgttttagtaattttccgaaaattaaaacgactcttcatagaatatttgctgaattgatcaatgcttgtatctatttcatcccacagaatggtcggctcggtggagcttggggccaccaaatccagagcagccagtactggttccaccaacggagctcagcgggaaggccacgggttcaaatcattactggaggcttgcaataggatacaagagaaacaatctaacaaaataagtagcactacaaattgtccatctacatcatcttgtgggctgccggccgatggcaaagtcgagacaacatccgcttccaagaacccagatggtcccaagggagaattttaccacccgcttgagaaattctcacggatg

SEQ ID NO: 4636 - DNA, 700 bp, Nannochloropsis_gaditana
tgtgggattagaaaagggtcggtttgaataagcgagcaatggtataaatggtcaaaggatatgaaaggatgtttcaggtatgagaccagagagagacaaacaagttgtggtccgccccgcgcctcccagtagacaatactttatacaatgtgtagagcgcatgcgcgcgtaaaggtttcgtgaaagcagtaatgagaaggcatgccattctggaccaggacgagtcaggcgctttcacttacacgtgaagatgcttggagcagcacggctgatccaccaccaaggcccttcccgagcccagagaagctaccacaccggccacatagagtgtagctagcgttcggcgcattttgcgcggtatttgatattgtctttccaggcccaggaaggggcacaggtctggctcccgattgtgcccggatgtcgactgccgaggccgccgaacgcttcaatccaatggtaaggccagggcaccaccaaatagtcttccaaagtatcggctatgtgcgcatgtgtgtgacacgaacacgcgtaagttgcatttttcctcgggctccagaatcctccagactcctcgctcgttcagagacgtgcgcctggcgtgggcaacggttcgacctcccctgggaaggcccgcgcttcccgaggtgttaactttacaaacgagcacgatcacaatgctcacctccgaacctttaac

SEQ ID NO: 4637 - DNA, 700 bp, Nannochloropsis_gaditana
actggctgcgccaatctttctcagctgtgctgcgagaggctcctgcgggaccgcccaaaagagtgctcgtggacctggtgaaatgcttcgcaggcttgggacggaacgaaatgaccttggaggaagtgcgtgagagcgtggagaggaaccaggcaagcgcttccatattcccagatctagcaatgtaaacttacggcgtaaggtgtggctcgaataccgtgtatccacaaatgtaccatacgcagacaaagctggccagtcattaagggtaaaaacaaaagaacaatgctattaacgacctaagcttgttcacagtatgctttagcgcgtccacgtaagtcacacaagaattctctcagccatcgatcaatgtgtggcagcatctgctcctttctcgtcggttccgcgtcgctgtaggtggacggcgacctcgatatgccgcgtgcccgggaagtggtcaaggacacacatgtccaccactttgtgcgtgtgaacaagcccaaagcctgcgagcgacaggaacttcctgtctgcactctgtcgccgttcttcctcgctctccccgcgcaggtcacgcaataaggagaggggcgcacaggatatgtacaagatgtcttcgtaattagagaccatcttccgtgtgtgtctgtccaatccagcccgtggcgggtctacgagtacaacccgaaaggaagggtcg

SEQ ID NO: 4638 - DNA, 700 bp, Nannochloropsis_gaditana
caacaccaaaaatcaacatttactcactaggccgaaaagccctggttgggaggggaagtccttggtgtttccggatgaagcttgctattggaggaccctggaacgctcccgacacatctgattgagacccgttctcgtcatcggtacgtttttatgcatcgcttgccattataaggctacttgctattgcgaacatgtagcctctcccttcggtgaaaggctcttacagctttccgttccttgtaacctcttcaatcctatcacgaagggagggtcaaatggaagctctgttgttggagctactacaccgagttaaagagctgtacgatagcattcccggctctcccacacagcgagaagcggaccgatggctgacatctttcgtgcacgtagagggtgcgtgggatgtcctcctgcacgtcctgaacagggccgtcggttgcctccccttgaacccaacccaaccgattgacgtccgattgctcttcatatcaacaaagattctgcaggtatgcataggaaatgcgagacattccttgtaaatgtcggaatgtttgcaagcaagccgtgcatcatcatttcgctgcctttcgtttcccctttcccacagctgaaaattcagcttggctggcggacatgcaatccagggacccaagcagccatccaacagtgcctgtcttcgcgtcttcagcaagagatg

SEQ ID NO: 4639 - DNA, 700 bp, Nannochloropsis_gaditana
gcgatgacttcatcaggtctgaatttatccgttgatctcttcttcggtccgcaaagcgatgggtcgagcctctggagcatgagatcgaggaggggtaccgaggtgagtctgctgtaagcttggtaggaggtcggatgctgtgccaggcaaacgcggtggtagaggggcataccggcagcgccactgccagcaggagccagaaaatagcagggcggtaaaatcgtggcatcctgttggtatggtgcggacgtggaggtgacaaagggtgtcgggtcgcggtgggcttggcagtgcaatcaggcttgtgggcgacgcttcgtaggagcgaagcgaggtcggtatggaacaaccccctggcctgcgcattccacccattttggtgccagacgacccagtccgtcaggccattcacgcacctacaacaccaaaaatcaacatttactcactaggccgaaaagccctggttgggaggggaagtccttggtgtttccggatgaagcttgctattggaggaccctggaacgctcccgacacatctgattgagacccgttctcgtcatcggtacgtttttatgcatcgcttgccattataaggctacttgctattgcgaacatgtagcctctcccttcggtgaaaggctcttacagctttccgttccttgtaacctcttcaatcctatcacgaagggagggtcaaatg

SEQ ID NO: 4640 - DNA, 700 bp, Nannochloropsis_gaditana
cgagatgccattgccatcgtccttgtcatgttgattggtagtttctaactgactaatctgccctgtttcctgctcttgttcttccccatctactaggcttgacgcctctgctgcaagatgccgctcctgcaccagctgctgctccgaaatttctccttctatggcggtcggtgccaccatggtagcgggtatatctgccatgctgttggaagttttggtggtgggaattatgagcatgagggctcgagtttcgctctgccaaggcgcgtatgttcttttcagggtggcaactatcagcccgtgtggcaccctaagatgtccctgtcatgccatgactctgcattccatactattaacacactttcacataaaaacacgcatgtgttgataggggcgaatccccaagtgctcctggttcccagcgccattttctttccttcccctccccctcctgctcgctctcactcgctaagcacgagctcaaggagacagacatcccaccgcgttgccactgagttgcggttcgtttaggtcgtacccagcgcccatttccacacgtcatcgctgctgccacatctacacacggacaggaagcaattaacgaactacctaagcgcgaaaacacgggatcaagccctgacgttttcctttaccctcccgcggcctgtctgccgcctggtcctaattcctgtttcccatg

SEQ ID NO: 4641 - DNA, 700 bp, Nannochloropsis_gaditana
attgaagagccagcgtggaatggggtatgtcgtcacgtattcggtctggcgggcacaaaacagcgggcacagaacggacttcgggcgtgcacaccctcgcgcgacatattttactctctccgagatgtcatttacacgagatattccataaattcttaatttagatgtgcatccatgatgcattccggggtgcaccaaccttggagagggggcagaaaaagacaaggtccggccgccttgcgggcctcggcctctattcttatgagcacgcttatcgtcagagcaatggccaagcaggtcttggacactgccctctgcgctgcaggagcacccaccgcatttcctgtccgtccgccttctgtgtgtcggcccctttttgccgtcccaagtgttgataaggccttccattccatgctgttgcccaacagctgccatcaggcccgcgccaggacaaattattgtgtgaagacaatcagttagacatcgcgtataaatgtcattgctgtagcatcgttttggcagattttctacccatcgtgcacgccacgtgccattgattcggaagtcacttgagtcaagggagactcgatgacgccatcacgatcattcccattcacgtcgccaagtaatatgtcctgtgtggagtgtttgtgtgtctacgtgcacgcaagaaggctcattttgccgtttcatccacatg

SEQ ID NO: 4642 - DNA, 700 bp, Nannochloropsis_gaditana
acagctgtagacctgcaagattgcgacaaatgtgcaggcaatggggctacgggcgtctttatgcgccatgatcagaatctttcgagcctgttcgaacacctccatgcatttaattgggtaagctcgcgtgactttgcaagtcgtattttaaaaagcatgaaggcattgaggccacgagaagatactaagactcgggattacgaacggtctgttcgtacgaatgatcccaaaaaacgcgcttccgcaatggaagcatattcggttgagcagcaggaaaccgtacatgagaatgcccgccgtaaatgtggtcattggcactgttcacatgaactaaatgtgacgggatgccttccaccgggtctctgtcgctggttccccgcgttgggaaagacggcgattttccatcactacattccactaaactccccaaggggaaaaaccacaggaatccacgcccacccctgtgaatacaatgatttaaatttgattataaaaaatgcgctgcagcgtctgagtcaaatcataatgcatgctttgattttcactcgacatacttagaaatgttctatgtatgtactgttcagtgtcttgttttatcacacaacctcgtgttttttttttccttcttcttttctttcacctgagcagccacaggacacagcttggcaagctttccgggatggcaggattggagaaaatg

SEQ ID NO: 4643 - DNA, 700 bp, Nannochloropsis_gaditana
ctgtccagaaagtgtcaaaagcgccaaaaatgcaacaaagatcgagcaataataccacataagcagcccatgcctgagaaaacatactcgaccaccgtgctcccttgcttcaaacagcagtcgctaaaaaaagatcatttttggggggagggggcgataaaaaaacttgaacgccaaggaaaaagcgaggccgggaaaaagagacaggaacagtcctgagctttcgtcacgccctttgccgcgtcatcgtgggaccatttcgcccacctggacaccaacgtgcacacacttctgactaaaattttactaaattttcattgtagtgcacaggccttaatatttcgtttcaaaggtggacgtcacaagtcgtttttgactggacaagaggccgccgactccccggcagcctctggggggattccggcaggagatcgacctggcttctctttcgatttgaagtaacagctcgttgtttccccattattggtaaggtgcccaaaatctgtaattcctggctcatagagggatggatgatgcttgcaagggcttaggtcacgccgtaatgcctaggcaaggaccggaaatcccccgagcgccgacaagatcgccattcctaaaattttcacgttcctgttaaccctcaccgttctcgtatttgaacgtcccattcccatatctcccgctcaaaaataggaggatg

SEQ ID NO: 4644 - DNA, 700 bp, Nannochloropsis_gaditana
attaaatcctcctcaacgcctcctgctgtcgtcactacgacatccaccattttatgttccacgaggaaccgcaaggtttctcttaggcctgatgagatgagattggaggtgtaggctaggaaaattttgcactttatttgagcacgtacaccgggatcgatcaaatcctcatcctcgtctgtagctacgggaacatcgctcaggcgccaggctcgcatacgttcgatttccttgatagccaaacccaagttggtcgcttgaaatcctgtggttagatatgaacctaacaatccatgcaatgtcacgccctcaggcgatgaaatggcggcattccagtcaaatccttggaccgtgggcgtctccgctggtaagggatcagagggcaggaggacagcagtttttgctgtctcgtgcgtcgaaggaggggctgccatggtatcaggactccccatgctgccactcccctgcatgaaatattctgtgttcgatggacaaacggaggatagtcagaataaagcatcgtaaagcatcgcaaaacgcttaggaggaagtaagtgggccattcatctgcatcgggagccgggaggttacgtcgcaccgagtctggttggacgtgtcagacgacattttaaaagataaatgtagtctcttttgatctcaccacgctcttgtgcacataaaattcttttccatttgtaac

SEQ ID NO: 4645 - DNA, 700 bp, Nannochloropsis_gaditana
cggtataggcagatccaccgtcgcatccgttcccgccatggtccggatgcgcagcgtcgttgtcgttgcagtcgtgctgctgcttagtgcagtcacgatgtcactttcggtatgtggcattgcgccagatggcgtgcgcgggaaaggcttcgcgtcttcatgcgccttcaagatacaagagcgatgagtgagaaaaacattaataccaagcaaggaaaagacagtctgaaaaggaaaaaaaacatcttcggctgcatggcaaaacacaatgtaaacacattcacgataaatggcaacttcggctgttcaaccgttctagacggaggatgtcaacactaggcgacccggatgtgtgtcgggcgactaaaaagggagctcgcgtccatagaggatgtagcgttgggtaatttgtgaatcatgtaaccgaggaccagaaccaaaaaaaacgaaactactcttcctcactgtgctttatccatttcgtacgaacagcggttccctgactctctgttggtgcttttccacctgcgttttcggacgaacggagcggagagcagagggcaactcaagttgcagcggacacaccagaatgagaggctgtcttgtacctggactggcaatgccttttatatcgtttacaatcgttgttattacgctcatgagcagcacgcaggtatttggctgtgggccgaagtcgatg

SEQ ID NO: 4646 - DNA, 700 bp, Nannochloropsis_gaditana
gaaaatacttttttatatttccgatcctttcacgactcttgtacagtgtcagcagaagaccctttttttcgtgtaagcattactgaattacctttgaaacaacatggttgcataactgtttgtgtcattatatcggatttcaggctgtgccttgaccgtacaaagagcaaatctcatgctggatgtcgcattgaaagagtttgcactttgtctgaaactcttaaacattcaagacgtaagtagaccaacgacggcatcactatccctcaagctactcgatattaaaaaaaacacatcaaatgtgccgttttattcgggcatttaacgtccaaaattcagggttaaaaatggttttcctttggcatggtggaaaaggaagtaatcgtgtggaccgagagcgtctttttcccttgtgtggctctcaccaccaccattatgtgcacactgtcctgtgcgattttgtgtgtcggtcgtctcggggtcgggaggaaggaatgcgataatttgcgtctagttaatggaatggtcaggggctgtgaccggagggatggatgcactcgtactatttgcatttcttccagccatcgagagccccccccttctgctatgtttttttctctaggctagcgagagcgctcaccgttcctcctaacatattcaccaacccaccatttacatcagtccaagacattgtaccatg

SEQ ID NO: 4647 - DNA, 700 bp, Nannochloropsis_gaditana
atgttgaccatgcagactaatagggcacggccctccgggccaacctgagcctcttatgagacgctgctagcgcgagcaaagccagcttttacagcacgtgatgtctctcaccgaacagtgggcaatggcaacaaactttcccctgacaatgtgaatgatatttttcccagttagtaacacatgacgaaaagtcaattggtatgccacattctccgcggtcaacattcagggcccggtcatcgaatcaaaaagagaaggtcacgcccggcttttggatcgaagtcaacgcaaagtatgacaggagacgcttgttccgaggggcggggggcggggggggagataggatgaggctatgggggcggaagggatggaggagatagggccatggccatccaccctctttggggctacccagcgctcctggggcgtgcgcaaggtgttccatgccatttaatcgtggtatgtgcgttgatggtgggattgtggacgtggaaggtgcattttggacaggttatagggatgtacggataccattatgcggccccttcctcgctctttcatggtaacactggagaagttctcttcttcacaattctctctgataccggagggcctcatcgcatgtccaatacatttcccgacacgctttaaacagtctaccatgtctagcactggaaccattcgtgggattaataagggt

SEQ ID NO: 4648 - DNA, 700 bp, Nannochloropsis_gaditana
tcatttacccttttccctcggtcctctcggcccactgcttgctcaaagccagcatttttaactttccaaccatcgtgtccgacacggcccgcatccgtgaggcaagcacgcgcatgactccctccttagctctcaaggtgatggcgttaggctgcactccgtccctttccatcatctcaagaacctctaccagcagtcgttggcctccgccccccttgctccctttcctgtccgctttacccatctctttctctaggcaggcgtaaatcaagccgttgtacacgcgcacgtccggcacccacttttttccccgcatattttgcacccattgcaatgccgtctctacctcccccgccacacaggcggcccggataacttgcgcgtaggtgcttcgggtcggccgcacgcccaaggaaggacatagcgtcatctccttccacgccgccaggaccccgtccaggtcccccttgcgggccaaggcggccatccaggcgctccagaccgcacccgcccattttccgtgcgactgttggggcgctgccggcatcggtgcccccggattgcgacgagctttgaaagcttcaaaaatctcccgcgccgccaccaggcgggaggttggcttctccggtgccgagggctgctgggaagacgaaggggcagacgtgtagtgctgtataaatgccacgaagagcgagtcatg

SEQ ID NO: 4649 - DNA, 700 bp, Nannochloropsis_gaditana
ttcggaaaaggatgaatttaagtcacaaaaaacctacaggagggaataaaaagtcatggaagcacaaataacaaaaatcatacgctgccaactgtcatcaagccgtttagcttaaaaagggaaatgctagtttctataggcaccacgccacgtatgcatatgcaagtggtacatatatgcaaaaatgagtataaacattgatgtgcactagtcattgtcgcatgtcgtcgcctgatttttttacacagatgagttcatgctgtccaaattcttagggaaatgcattttgaatttcaaaaatccgttcacaacaaggtcgcgtattcatcgccacctttcgtgcaatttcatctcatccctacatgcaccttttttccattaagtattttcacattcattggtcttttgtggagccttcaaaaaattgtccatgttgttggctttttccattaggcccccttcagggatccctgcatgaccgcgcttcccatccctgctccattcctttcaaagaatatttcgtttgctcttatctgggcgcaactacccgtgaaaatattttcttatggttgtatgctagtacttttgaaacattatggggtaagaagtctgttgctccacttgttgttatgcaagcttctcattatatatgcaattttctaacacaccatgccgtctagacattcttacgttcaaaatg

SEQ ID NO: 4650 - DNA, 700 bp, Nannochloropsis_gaditana
tcgtggcatgcattgccccagccccctccggctgaggcgaggacgaaattcttggggtgggaaacgcgcctggcagagggtttttcggcgcccgaaaaagggggcgtgttagggaacgactgggtgcatggccggcacaacgtaaggaaataggaaaaatctgcacacagagagatagcgcggggtgatggaggttgaggttttgcttttcaagggtcatttacatgcactgcgatgtaccatgcactccccttgggagcagtccccggacttgcgtcctctccgtcatgggcacgtttgtaaaatcacctgtacagattattttcggtcaagcatttgggacgcagatttcagatgctttcaacgtgtgtgcaccatcatatgatctcgctatccctgttgccgttgctgtccttcatttggggcaagaaaacccggggcaaagaggaagccagcaaccccctcgcctgtgtagtccgactcctcaacttgctttggtcggacagacaatgaaagcctgtaggtgtcatccattttgctccaagcaatcatctcaccgagagtatttttcaatttattacagggacgggtgctcgtttttcggtgcgcttgcgggtcttgttcccggaaaagtgttggcactaaccgcctggaaactgcacataggcaaccgcaaggaaaagtgcagcctgtctgaatg

SEQ ID NO: 4651 - DNA, 700 bp, Nannochloropsis_gaditana
ccatctctacttttcgctcctccaccaatctattcaaaatcttctcaacctcgggaagcttcagggccgtcattggccgctcgcctcctacccatatccgaagagtgtcatgaatagcgcgcacggacctcccgccgtacgtcccaagcatgccaacgacatacgacatgtataagtccatttcctgtgcctcctgtgcgtgtgaggacaccgccgcttccaagtcatcctcctccatccccatcgtcccctcccgcctcccgagggtaccgccacactcctggtcccgcctgtgaagcaagcggtacaagagcccccccgtgggcctgcccgacaaggacggcaagagcgccgatactgatgcgcccgcctgggcttgagaggacgaggtcgcggaggaggagagggcggaggcaacaacgccttgattgacccagaaagccatcttccgcgccaccaggtccgcgtcgatccccgtcacatgggccagctcctgaagcgtccactcgtcccggtcctcgaagtgcatgatgagggaggcgtggacgggagagaccttcaaagaaagcctcgccctccttcccgtctcccccacccccttctccgtctcagagctgctaccgacagccgagcccgtcttcacgctccccgacgagaccccgcccccttgcagtccctccacacccccaaacccctgccg

SEQ ID NO: 4652 - DNA, 700 bp, Nannochloropsis_gaditana
ggcggcaacagaatggggggtaaatcgtgcaaaggctctaacttttttgcatgacgtctgtgctaaatatatgcggtataatgtgttttcatggttgcaaaaggttgaggcaagaaaagggggggaggtcgcgagcccgtgcgagtacccccgacctgtgggtgatggccacacatagcgtcttccagtgtcccagtcatgtggtgatgttcgtgcttgcgactgtcaaaatcacaaaaaagtagtggggggtctgtctgtccttcgaatggcatgatcgcagtttgcgtctcgggcgcatcaggcgaattaccagaagcattaattccttgcctcagcccgagctctgttaatcctttgttcccgtatcgtctcgcgatagcctttgagttcgatcagcaaaaatccaagcaccagacgccgtctaggctcagttgggtattcttagcatgctttcaggcaaagccgcaactgggagcttggtgttgtccgatgtatcgaccctcgctcaaacttgccggaaaagagacaagcgacttcgcctctcttcttcattcaggcttcctccctcagcaccatgcagggggccttctatgcttactgactactcccgctctcccatatcctcctgatttacccgtaggcaggcatagatctcgaacctgggcttattttagcgcgtgggagccggtgacagatg

SEQ ID NO: 4653 - DNA, 700 bp, Nannochloropsis_gaditana
tcaaaatttgggggcgattcgtatcggccccttcaccgaagttatcgattgcgggggggcagcaaccatgcagtacaaacgcaaagtacaggacatacgacaggagaaaaagcaagaaaggcatcaggaaaggctgctacctcgatggttgtaatatgtatcctaaattttggcatctagtgtgttgtttgtccatagtttttgtaaatacattgctcattgtacggatcggcgaactgtcgaacgacaatcaagcagctagacatatgtacttgcgggagccttgatctgattctttaaagggaataatctgttaatgctgccgcatatattgttacggtgacttaggtattgctttgaaagtctgatggaatgtgaccatggcaggagagatcgcacggatcgattccttggctcggtcggagaacacaggcagcctctggggggaagacaaagatggtttgttacatctcgctgatcaatacgaacactcaagacctgtgacggatcctcatgatatttcatggtagaccttatgcagggtctgatacttatataaggatagaacacgggatttcgggcccttcttccggtgggaatcgacgttaacctcccccacctctcctgtgcctagtccatggagcctgcgaccaaacatgtctctcttgcagcttcatcgatcacgaacgcatgtgatatg

SEQ ID NO: 4654 - DNA, 700 bp, Nannochloropsis_gaditana
gagatttgaaagtaagtgagagatcatcgtggatccgttcaaagggcattggaaagagctgccgtcagaaacttgtagagatagacttgatgtgacacaacatctggaaacacgctgctgtcgaatttgattgacacaccgtatctaacgtggaaacgtaatgttctcacacgaaaaatatccccgtgagcccaatgcatgaaagggtgttctcggagggggttgcttagtgcctgatgggtgatggcgtcatgcatgtgatgcaaagtgcccccttgttttcaagccgggcgcatgggactggcacgtcctaacgagaacagtgcggtacagggtatcaccccgtcgattgaccaacgcttgagtccctctatgaatatgcgcccatgaaatgtgccctctttctttttcaagcgcttcctctcctcaacactggccacgatggtcgtcctgccgctccgtgagaggaccagacttttcgacaagctttcatcagaaaaacgacgtgcccatggcatggatctatgctaaagtggtgtcctatatagctttgcctgtacgtttagtttttgatgtcaacccgatgttggacattgaacctttcatagttgtgggccatgcgttcttttcattcttcgcccaactttcactccggatctcatcgtttaaaaccctcatacggcgcgatgtacaggcgatg

SEQ ID NO: 4655 - DNA, 700 bp, Nannochloropsis_gaditana
gtgtagggatgtcgaagaccagtccagctagtatctatcctacaagtcaatcatgctgcgacaaaaatttctcgcacgaggcctctcgataaacaaaactttaaaagcacacttcattgtcatgcagagtaataactcttccgcgtcgatcaatttatcaatctctatcatttccgcccctttccttgcatagagcaagaaaagcgacccggatgaggataacatgtcctgcgccagtagtgtggcattgcctgtctctcatttacacgtactgaaagcataatgcacgcgcataccaatatttttcgtgtacggagatgaagagacgcgacacgtaagatcacgagaaggcgagcacggttgccaatggcagacgcgctagtctccattatcgcgttgttcggtagcttgctgcatgtcttcagtggcactatatccactctgcctcgtcttctacacgagggccacatcggtgcaagttcgaaaaatcatatctcaatcttcagatcctttccagaaacggtgctcaggcgggaaagtgaaggttttctactctagtggctaccccaattctctccgactgtcgcagacggtccttcgttgcgcacgcaccgcgcactacctctgaaattcgacaaccgaagttcaattttacatctaacttctttcccattctctcaccaaaagcctagcttctatg

SEQ ID NO: 4656 - DNA, 700 bp, Nannochloropsis_gaditana
agagagactggatcgcaggacgcggtaacgccccaagcagacacgatcatggagacgacctcgatctcctcgtctccctctctcccttgccattttgtccttaggctatgctcccctatgtttcccgagttaaattcataattttttggatagaaagccgttccaccgtatggagcggtattagaagtggcacagcgcaagttgagcaagtttttcttctccttcttctatttcatccatcccacggcttatgctttcatactttcttgatacagcttttcatcgaagtgtcatgatacgcttctctttccgtcaccttgaggccatcttaatgagtaggggtagtgcacatttccgccgcccgagtcaaggcttttcttcctctctatggaagtcccctgtatcttctcgttcctcctccacgagctccatgccgtcaagccacccacgccatcaaatccttgtcattggtgccgggcgtatgggaactattcgagcggccgctttctatggctcccggacctctacgctcgccggcattgtcgatgctgacgaggcgaaagcagccgagctcggacgacaatatcacgcaccagccttctcaaacctctctaccgcccttcgcgccctccctgacgtgcgagcagtttggatctgtacgccgacgcctttgcacactgagagcatcaaagaggcgatg

SEQ ID NO: 4657 - DNA, 700 bp, Nannochloropsis_gaditana
gctgtgttcctgccttgcaatggcgccggttgcgaccagatgctccataatgcgggggtcttaagtcatgggacagagcaggaatcttctataaaggatatgatcaaacagactgtatggtcgctgtggaggcatgcgccataattccttcatgataaacacggaaaaggtttgggggcggaggcagggttctccgccccaggcggagaatgcttcgtcaagtgggaggctcggtggacttataagaaccaatccgagccaccagcgaaacgggaaaaatgctgccgaggcccacacggtagctttggcatggtattgggggcgttaggctcgaggcgacactggaacgtacagaaaaaatgtcggacgcagggtttggaagcgggcagggaaatgctcgccttcgtcgccggaggggctgacatggagctcgcgcccggctaggaagatcccttttactcgaccgcggccacgagcagtcacgttgtgctcgtggcaccgctttgagagacgatcacgggcatactatccttcatttcctgcctgcctggcatgcacgtaccaatggtacgagactcgcaccgggctggtcctcctcttccttcttcgtgagctgaacatttcatgtgagggagacttaacacgccattctctcgagatttccccgtgccaagccgcgcgcctggggcatgatggcatg

SEQ ID NO: 4658 - DNA, 700 bp, Nannochloropsis_gaditana
gccttcgtcgcacgcgaggatggacatgtggcgccccttcggcattttcatgaatattatgagactgatctttccgcgaagaacaaaggtcaattctcgtccgcgtggctgtcacgtccattcttgatttgttattcgccgggccttggaggcccgacttctcactcgggggcgttgctttggcctcagcccaccagaggcaggaaagccatgtgtgccttcctagctacctcccttcctacctgctcgaccctcggtgctttgctctactttacacgttaccggtggctgtctggtctccggcgttatctttcttctccgtcctttcggattcataaacggtccttaacttctctcatttcatatcccttcacttcatactcatcatccatttcctttgcacagcacctctttcagcacagtacaacctcctttgcactgcctttctccccctcccgaaaccctccttctttccttacattgtcctgccttcgacgcctttgcctgctctcacccgatcggcatccctcctcgaccaaccccccttcctccctcccccccccgctacctcgtccggcgactcaaccccaacgtgcgttagcctagagaccagagcgcgctaccgcccgctgccaagcttccccgtgacgttaccgcgcccactcttccctttccgttccacctctgatacctcactgcc

SEQ ID NO: 4659 - DNA, 700 bp, Nannochloropsis_gaditana
atgtcatcttctcctcatgctttttcatccgactttattaaggatgagtcgcgaatgctaaccaggcacgaggctgcgacaacttcttggaaaccattttgtgggtgtgtgggaaggcagggtagctgcattcctgttgttagtgtttttattcccaccaggtcttgatctagaaattttatcatttttgggggggacgaagagcctgacataggttttcagaacgcagtgcgtgttccgtcatatcctattcgaacgttggcggggtcgatgggatgtatcggatctttcttttccacctcgcaacccgtcacagtgtccccacaaaggctgcaaacatcgttaggagttagtaaagtgacattgcatgcatttggattaattttgggcgtccctgtccctctttctttcctaagccctagattgcttgcatcgtcggccatccatctgactagattagatccacttttctaaaaaatcacgaaacgcgcaagacgtgttttttaaagcctgtacacgtaaattacatgaatctcggcgcaatggcttctctttttctcttcacgcctcgattcaggacagacaatttttcttttgttcttcgttttcctactctgatgacactgagaatctcataaagttttccattttccaacattttgaaggaaacaaactacccaccactaccaacaacaccatg

SEQ ID NO: 4660 - DNA, 700 bp, Nannochloropsis_gaditana
ccagtgcgattgggcatggggcatgatggaaaaagaaggcttgaagtaacgcccttcagggtgccgattggatggggaaagaatttttcgaataaaacacaaaaagttgaaaatagacgaggcaaaagatgtgctgtacttcctagaaatgatgagagattgtaggaagatgttatgttttacttcctttctaggataggaaatgcccaatatcctttcgaaggacgtttctttaaaatgagccatccacaattatcatcacagtatttttctgagcgttttatacgtttacatacgtttacactcaatgcctcaagcacgtgtgtcacggtagggcttcaggtttgaaaaaggcttgttatgttcccatgattaacctcctaccttcaagttgtagcacaaacaagctttcgataggctgcactccttgttgctgatgctacccattatgccctactatcggtgcttattcatgccgcgtatgcgtttgtacacggatttgtacgcgccttggtggttgatgcatgtctcgcggaggtaccgtctttgtcgcgagggattggtcaggctatggccgctcccgtgcttttctgacagcaaccgtcattcgagcaagaattaagaatttgtccgaaacagcctcatccaaaagaaatgtgcttacaactcgtccgcgttttctcaacaaggtgtgtacatg

SEQ ID NO: 4661 - DNA, 700 bp, Nannochloropsis_gaditana
ggtgagattttcgataccgtgtcacgtcacaagattaaacagcgactgtctgatctcacgatctctgagccccgaaacatgaaacaaaaaaaatgcatcccatcacatttctccatgccgccatttttgagacacgagcaaagtaaaagcatcagggatcaggggtctcccctcgtcttgttgattttatcgctagagaggccaagactggctttcgctggtgcatttcgggactgagagttgcagcctgtaggatatcttaatgccttgggcgagagcgggccgatggaactaccggggggagggatggattgagatgcggcattgatgtatgggctttccttcatgccaatgtgcgtctcgatctgggtgggtgggagcatcgggggttatattggtggcacgtgttgttttgggtaggccgcagtattgtcgtgatcggtgggggcagggcaatccacgcgcgggtttggacaagctcacttttaaaaaaaatcctgagtgcaatgaaagtgtgttgttcaacattgctgcacttgtggctcatgtagaatatatgtatgccctcagttggatagaatggggccctttgttaatctgtggagacgcgccttgtgagttggtgaagaatccgtcgagtcgccacccctcacgtgtttcctttatttaatcattgaccaacagccatcaaagcatcatg

SEQ ID NO: 4662 - DNA, 700 bp, Nannochloropsis_gaditana
cgtcttgcacaaggaggacgggacggacggggacagggagacgggtcagaccagcctggctacccggatgttgagtgcggccatggctcaatgccgtccctttcggtggccgggggaggggccggggcagggtctgggggagggagggagggaggaagggagggagagggtggagggaaagcccgcgcagtccatgtttggttggccgatagccgacacgactacgcatgacgatgtgtgtgatatcgatacagaagaagccgaggctgccgcagaagccgcagcagcagctgcggccgccttggcggccgccagcaaggccgtaccgccccctcattttctctctacgggcctgcccgacgaggttcaattggaaattgtcgagtacttgcaacctcgggacgtgctgcgattgacgcccgtctcccgggcagcccggaggctgggggaaggggaacaggtgtggcgcaccaagtgggcggcgcgtttcgggcccatctggcggtcgacgcccgtgcaaaaggcggagatggcacggaaagcacggagggcagacggtcaacgggcctcggctaccgacggggaaatggaaggagggtgtggccagtgtgggcggggggtggggggaagaagggagggggggagggagggagggagggagggagggaagggccagctggccaccctgtttgcctcgatg

SEQ ID NO: 4663 - DNA, 700 bp, Nannochloropsis_gaditana
tccgagacttgacggctgaaaaagggggtcatcgtcgatatcctcaacgcctggctggctggtgacgccatgagaaggagaaggggaacgccaaagaggatgtacatctcttgacgtgtgatgatccctagggcctgtcttccacagttcgagtgtcaccggcgagtttaagtcagctgaaaacgtaatccgtccccgcacgagttagggttagggtaatttgtcggcggggtcaacaaaaaggtagctaactcgagcgaggtactctgtctcgacgcggcggggcaacttcaattccgaaagtctgtcgctaccgtactaaagcggtttttattactccaagtacatccaatccacacctttttcacgattaaaagtaaattcatacaaatcaggagtccacaatcacgattttggaccgtaactctgctgccatggccatggacgctcccagtctgtctacctcctccctctcgccctcactttctgttgataaacttttcgacgtacgagacaaaaacgttttaattactggaggtgggacgggcatcggccgaatgatagctcaaggctttgtggataacggtaaattttgtcgagcacagtgacaatttctctagaaagctggaagtagcgtttcactcctcactcatacgctctgcacgttgtgcctgtcctgctgggcatacctcatcgtaaa

SEQ ID NO: 4664 - DNA, 700 bp, Nannochloropsis_gaditana
ccgcattaaaaatacagccttgcatccttgcggttgtgcgcgcctatttcatctctcctttggaagatacagatttttttatcttcttctggtgtgacatttggtgcgtatgctcgatttttgacttactgcgatcagcgctgaggagaggactccgctcgcggtaaggccgagcaagggaaaacacacgaagataaagatcaaatctaacaccgttgcaactgtatgaaacacactgtgttggcaaagcgtgtatggtatctcctgcgtgcccgtgtcgcggtgtgccctgtcgtcaggctggcaacgcagtggagtaggggagggtggtgcgttccagtgcaaggaggggaaaaagccgacagtctgcccacgtgtcgtctgaggccttgggggacaagttaaccccgcttcgtcgtccttcggttctcgtgcatgaacagctaccagtacttgatagctacgagttctagataagaagcattgtggtaccctcaaaaggagatattcacggagatttgtcccgccgcgaccacgtcggaaccgccgagtataagtacgccggagattgaatgtcctgcactattgacgttgttcatttgtctaaccgcaccgctacgacacactcttccacccttcattcatctctacgcttgaattgcacttcttctctcagggtcctcaacttacaaacaagatg

SEQ ID NO: 4665 - DNA, 700 bp, Nannochloropsis_gaditana
tacagcaatcccagtgtctatttcgtgacagaggattcgagtgtcacgaaagtctaccgtctcttccggggcttagggcttagacacttacttgtgctgagcatagagcgagatgtttgtggggtgatcgcacggcatgatttgatgccgaacagcatggaaagcaagctcagaaaaattaaagcttgtaagaatgctagcaaggcgcattggacattgccgaaaggaatacaagggaggaaggcaaaaacggcgggcgattttgtcaaggaaaaagagaggggaaaagctacgatggaaacaggagggcaaggggcttaggtgaaaattgcacagacacgtgaagatgacgtgttcatcttatacatatatcagaattacatatctacgtttgaataaagacgatgtatcgtacattcatggtacaataaaaacaatgcttaaagtttacatcgtgcttgctccttggtcgacgacaatgtttttgatttcaagcaagcaagcaaaagctacccggacaggcggctagctggccgccgcctggactccacgacgacgtaaatagtctcccttcactctgacgcctccattcgtggcgaattttccctatattgagaatagacattctgtgacgctaggtctcccacctattacacagctttgcttgctcggagagtctctcacaccaaccgaaagcatg

SEQ ID NO: 4666 - DNA, 700 bp, Nannochloropsis_gaditana
aatgggtgatttgggacaaaaactgccagaattgtatcttgggattttcctccatgctgtcacgaccaggacgtgacgaggcaggactctgctttcaccgagcacacaaattacagaaaatggaaaaagttatcctccttcatagtattttaattctatgtctacaaaataatgaaaaaatatcttctgtcacccttggtgagataaagaagctggagccagtatgcgatggtcttttcttcggagagcaatcagctttccttctcgtcttccagacttttgcgtgggtattacttttaaaagttgactgtggcccaagttcggtttccaccagcgtaaatcaatgtcaaatatacatggatacgtggaggattgttgtgaagggttctgggaaaaagtgctgtcttaaaattgccagtgtgcttccggttttcttgtgcgccttgtttttcccccgctcgctaagaaaatttagcgggtcatgtcgagcctcccactcctagcgtcgcggccggtggtatagaattacctcttcagtttcgtacacatacggcatcttaatgcatgacgtatgcataatacagtgcaggctgggtagagttggcacgttttggggcttggcaaggtcatgggaagaggaacgaatccacaaagttccgacgacaggagcggcgggaacgtcgcgactgccacaggaatg

SEQ ID NO: 4667 - DNA, 700 bp, Nannochloropsis_gaditana
gacataaacgttcggtttttgggatgttttttggcggcggaaaatcttttctgcgggtgcctgcaatgtccggtcaagagtagggctgcatcttcacgagagataatataccccgctggttttttgaggatttaagaggcaatttgccaccagaaaacatgccgttttaacaaaaatatcgcttttaatatattgtgtgactacgctgcatcatcatgcttaaagatctgcaatttaggaataaattaccaaaaaaagaaatagagcctcggctggaccctcctcagccgaaggcagacctgtcttcttctccatactcttaagatggactctccgagacctcaactacaaagtacgcagacgtacgtaggacgagagaaacaggagagccttgagagaagaaaagccatatgtcacagcctttgcgtactttgttttgcgtcgataacgtcgtgagcgcttctacaagctcggcgccagcgctttcatcgcttactgttccggcttggcacccttagtcattttcctgcccccgcctcgccccgtttctgagtatgtcctcttctctatgtacattcagcgacacccgggggatagaaggaaagtacctgcaagctagctgctttctggcaaaaattatagattggtcgatgcgctctcacttacgtcacgcccacaatattgtccacacagcactatg

SEQ ID NO: 4668 - DNA, 700 bp, Nannochloropsis_gaditana
cttcaaaggacgctctatccatgtcctgccctagctgttttaagaattgtgggcgagttgtgtcatttgacattcgtctatactagctgcaggcagaaaaaggaaggaatgacgcatgcgttgctttgttttgggggcatctctatcgtggtgattaaaaggcattttggacacacacctccacgacgtgcaggcaacgtgcaattaaaacacaaatacatacgcgcactcacattttggggtccaaggtgttactgcccgcccttcgatgtggccatagggcggggtaccctccgttttggcgcgaacgccgcccgctagtcgctttttttgttgcctcccgtacccaaagtcgacgtcgagcgtcaaaaatattccccgacgagtccctcccgcgggcctagagtggccctggatcaagagacgttgccctttggtcgcggcatatcaccgctgtcctcgttttgcgccggtcgatggctcaaagcttatataaatgcaccacatggaaaatccgacgatttcttgcttccttgctgccactggatatacatcgttccgagttgctcctcccggttgtgggggtttcctgcacgcgattgtcgcagatctgttccatgatattccccaaccgtacactggacattacaggcaaccacaagggaaggttttaccttttctgtagccagccgcagtcatg

SEQ ID NO: 4669 - DNA, 700 bp, Nannochloropsis_gaditana
gcgcaccgttcaagggcccacgacgaccgaccaatcggctgcaaagtgattacttatgaagggcatttatgtgctttgtcgacaggcgccggcgggtaggaaagaaggatatggattaagcaaacgcaatgaaagcagaaacaacacccctttctttcttgcagaactatttatatatgtgtgggaaaaaatgcttctttgttggacagtatcgtcatgaaagcaggatgcgggcagttctcggacatgacaagcctcctccggcccatatccaccccgcacaccaccgattacttcacaggatgaaggaaaaaaaatgcattcccttcatctgaacattcctgttagctcattatgtcatatgcgtgtactccttctgcaggaatttcgaaaaacttcagaaaggggtacaagtggaagaaatcgttgtgtgcatcgcatcggaagtctcgagaaaaagatgaaccgccgcgtttatggcgagtcttgctcaaatttaatgccgtcagaaacgtgtatcatacaacatcggcaaatcatttccctctccgcacaacatgggcaactcaaccatttgccgtgcctactgtgatatgcctctttaatttttgcagtagacatgaagccggctacagtcctcgttttttagcttacacagattcctttccttttcaacctacccatctttgcaaatttgatg

SEQ ID NO: 4670 - DNA, 700 bp, Nannochloropsis_gaditana
gcagagcttgtcaaggaggacagtggcagcatgttcctccgcaaagatagtgagacatttcttccgcctgtcgctgccttggttccaagcctcagagaggccatctagccagggacgtgcgtgttttctcaaggaatggggcagtcccagcggaccacactcagaatagcactgcttgtggcttagcgggaaaaaatgtgagaaaaggtacgtaagattactcaatacacgtcttgaccacagccatgagctaacacattgaaaaggggcgtccgtgtcggcccccgacttgttttgacaggagcgtagaaacctgaggtggttggaacaattgcatgtttcgggctttaacggatatacgcatacgtggcaagcgggaaaggcggccaaacgcgagcatacaggcggcgtaaaatgttggtgtcgtccttatttttgagctcgtgtaggacataagcttcagaggaagaagtggacataatttattatgcagtgggggttggtaccccatgtttccatctttcgctgccccgctttgtgagactcatcaacgtagtcttgacatcgctggcatacaacaagcctttttcaatgctgccaggtacagattggctttgcataatacatccgttaatgtagcctctcttatcaacatttacaacctttgtcttttgtacacacaggctttggtcgctgcatg

SEQ ID NO: 4671 - DNA, 700 bp, Nannochloropsis_gaditana
gaatttgtagtgtatactagaatctttactcagcttttggcacacatcaaaggaaaaaccatgtttatggaggcataatccctgttgccccaacttgttcggtgggaaacatttcatacgtggtgccaaggcgcgaagcttcgttttggtcccctctttttcccctacgcttcttacgcccttccccacagccaaaacctgtcatcggagacaatacggtgggggtgcatgagacttgtcgaaggccgtgacatattatcgtaccgggtcacttggaggcgcgacgaagcatcatttatgttctccctccactctcccaagccttgtacccattaccaagccacattctaccaccccccctcacagcggtgtttcccaaaaaaatccgtacacctacagatcagtcgggatggcacagtcagaacagcaaccatcgtccactccgcacaccaattgctttccatcctcgcccaagcagcacgcacacacgacgctcagcggaagaagaagaatgctcccattttctgcgccacttttgttattttcctgccaactcgccctgctttcccttgtcaatgcaattcaattggatctacaacctcacacgacacggtgcgttgctgacgaatacgcccccgaggaggattcgacgatcaaagtgcgggctgtaggacgtgtgcaagacggcatccgcggtatg

SEQ ID NO: 4672 - DNA, 700 bp, Nannochloropsis_gaditana
ggcttcttcggcccctgcctccgccaccaacaccccggggtctcaggagctgggggagtacttcccgctgccaggggcatcccccctggggacggggcggatgcgggtgggaagtttggaaggggagggcctgccgccgccgcgccctctcccacccccgcaccccacaacttcgtctgtacagaccctggccctggggctcgataccgggaggggagggagggggggagggacaggtggtgcccccgctgcgccctccccttccaatgcgtcgggaagggggggcacgggcccgggacatccaagcggccacccccggatgcacccgtcgtccccctcgaaatgcgcccatgccttttcgccccagcggactcccccccccgggaggcgccactggcctcccccctcggacctcgtcgcgaggtccgctcccaccgctgcctcccccctgccctcttcctccgccgccaccacgcaagccctcacccaggcgcgtgtggaaatggcggctctccaggccgagttggatgcggcaagggcggtgtcggaggtagaggtgaggaagagggtggcagcagagcacgaactgagcgtctggcgcaaggcattggcggagtcagggcccagactgtcgtccgtgcaggggagcgcggcaaggcccggggggggagagagcgtgtcgggggaggggaagggaccg

SEQ ID NO: 4673 - DNA, 700 bp, Nannochloropsis_gaditana
ggacaatgatctgattgcgggtgttcgggcccccgattttgcaaggagtctccagcagaaccagaaccagggtcaggtaagcagaaagaaaggcgtggaggatggagacggtccggtttcgaaagtcgaagcttgtgcccgagatggccggcaggacacagacgaggccgaacactactgaccaagctaccgtagacaggattaatccgggccaccggtctgccagtatatccacgtagggctggatggctgcaaggagatccgtcgtcttcatgatgagtggaggagggactaagggacgtgtgtccgagcgtgtgtgtggcagatcgaagagttgttagaatcctactagtagtaggagaaagcgtcgcttgatgcaacacgggggtgaacgatctgtcgcagctcacaatgctgctacctggacgctgagtcctacgcatgcatgccgtggatatagccatgaatatagacatcaacctacggcatggaccaaacactctgaccgttgcctgcaattatgccataatcagtctggacactgttatcacgggagtcggtgcggcgagtcactccctcgccaagattgcaatactaagatgaccaacgtttccttccggcactcgagacttactttaacgccactgaccgcgcatcaggacagatatacctgctatgcaccatcggcggcgtggagatg

SEQ ID NO: 4674 - DNA, 700 bp, Nannochloropsis_gaditana
aaaattcgaagcgtctcgtttctcgtgtggaagcacgcatgcccgtcagtgcacgcagagccgccctccacttgttaaagcaacgagactatgagttcatccacttagctagcaatcaactcccttctgctcgatccattcccttccgcattcttaggccatgcacgtggggagccttttggcatggctgacgctcttgtgctgctgttatagttgtcgcctggcttatgtgacatccccccttgccccaggacggggccacgggcagcggacggtgactattaccccgcaacggcccgtacctcttctattgcaaccgctgacaaactatccttgcgccacgctttctgcccgtcgttcctctttacccgtattttcatccttttcgtccttctttgccgagcgggctggagtgaacgcgacgaccagcggggataacttggcatatgaactgcgccttctggagctggagagtcggctcttgaaattggagggaatcacggggcggacggctagttcaggcggtggtggggcaagcggggggaaaaaacgtggggggaacgtgcaaggtgcaacgggcaccggtagcagcgctttcaaccacattcttccagacggggagcagctgttgttaggctgcacgttcgccggggccgtgctcggcttattcgtgggccgcgccttatttaaccgacaaatg

SEQ ID NO: 4675 - DNA, 700 bp, Nannochloropsis_gaditana
ggcgatcttttgaacccgtggaatcgcccatgacgctcgatagggaaggcttgctgtgtcgtgattgcagtgagagcgcctttaagtaaagtggcaataaggaagggggggcgccgggaaagggaggggccaggaccacgggcgagagctaggaactcaggcgaaggccaggcctgccggctttactgctactctggacactttataatcgtcagcacaccaagggggaaaaagacttccaaccagcgtggcgagacaattgaaacctccccgattcgtggggacctgatgtccgcctccttgcgaaggaggaaaaggcaagaagaggtaggggcattgcacatggctcaatattccgtttgaatgccctcgctgttcctgcactgctgcatggggagacgtcgctgaacgcatgacatattcggtgcaacatgccggccatgtccaaggccaccatgtctttaagagagtgcgtatcagaaggagaggaggtgcgttgtatgatgtactcgcctattgctcggccatcatttccagtcctgttcgtcgtatcttgttcatacaatttctttttcttttcaccttgcacacatctacccacagtatgctggcccgctccatcctttgtcgtcctgccgttaggtatggtttgacgagctcaatcccctgcctgcggacaaactgtcaaatgtcgctgatg

SEQ ID NO: 4676 - DNA, 700 bp, Nannochloropsis_gaditana
tcttacgaatgagggctgatcaacgtctctctgtctagaatgaagatgcaaataaagcccccatcagctgcgatgaagtaattttgcaccaggccgtcctaaacatgactccactttccatccgcaactgcactttgtcttcattcttcttcaactcatgacagcttgtctattagactcaaaaagtcgtgtcttaaggcactagtgtcgcgcctcctgactgtggtactagcgccctcgtgacccctactgtggtacttctcgaacaggacatgtttgtgtggccgaaaatacattttaccgctaagacccatacgccaagaagaaaataacgcaagaagcgtgcaaagatcaagcatttctgactccctgttataaacgcttcgccgggaacactcctagatgtcacggcatagctcgttgtcgggtcgtcgctaaatcgattccccgaagtcgggctttggtcgtagtccttctcacattcgtttcttttgtgcccccacctgaattcatcaagggaattttataccaacgtttataattttgccgtgtacgactcagtgagacattcaccgtgcattttttttccaggtattgcaattggcaggagcgcggaggttagacttctgtgaagatcagcgaagcgaaagagggccccatctcactatattctaccgcactttgactccaagaaaacatg

SEQ ID NO: 4677 - DNA, 700 bp, Nannochloropsis_gaditana
agccgacttaaacctttcgaaacatcgtagtgggacaatatactaaatgattcgcctgtataaaccttgaagatatcttgaagagagacaacaaaaccaaataagtcttaaaaggttaggtgacgggtaaaattcccacgttttccttcatgaaaataatcggaaatagtctactgctttttgtaagaggtatggggaggttgataaagcttgcttttgctcacaaatatgatgttattgtatcgcttgagttctcttgggacgcaagaaatggttaaagttgacctttgtcaaagctggcgctggtgaagcgggcccccgagacttcttttcggtacacgggatcaacaatgtcgcagtccgcggggtcccatcagcggcagctgtcactcagcgagttcgcggtggctacacgagcatgaccatgcgagggtgtcaggcacctagcagcacataaacgacgagagagcggcgtgtagaatcgtctcatgaaggtcggttgtttgcaacgttgtgcgccaccgtgctgtgccgccttcgtcgctgtgttgatcgggctttcctaggaccaagaagcctataatatgaacctatgagctgccatatgacttgctgccctggaagatctctttacccaatatttctacttgcttcctacaaaattctgcttctacccataggagagcgagagaactacatg

SEQ ID NO: 4678 - DNA, 700 bp, Nannochloropsis_gaditana
gctggaaaaaagcgacacaaacgatcgaggcagaaattatagaggaatgtccagaaatgtgagataagtccacatgcggaaataagacacgtatagaattcatgatcagcttctgagtgattctttcctccaagccttagtgcgcattaattgcgctctctgcccacgaaggagagggtctcctcagaggaggctcgatcctcctactacaggagtacttcctgcttgccatggtgctctacacgatgaactcccatggcaatacaaacatgttcgacaacttacagcttccttctatacaaacacgcacaggggaaacatccggaatctcagattgctcacagtgagtgtcgtgcctgaggcaatccctaccaggattgcagtgaagcagggagaaaaaaagcgtggtagaggtcgaaagtgataatcgggctctccacgcaccggaaagccttctgtaagacttgcgaagagccaacccttcgttgcattttccccccagaggtccgtgtatagaactgcggaggaacgtcccatggcatcggattgcatctcaaaatatagagcgtgcaccgctccatcggctcgattaggagcattgcagcaaaatttgacattcgacgtgctttttggacggcagcaaagcaggattattacccatcacaacacttgccgacgcgttcgttcggctccaagcatg

SEQ ID NO: 4679 - DNA, 700 bp, Nannochloropsis_gaditana
gcccgccattcaatgcaggtttcgtcagagaaattttgcagtagtttgtatttcggaagcccaccatttcaaccaccatgtggcgaatttcgcgtgcatatagtactagaaggattaattttcattctcttgatcttttatcatagcctaagtgttttgattattgagattgtcaggagaaataagccagcaagcagcttaggattggctaatcccgcaagccgtgatctttgtgagaaaggacttggccctcaccgaccttcgtaacattgatagccttattaatatgtcacatcgttcttcaagggtagtcttatgttcaatgcatgatacaaaacaacattgtgggcgttgggggtgtggatggggggtaaagtctgagaagttataagagcccagtaatcgaagcttttgctgttactgagggttaaaatgtgcactgctacgcttgacaatgactggacctcagttaaaacgatatcatggcacaaactatattcactgggactcgcacaacccaaattaccaattaagtcagtacgctcgggcaaagtagtctcccaccgtgatggatggcaacgcaagtacccggcatccccctcagataaatgtcttggaactaatttccccaacgcattgaaacatcctcgtacccatcgcgtcgggtccatgcatatttataacaggaggagggaagatg

SEQ ID NO: 4680 - DNA, 700 bp, Nannochloropsis_gaditana
ggggggcgtgagggagtgcaggcagccaaggaggtgtcggatcccatatgtggtgggacgtcatgaagtggaatcatctcgtcgattcctcgggatatttttgggagtggcgagcgcaaggaaagatttttacggtgggtgcgatgagagcgtgggggtcaggcagatagtctgtgtgcgggagggggagcgtaaggcgagaagacagggtggaggtcacaggcatagcgaattttggcaccgcgagtgccggcagacgacgggatggatgcacgcgatgagggcctaaggctagtggtgggacaacttgggttcgagagcctagacagggtgattgtggaactgaaaggcagctggacgaaaggacttagcaccggaggctcccctttatgacggggaatcggtacctttgttcgcgctccagtactgaatactcggaggaagggaaaggaaaagcaaaaacatcataattcatgcgactttgggggggggaaggtgagactgcgcccggtcgcgtactgagcacgaacatcttttgacaggtttgaggagaggaagaaaacgatggcacggaaggggatgcagaggatcaattccttgtgttggggtcggtgatggaagggagacttgatgagcagaagaagaaaccatgaccacggggaatgaggggcgacggctgggaagggagagcgtcggctgc

SEQ ID NO: 4681 - DNA, 700 bp, Nannochloropsis_gaditana
aaggaaagaaatacaatgcacgccaaattaaggatttgctgtcgttaatttctcgaaaccaattttgggataggagatagcgcgatccccccgcaatggccccatccgactttttgggggattggaaaaattgaaggctgccttcttactatgcatctctcataataagggactgtaaaaatactaaaatttgattgccaagtttactcacttcaaggccgagcccattacagtcgcggtcactgccatcagccgactcgccgcaacaagttgctcaaagctaggaaatgacaaaatactcgatacagaattgcatctatgtatatttaaaccgcaacggcagaaatgtaaacgctgaaaatgactttcttcctgccctcagtcatttttcccggggtttacgtaatctcagttccactcagtacggcctcgctttgcgcttctattgtaatagagaagagattgacaatagttgatcttcctccacgataagagtgctcacggccgggttgtaatgcgattgctcacatcctgcataaatcaacctatttgacttacgcagatagctacaagtagccaacaacctccccacccagtttattttaagtacctcagcataaattgatgcaacaagtggaaaattgcaatttaagaatgtacagtattttgagcagaactattaccattgtgacctagcatg

SEQ ID NO: 4682 - DNA, 700 bp, Nannochloropsis_gaditana
ggtgaatgagcgcctgtctcaggaaagacaagtagccggtgattgaggggacacgtcgtattttccattatgtccctttcgaattggtctgatataaagtaagtgcataaattaccgcttgcagcacccctgctagttcgctggacgaaattgatgagttggtcacgagtagtgtacctctccatgttagtttttgaactttactatacgctccgaccttcgacgctgaaacgcgcgaattgtgtggaggcggatgtgattttcgtcatattgtcaaattaacatcatcatttatgcgttttattcgcccgtttttccccgctttctatattgtccacatctttctagtcctcggacggctacgaggacgtgaagccaagatgctatcgattatttgcctgtgccgcggtgagaaccatcctacgttttctcgacaatgcgtacatcacggtatttcaaaatagggaatcttatgaaagaaacgagaatatgccaccaaaaagggactcaaaagcccaacctggcggtatcgctgattgaagcaagcgaggccggcgcacaatgaaaggggacccggatgtagaaaaacggagcgcctaggaaatgcgtatacccctcaaactccaaaaaggtcatgttctgaacctgttgatctttatccgttccggacgtagaagagctatcgtcgggtagagcaccg

SEQ ID NO: 4683 - DNA, 700 bp, Nannochloropsis_gaditana
tctctcaaggtcggtgccgccgagagcaaggcaaagagctcaaaatccgggccgacgctcacaaccagacagtccgtttcccgcagttcgtatactaagctgtgcacgtttttcttttcaaagacctccatcatacaatccacgcagcccttaccgctttctccactgtcatcgctccgtcgccgcctgccccctctgtccgcatcgtcagggaccctgtccacgccactggatgagggcccggaagatgctgacagggacgttgaatgcctttcacggttccccacgcccaccccctttcctccctcccctcccgcatccttgaagatgcagtccatgcgatcccccgcgtgagcccaaccagtcccaccctccctactcccgtaccgcaactgcagtaaggccttcgcgtataggttccagaccgcctgcttcgcctcctcgtccacgtaggggaaaaaaaaattggaggagatgctctgcggtagggcccttgccctgtcgctcgtgtcccttccgtctccttttcctccacttcctctcccattctcccccctccctccctctctccctgtcactgggcaaaatttatacatgaaatgaaaggccatgccggcgttcgaatatttgttgagcgcccgttgcctatgctctccagccgccgcctccttcaaagcagcgagccacccgcgctcctcaa

SEQ ID NO: 4684 - DNA, 247 bp, Nannochloropsis_gaditana
gggaggaacatggtcgtcatcgtctgcgacggggtcggtgacagagctgtccgtgtcgcccttggagggaggcagctctagcagtcgggtctcgccctctccccccggcgtggagtgcgaagccctccggaaagcctgctcggcctcctcctcaagcattaccctgtacgacactgtgcccgttgggagggtgacggaatggtaccgagaatgcggggagacgagggagcgtttggattcctggatg

SEQ ID NO: 4685 - DNA, 700 bp, Nannochloropsis_gaditana
cctcaaagactttttcgtgctttgtttccttcctcggctccccgtgacgcgcctgctttcctgttcaagacaatcgcaacactcctcccaaaaggtacactaggcacgcctatactcttccaacttagatgagaagttgctttgccttgtaagtgagaagatggggaggcgggaatacggggaaaagtcaggggtgcgatatctccatggaagaagcaggagacgagtgctcgggctcaggaccacgggcttgacagaggcgcctagcggcttcatgtgtcatccacactcgcaaatatgcctttccaagctctctttgacaatggcaaggtggtatcctccctcgacatcgacgacaaggccccaaggacgcaggcgcgtgaagctgacgaaagccgcctgtcgtggtgatcgatcaccagacttcccctatctcccagatcagcggtcctcgactcacgcaaccacttttcgtacaactctagctgactgtgaccaccgacgactcaagtcataagatgaggagttggcagggtatctcttctatcaacatgtactctcctctttctggtgtgcgacattgagaccatcttatctttccctatactccgtctaccgctacaacatgactaggttctccccatccggtgcccttttcctcattgccccagaaaactagaccgttgacgccgtgacaatg

SEQ ID NO: 4686 - DNA, 700 bp, Nannochloropsis_gaditana
gcgatatagatatataaaaatgtacatgagcttcatgccctatgtcacctgccgtggcaactttctgcgcgtagtgtgctgtgtcacgctcaaccacccacctccctgcggccgctcgcccaaattttaggccccggccgcaaagatttgacaccacctgttctgaaaacgccctggaaactgaccaactatgcctgacatccgtggcagcacgcccttcccgctcgttgcgactactgccagcttgcattgcggcgaggtacatccgttgtggtgtttttggactgcacgggagggtaatgctggatctttaaatcgaagataaagtgccgcgtcgacttgaattttggagagcgggcgaaggggggcgcgtgagacagggaaggcgggtcatgccaatgcagtttttcacggctttgcctttgtccaatcagacccgtcccgaacctccacgcagctttgttttcactcatgtattggcaccttccttgaatgtgaggccttctcttgtgctgatttgtgtcagcgcggtcatgcttacgcggctcacgctgtgaatcgctcaagaaaacacaccagctttcgtgcggttcggttccgagtggagcagccggcatctttgttagcgtgctcattcctgctcgctttcctcccatactaaagcagcagctcctatccaaccttgtttgcaaacattatg

SEQ ID NO: 4687 - DNA, 700 bp, Nannochloropsis_gaditana
aaagtggagcgcattcgacgtctatcttcagctttatctttgagtgacagcacaaacagatctgactctggccgggtaagctttcactataaaaacccgttcatttacgggctcattgaccgatatatatatattttaatgtcctatacgtctcatcggattgtttaaggcgagcgattcgacagtcacgcggcaacctgcacctcgcaaggctgcatcacgtagatcgctccgtcaagctgtcagcttttcccgtcaaacaacgtttccaaagccactcttttctgagaaacgaaagaagcaggatacgaaaaccttttcatcgacttcgatatcgcctattttaccaagtactgcttcaattgcatccacgcgtgtggacgacaggagcttttccccagaatgttgcaggagtgactatgagggttcacagcgagagcagcctcgcattacgtcacattttactatcgaaaaggtatacgcacgtgtacttatatatatctttttgtgccaaaatattcctaagtcgtccggatacttgtatttatcggtgcacaaggtcatgactgtgttgtgcgtacaaaaactcatgataagctcgttaccctcgtaaatgtaaagattcatcgtacttctcattcaagtatctcgcaagcccacaatagctctgagtttgctatcaactacttctaaactcatg

SEQ ID NO: 4688 - DNA, 700 bp, Nannochloropsis_gaditana
gaagcatcagtcacattcgctctgtcaacttttaatctcactgcccttttcccgttatagttggaaatgcagcaaatatttcttgattgtacaagctgtcatgaagtggccgtgaccgctatcgggaaagatgttgcactcccgatcgatcaaaccaatgctctcggccatagcttgagtgagcaggaaacagagagatatatttttggaagtttcgataagtcctcacgcagctccacatattgattgattgggaattgagtcgtacattctcctgagcattgggtgtcattgctgtgcacgtggcgtttccgtggatttcgcccgagatttagggacgaggaaagagacccggatatagagatgggaagacaccacataggcatctgtgaaagcgaaaatgtatgggaggacgaagatgaaatatgggatcctgctggccgatgtcgaatattgcagatgccaacttcgttgttcatggctctaccattccttgtacagggagatttaacctagagagtctgcaacaaggagttgcgagctctagccctctccctcactccctgaaaaaaatcccaaaagtgacaatttgcccgaaaagagcttgacgataggaagataaaactgacagcagcattataacacggcagtacgcactcgataggatatcttgcgaggagtacgaccgggtgcagggatg

SEQ ID NO: 4689 - DNA, 700 bp, Nannochloropsis_gaditana
ccgatcaagaaagtgttattcttcagaaatctcatccatgaacccaatgcgttaagttgatcatcaccccttacctaccgctgtaaagtccggtgccgcctgaccgatttttacggcggggggggagtaagtcactgttcccatggcacgagctgccctggaaagaggagtgagggaactcgacttgggaggcaaggcggccaaaacgccgtgacgagggcgcaccaggacgttgatgccaacgcgggcaatattgcgcatgatcattgtgttgtgtggtaccttttggggggctctgtagcatgtgttcgactagcgcgtgagactgcatgtaatgcttctatcaaaagcagcgataggaaagagtagcatgacatatcgaccctgttttttaaaaaaaagaaattgtgctgggagggggacagctcagcttgccctctagcaggcgcaaatcagaatcaagccatgtcccacgagtattcttgaattcgtctgtggagcttgacatttctgggtagtgaggcataaaaattgcgctgaacgccatcgatccaaggcccgtcctactactagtacgtgtccaagccgtctgtaactcgccaccctcgtcaaaattcccactcactaggttcacaagggccttattatcgactgagaagagcttacaagtctgcgaggctgaggtgtcagagtggtcatg

SEQ ID NO: 4690 - DNA, 700 bp, Nannochloropsis_gaditana
cttgacggcttactttatccccttgcacgtaaaaaaacagaccagaatgtgaagagggcctgaacgtggagtggaacgtcacaagggagggcagctcgccgcagggaaaaagcgaagcgatgtctcctgccgggggaaaaagacacggcctctgtcttgtgcgggtacatatgatttattagagagcgaagatggacagagttgccgtcgcgatgtgagctcgttagcttttttggtttctaggcggggctgggaaaatatgacagtgtttctatttcccgccttttgcgatcctccaagtccttttgttctacacattgtatctcaaggtgtaacaattctgtcacgtgttgaccacgtgatttccgctgagtcggatccatgacaacccgggcctgggatgaaacacaaagcttgtgtacatgtgaatggtgccttcaagttttcctcgattgacggcaaaggaacttttgccgccatatctcctagactgcccactttgaagtaaagcgtaccactgccagaaaatccacacgttctaggaaacggtgagatgccaagagatgtttatacttcgttctatcaagacgctcccgaccaacatcgatggtaaattccccctccactacctttgaatagcatcagagacacggctgtcaaatttgtacacaggcattgacctgcagctcccgaggctatg

SEQ ID NO: 4691 - DNA, 700 bp, Nannochloropsis_gaditana
ccaccccggaccctgcctccccccccctacccccgacgccgagggggtcttgcgcgtgggccgactccgggtctgtgtggaggaggttttgggcttcggctgccacgggaccatcgtcttcaagggcaagttggacgagcgccccgtggccgtgaagcggatgctgcgagccttccacgcggcggcggaccgggagatccgcctcttgatcgagagcgacgggcaccccaacgtggtccggtactttttgagggagcagagcggggacttcgtctacctggccctggagctctgcgtgtgctcgctgcgggacgtggtggggcggctggaaaaggcgatggaggctgtgggggagggtgggggcggacgccggtgggcccagcagagccgcagggtctttgtggggaagctctcgcaacgagagggggccaaagacggggcggagggcaacgagacgcttggcgtggtcccggcgcctgtgcgcagcgccctcttccaaatcgccaagggcgtcacgcacctccactccctgcgcatcgtccatcgcgacctcaagcctcacaacatcctcctcgcctccgcctccaccaccccctccgcccctgcctcccactcgccctccgccccgtcctccattccccccctcctggtcgacggcgtggaggagctcagccagtacgtctgcaagatcagcgatatg

SEQ ID NO: 4692 - DNA, 691 bp, Nannochloropsis_gaditana
tccccctcccctccgccaagcctccgcccgcccctccctccctcgcatccctcaccaccatgaatgccccgccggctatcccagcagtctctgcaccctccgcagtaagggccagggcggacgcgccttcccaccgtccgcgtccccctaccagtcgcctcactcgccgccttgggcacggggaggggcaggggagggcgggaaagagggcgggagggagggcgggagcgaggacgacgagtgggccctcacgtgccggccgggcgagcccgccttccccgcctgcctgctgggactgcaccctatcctggccttcccgcccatcgtggcctccagcccttcctttgccgcctcctcttcctctccaccctcctctttcccctccccctccttctcttctctctccaagccctctacgggaagcgcccagcagcagcaacactacctactcggtcttccgtggccccgcctcttggacgggacctccgccccgtcctccccccctccctcccccccttcctggtcctggctttcgccgtcgacttggctggcggcgtcccggggcatggacgacctgcttctcctcctgcttcttggcgtggctgcccttctcgtcaccctcttccaacgctcctccttaacctcttcctccttcctgcgcccgttctccccatcctccctccccaccccg

SEQ ID NO: 4693 - DNA, 700 bp, Nannochloropsis_gaditana
ctcctcctgcccgtagcagtcttgaccatgtctatttccactcatccccgcttccactcagatgcccttatgaatttaatcttgccaccgggctggaggtgcttgtggtggaaagagctatcatgggcgcttgtgcttttgtttgtgtgcctttcaaggcgcacaacgtcatcgtcgctcagggacgctcggcggcagcaaccacaacaccaagaaccagacattttcaggatcaacggcgacaaacatcaaaatctgcattcagatgagcctgctgccataattgcggacgttggtggccgggggggcataaatgcggtgcaaaaatcggggcagtcatggcattctcctgctaagggcctaggggaaggtgaaagcctggagcctgaaaagcagtcaagtcctcaggaaaatgcacccttgtcccttcatcatgagtccgtcgagaatatttaccgaagtcctcgattgcaagaatggcttgatcgggtcgattctacgtattctgccgacgaagtggacgtggagacatcgaaagccctcgccttgaggtacctggaggagcgcagcgacttgaacgactacgaacgagctttccacgacctagcagcggcctacaacctgacaaatgcccataaatttccggagaaggccctgcgcttgacccagtccagtggggggggagacgcgatatccgatg

SEQ ID NO: 4694 - DNA, 700 bp, Nannochloropsis_gaditana
atcacagcctttaattccaccaatccaatgaatgtggggtgtttatatgttcatcaacttttagatagcttttaccattccttggactgtttttgggggcattttatcttccaccttcttggaaggttaccgaggacgtgacctctcgtctgttcatgtagcgagtcgacgcaaaaagaccatcaaaaccatagatgcacaaagcagagctttccgatagggaagtgtaaacaaaaagagggctaaaaagggactgcggacgacatgagttattgttgtgaaggcagaattccttcaagatcaacaagaaggaagaattgaaattgtgcgaactcgattcccggcctactggaaagcaacagccaattcctgaacgacatttcaccttccaccgcctgcattcttatttccttgcacaggtcgacgatttccagtggctctgctttccctggtgtgcgtgcacgcatttttttatcggccatccgcattccattccatacaacctcctcccttccgaagggaccacgtctgcgcaactgaggcacccccccaaaaagaaatacgccgcctttaagtcctttacacgcgcgcaatcccccccttctatctccgctactctgtcttgagcagcgtggcctctcatcgacgtggactcgccttttatagaaagaatggatgtggcatttcttaccccgggatg

SEQ ID NO: 4695 - DNA, 700 bp, Nannochloropsis_gaditana
atcaagaatacatcagtcaagccatgagtacacctagaaaggaaatacgctaaagtcctgcatgactatttgaaccaaaatgccggagttttggcgactttgaattcgttttggggggagagcaaattgttttcgaaggggagaggtcaattcaaagggggctaacggctgaagattaacggctgcagtgccgttgggaattggagaaagggtatacggcttttactaagtacccgacaaaagtgtagaaggacattgcactcagaattttaagctggccatcttgtactttcaccaagcagaggtgtccagtcttttgttctacatgagacccacctgctttgcttacatgtggagttgtacgatttggagcttacaactttttgaaattctgaattaaaccagtaaattgcttgagagtccaaactacctgtcctgtgtacttaaaagttgcgtgcaaaaagtttcccacgattattggtttgcaagctactctggaagactgtgtaaaaccctacaggccatgcttacttttcgtaattgacaaagacaggccggcttgaaccgtcgagcttattcttttcgtctgtttgccaagtcatttcactccattgcttatttttgttcccaatcgctaacacttatctgcttcattactcatttacgatcacttacaaaacatattttatagggtgacatg

SEQ ID NO: 4696 - DNA, 700 bp, Nannochloropsis_gaditana
tggtgcagctctctttcagaagaaatggtaaacgtaggatactcgcctgtatccggttacttcgttggagcaaaggcaaaatagacttgttatgttataaatgatgcgagcttacgttcgtgttgcaaattacatcctggtcgcgtacccgataagcttgatcgagctgagttctctttagtgtacaggtgccccaacattaccccatcatgtctcacttctttacatttcttcatctacatgcaaagcatagaatatgacatctcactacatcaaagtggcttttattcttttggccatctttgccttgcaagtcgagtctcaaaccgccagacttccagtgccacaacgatcgcaaggccttagcggagagccttggctccccagaagattgaaggaactcgtacattcaaccctaaagcgatgcggtaaaacttgtcaagatcaacgtggctcttcttttcgtgactatcttgccaaacttgagaagttccccgaatatagtaggacggcctctgaagaaacgacgatcaatgtaacacgtgatgatagttttctttagcgtgatttacttctgaaacgacgaaaaagacagagaatcagcaagagaaagctccagaaacagctccagcagtgtgaggcaagcatccaggagacgcaggtcgccttggaggccccgagacttctgtttgtccaaatg

SEQ ID NO: 4697 - DNA, 700 bp, Nannochloropsis_gaditana
gtgacagaagaggacatgtagcggcgtagtggacaactccgcagtgcgaatggggccagaaagagagaatgctgcccggagactctcttcacgcgctccgcctcctcttacgttcatgttgccgtcacctcccgccttcgtctggccaccctcgcagcatttttcactcctgaagtcgccctggcgtccacctgcctcattaatatcacttttgccactcattctcggcacgcttatccagtgtccattggacgttgacttgtgcttctcgtcccgagcaaacgccgtccccgtcagcactgcatcgaccacggaaacacttttatcgggtcgtctctttcacagcggcaccgatgagaaagggagcggtaggacggattttaagacatctttatcaataagagatgtcgcaatcggcagtgcgggctcacctggaacaccgcattttgctgcttcatcctcactctcgtccctgccaagcatcgtggttaaaggaacctcgtcacctgtcactcgcccagcacagtctggaattccagctctacagtccctttgcggcagtactggcgcttcttcggctacaaggtcgtcgttgctatattcctcgttgcgtgtcataggtcagggagcctcgggcatcacgtacgtccttcctgccgacagctacgactccgatatcacgctcccgggacttgacatg

SEQ ID NO: 4698 - DNA, 700 bp, Nannochloropsis_gaditana
gtgacttcagacatgaaaagcgttctcctactctttgtgcaaactgaaaccccgagagatgacgtgccagctataagacaggctagccgccttgtctgcacgcgcaacagaatccgaggcgctcagcgccgcggcctgtgtgtcaatgtgtacaggaatatatgtcggatgtagaaagagggaatttcgattctggggcattaagatttgtccccaaagaaagtacgcgcaagcacgaagtacgacacgtcctggtatttcaaagtacttgccgcgaaagccacggccatcgatgcctatcaccacttcacccgcacttcctcctccacattccactgtcatctttatcgatacctgtccacacgttgtgccgcgggcgtgcgcccattaaaaagagtaccccttttgacctggaggatctccctcacttgccgttgcgctcgccctcccttgacttgaagccagccatgacgaggtggaagtacggtcccatctgtttacatggcatttgacattttcggatcctttggcacaccaaccatcacacacagactatggagggtagttggggtcttttgttcggctccaacttccattcatgtttgtaaatgcctgggcgtaagcgaggcgaaagcaggtgcttccgaacaggacctttcccaggcgtgttcaaaggggtactgggtcgaattcaaacatg

SEQ ID NO: 4699 - DNA, 700 bp, Nannochloropsis_gaditana
agaataaacgctttgtcacgtctgggaagaatgggagaactcccaggattgtcgcagagcatcgtctttgtcggatcctttcgatcttagtcaagggtgcgtacacttccgagcgatcttttagcaatcgcgtcaccacagttcggaagggtaaaaactgtatcagtagcttgaattacatcctagccatgccgccaatcgtgacctactgccactctggccatatggaaaggagtaatgccaagttatcatgaatgctttgttacaccagtagttgacggcggtaaaggtgacattttcatgcgctggtgcctccatcagcatgatcattatgtccttcgtctcaagcgcaccaagaatagtacacgatgacagtattcacagcactacctccacgataaatcccgcaatggggctgcagcctgccgagaaagatatatgggccgttgtgacgttacaaaaggcctcgtcaatcggccgggaggagggaatgacgatcttctcaagtgcgtgttccacggcactgagaaagccccttgacgtgccgtctggtagcctgccaatgtcttttagtcggtagtgaaggataaagtgatgtctttgtgacctctcagctactttacgggtcgaattttcttcatttcaccattttttccccctctcattcttccccgacccgcacgctggttttctaggcatg

SEQ ID NO: 4700 - DNA, 700 bp, Nannochloropsis_gaditana
tgtttttaaggccattcccgccgtgaagacccctgaaaagggaagctgccgtcgctgccgccatacccgccgtgctcgtcgatttgggtttgtgctcccgtcctccactgtcttccgacgtgctggtgctattatcgtgcgtcaaaccgggtgtagatgctgataaagggtcgtctgccggatcttttattggtctcgttgttacccttgtgggacttgatgggcctgtcccttgagcctccatcgtgccatatagtgacccctgagggaacaacacgatcctgttcatggcataagaaaggcagaacggagaatggtcaagtcctaatctctacatgcggagcatggacgttttaagtttagagacaaaagctctttaacgctgtgtagtggtttagcgagcccgcggccaaagccctccaacgtcccaaagagcggcttccctcacacgagttcccaccccgaaatataccaggaacctttagcctcatgtcgtcaccattgttttgaaagtattctgtgtttgtttgtgcatgcacatgtatttttgcggcaagtgtcccctgcctccttgacgatgaaagagcgaggatcaccatggattggcatgctgcagtcagatactcatatattactctccgttatctttgcctctcttctctctcactttattttataattacagatagtgagagtgatg

SEQ ID NO: 4701 - DNA, 700 bp, Nannochloropsis_gaditana
ttccctggatgccaggcgggactctcttcatgcggaacccccccttgcccttcgacgtggtgtttgccggtcacgtccctgaggacgtgaaggaggagccgttgaacatcgacatgacccccgtcgtgaagggagagaagggcgacggtcgtgttctggtggacagcgccaacaaggcgtatttctgaaagggaggcgaggggggaggaaagggacatgtgtatctaggtagggcgggggagcatgatttgagtatctgcaaaggagcgagaatggaaaaggcatggaggccagcgatgccattccaagggaaagaaacacccatcaaatggcagaaaaggaggcacgctcgctggcacttttcaggggtcttgaaaatagtctttctggcaacgccgacggggaagggagtggcggtagagccaagaaaagtgggaagaggagcatgtgtacaagcgcacatgagccttgtcgcccagcgtgttggtctcgccttcgtttttttctgttttttagcggggctctttgatgaaggaggaggaagcaagacgcctccccccctcccgaccgcaacctaagcttatcgtgtcctactcattgattcattaacgctaattcactgttttgatgccatagacctcgcattcctatttatgttcatgcaacgtgctgtccatttcattgatttttggaaacaatg

SEQ ID NO: 4702 - DNA, 700 bp, Nannochloropsis_gaditana
gggtgggaaggagacaaaacgttcaatcgagcccaaaggccatacagaggtgttggcggagtacaagccccagatggaacaaatgaatgaaggtagcgtagacgagaggaatccacgcatgaccccgttgcccatatccgagggcactgcggacgaagacaaccgcgaaccccagggtccaacggacttgaccggcgggaccttttcagggcctaattaccgtgataggatggatcatttttacccacggcccctgccggattctgggaaggccgattatgtggagaagcaagcccacgaacaccatctacatcctccgccttgcccgacttggtggtcatcgacgcctggactttcaaagcctgagatgagtgatcaagaaagagtacagcagcttcgcaccccaccttgggaagagaaatgtgacggagaatggggttatgagggttttgcacaaaaggcagggcgaccatccggtcccgggcagggacaagaggggtcgcatcaagacagaggggaggacgatttcttgaaaagatgtcacgccttcagcgagtccgtcgcctacgtccatgctttcgggaatacacatcccactgcagcctttacattaggagtgaacaatatgagcgactggacctctgaggaacggcggtatttggggggctcccgggccgtgcctgtggacacggaaaagatg

SEQ ID NO: 4703 - DNA, 700 bp, Nannochloropsis_gaditana
agacgcgagcgagtaaatggatgctaattaaaaaggcgtggatcgatggaaggatttgcgaatgctactgggatgtactgctgtcacggttgcctatctacgagcgaagggcagggcctggcggccgcacggcatagagcccccgtttgacaaagaaagacaaaaacctgttgcatgagataggcaattttatacatggacgtgagccgaatgtgacgagaaaatcgaaggcttcgtgacatgataacctacgcacgattacatacaaacgacttcgctgtcatgcgtccttgatatacgaccgcccgctgtggctttcacaaactctaatttggaatccatccaagctgacaatgacatgtcccctcgacaattccaaacgtgacatccttacgattttccagtatcctaagcgaaggaatagtgtgtcgatggccatggcggcgctcgctcgagtctccgcgactgcgtgtgagcgacaggaacctagacctcctaaagaatggactgctgtaagagtatgacaaccagaagaagccaatcacaccacgagctcatgcacgactgcttacaggcgtatcagaatgatcattctgccaggatacatgcacccgaaaatttaaagttgattctgtccatttttcttctaccctccctccattgctcttttcggtcacgcaaaaatacagaaaagcatatg

SEQ ID NO: 4704 - DNA, 700 bp, Nannochloropsis_gaditana
gagggcgctaatcgataattgtccatcgagttgcggcacacagcacgccgacaagaaacaacgaattaactgtgaagggtgacgatggctttctttccttctcatctaggctccctggatggggtgcgcatcatgcaaggaaggtgagttgtatttttgggtcgtgcgtgagaacggacggtagaggagattgaagctgactggcgatacgagcagcatcgctgtcccccctgaaaaacaacaaaagagtgcacaagcccccaaatacaacgtcaaatactgagtttgagacatcatctactacgtagagggagatctgatgaatgagaaacattacagagatgaggcagggatgaaaaagatgtacgtgtcgacaattcggtcgtcatcgatcttccacgtcgccttgaccacgtcaagcaaagtgaattttgacccataccgttcattgactgacagcgcattgacactacaggtattgtttcgaaaattgccgctgatggtggctactgcagcagcctcatatatgggaggcaacagaagcagccaccgtctactgctattattcccaccgtgttctcaagcagggaatcagctgatacggttgcgctggcttagatttgtcgtattgttgtcgttcatcgcttctcaatgtccttcttgggcatgtcatgcggtatctagcgggacaccagcaatg

SEQ ID NO: 4705 - DNA, 700 bp, Nannochloropsis_gaditana
gcatgcacagataagagagtgctacgcacggggagggcatgatcagcgtgtcgtgctgcacgtctccggggtttggcgtctacttcgcgcagggtcacgtgggaggacgtcgaagtcgcgctttaagcgaataaggacgagcattccgtggggtggtgactcaagcgacgattatgaggtggcaagccaaggccggaagcaaagcccaaaattttggtctcaggtacccgaccagctcctcttttgacacgagtccaccacgcgtccatgtgaaaaggtcctcaagtgcatgctagtgtgttcgacacgatcgacacctcggtacccgaggtttcaatgcaaggtaaaaattgcgcgaaatatttttttttcctttttccggcgaaaaagaaagtgtcgtctttcccctcactcgttacgacctcatgaccggacaagtctcgatcatgcagatggctcctcccttccacacggatcttcatgccacaaaattgaagtatacgagctggatgtgttactctcttcatcgcttcggaaatcatgatatggtgtgtgttgatgagcgcatttaccgagtatcatcagttaaaatcttgaagtcagaaacaagccttgctggcatcacaaatatgaggacatgcttaccttactcttgctatgaatggacagacagggtcagcccaaagtcgagggctgaatg

SEQ ID NO: 4706 - DNA, 700 bp, Nannochloropsis_gaditana
ggatttcgtagaaaccagtgtcttcggaatgtatatgttccagcatgtccggtatttagacgatttctcggcagggcgggtctcctctcaagcagggccgtcacccccaccaatatttggtcattcatgattgaaggccaatgaatcgatagtcagtcatgactcatgcataagactgtgcccgccctgaaggagcgatgtccaaactaggggggatcaaaggggggcttaggagggactaagggtgcctcgcgggctttggggcgaaaccccaggcaaaaacgcactttggagtgtcaaaaatgcattttcaggcccaaaattagaagcccacacatttttccaggccacccttactagctgaagcgtcattcatgaatgaaatctcaccaatgattggtgacccatcgatgaccattagcaggggttacgaccctgctctcaaggcttgcgcttttcgcgccctcggcgagtcttgagctgtctgtcggacggcggagacgacatagcagacttttacccaaagagactcgggaaggaccctctcgtgaacacgttggcaattgtaaggaaacttgtgcatgtacttggtcgtgatacgatgatagattcctttttgacagcaatgcacgcatttcttatatagatggcgcagggctgcctggttgtggaggagaaagggaaaagaagaaatctaccc

SEQ ID NO: 4707 - DNA, 700 bp, Nannochloropsis_gaditana
agcggcgtatcttggacaacatatcaatacgatcggtacttcccttcctgtttctctcccctctcttgcccttttcgccctccaggctcttatcctctatgaaacatatacttcctttctcgctttgccttcaaccttccgttctggttttgccattaggcatccgtgcccgcgtcaaagagctttcccgaggggagagctcagtctgtagcggcttactcacggcggataccaagatgacatttcggtatgccctctgctgttttcctgtcttctcgcttgcccttctcgcgatctttatatctgccccgtttactcctctcttttgtcctcattttgaacaggtcccgctcagctcgcattttctggctcgtacagatgtcttacgagatgtgggactatgccccggacggagaaggtatagcagcggaatggatgaaaggaagacagtgaggaagtctgtgggtccctgcctttagcacagtcttctccagtttcttgcttcatctttcgtcgtcactccatttttcaaaaaaacacagtatacctggaaaaattcctctcattcgcacgcctgctgctggaaaactggcgggctcttgacgtttcgcattccctttctgtcgtcttctttacccgactctactaccatcctcccgctttcgcggattcattttctggctccgtcgctcctgggatg

SEQ ID NO: 4708 - DNA, 111 bp, Nannochloropsis_gaditana
ggtgggtgtggctgtcggcgacgtagtaggtgtggcggtggctgtggcttcccaacatttttaaaaacactgctccacgatgatcaaggacaaggcgccggcgtgggcatg

SEQ ID NO: 4709 - DNA, 700 bp, Nannochloropsis_gaditana
gcgctttcccagactcgcatcaatggacattcaaccaaccggcaaccccgcttgtaaacgagaactcgacggtactcatcacaggcgttgcaggatttattggattctccgtggcaaagttccttgctgagcacaccaaagcaaaggttgtggggatagataacttcaatgattactatgatgtcgcacttaaatacaagagagcagacttgctgagtcactggaacacggtccaggtcttagatggcgacgtttgtgacgctcccttcttgcggagtatttttgaaggtcaccatgtaactcatgtacttcatctagctgcgcaagcaggggtacggtattcattagagcagcccttgagctatgtcagaaacaacattcaatgttttgtaacgctcctagaagagcttagtcgattaaaaggaagctcgaacgatagtgtggttcctcgctttgtctacgcgtcctcttcaagtgtctatggcgggaatgtggaaatacctttcaaagagacagatcaggtggacaacccctctagtgtttacggcttctccaagcgagcgaacgagctcttagctcttgtgtatttcaaggtcttcggcattccatctgtcgggctcagattctttactgtgtatggaccttgggggagacctgatatggcaccctacaagtttactgctagcatttccaaaggaga

SEQ ID NO: 4710 - DNA, 700 bp, Nannochloropsis_gaditana
gccatattctatatctttgtatacttgagaggataggaaaaatggatcccgtgccctcttcgaaccagcttattccgtcctaaaaaccattcgaaaaacggcagcaactgtgccaaaactccccaaaaagtgccaggatatatattccattacaaaagatgtgaaagaaagaattgaccggcaacactaccggccacagaatttcttagcttgtctcttcaacggctcgcctctcaccatgccaggtccttaatatgcatgcaaggagaggtaaatattgcacacaaaatgtaatcttgtgaatacgacgaataaaatcaagcccttagcaaaatatgaagctcttagccattcaatgaaaggactttcgtggcctcgtttcctccgagcgccgttcaattgccgcagacaaaagcccatcggttctcttccatgacttgattaaactcgattaattgcaaaacgtcgctattaagtctcagcgatacgaagaacattcgcatgggctcaggaggacactgaacgccaggccaacctgggagtggacaaggcaccatttcttgtattattgtcacacacacatgaagtagtgcgcgtgactcaatgaatgcggtctcatttaaactttgatcggggcccccagtcactgactcgcgctccttgatcacatacacgccctggtaggtctttcgtgagaatg

SEQ ID NO: 4711 - DNA, 700 bp, Nannochloropsis_gaditana
agttccatatatgtagacaatgaatggaatttcggactttaaaatatgctgtttgtgcgcaactgtctgcggcccacaagaaaggcaagtagtctctgtgcgtgcgtctttccttcaaaagcaacgagcgccagagagagagagagagaggcccatactcggtccagccgcgagagcgctccgccgacacccgtgtcgatgtggcacaaccctcatgaatgcagtgagtggccttcaatgcagccacaaaagtatggttgcgggtatcttggttgtttcgaaagtgtcgtttcttttcaaagaattattgacgtcaaagcagggggcccacaggcgtggaaggcgggaagacgggttgaagggggggcacgagaaacaccccttgaaggaaagatggacgagaaacatcatcacagagagagtctccgggacgagaaacacccgccgcccgaacgtgagaaaaggcaaagctaggcctcccctcgtccatgcccaggtttgtgattttttccacttcgtagcacgtttcgcgaaagggagtgttacacgtgtacaaaataccatactttcggatgtgttgcttatcattgagcctctatcgttgacttacaccaaatagggatcatcgcttcattcacgtaggcaaagcactttttcttgttcatcttctccgcaaccaaagtcaccaaagcaaactatg

SEQ ID NO: 4712 - DNA, 700 bp, Nannochloropsis_gaditana
agcaaaggggctcaaacagaggtaacaaaggatctagaagacgagcctaaggctgcttttataaaagataaatccaattttgcctgtgtggacgtattaggaaaaaggattagccattaaaaggcagggttgatggcgatggacaggttgaacacaggaggacgttacgatacgtcctaacaaagagctctaccctaaatatgcatggatttctgtcgcatcgagctcatgtagtaaacgatttgggatttcatcttgcatcttgcgtggaaagtttggtgaaagataggagtggaggcggcggctcatgcgtttattcccgacctagggaagaaggggggtggatggaggacgggcggggaggtcgccgggagcggtcctaagacgcatgttccttctatgtccttaaatttggtttggctattgttcacgtccagctcttgactcggatcttcttgcacgtgcttgtctttcatggtgatttgtcctgtatggtatcgctctttccgtttgacaaagttttgacgacgcccacgcgtccttacagcatcagcccgaggccggcttccaacaagatcaacggagtcacgggacaacaacctttatctggcagcagccagaattaataaatgtgtgcgtactcaaagtcctcctcttcacacggcttggaggggaacaaaacctgtctatcagcatcatg

SEQ ID NO: 4713 - DNA, 700 bp, Nannochloropsis_gaditana
gggtatagtggaaaaaagaaaagggagggaggagcgaacgcgagcgaacaaacacttgccaggaaccatttcccgggcactcgcgcttcacaaccatctcgtactatacaggaaccaatttcgatgtgatggtgtatgatgactgcgcggaacagtgcgtggagagatgacagaaaatagggcgggaacgtgacctctccaagagagtcgatgaggtccactgggttaaaaaacccacacactgaataaacttacgtccaagtccacggcttaaatcaagtgacgccacggctgctgtgctttgtagtgccactgttgtgatacttatgcgagtaagagtgcaggtaaaggtaagtcttccgattgtgcggcgatgttgaaatggagaagcgtctcgatgggcctgaggaggaagacggaggggaactggttgcttcaataatagaggcactgacgccaggaggctctcgaatatgctctcgaaaccacgattcaagtgtgccgtgggtagatgtgctaaggcgaggcttcgacaaggttttttctcctctggaaagcagcctgcagctgtctaggtgacctcccgcccagtccagcccagcctcaggagttaccgagttggaactagaatttccttcaaatcggcttggcgccccaattgtcggtcttcagtgagctaattttgtcctctcaatcaaac

SEQ ID NO: 4714 - DNA, 700 bp, Nannochloropsis_gaditana
ggttgtaagggggaattgagtacaccgtgagagcggaggtggctcgtcctgaaagtgctgacatgcgatagacaacacccagctctttctgacaaaccatcagttatctttctaaattaccacagtgaattcaaagaagcgatcgctccaaaacgtaatcttctgttggcattgatgattcaatccatgtgaacgcgtctcagataacgagaacgtattgcggaggcgctgtgataaaatatctgcctgtccacacacctacaaacgcgcactctcctccttacctgtcctggccacatctatttcaacctggagctatgccacaaatatgcagtggtccctttgttccctgcactgtaagatgtgagaattttacccgtgtgagccgtgattccgattttcttccctgtttcacccaagcgagaggacgtcgcgggcgctcgccgtgctcgccctccaattcgagccaacaggcctcgatctgcccaccccgtcagcctgccagctttagcttcagccgtaacttacgcgcacaatccgccggcgaagaggtaactttatctctccccttgcattacaggaagcattccatgtgccgcagcggtttgtggtttattgcgctggcctttctggcttctattgccacgtctacagccttcctggtaccttttccggaaagacctttgccatgcacacgatg

SEQ ID NO: 4715 - DNA, 700 bp, Nannochloropsis_gaditana
agggggggaaagcaaaaaagagcagtgctcattattctgaccgacttgttgcttgtgatttttaaaaaatgtggggctagagaaggaggctctcgtttctttcgtttaaatcttgagtagactttatttcaatggatcacttgacagctcgtgtggattcagtcgaaagaataagtgaatagtttaacatgtattcacaggtaaaacttaattttttgaacggcagcttctgtactcttttatccttttgcgtaccagtaaggggaatgccattgccgtaagtggcacaggttgcacgtcagggtagaaaagatgtaagaatttgtaccacaaagctgaatttgtatgagtagatgccttctgcattttgaggtttagaagagttatccgttaggtcgatttcaaaaaatcaaaaatgaggccaacggcacacgtagggcacgcgccttagatcccggttgatacgacgactcacctgccccacgcgaatattgccttgccaattaaaatgttttcttaattgtgtctgctgattagtaaaggttcactgtcgtagattgcaacatttaagagctgcttacaaacaactcgaatatgaatatgggccaaaaagccaaaaaccgctacgttggatctcgtcctcttttcatgatcctccttcccccaaaatgtataccgtagaaagtaaaaagatcagatg

SEQ ID NO: 4716 - DNA, 700 bp, Nannochloropsis_gaditana
aaagtcgagggctttcagtctttccccggcattatgcactgtaaaccaacaaggcgcaatgtctccctctgatatttgcttctcattcattgacgatgagatatttatttcagaagaaatatcgtgagctactaaagctggaatcctagtcgagaacaagccctcctttgaggcgctatcacctctatgtttgagaagaagcatggagacaagcaagagcaaggtactaagaagtctcagcaatgatctcctcttggtacgaatagaaagccaactcctttttaggaaaatcattggggtagtagcgctttccctatgtgagaaagcgttatccgcaaacatatgttaagttctgtgtcattgccacatgattcatttgaaatccttagaaacggctcgttgtcagttaatcggatttaacggcaagatgtcggggcacgcgcccagcacaagcgctttaacgagtacccctataaaagtactgtgcctctaacgcactcaatggaatgatctatttcttatacatgcgagtaatgagaacattttacaccacacagctggtgtctctcctatcctctttttactatgcaccgtcttttgcagccaattttcacgctctaatccctcctatggaaacagggcatccattcttcctcccttgactctttttttgggggtcagcgagatcgcacttagaatg

SEQ ID NO: 4717 - DNA, 700 bp, Nannochloropsis_gaditana
atggaaaagatctacgtcacagaacttcttccatgatctttcaaaaagtatcgttcaggcaacaaaattgtagtaaaaagagcaattaaaggttatgtcttatcattacgatcgtgccacgtttatttattttaaattaaatcgctacgttgaacttaatgggtgagatttttaactgtcaggaagaaatcggggttgcaacatgaacttccgtgaaaggcccgcagccctaaccctaaaactaaatctgttttagggttgagctaatgaaaatacatgaagcttcgggatcgagtgagattctggtaaaagttgaggcacgcgccctcacaacgtctcaaatcacgtcgaagccggggaaaccgttaaatgaaacgtcttcgcacgggagagaaggcgcgtgcccctctccatctcaaaagatgtccaggttccctgcgcgtgcttctcagattgatatcctggaagaattcttggctagttctggacttgtgatttgtttcgtgggaagacatagattcaagttgggcccatatttgaagtagtgtgggtggtatgttgtacactctggtcttgcttgtaaatgttttggagcttatatttactgccagagcctcgagacacattaagatcatttccactactagttacagagaccaaataatagcagggacagcaactgaagaaattctacaccatg

SEQ ID NO: 4718 - DNA, 700 bp, Nannochloropsis_gaditana
tcaaagcagttgggcaagtaagtgaagatcgaaccacacaaatgcccaataggttgcacgctgtacttgctttgagttcacaatagtttgtacttgctcgccattgataggtcttcaaaaccgttgccccaagtgtttgtaatactgctgccatagcagtggtcatagcattcgctacatcgctaaacattcgaaatgcgtgcatgtccgaaggtacgctcacaaagtatggcccatacaagcaggaaatatagggtggatagggtaggagaggcgggaatgtgcgacggagaatgtggtgagaggctactgatcctgaggcgcgtgcccctcttctctctcttctcatctctgcgtggcgcgtgccggcatccggttacctgagaccacttctgcccacactctcgagcacgcgttcgaaccacttgcatgagaacctcgccgtgaggtgtgcttacatgcgaaacaatctcgtgactttctgattttcaagtgtataacgagatattacgacggcacgcgcgcgacttcaaaaatgtcgtcatttcgtgttcgccttaaacgcttgcttttgaaaaactcgacatacttttcccatgccattctacgcgcgacaaagctggacccctttatcgttctcatcccatgtttcatagttgaagtcatttcaaacgtttcgctttggtttttcaggtcgatg

SEQ ID NO: 4719 - DNA, 700 bp, Nannochloropsis_gaditana
tgtcggtcgacacaatcccgagagttatggctgttattgctgcataatataggcgtaggagtagtcacggggctactggtgctcaaggaagcagacagacgacacaaaggcttgagatccgtgctgtcaccacccactaacatgatcttgatgtaattagtacacttgcttatcgactgaaaaggcttcggtaaattgggcaccggattaaaagcggctgcaggcgtccataagaagggtgacgtacccatcctgctctcctcgagctgcaagaataataccatcaaagatgccacaatccaagggggccaagcctgccgcctcctcatcgtggctgctcaatgtatactataagctcacatatgtgattttaggctcgggcatgtcatctgtgttgtgaaggatgggattgaatatcatgtgcggcgactcgacgtaattgaagtcaagactgataggaacccagaggcagttcgagacgactggataacttggaatatgtgatgaatgaaatcacatttacggttattctacaagcgggtgcacaacttttatcgtcatggtggaactttttcggcatcagagtcctcgaagatgcacgattttttgacggccttgcctaaccaccttctccttcccatctgcaccagcagcctcatttattgagacaggcaattaatcttgtgtcgttattgccatg

SEQ ID NO: 4720 - DNA, 700 bp, Nannochloropsis_gaditana
attcatatcatgtacgccttccaagctcacaacatactggctgcatactgcagggcatgctcactctaggatagagagaagcgattcttttgtggtgccagtgcggtgaagacgagggaaacaagggcctgcatgacggacaacctctccatcgtgcatagcccttttccttgctgtctctcgtcgaattatagggactgtttcgctggagagggtgcacttatttgtctgcacgctatacagagacgctgttacctgaagaggcgctcgtgtcggagtcaatctgcatttttctcgcggtacaatatttgtggttggaggcccttagtcttcatgaaggctttcgaccaataccgttcgagacaccaatctgagatgctatggcatgttcttgggtttatgttgatgatatcacatggcaacgccgttcattgtccgtgtgaggaatgcgtcggtaatgcttaccatttttgcagcggcagtcatgcagacgcgaacatgggagaccctgttatctgctctttgtccccatggacgcggtggcataccttgcttgtcgcgtttgtacaggaatgtgtatgtgttgctcccctccagcattgtgcaaggcatgcacagatggtcctatcaatgggatctggcctggccgagtgccattgtcagacgtgctcctcaaagaatatgttcatctcctcacagg

SEQ ID NO: 4721 - DNA, 700 bp, Nannochloropsis_gaditana
accagcgagacttcctttctccggaaaagtgcggtacctaacaatggcaattcgaattatcacgactgtaaaatgcgtgacgtggctgagatgactcgtgaagagttgcaagccatgatccgagcccttgagagtcagtacgacatggatgccacggctttggaggaggcttacacatatcagaaaaagtatcttgaagacgccttacgacggtgtagatgacttggtacgaaagaatttgtaagaggacccccgtgtaaaatgtaatacgacatcaactaagttggaaaatgtgttttcatgctgatcgacgagcctctgaggtatcctattaaaaagtgtacctgaggcatggacgatggaaatttaaaaaaaattgttcgagaaaagctagcgacgtgacgtttatttcccgtgataatgaattacttctgtgaccatgtcatatgaaagtcgcttttggcagccaaggcgcagggagtggggaggttaaaccttcgatttcgagggtttgttcacgaaagagggcatgcacagcttttattgcgtaagacggaggtaaaatggtatgagatacctgacaaatttcaatgtcgcatgccatagagttcacaggatttgacttctacgtctctgccacacacaccccgtacaggaaggagtttatcgggtcggatgatttgagccgccagaagtgatg

SEQ ID NO: 4722 - DNA, 700 bp, Nannochloropsis_gaditana
cttctcacccagtcgagctgccaaaaatgtagttctatacgccctgtaatgaattacatgcaatgattccatgttgaggcgtcacagtccgtacaattttttgataatggccaaaatgccatcgggggcaggggagaagacaaaccgaacgaagcctcccctggttttcgggcgagtaaagcatgtgtcgggatgtcgtgaccgacacggccgcgaaaaatagatgaatgaggctctggaaacaacatccaatcctccatgtgagcctctttatccctgtgcctccgaggttcatgctgttgtcatactgcgggatttcctgcatgtcatgcaaccgcatgtctcgggccttccctctcgtcctcccttccttgaagtgggtgtgggccgctagatcctcgcaaacaaattaaagtaatgtaaaagttacacggagtcacgccgctggcaccctctgaccaatctctcatcgttccaaaatgacaatgcatctttttcaggctggtttcaaggctctaacctggaaaggcaagggcagaagaagcgttgggccgggggcccatttcggctgagaagtcaaggccattactattgtaagtcgcactcttcacgcgttgccattcgcaggtaccttctctcaccctctctttcttatgtagggtgctgctaacttcaagattcactagcaagcgtcgacatg

SEQ ID NO: 4723 - DNA, 700 bp, Nannochloropsis_gaditana
cctgggtcgagacagccaacgaggggtcacatgttatttattgccgagcgacatccataaattcttgcgaatacatacatttcatacatgtgatagcgtgacggtgactccatgccgccgccgcggggtttcctatccttcgtggcggtcgcgttggtcctgattatgtcgcccatgttatttatgaggaatcctgctgaaacgtatatgaaccttttgggaacgcgaggcttacggcgggaggcgaagatgtcaataccttgggtgattgaaggtaggtcgagactctatgggctggtaagacgtgcatccatcgcaagagcttttacatgcgaccccaatttcccaggagaaccaagggagccagcgcatgtgcgggtggtgatacggactcacgcacgggaacaactccagttgcgatctttaatttacgggttgcgcgcgcaaagcgagggacaagccggttttaaggcagattttgtgctggtcccaacggaatcagcttcgttgcaaacgtatcaacgactgtgtaacggtgcgagctactagtgtttgtatgcaccctttgactaccactgagcgtttcatgttaagtctcagccttatgattttgggtgttttaatccgcaaatgcacatctttcccctggcaatgtcggctcatggatagactttttcttatttttgcatgcgcagagatg

SEQ ID NO: 4724 - DNA, 700 bp, Nannochloropsis_gaditana
aaatctcaaccatggtgcagctagcacattgtgtactctatcgaaagactgtcatcgtgtgcagtgggtcttggagctctgccacgctgccgccacctcttgtaaacccttctcagagtgtgtgaactggtccaaagttatgttttcttgtgacaaagagggaatcgaaagacgtctacatcgtgcggaagtgccacccattccatggaacaaggtttagaaatagaaatatggtcagaacgaggctaggggggttatatcgtacatccgcgcgtcgactcacctttatgaatgatacacagtacttgaaatccacaaatttgcatataatcaaggcaagtataccgtttattcgtgctcatgacttgcttccaccagtgtttggccatgtactcattttcttgcgcgacctcaaataacctcccggcttccggcctaccctccgaccttcaacacgaaaagaccgacgacgcactccgtacactgcgtgcctgcaacgctccttactggtcgcactttagccggaaattcaggtccccttacaatatgtctgttttttggtacatttctttctgttaccctgttgacgcgtgttgacacatgaatgtggaactgaagtgggttgtaaagggctcggcagattatccaccgctttatccccgccaacccgaaatttcctgaacaggaccacgaggagatg

SEQ ID NO: 4725 - DNA, 700 bp, Nannochloropsis_gaditana
agtgtatgcctccggaaggaggggtagtcgtataagtgggcagctccatgaataggctgggtcgaacttcgcgcaaaaaaagggagaagctcgaaatccgaatataattttgaattattggagcccaataataaaggagccgaagatttcccaatccctcgtgctggtcaatgtcaaaacagccgcccggaaagccactgctgtgggtggatgtatgggtaaaggattgtgaaaaattcaacggctgcgtgagtagaagcgagtaccattttaatgctagaacgtactggcaaaaacttgaatggcaaggtgaaatacacctcgcgcccgagccagcagtgtctggttgggggagggaggcccccgaactgacgctatcgaactggattcgactacgaaatgggggatagtggacagattgtggtacgtatgacggtcctcgattatgaaagagccgctctgttttttaaatgatgtgatgtgcacattttggtggagagtcacatgttgctagtcgaaaaagtgctctcttatcctaagctttgtacctgtggcctccatcttcaagctaaatggatttgtcatccagatcgttttagggtaatcctactatattcactgcgctaatttaccgcttcaaatcctttcacattaatagtgacgaccacgacgcaatttaggcgttttcacaagaagcatg

SEQ ID NO: 4726 - DNA, 700 bp, Nannochloropsis_gaditana
tctaccgcagactgactcattctgcgcctgcacacgcccacaaaccacataggacctgcttcaccgccagctttcggaatttcaacagtgaatatgcctcttacggagcattctaacattgcgaacagtcctgaagacttggctgcatcagttgagaaaaagctgtcccttggcagcactgccgcccaaccggaggaggatgtcgaattgcaaccctctgacatgaaacttcgggagttggccggtgatatggacgatgagctcctcctgaaggacaatccagggcgttatgttattttccccatccaacatcaagacgtaagtgagagtggtgtgcgccactcgcggacaaccagttccctgtctcctatgctcccctccgtcgatcttgatgagtcccgcagaaggttgtaaagcataccatgcatattctttagctggttgggaagaggtaccgggaatcttgccgcccttggtagggtttggagagtaccacccctctgcattctgaactcagaatcgtagctccccgtgttggtgcttgcatgaatgtagattctgcatttcattgcaccggtatcttccgggtagacaggatcattcgctcagaccattctccctcattctttgtctctcttttgcgcttccgtctcatgttctcctcgctttgtgcctcatcacgcgacagatctgggatatg

SEQ ID NO: 4727 - DNA, 700 bp, Nannochloropsis_gaditana
ctattctccaatttcattcatggacttccattaccacaccataagggtttccctcctcattatgcttacctggattatcttattgtcaacacaagaatgctcttacaaagttcccttcagccccaaggcacaggagctttggtggacacaactatacgcgtatgccctgccctctatcatgttatggtcttcaagctggtacgacgaagatgaaaaaacacattgtccaaaaactatcaagtattttcctgcacgtatattcctatttttccatcccaaacgcagtgcgagggttgacgtgtcgcacatctgtgccatgcacttgatgccgctgcctgccatcttgtgtttcaaaatgtacattgcacgaatccatccatcgatcttttttccaaaatgaatcacaaaaatgattcaaatgctactgcactgccttagcacgggtcaaaaataaaaatcacggaaaggtcatagacgcactggaaagcgatgcttcccgtgtcccctcgctgcctcctcgccgctggagctgctacttgccttgcctacgccgacacttatgttcttctaccgacaggcgagcgcccaaacgcaccctcatgggccttcctttgtttcttcatttcctgacaggggaggcacggtggtagcggcattggagtaggccactaaattctttagtgtcgcggacctgaaaatg

SEQ ID NO: 4728 - DNA, 700 bp, Nannochloropsis_gaditana
tggccgctgacctggcctgtctcctcttccccacagtgacctccccctcgattccaacctggtggggggggggggtaccgggcctgggacgcactggcactgcagcacgactgcacgcccttcaagtacgctaaattcgtcgacaatcgctcttcctggtccacgtccactgcgactacccttccaacgtcctctgtctccttcaaagctgctgccgggcacggccttcaccacttgccagatggcaggcttgggggagcaggcggaggccaatgggccgatgaatgcgtctacctaggcaaggatgtgatcgcaagctttccaacggaggatgggagggggaaagccaacgtgacgctggccgctcagatgaccgtgcgaggggtggatctgccgggcgcgggcccacacgtcccagggcaggagcaggtctccttgtccgaacacccccgaggcaaggggggaccgcaaaagagcgggcaatgtcgggattccaacagaaaccaccagaagccccagacaagcaacccatatctcccccctaccccttggcaccccggcctgacagccttcctccaccacgacctcccgcgggctctccgtctcccatcctggcggcaggggtcgcccatcggaaccgtcttctcctcccactcccagccctctatccttccttgcacgtccatgcctgctgcccggc

SEQ ID NO: 4729 - DNA, 700 bp, Nannochloropsis_gaditana
cacgagcaacggtcgcgacggcaacgaatgtggaaatccaaacgacgaaatgctttacaagcgggaggagatagaccatttttttgatcttgtataccgctatggctcaaacctagtaaaatttaatgcatagatcagtatcattcttagcgctttcatcgctttaagctactttcgaaaagcactctttgccttgcagtcgagcattcttcaaagtttacgcaaaagctggccttacaatcgaatatttggccaacagaacacttcacgggtccaccttctcattccaagaaaattcatggaaataatgagtttttttctggaatcgtgtgggtcagggaaggaagtttgcttcggtttagcgcaggaacaggggaggttagcgacacgtactcgccttccaaagaagctggacgaccgtgtcgaaggacgcgacattctggtgaaatatggaattttagactcgtattgtccgcggtttgatctctcttgtccccacagacatagccatggtctcagcgaccttgcacgttcacatcggtcagtgcggaaaccagataggagagcagttttggtccctggccgcagacgattttgccgctgccgccgacaacggcgatgcttcttcgtttagcccccaatacccccatccattgttccatgagcaggatggtcgggctgccgcagtcttcgtggatag

SEQ ID NO: 4730 - DNA, 4 bp, Nannochloropsis_gaditana
ggcg

SEQ ID NO: 4731 - DNA, 700 bp, Nannochloropsis_gaditana
attcgcacctctttctgtccttttgactcaccgttatccgttcccgtcaggctcgatttgaaaagcaacaaatgggaggagcttccccttcagaaagacacgccctctgcccgctcggggcatcgtatgtgcctttggcgccattatttggtcctttttggaggattctatgaggtaccggcctgggatcgaacgcgtaaatgggtgaaatcgtgtgggtcgggcgctcaggaataattgtaagttctcatcgtgcgaggctcacacgccactccctccctttctccttctttccctccctcttcccctcactcattccctacctccgctcctcgcttcggaccccaggccttccgggagacgcgctggtacaacgaccttttcctcttcaacctgcaggacttgaagtggaaaaaaatcgtttattctgcaaccgcaccggtattgctccctccctcggtccagcccttcctttccttcttcctcccctcccccgtccctcttttcctcgcttttttcttccccccgccacgctcttcccctttccaccctcggcttgcctcctgtaataatctcctttatttacgtttatttttatatttcttcattgccaaatgattcacctccctcctcccgtcttttcctcctcgttccctcgaaggtcccgacgcctcgctcgggctgccaaatggctgtcggg

SEQ ID NO: 4732 - DNA, 700 bp, Nannochloropsis_gaditana
acttccgctttaccgaaaacagggatgggcaagagggataagaggaaaaaggcagcagctaaagtcgggggagctggtgcggggaagaaggaggaaaaaagaaagaagcaagaggcgaaatcaaaaaaggcaagtgaagttgtgcaatgagctgctgttggaggtgggctgagattgaaatgagatagaatcgatctgaatactagctcatatgcagcatgtatcaatcaattgattacagaaagcgaccaagggaggaggtggtgccggagaaaaagacaaagagctgcaagaagaggacattgaggcgatattggctgaggtaggagagcgggcgtgctagagaagtctttatcatccctcaccttgatcatgtgcaacatgtacatacaaatatccttagattcgtgccaaagatgcggccaagacagctgtgactatttcggaggcacctcaaccctccccgcgcacgaatttctctctgaccactctaccttccggggagctcctgcttttcgggggtgaatattacgacggtgaagatacaattgtttacaatggggtctataggtaaaggatgatgcgtatggggaccatcggaaattggaaatggcgtggaggggccctcacgtttagtttttgcgcgcacacaggtggcacctggaacgaggggagtggcgtgtgatcgagagcctgaatg

SEQ ID NO: 4733 - DNA, 700 bp, Nannochloropsis_gaditana
ggctagtccgtgaaacaataaaacgtaaggttgttcactataatttcgtagctcgtagcatgggccagaacgactgaaaggggaggctaaagtattagaaacatgtcgaggaattttgagaaatgattatattgacacccattcccgcaatgaaaatgagaatattccattgctgacagctagattttgcacgcgcatcatgctgtttttattttgggaaggttttaggttatactgggggtgaacctcccccgcatgctgcggtccaagaacctcccgcctccctgtaccgcaagctattctttggcactttattccgcacagacttgtactattctgtagagacccagtggattttcatcttggctgacagcattttatgtcggttgctttttcaataggtggcaggtgggacaacaacgcggaggagaggcgatacctttccctcagctttacgccccgtagcatgctccgtcctcctgcagatcaaataacgagcaaaacaaaggctcccggtgttgaaaggcaccgaaaagatagaacgttgaccacatgtgtgaaaagatcgggcacagtggacggcaagcttactaaaaaaaagagaaagatatcggttgcctctccggtcgttgtacgcagtcgtgggattgggacgcataacggtgaagaagacttgatgcgtgacttgctggaagaaatg

SEQ ID NO: 4734 - DNA, 700 bp, Nannochloropsis_gaditana
ccaccggtaaaaacatgtcaggcggttgaacgtggcgaacatcatgtatggtgcatgagttcatcggtgccactttgtctaagcaccgcgaattatttcacacggatggctggaaaggcatgcaagctcaggaaagttctcaagactcgtgaagaggttgggttgcttgtccgtctttcacccatccatgcaagttggaaggtgactatcgcacagagtgtggtccaattggcttttcgtggtgaatagccagcacaattgtgttctcattcggctgccggctgcgtgtatacttcaccttgtacctcccctccttttgcttacatcgagctgatatgtcctcagagacaggagggcacacgatgccggtctgatgcccattcaggtatgagagtgcgccgatttggacgtcgcagggcgcagggcgaaagaaaatgcagcagtcttgatgctctggctctggcgttctcagacctagaaatgtcgcagtcttggcatggccagtagcggccattttcctctctgtcctgaagacttttatttctcggtatcatacagtttattcccaccatggcacaggtaccggagagatcgaattcattgtagaaagctgtctcacacaaaatcattgcggacccctttgttgtcggaaggccggtttttcaagcttcaagggggcacaataagggatagagccatg

SEQ ID NO: 4735 - DNA, 700 bp, Nannochloropsis_gaditana
acctcaagcaaagacggggagggaagaacggcgacaaggcggacgaggcgcaggcaaccccaggcgctactccctccctcgtgccctcctcctccctcgcactcgccccggcgggaaagcggacgccggccttgctctctctccacaccgcctcctccttcccgccctccgccctcgcctcccacgctctcctggccaacgcctcgccccctctcccccccccgaagtcagactcgaggaggatgcacaggagggggttaagaaaggccgacgaacgaagaaagggaaaaagcacaaccaagggcagtcctcgcactccccggggccggtcccgcccgccgcgggcgccttcgccccccccgctccccactccaccctcctctccaagcgcgaggtagatatcgtggtaggggtgctacagatctccaacaaggtggtggcggactgcatggtgccctggacaagcgtctgttgtctggcagtggatgcgccgctcaacgaggaaacgctgaaggcgatccgagctgctggcttcagccgactgcccgtgtgttttcggcagggaggggggaaggaaggaagggagggcgggcggggaggaagttccgggggggaaatgaacggcactcgagaagatgcacgggcctcagggagggaatggagggagggaagacggggagaagggtgggtgggaaagcgg

SEQ ID NO: 4736 - DNA, 700 bp, Nannochloropsis_gaditana
gtttgacttcgatggcaaaaccatctgcgatattatcgagcgtggcaaaggatcaggccactggaatttaaaaaatggtgtcagcgtcataaaaatgcataagaagcctaggggcgggagttggcggcattccacaccgtgttggggatgacgtcatagcctcgttaggccatgccatatactacttctgttcaaaataaatcgtgtcctggcacaatcgccttctgcgcgtcgcacgctgtccgtagctctttttgtcatgcggggcggcatgatttcgtctcgtctttgaagcagtatttacaagggatggtgaaatcgttccgagttgcatctgttgacaaattcaaagatgccatgaatctcagagcgcctgccgccaaccgagatataaggactgccctccgaagaaggtgatggcagggtgacaaatgtattaattgctggggggcgacgttatttgtgcatccttcactccatccaattcggatgtctttgttctcgtcgatttgaccaacagccgtcgacttcgggttagaggggaacaaggggttttgctgcagtttgatctgaacctcgattcgctcaagaattttgaattgtaaacatcttgaccatacacaaaacttaccacactggtttcgcacaggaaatggtattacgactcctaccttatagcaatacagttttatacagctcc

SEQ ID NO: 4737 - DNA, 300 bp, Nannochloropsis_gaditana
cttctggaggccttccagcagagtcacgcccacatcgcggtggtggtggacacggtgaggagagctggggggtgggggggagggagggcgacgggcttcggggggaaaggggccgggacaggggcggaggggagcgtggcttggcacctcctgactttttccgaccctttgcctgtccttcattctcctttcccctacctgcagaggacggacttcccggaagaggcggcctcgcgcctcctgtgcggcctgccccttgcctcggagcccttgggcctcatcaccctccaagacgtgatg

SEQ ID NO: 4738 - DNA, 700 bp, Nannochloropsis_gaditana
atgtgccgaaagcagcgcaggtgcattattatggaatactcgccgacaagagatagatttcgatttcacagaggtaagcgaccatcgaatatattctaacaagggtcttatactgcacaaaattttacacgttgaagaggggttggtctgcatcttggtaccactccttcgtatcttgtcttttggcatcctaccttcaaaccccctttcaattcaggtttttcccccagcggtcgcccaagcggaaatatacgaccgagcagctaaaggggtggtagactccgttcttcaaggctacaacggaacaatttttgcctgtaagtagcctcctcatagagcactcgttttgttcctcctttcttttccttcccttttttgttcttcgatcagccctccctatctttttcctccctcattttatctttcttctctgcttagtgctgcattcttaggtttattgtttccccgataattcttcattgacaacggttcaaagcagtgccttgtctcatgtaggcgcatgaccaccagcctcttagttgtcttcttgctcttctaggtcttacaaatctcaagccatacgatccctctgatattattattgtcatgggagattttctcgctccttatgtgcaacccgatcattccacacttgtctgattcagacggacagacgggctccggcaagaccttcaccatg

SEQ ID NO: 4739 - DNA, 65 bp, Nannochloropsis_gaditana
ggagggagaggtgaactgtggctgcgggaataccttgacagagaggatggagctagaagaaaatg

SEQ ID NO: 4740 - DNA, 700 bp, Nannochloropsis_gaditana
ggagtttcgaccctgtcatgggaagctaccattaaaaatgcactggagaataggcctgtctcttggtgagtccaagttgctaagaaagcaccttcatgcgccgctgtcgcaagcagccgctgtcgcaagactttttttttcggttggcgcgcagaaattgttttgacaagtcttgatcaggaccttccataccatcgagtagctttggactgcgtggaaagggaaggggaaacttatttataagtaattgctgtatgcacataagaggaatcgattaacatttttacagtagtcactctatggtaagctgtttgataatacgtaatttcttatacagatacttagtaagcatagctagacagttcgagtgtcattttgtgcccacgttatcttttattgtaataaatacataggttgactcggtgatcggcaaagggcaacgaaacaattggagagtacacagaaagggtatgttttaaatcatttctatacccaagatttcccccgcgtcagggtaccccgtttaagttgccggtccaagcgccccggatttgtcgtggagagcagagcattcgattgtaaggcatctctgcctgtccagatttacatagatggaactcttcctgaaggtcagtggttttacgaaaaggcagcagatagaatcgatgagttgcctgatgacctgaaaccggcagtgatg

SEQ ID NO: 4741 - DNA, 700 bp, Nannochloropsis_gaditana
tagtttaggttctcgaggcatacaagtagcttgtctcagcctaccgtggtcgcgcacgaaaaggcgcgatgaagcattaatcctcacttatggttaagccagttgtgctgcgatgaaaagggaatagaaattagattaagtacattgcgtgcgcatttagatcgtagccctccctgttctctctctcgcatgtttttatgcggtatatcaagacgtaatcccgcaggtcatgctcaaacggaggaccatgatgactagctgaaagagccctggcttgtcaggtcataatagacgtgcgattgctaataatgattaagaatgtatatgtcaaagtcaaattacttcttgacaagaccacttctctatggaaaactcatgtcaaagaagagatcaagtgtgagcataacgcttgccctgtcggaacatcgcggacaaacttcccgttactacctgactgcccggacattgaggcctagagtccgaagcgtgatcctatcctttcaatacttaaaaatcctccttgacacaataatctcgataggtgaagatggtccagcgctctaatcgctggtatgtacaaaatatcggggggaaagctggtgtacgagcacccacactcctgctacttattagcgttctggcaagcctgtcattattggtgctgaacgcgacctatctaaatcatcacaatcaactcatg

SEQ ID NO: 4742 - DNA, 288 bp, Nannochloropsis_gaditana
ctaccggcgcgacgggtgacacgggcgcgacgggtgacacgggcgctacgggcgctaccggcgcgacgggcgcgacgggtgacacgggcgctaccggcgcgacgggtgacacgggcgctacgggcgctaccggcgcacgggcgcgacgggtgacacgggcgctaccggcgcgacgggtgacacgggcgctacgggcgctaccggcgcgacgggtgatacgggcgcacgggcgctaccggcgcgacgggtgacacgggcgctacgggcgctaccggcgcgacgggtatg

SEQ ID NO: 4743 - DNA, 700 bp, Nannochloropsis_gaditana
gggaaaaaggcagggatggaggaagaagtcgcacgggtgggccgcatcttgctcttgctggggcagacgactcgaaagtctctggctcggcgggtggctatgcgtcgggaaagtgacctctcccccgcggcccaacggggatatcttttgctcgcggaagaaaccttaaggttcctccacaccctggctcagagtggcttgcggcaacggggtacacgggcaggcagggttgtcctccccgacgacactggcaggctgcgggtgagcaaggccaggagcagggataggcaggaacaggacgtgtgggaggcagtggaggaggtggcagtggggctcctggatgagacacagcctttgctttccctcccgtcttttctgaccttgatccaagagatgctggcggacgaggacgccggcgtccgtgcccgggccctccgcctcttccacaccaccttggccgagcggggggaagcattggggcggaggaaaaaatggtcccggggggaggaacgcttgatcttggagatgcttcctgatatgttttcggtggtgggagatggggaaggcgagggggaaggagggggacaggatgggaaggggagggggaagaaaggaaggagcgaccccgcgttacaacagactgcctgggcaagcatggctgtcttggtcgaggctctggggaaagggtacccgcagaaat

SEQ ID NO: 4744 - DNA, 700 bp, Nannochloropsis_gaditana
cagcctacacgtccgcagatcagccgtaaagcttttgggactcttggtccgtcgctttccgcgtctccgcgccaaagccttggcgtatttgtttgattggatcggaacggatgccccttgggagagggctccgtctttttccctgcttgtccgggttttggagcacgtggtgcccgcggccctagcttcctcccctgcgacgtcgtccgatcttttcacgattgctcataccttaacctctgcccacgaccggatcctcccttcccgccgcctgcccctctaccacgccctccttcgctcactgggtgactcccgtctggcgttcctgcaattcctccttctcctccagcactgtgcagccccgaatacggcgggcaagggcgaggaggaggacgggacggaggccctgctgggtttgacggaggccttggcggggaaggtctccgagatgcaagagttgttcagcgccggcgacctgctcgagatgggccacgccctccttcggtaccttcttggccggcaagaggacgtcgagggggaggaggcaacggagggagtggtggaggacacgggggaagaggggcgggagagccacttttgggtttgtcacctgcgctcgcggcgggacctgtcggggaaggatagcctccctccctccctccctccctcccgccctgcccttgccctcgacctcgagccc

SEQ ID NO: 4745 - DNA, 700 bp, Nannochloropsis_gaditana
aatgtcggtatttttctataactttttgctccctttgggtaccctcagcctatacattcttttacttatagctattgcacgggtggcatgagagcctgggactcctgctaataggtatgtatggcctggttggtgtgcacgcgcgctatgaggaaggaccaatcgcgcgaggagcatatgaccagttcttggtttattgtctctgtactcaaaatttcagtgcgcccggaaacgtcataccactttcccatggggtgttttccctcaccctaagagagctcgctgctaacttgctgttcgggggctcgccgaccgttagtctccgcctgaaggtcactataggcgcagtagagcatgtcctttcctgtttaccacgccaatcgtcaaatacattaagaaattgctcctcaagtcttcctcgagcttgagaatccggatgaagatgactttcttcagctttagcgtcggcacggttctttcgagtagggataagaaatctttcttgggcaatagccgtttcactggcagtttccttttgggtgatcttcgatactcttcctgaagtcttttcacgtatatgtttgcaaacttcgagcgatcgcatagatattgcattacagatatactttatgtacatttacatacaccacatcacttcctgcttgcaaaaggaaaccttcaggagctcttcctaagtatg

SEQ ID NO: 4746 - DNA, 526 bp, Nannochloropsis_gaditana
ttaccgttcggtggcggcattacgacagtggcggataacgtggcactgagcgtgcgtgctggggagggggggtgggagggcgggcggcgggagggagggagggaacggggaagcgcagcattgtactcgtaattttcaaattcatcgtacatcgtgaaaaattacgagcagtaactactcattcccccgctgtctaggctcatcccagtcactcccccttcctcctcctctttctcaattggtgttgattcccctcaccctttttcatccctccctcctccccccatgtcgcactgtttcgtctttacaggaccaccgtcccgtctgcgcggccctcgacctgaccgtagatcgacgcgtgcgaggcttccatgttgtcgccccgctcccctccctaccgctctccttgccgtcctacggatcccgagagaccgaaaagagctccctggccgatgacctggtcctctttcacatctacctgggccgcccacggctggaaggtgggtgaagagggcgaggaaggatg

SEQ ID NO: 4747 - DNA, 700 bp, Nannochloropsis_gaditana
gcgcctggtctatactagcacctcgggaggttcagcaggcaagctcggccctttcgtgggtcaggtgctgcaaaagatcgacacggccggaggagactacgtgaatttcgtgcgtcttttcggtggacttgtggagggtgccctggtggcgacttgggaggtgaagggcgcaaacgagtggaaggtcatcttccaagacatcacgttccgggtgtttggcatcccacttgtggacaagaagcctctgtcagggcaggcagggcaatggaagctcacgtatgtagatgaggatctacgaattttgacggcggcagctttgaccaatgagggtaagccggccaaagtttccaatatctacgtgctacggcgggtctgagggttacgagtttcgtgctatctgcaggacgagagaggataacccaaacgtgggtaccaaaaaattgataagttaaaaaaaaaaacatcgagattgcgtaggtcgaagtagaaacttttgtttaactcgttttattaacatggcctcgactcacaaggcgtgtggacgggggcaatcagaagtccgtcacgttgcctcaagagcagggcagagaccaccctaagaatacactcggaagctccccgggacatgtctttgagcctttttaaattaatcttaaccagcaacatcttgaaataggagcattaagcgcccacaggcatg

SEQ ID NO: 4748 - DNA, 700 bp, Nannochloropsis_gaditana
tactagtcttgtgtatgcaattattctgtatgttctcatcctgtagccgtcttctcttcatgacgcctgtccacggacatgtgataaagaagcgaaaatgaggcgtaaagaacggcctggagaagtcgtctgagggaggaggtcaaaatagaaagtatgcttcagcaacaagatgtgagattatgaaaactgtctgaaaaaagcaattcagaacatgagtactttacatcatcgctaccaggactcatgttcttgttctgggtagaggtcctgcttcagaaattcgactatcacgagtggtcacacatccatggtcctaacggccacaagtgcagacatatttcagccactgagataccacccttcatgttgcttcgcattaaaagctgaaaaacccacaccaaaacgaaaatcgtaatggaaaaaccaggaatcacactctgatcttggactcgccgatgtatataccttgacagcttggtgtgctggtgtaagactatactcgaacagaatcagttctatagtataatctcctctgtctgtactacacaagtcagacaacccttccaactttggtgacgagaagaggtccagtcacggaaacgtgacatatgcacttccttcctattccgagcccttcggagcccggtggaagagtgctggaagaccgtccccctcaggagtgccctcgtggccgatg

SEQ ID NO: 4749 - DNA, 700 bp, Nannochloropsis_gaditana
gaattcgacaaactaaggaccaccgagaatgtttacttgcattcctaactttcctttttgttttgcttcgtgcatcttacgatgttacgatgagaggaagcccacattaatcgttcaagcagaatttgcgtagtgaagtctagcgagggaaggcctctctgccccttgcaaaacgtgaagagcaacaacaccctatttgagccagacggcgaagggacgcagagggaagctgacaaagctgccatcagcccgagtaacggtttttcaaatcttcaaaggccgaaccggggtctcgcacatacacctggccaggcgtttaccttcgtggatgttttcttaagtcttttgactgaaattatgagacatgaattaagagaaaggcaaataaagatgatcaagtttgacggggaagccatgacttttaaaccaatgctttgaagccgtcttttccaaaaaagacatccttcaaggcacgtcgtctcccgcgtgtaaatgctcgtggtgagaggaacccacacttttgatacatttctaattattggctcatttcaatcatcaatatgatcaataaaacttcttatctgataccgatacgacaggccgttatcccgacctctcattgtgcgtggcgtacttgcatttttaagctactgccttaaataaatagcgattaatatcaagagacccctacaaaaaaatg

SEQ ID NO: 4750 - DNA, 261 bp, Nannochloropsis_gaditana
tgacaaatggcagcattggggtctccgggaaggtaaggacggaagtgtaacgcttgcggggtgttggggggaaggagtgatgaagaggctaccgtagtgttgagtggatgccattgaagtctcctcagtgctacttgtggctgctgagacgtgtatttcccttgtctcgcatactagaagcagagcgtacaagatctgtttgaagcgctgtcgtggaagcgactggataggaagacgctggtggacagggcccgattaatg

SEQ ID NO: 4751 - DNA, 700 bp, Nannochloropsis_gaditana
ataatcacaagctctgtgcgccgacctaaatcctactcttatcctgacagttgtggggcatcaacatttgtcgtccgcaggtatggaaatgaaaacaatcgttggagtctatttagggctctccaaattagtgttctttatccatcgcctcgctaagtggcacagataaattaaattttaaggggtaagggcgaccccccagtcggaattggcagatcctttctattatattattgttcactgctgctttacttttttcgcgccatattcaacccatttttttcgcgccaaatttggagcggtcttcctactcgagtctcgaggccctcgagtcgaggggggcgaagagagaggcacgagggctaaccacgtgcgaacagctttgtggcgagtacaagaggcttgttaattgcattgcgcgtccagatccacatcctgcgggcacgtgtatgctgcattgttgtttttacctttttcggctcctccggtctgacgtatcagccagccaccatttgtggatgcagtatcccgcctcactcgtctcatcgatcttcctcgatcttgttcctcgccctcgtgcctgcgcgaactttcgagtagtttgatggtcgacaaaacgttatcttctgctcagcacgtatacacacattcatatctacataaaattcttgcagtctccacatcatctgcacacgggatg

SEQ ID NO: 4752 - DNA, 700 bp, Nannochloropsis_gaditana
aaccagtttctaccaccccctgcttcctcgtcttcgtcttacaaaatgtgctcgttgcttggtccatttggaccatcttcatgaccctgggaatgatattaagaatagtcttcatttctgctcatgaaatgtccctcaaagacattcttgcttttcaaaatggactccccactcggtgccggacttcaagttgtatgcgtgcaaatgccaccgtgacacaccggggggttacaaagaaaaaggacgaaaatcgcgcactcaagtgatctgtcatggaatgttgtggacgacaaggacaaatcggaatgatatttctaagaaatacttttctgcatgtcaagcatcaaatatgagagaacttgctcgacctgtgctgaagtcctttctgctcttacttttccagcattactagttccgacaggttacgtttctgtcgcgatccgtgagctgaagcgttcaagaggcgaagaacattccaaaaatcatgcgctcaaatgaatcatgcgctgcccctcgagtatgtccaaagtctgtctccacaaaagggcggccttccacgtcaaactggcacccagagcatgtgaacaattccgagtcgttagtccctcccacccgggaaagacaatcgacgacacattccattccctttgagtcatcactgcattcgaaaacgagagtcggaaagagtcggaatgatttg

SEQ ID NO: 4753 - DNA, 700 bp, Nannochloropsis_gaditana
gggcgaagccccaggccagaacgcattttggagtgtcaaaagcgcaattgccgatcacaaatcggaagcccacatattttttcatgtcatccctactagctcaatcgtcgttcatgaatgaaatctcatcaataattgataaccctcataaatgagccctagtaggtttaaaggccctgccggggggtatagactttctctcggggaaggaggtgttgccatagttttacttccagggctagtttcttcacctttcttctccctgtgggtagcgtcagtctacgaggtgctctgcattatagcattgggagttgtggctcgagagggtaggactcctgccatacggtctgcgtgacctgttctcttcgtcggtgcgtacgcgcgccctgggaaagaaaaatcataacgaaagaggcatctgcatagttcttatccgtcgatctctgtactcttacatgacttcactcggggtgcacacaacttccccaagggttcccctcgtcttcggatagctagctgctgccagtgacttgctctgagggggctacccgaccgtttttaaaggaaggtaaaaaccgtcgagctttacgatggtgagggaaaggaccgctgggaagtaatgcatcatatactggtgaactcatattatgagctcagggattaaaatagacgagccttgcagaatgtccctccgtgcatg

SEQ ID NO: 4754 - DNA, 700 bp, Nannochloropsis_gaditana
ctaaaatctgggacaacaactgaaaactttgcaccaacatgaaatctgcctgcattattatcttctctcacaactactagtattcacattttaattttggcatgcccatttttccgccttgggatccacgcatttgaaaatgacttttcagtcaggtgcctgttccctcaggaggttatcggacggctcggaccgtgacgggtgcttcccgcctgccacaaacctgtccaacttatttttgtcgtgtcgctttactagacaccacgccgcggagtgcccgataattttgacaataggattggccctcggtattgcaccttggtccgtctgcgcactcatcgtggtgtatctgcccccggtatccgcgcacagcttgcctttcttgggccttcgcttgtagcagtcttggcgaagggaggcagctttcctcgtttccgcctccgcgccgcgatcgtaacaagtaccgaagaaaatgactgcaggtacggatagcccccctcatgtaaattttcacgggttaaattgagccagtcaaatttcatttagtgtccccgacactgcaatgtcgtttctcctttttcgcgcgtcctttctttcccgctcatcgttttccaaccgtcccatccacctcaatgcaaaaaacacactctgcacttcgacttgtggacgtttgtcagctgcgggaaacagagaaaatatg

SEQ ID NO: 4755 - DNA, 700 bp, Nannochloropsis_gaditana
aaggaagactctttgatgcctacgtttccgtcccgtcatgatgagatggaagccagagaaaaggaaagagctcggctttcagagggtcaaaagtcttccactgccatgttgctcaagagtgctttattttcttcgtcctccgcgtctagaaagggactgggaggaagagaagggttgaagacctcagggggaaccattatgccggtagtgaagaaggctaagcatgacggatgacgaagagatgtgtacatgaatgaaaatgccatggaaataagagcaatttaatatttttcgaaaaaatggtaaaaattttagctttaccgcatgttggaagtcaaaactgcatcatgttccttgcacttgtgcgaactcgctcctcgaacgagctctcgtatcttccttgatcgtgagtatttgtcggctagagcaaaaatgtggccatcgtagctttttcacacaatattacttcctgttcgagcgatatttcccagtctgttgaaaggcattcataatatatttgtagccgtagtcatcgggaaggggaggttaacgcagcagagaagggaacggcgatatcttcaacatcaatgaccggccgtgcacgaccctctgctgccaaatcccacgcaccctgacattcccctgcatcccaataatatctatacgaaaaggcttgacgctttgttcgtattttgccatg

SEQ ID NO: 4756 - DNA, 700 bp, Nannochloropsis_gaditana
tgttgttgttgttgttgttgctggaggcttccctttcagccgtaggcgttgaattctggttgtgctgtgcctccctctccctgttgctaccgcttcctcctcctcctgccctaaaaacagtcaaagctgcttgtgcccctggtaatcggctctccgttgacccgtccaagagcagcttgcgatgcggcatcctgtcatcgaaaaatgtgtcatgatgggatttaaatggcaccgggtaacatcgagggcgacttaccggggcaggggacagagaaacgacagctgtcgtcatataccgaggcataatcctgcctgcgggcactatttgcgcatgtttcataggttttgcatcccgtcgtcgcccgcgcacattatagacacagggaaagcatacactgatcacgcggattgaaatgatcgtgccggggtgcccagcagcatagcttcatcttgcatacttcatccacctgcccgccatcccccccaccttcgcccccctcgtgatgctataaattgtcgtcatccgccttttaccatggcagcctccccagttcagtccaagcatgaaatcagtgaagctggggaggcagatttatatggcgcttgccgtcctgtgaagagtttccaaaagcttaatcaaatcggggaaggagcgtatggtactgtgtatcgtggcatcgataaagcaaacggacgcatg

SEQ ID NO: 4757 - DNA, 700 bp, Nannochloropsis_gaditana
gttgaaaggacaaggtgtgcacagacagcgccttgagaaagaaactaaacgattacaagccgcacttaaaaaggacaaatctacccgagaaacgaagatgaggcaatgtcaaattgccttggaccaaacggagcgaagggctaggcatctggaaaaggagaacgctcagttgcgagcagctcttcaaaaacagggggagttgttgcaagtactcgatcgacaggtggagcacgcgcaggctatgcagctcttatctatcatggaggaagatttcgacaatttggtcgctgatctgcgacgctcgggacgggaatgaggtcaaagagaaaacttgaagagcgactcggcgaaagggttcgcctgtatatgcgatttggggtattgctgagatttctcttctcgtagttaaaggcagcttttcgtttatttattgactttgctatggtaggccccggtccctcctccatggcgcggcaagcgctcttgacatactcccctcttttcctttcctcaaccccctccccctccttcctatccgtcttcacaagagcaccacaatgcaagttatgttgtccgacgagcctcttcgcatcgcctcttgtaccagcaagcccgccgcgtccacctccggcctccggccctccctctcccattgccccctcacgagccccactgcctcgtcgtccgagagcacgtccca

SEQ ID NO: 4758 - DNA, 700 bp, Nannochloropsis_gaditana
ccattcccgcgctccgctacatttcacaataaaaccattaattagacatgtatgtatttttggaaatagaggggatggttgagatggtatttgtgttgtttcgatggcatctctactctcctcctctgtccaacggaaatcgtctgctgggagcattgaccaaggaaggcgagctggaggagaggggtacacatataaagcaacatgtatcgccctcgtgtacatttaaaacatttatgtctactttcagccgccttaaatatcactcaattattgaaccacaggagcagggacaacaaaactagtataactagcaagggtatcctcttttccttgcatacctcgagaattttagactcaagtacgtgcaaaggaatgcatgtccatagcatcaaacaataaatcataagtgtatacgtgaccggagaaggatcggattctgtatgcatggtaccctactgctctatcatgctcctcctccttgtacagaattgtggggactcgatcagggcaaaataccatttgattgaccctttgagcaactcgcatatcttattacgcgtatgtggtttcgttatctgcttagtaagggtcttgttacagcccatatgcgcaatttttgtcagacccgcttacgctaatgccctctttctacaccatttctggttgataaccacccaggccccagtcaatcgaaatg

SEQ ID NO: 4759 - DNA, 700 bp, Nannochloropsis_gaditana
ctgcattacttcacgcgaagagcactattttccgcgtcacttccccccttgcgtttgtagtctttaaagctttgttatctaccttccacacgtttcgccccttacatcgtcaaataaggaacattgtgcacgctgcttgctcgttgtggaatttcggggcaaaaggatggaaagcgtggtggcctgatgcccgtttcctagcccaggcgcgggacgggtgaggaggttgaagctcgtccgggttgaagcaagcaggaaccatgtggccaccctggggatcgcattccgcctgtccacaggaatcacgtgctttttctgggcgcttgcggctcatacgttcggttcaaggtagtttatgaccgattggacgaaggcagggtggcatgctgttgcttctaattttccatttgtggtaggaagcggaattagatggtcagttattccaacttctggagatcgacccaaggcaagtagagcaggacacacggcgcaatctggaaaaaggcgacagccttgggcttgcaagtcatgtgcatgctgtcgatcttttgatgacttgtctttttgtttaggaatagatgccgttgacgagacagaaggaccttctaaaaaactcagttctcaccggtgaactgcaacatgcacagtcaaccgaaagcttgtgggaattcaagacaacatccttccgcacaacagtatg

SEQ ID NO: 4760 - DNA, 700 bp, Nannochloropsis_gaditana
gccaatcgtagagactgatcttgtatgcccgtaacattcgagcttaggaaagataaaaaaccgttcaaaacgcagatagcaaggagacatgtaagaactttatagaaggacgataccctcatttacctattaaacttaggatcagaacgtgtgtataatcagatatgagagtgtaataataatataatagatctcacaaagtacctttccaagcgtcgagaagcataggcctaccaaatgtttctcacaatgccgcttgagcgggctatcaatggcccatgtcgttgggattcagccacggcttggacagaagatccgttacttgacccttcgctggcgaccgtttcgctcgcccagtgtctcgtatggttcagggacagcgatcgacacatgacgatcatgtcaaagcactacttccgtcatcttgaagcgaaaagcaaagccgatagtaggatgactagggatgtgcgatggctagtaagatgacctatgtggcctgcataggtgatcgtgtgccaaaatctccccagttggcggggtacacgttccatatgtgagacacgtgctattaataatttcctttcaggttacgacactagcaatggtttacgactaaagctctcctgaaaaccacttggctgcgggacgttttgcattaggtttatcgaaaactgagggatacgaataaatagaagcaatg

SEQ ID NO: 4761 - DNA, 700 bp, Nannochloropsis_gaditana
tgctctttcatgtcaatacattgcttgtgaacgacagtcgagctccagtcgtcacggcatcctttttttaaaaatcgttccacatattatcgtccactcattctacttttatctcgttgctttgattaaattactttttccggaggaattgatgggggtacggacctttggtcgactccaaacgaaaaaaagaataggttacaataaagcactctgtacacgatagacattttatctgattgtgtggctgtactatttttatctgttttctgcaaacatttgtacaagcgtgcaacagaaaatttgatgggcttgtgtgaatgaggacactttacgtcccgcgttctccgtgacctagccgtttcacgcttgacgtatgcgcgtccgtgtgaatgagacagctttggaaaatcaatacgtcatggttgctcgactgtccaatctgcatgatgagagtacatagtttgaaaattgaatgcgtggctgctaatgtaatccgaaatagatccgggagaacagtcttaagtcaagacaggctgcctcattaatgggcacatcatgaaggccacactacgatgtaagagcaattgcctttgctgtgcatcggtaaaagccaatgctgaaacacaatctggatgtgataatcattccaaagagtgcctgacagtataccacgcatccatatatcacttcaggcatg

SEQ ID NO: 4762 - DNA, 700 bp, Nannochloropsis_gaditana
caagggcatctcgccccttctcaagatcttcctccttcccttcctcttccccttccttttcctccccctctttctccaggtcaaccgtcaaggtagcctccaagccagcaatgaacaaaggagggtagatggaccactccccccacactttcaagaccttcaggagcttctcctcgacgtgctgggcagtgagcctccccaacacggccaaggagttgtggaaggcagagaacacgtagggcagtgcgagttgcaacgatgttcgataggtagaggcgttcctgacaccggccgaggaattgtgcaatatgtctgacaccagataaagacgggccaccctccgggagagggacacaggctgttcccccgccaggtcctctgaccatcccttctccgcacacagactctccttgagcaagcccaccacctcctcgctcgcatcggcatggtccagggcgaatcccatcccctccttgattttcgcccgccctccgtccaatgctcgcagcaaggcaacaaaggtctcgtagtctttccgggagaggcgagaagaaggcgcccgcccccgcgcaatgtcccgtgcccgttcggcctgtctgcccgtcaagaaagcagccgcgggcatgacagcttcttgcccctcatccccaggggcccctacccgcccccgacctccccctctccgactcccgcccgggct

SEQ ID NO: 4763 - DNA, 700 bp, Nannochloropsis_gaditana
tggcgaggccagcgtcgacataactgaggacatggtcttgacacgcgtctctcaaagcaaggcggacgcgagcaatacgctcgtcaacgtcatggtcgtgaggcatgggaaaacctgggaaccgatagggcggggaagaggactcgtgaaagaccttatcgcccggaaaggcaacagagaagccggagcgataatgacggtccaagcgattctccttctttttgaccttgacttgcagctgaaccagcccctttgcccgcccggcacaaagcacacgtagacataaacagcgtgtatactcaatatttattatctgtccggacgaggatattactgcggccgtaaagctgtgccctgcgggtggcgcttgctctttaccatcgaagcattacgagaacagagcttagtgggcagtgacacatcgtcgagccagtctgcttgtcaatttagggcatttgcgaacgcatgtgatgtgaaggatgctggtttttttcattgatgaccactattgtctaggacactttgtcagaaagggatgccctcttgctccttgtagcatgggctatgaaggagtggccttccaccaacttgatgtctctactcacgaataacggaggttttgcatttcatcgatccccttttctcccgttcttctaactgcaggaaacacagaagttgtttctggaagtcgattgacatg

SEQ ID NO: 4764 - DNA, 700 bp, Nannochloropsis_gaditana
cgaattgacagatcgttcttccctccccatcctgccctcctgcgctagctggagtgcgaaagagacatcaactcttctcgcgggacctcatgaccttgcatagggcgatagaccatggacgtagaccgtgcatgacatgtgccgtcgcatgttggcgcggatagcgggtacaaaggtggctgtgaaggggcctttccaaccaaggaccgtgccttccacccgaagagccggaacatcgggggagcaaaagcagcctcccggcggccgcctagacaacagtctaggcccccatgtgtgtctcttgccacgcggctctcacgtctggagaatgtgctggtggtgtctcatccacatggagtgcattttcagggggcttttgtttccattgcaaaaagttgatctcttaagtcgtctgatcaacccctctgcacactccagcacaggaccccgtcgagacctctcggtctgtgtggacgctcatttcaaggacaatccctccacctgtacttcatccattatgagcgacgaatcctcggctgctagctcagacgatatggggtatacgccacggaggcggtaccatttgcatgatgcagccgaacgaggagacttggaaataatgcggcgactgattgatgcgaagtccttgggagaaggtggcaatcaaggtgggaagggggaggaaggaacagtgaatatg

SEQ ID NO: 4765 - DNA, 700 bp, Nannochloropsis_gaditana
agagagaaccttgagcccaagcccctcccaccgtcggtggcttcacagaagttgtgcccagcatatttccaaaaggcgctttggctttagttgattagagttagctgaggattgtggagagaggcgagcaaggaaaaggaagggacgtcatgaggccgaagtgggacttgagggagtctgccttgcttttcccccgaaaaacacggctcataagtatacgcatacaatgagtactcttaatggtaagatagcagatcgggcgaagaagaagaggctgcgagggggaccacccccgaggtttaaaagtagtgccgggcggactccttggatactgaagtccaggatgcaggaaaaaaatgcgtccactccaatccaccaaaaaccatcaacatcaacgcgcactatcacctcagcctcctcgtcatccactcccctcgtgcgagatcgacccgtccgttttcattccagagcccgccgtgggccctgcgctagcaagaagaaaaagaaaggcccccggccgctgcgagagagcctccaggcgaggggcgggtggcggggaggttggcaagcaggaaggcagatattcaacaggttacttgccatgcctgcgtacctctcacagaggtgtcggtgtacacatatatacaggtatccaagtttttaaggggatttgctggtgtcgtttgtggtctcaaatatg

SEQ ID NO: 4766 - DNA, 700 bp, Nannochloropsis_gaditana
cgtgggggggttctcgctgcctcctgcgcatgtcccttcgggagacgcacccagctctggccccatgctggtagcaggggagggtgtgatcgcctctgtcgctgcgggcgaagcgagagtctggcgggtggagggccggagaaggggggtcatgggccttagccgcgcgctgggacagctctcgtcgcttgtccctcccccggggctggacaagggggctgacgatctggccttgccgctcacgtgcaggcgcagtggggaaggaggcatgacgcccatggttttttttggggggggggccgggtgggcgcaggccggggggggggagggggggagggcgcgtcgcccgcagaggcggtgcaggagcttttggaatgcctgcaaagaaccaataacaatgtggaaacccagcatgtctgcgagcaggggaaaggtgcggaggagtgtaggcggaagcaggaggagaagaaaagcagaaaaaaacggaagcggggggcgaggccgcgatgttggcgccactgcatgtggcgacggagacggccctccacgtggctgctctgtgtctgggcgaggacgcgggtgtggggactgtggggtccaggctggctgacaagggatcttgggcggcgccgcggaccaaggtcaagggccaggcagcccgggggggagcgaggggaggaaggaggagcgagtggtcatg

SEQ ID NO: 4767 - DNA, 700 bp, Nannochloropsis_gaditana
gacacgataccttcggagcccctgactcggccttaccctcctaatgcctcgggccttactacattgacggacgcgtatgctttacctgccatggacactgatcccctggaatcgagcgatctatcctctgcgaaagtggtccccgtggcgctcccgctgcccgcctcccccgctcccacggctccgccgtccctccctccctccctcccgcccgccctccttgcctccctcgccatcaccatgccggacttcttctcggccctgaaaaaggtccaaccgtcggccaaacgcgaaggcttcgccgccgtccccgacgtgagttggcaggacgtgggggcgctggcgcctgtgcgcgaggagctgtccatgtccgtcttggagcccatcgcccatccggaaatcttcctctccctgggattgactgtccctgccggcgtcctcctctttgggcctcccgggtgcgggaagacgctgctggcgaaggccatcgcccatgagagcggggccaattttatctcggtcaaaggtccggagctcttggacaaatacgtcggcgagtcggagcgggcggtgcggcaggtcttcactcgggcgcgggcctccgcaccttgcattgtgtttttcgacgaattggacgccttatgtccgaaacgagggatgggcggagggggggaaggaggcgggggcagtggggtgagcg

SEQ ID NO: 4768 - DNA, 700 bp, Nannochloropsis_gaditana
cgaacgggagaaagggttacaggggatggccgagagtcgaagcctgaaccttttgaaccataccttgagccaggcgtataggaaggccgccgttgccccgacaagggacacgggggaggaagtgggggcgggggcccccggcacttggagagagagcgtcagccacatgcggcggagaaacagcaagactctcaaggtggcgggaaagaaggaggacattcgttgccaaatggagagacagaatcgaacgggaaactcatgcgacggaagtcaaagcgacgtcgtcgcttccccccgccttccctcctctcctcccccctctctgcccccccggggaggacgcagctttctcctcttcgtccccgcctcccctcctgcccgtggaacgtcccaccgcccgcttcaccgacctggctggcatcgacgccgtcctgcaagatgtgcgggagctgatcgagtaccccctcaaatacccggaggtatacgcgtatcttggggttgaacctccccgtgggatccttctgcacgggccgccggggtgtgggaaaaccttgttggcgaacgccgtggcaggggagctgggcgtggcgtttttgaaggtgtcggcgcccgaggtggtgagtgggatgtcgggagaatccgagcaaaaaatccgggagctcttcgcgacggcccgtcaggccgcgccggccctggtctt

SEQ ID NO: 4769 - DNA, 700 bp, Nannochloropsis_gaditana
gaggtgtcaagaagcgaggtcgaaatagcgatagctgcgagagggggaggggcaggggcgcagagaggccacaacgacagggaacggactgtgtgagcttgtacgggggcctttattatcaagaagagggaaacccaggaaaaagcgcatcgaaagaaaagatgaaggaggaaggggaagacgagacccgtgccgtcagaggagaagaggaggaggattcggacgccgcgtatgagcaggaggcgcgcgaacgggagaaagggttacaggggatggccgagagtcgaagcctgaaccttttgaaccataccttgagccaggcgtataggaaggccgccgttgccccgacaagggacacgggggaggaagtgggggcgggggcccccggcacttggagagagagcgtcagccacatgcggcggagaaacagcaagactctcaaggtggcgggaaagaaggaggacattcgttgccaaatggagagacagaatcgaacgggaaactcatgcgacggaagtcaaagcgacgtcgtcgcttccccccgccttccctcctctcctcccccctctctgcccccccggggaggacgcagctttctcctcttcgtccccgcctcccctcctgcccgtggaacgtcccaccgcccgcttcaccgacctggctggcatcgacgccgtcctgcaagatgtgcgggagctga

SEQ ID NO: 4770 - DNA, 700 bp, Nannochloropsis_gaditana
ccgcggcacatatgtgacgcatgtatggacaagtcgatcaaaaagtgcccgatcaaacttgctttcagcgaattcttcgtgatagtcgtagaaaatggcgtccttgtcgcccattccgtgttgagagctgttctttacttcgcgttgtttagaacctcctgaaagttagttcacgcgaactcctcatctcttcattgcccacccatgcatggctcaagcaaagtgcacgggcttaagccggacttagagtacattgcctttccaccgagtcaaactactaggccccgaatagatggcaggaatatcgtctatggtatggctttgtgatgtcactgctgctccctcaggccatttcgcgccatattaggtgaaagacgaggttgaccaaacaaaaatctactaacgccccgaaagggacctcgttacgataaatacgaaaggatgaaagcgcatgttaagaaagggtggtttcatgggctcaacaccgattggatcaccaaaatgtttggacccgcacgccccccagccggcggcgtggtggatcattttggtaggacttgaagcagcacacgcaatgaatcagtgccatgaccaccacacggagtacggtggttctattgaccgctggtgcctccctcctctctcattcatcctgatataccttctctatcctcgctctgttgtcctgcgttttctcata

SEQ ID NO: 4771 - DNA, 700 bp, Nannochloropsis_gaditana
gcagacactgcatgacgaaagctttgtggttgcgtttccggagcctcacacatctctcccaccccgtgattttcgcccttcggcaacacttactcgcagcaggagctgccttgccggctggagcaccagcggtgccgaaaagagcatacccaagggccacagagagctcgtcgtattgcatggcgtaggtcattaggctgacttggagtgctgaacaagtaagtgtctttgtctactacatggggtggggaggcaaggttgactgggtggtgagaacgctttgcatgtatgtatgacacaaacgtgcatagaaacctggttattcctccattatgaacaacactgcaccctatgcgctttgtgtagtagtcatggtgaatcatttgacgtctaggtcgtctttatgagtgtggattggccgactcccgatggaaggaaccaggcgcggagggagcaacgcctgcgtcgctttctggcatcgagcgataatattcctcataagcatgtctcacgtgcccacaccttacacccacacacggcaggaaaccaactggcattgtctttgacgtgctccggccacaagtttttttgagacaaaggattgctgtccttggattcgttttggccttgcttcctctcgacctccttatatactactctacgccccgacttctggacagacgcgcctccacggctgatg

SEQ ID NO: 4772 - DNA, 700 bp, Nannochloropsis_gaditana
atcctttcaattgctcgatttgaggctcagtattatattcttgctcacatatgtcacgttgcgccataaaatcactggcattacaaaagcctctagcatgcgcatttgatcccttacgcgcagcacgtgtctatggtcagcctcccaactttagtttaaatagtcccaaaaaatttaagttataaggtagacccgacacatctcacaacgcacaaaccacattccacatgggctgtgcaattactaaggacattcctttgtaggagaacgaaatgagcgaggggcggattgctaggtaaagctacattatggaggatgccatgtgataaacctttccagaggacgaaggatttcatctcaatcagcatgtcagggcatgtcttctccctccaagaatgcgaaatgcatgaatgtgcaggtgtcgcgtatctccggtgggctttccggaaggggaaatgcgatcgtcggggtttttggcgtcatccgggcgctcgccaacacagttcctgttcgccgtcccacttgcttcgagcaactaggacggaggtctcttttgcttgaggtatctcaagttgtcccctccttcatgatacatggccatcatttctagggggaggaagtactgcacaatagagggacccctatggcaccaccggagactgacttctcggcctggtcgtccccgcagcaacactccatg

SEQ ID NO: 4773 - DNA, 700 bp, Nannochloropsis_gaditana
aacgaaagttttttcccaaaaaaagacagttatgtcaatagaaaagacgaaattgaaagatgaagaagatgatgatgatgacgccttactgtcacaggtgcccaattgcgctgtctcgctgcatacaaccgccacggtaaccattttcaaaaaaaaaaagtatttgaattctaacggttgtctccttgcgtcagtccccatccaaaaaattaataaaggtcgtgataataatacgtagcctttctgtatgaaagagtgaaggatataaaccacattcgtcgattgttcaaatgagcggcctgtgcaagtggttcggcccctagcaaaatggaagggataagatagatagaagacgaacgcttcaagacaacggtattccttgtcatggctatgcgcttgttcctcacgttaaaagccaaaccacgtttcttcccttgttttgccgatgaccttacgaatgatatggcatggtcattgcatgcccgtcagctaatcttgccattcgaaggtcgggaggcttctcagatcgtaagcatggggaggcgacaccgtcatctttacaacttcacaagtgatttatttgatttttatatgctaagcacatgaaggattaaatatgcgagtctggcatactcacaccaacattcaatggtttgtgtccctcctatctttatttcgacaaaaacatagcgcgaccatg

SEQ ID NO: 4774 - DNA, 700 bp, Nannochloropsis_gaditana
aggcccccttcgaacccccttagcttggacagattcgatcctgtagggcgggcgcagtattatgcatgagtcatgactgacttacgattcattgccactaatcatgaatgacaaatattttaaggggtgacggccctgcgcccacctgccaagcgaaggtcccttttcgatcatatcatcatcgtcatcgatccctcttccatcatatcatcatcgtcatcgacccctttcccaccatatcgtcatcgacattgatcccttttccaacatatcgcatcatcatcggtcccttttccatcatattatcatcgtcattggttctttttccatcatatcgcttacgtcagctgacgttccgccgccaccatgttccccatcccatcgagacccctcgaggagagtttaatctcttgtacattttcgattgagcgtgtcttgcgttggttatggacatggaatgaaaatttttacgtgttgaaattcttgatagcctgttcgtagtgtcagcatttgatggtgaaaccaaatattactcatttgaacaaacaggcatccatcctcctttcccccactcctccccctccccctcaccgcctccatgtaactgacctctccctcctctcctgtctaacttatgtatatttttcatctgtttgcattcatgcctctaggaacaaggagccctgtgaaagaggccatg

SEQ ID NO: 4775 - DNA, 700 bp, Nannochloropsis_gaditana
tcgcgcacacgcggcagacccatgctctgcacctccacaggtgcacaaggtggagtcctcgcgaatggtcacccacagcaccgtgcacggcggtgaattacgacgagggggaagccccaaatctaaacccgggcacccccggagacgtaacagcaacagtggagaaaacaaagcaacgatctgctcgcttttaactatacccgacaacatggctggttgcacgcaagcccgtcatccccacgacgtgcacggggttagaaagctccttgatacgcattgcagggacgtcaggcgtcgtccggtctattaaaatgggagttttataatgtccagtcccaagggcagtctggcgtctctctgagcacggagtggcccattttcgctttcccagccccaagataggtttagaacggacggaagaaaaccttaggaaaaatcctgtagatctcgaaaacatttggatatttcaccattgcaactgtatattttgtacaattgacccgaaaatgtcctctttctctgcctcaccctattttgcagggccgtcctctgattctgatgaggactaatcggcccatcactctcctgctgtagcctcttacaatgttaacgtcagcctgcaaaataaaaatcgaagagccttatacattgtaccatagatagaactttttctgatggataccatgccattctattcatg

SEQ ID NO: 4776 - DNA, 700 bp, Nannochloropsis_gaditana
cgcatccgtctgcgctttctttagcctggcatcagtctcgtcaatcttgtttttcgtcctgtcggaagcagagtctaccgccttggaggctctatcaatggcctaaagaaagcagtcgcggaagggtgggagaatcagcaagagggcagatcttcaatttgccatcaggttcgacgtcgatggcatcgcacgatggaccttattctttcgctcgagaccacatatcttacctcatcgccactcttcgtccacgacgagattttggagtcgagtttctcaaagaaaccgcctccacggatgttcaagagagaattgctagtacaggtgttgatgttggccgcgatgccggcaacagacaccacgagcaaagtggccacggttccaaaggacgcaaaagaacgcatggtcgtgagagggttaagcgcgaaggattctgtgtccacgagtcggatgaaaatgagaatgtggatcaaagttgtatgttctattctttccggtggtatttcgagtcataaaatatttttcttctctctcgctacttgaagaagaaccgactgtgcacgcgcaatactgtcaccaaatatggccccaggggtacttccagcaaaaatgttctcaaagaattgcccccataaatccatacaccataaaataatcacacagtttcttgaagcagctgggaggggggcctggagccatg

SEQ ID NO: 4777 - DNA, 700 bp, Nannochloropsis_gaditana
aatagttgctggcaaacatggcctaggaggggcatgttccactccgcccactcgttcaaccctccctccctccctccctccctccctccctcccccctgccttccctcctgcccttcttccctcccgcagtggtggaatgtgatcggcggctgcccgaacatgcagatgcaggaggatttggaacctcctccaccgtcgcacatccgcctcgtcaaatttctgtccattctgcaattgatttttatcggcccggcggccttcgtgattggcacgggcttgtacatcgcctgcttcccttgctttctcttcaaatgcgtgggggtgatcgggcagggggatgacgagcgggagaacgaagaggggggacggcagcttcgggcgcactacacgggctgcatttccttctggggcaacacattggtggcatttttgctgattccattttttgtggccatgctcctcctcttctttttgctcactttcttccaagtcttgtgctccagcgtgcacagtcgcttcgggatttgttgtgggatggagaaagggtgggagggaggtggagaaaggggggaaagagggcagggacgaagggaggggacacggccccacggtgaggaagcagaggggggggctcttgccacccccccgccgtcaacggtagaggcggcggctgccgcgatcaatgtgtttgcggccatg

SEQ ID NO: 4778 - DNA, 700 bp, Nannochloropsis_gaditana
tgtcgcagtatagtaagcactatcatcgtctaggcaacttttacccgccctcacgtttaggtccgagtggggagtattttctagaactttacaatgaattcaaaatttgacaacacacactcgatgttctctctttcctttaaagattacgtcacgcaggctttcattagtgaaacggaggagcacgtgcgtcgggcaccgcgagtctctccctgcgcttccacatctctgcacttcaatttggatttcaaatcctttacacttcttcccgtcattctctgtgcgtttacgaattaaattttgtctggcgtgatacacattgacagtgtggaaagaatgtcttggttcttctctcgtggtcgcgagccctccccgacaattacggaaggagagcaacgagaaacccgtcacgacattcggggaccgcctgactcggatgccctggtcagtctcgaggaagggcatgcctcgtccgcggctctgccgcccccctcgcctttggcccctggcgcttccacggtgccaacgagtcaggcatccaccattcctaggccggatgggccgccgacggcgggagaacgggcggacatcacgtcctggcaggagaagaaccgtaagagtcgaaatgtgacggaatatgtggagggcggccgacggagtgaaggctattaccagcaccccaaccgccaacgccaccatg

SEQ ID NO: 4779 - DNA, 700 bp, Nannochloropsis_gaditana
caacgagaatatagttcggcacttctcatctcatgaaatccaggcattttgcttctagcttcaagtaggatcaggactatggctgggcttagcgtcatttatttcgaaaaaaagtcaagatgatctcaccaaatacattgatatactcgcatcactctattctctatgaccgttgtagtcataatccagggattgaggcactgacaatttctttcaattcgaaaaagcaaaattgatgttgctcctcacatgaccagtccattctgataatctcactttttcgagcagcaactgagatcagaactatcaacagctatccaaggatatcaaagcaagatactctgctaataatagaatatattaatgtgatctgtggcttgctcactcatttggttcccctaggatctgacctgtggtccacctgtagagcccgtccagcactcatttttcttggcttgcttccagctaccatggtcaaaagatattgacaaaggaattaaattcaatgacgtaagaaattacagcgcctgttcattcagtgtcaaatcggatacctagaaaaaatgtagaagtgatacagggggttgaaaagcgctgtgacaatgaaggccagagaatgggcaagtgtcaggattctggtcatatatagctaggcctcccagaaatgacgccttttccctgatcttgttttcttagaaag

SEQ ID NO: 4780 - DNA, 700 bp, Nannochloropsis_gaditana
aggcatggtaatgatgatgccttcttgggtcttcgaggcgatgggtgtggccaaaggagcagctaaaacccttctgctattcatgtgcataagcatagaggagcacagtcggcgagttttgagaaaaaagcagtttgcagacatcacgcaagcttgtgtcgttgaaacttcacaaaaaggagacaagagcgttttcgatgatatgcgttgacaaagttctggtcctaccatatgggcctgacactatttcgaagtcatatcttgttacattttttaagtcggtcaaatgcttgatcaatgcatgaagcgacactaaagtgtagagggaggaggttccccttgtatggaacgcaaaacctccttttcgcaccgattttgcatctttaaatgtatactcctttcttttgcatcgatcctccagaacagaccaaaaaaatttatgctacgtcccctacggcctcctgtgtgccgtcctacacggaggctttttagtatacctcgcatctcgccgcctgtaacgtcctctcctcggcctccggtctgctgctcgactttctctttcgtcatccgcctccttcccgtgtatggcaatggccataaattagcagagccttcgtattgaagagcgtacattccatggctttgacgccattcccttttcttctgtccgtcgacatgtactaataccatcccatacatg

SEQ ID NO: 4781 - DNA, 700 bp, Nannochloropsis_gaditana
taggagtcactgtaggctctgtggtaagaggtatggtaggcaacatggcaggagtcgctgtaggccacgtgatcggaggtatgataacataaatggtgcttggagccgccgtagtcgcgggttgcgtggaaaaaataattgggactgaagttagcgcgcatatagttctctttttcgattttaggtgtcgcacccgaatttctgctggggttgataatggtgtcagacagtatgcatcagtcgtgttgacaaggtacgccacagcgtcgactgctagcattgcaggggcacacgtatcaacactagccttggccagaaagcgttgctttcgatgtttggtgagattaactccacgccagtggatggccgtcgtcctgtcgaaattttttacaatctcgggccgcttgtgaggtttggatgacgggcgagtcgctgtccgcttcaaagtcaatccatcgggtagtgttagtttaaattccacgtcagccacaggattgatgctgcgaagcttgacagataccttgacattacgtttcccagccaagataccgcgcttgctctttggatgcacctttgcgctcagcgaaaattgcgggcaatgttggccagacgactttggaatgctggccaacatcaagaagagaagatacagaatccctaagacaagctgcattcgcaaaatctgaaggcttagtcttta

SEQ ID NO: 4782 - DNA, 700 bp, Nannochloropsis_gaditana
tgaagggaagcatcaatgaagggaagcccactgctatatcgaaacccgtcgagcctacagcgccctaaaaatacatcccattacatgcccctgagagacaccacatagcctcgaaagtagattctgaatatcaaataaaataacgtcaacattcttaatccagagtatggattcgatttcgataaacatgggaaatcaggctgctttacgtccctgaaaacgcgtagcagctgctagcaagcattacgctcccactgacgcattccatcccaccttcaacttctagacttctcaccgattacctcaccgcatggacacaccaccgggacaggatggccacgccacagcaagccgtgtcttatggggcgtctcgcacggtggtcgcacctgcaaagcccggtcgccgcagccagggcagaatggcaagcccaagtcctcgtcttcctccttgccggcagcaggccaggacactcttaggcacatttcttgccatgtccctcctcgtccttccggcaacaagctcggccttcctcatgccctacacgagcagcagaaggacttctcctttgcctttttcccgcagcaccctgtcgtcccagacttatctttcttttcccctacgtgctccgggcatcacggctgtctacctcctccccctccctcctcctcctcctcctcctcctcctctttctcctcttcc

SEQ ID NO: 4783 - DNA, 700 bp, Nannochloropsis_gaditana
cacatgggcgatgatatttgccattaacaaccagcacagcataaaattaaaacttcaaaaaatatcccgcagactagttggacttctgtagggataaaaactcagtccaggtcgcaaatgaccttcagatgggtggtcggggatgagaattttaaatttttgaatttggcgccaagagaggcaaacggtggcttgtcaaaggcaagcgtagcatacttgatcatggcggggaagctttccgtgtttttaaaaaatgtcaccaactaaccagcatttactattttgggtttaattgccaggagaatgacagtgcacatttttttctgcgcttttgttcacggcagcgaggcgttgaatgtcaaccgccgtttccacttactggacgttttttacactttcatgtccatcgggacttttgtaaataaagattgcctcgcatttttctatagcgtcacaaatagcagctgattagaccattcactcccaactgttgcttagttgtctgtctgaatcttttttttttggtgtgtggagtgcaactcgttgtgtgagagaaatgcacccgagggacgcggcgaggagcgtgcttagtcaacgtaatgggcctttgattttttgtcagtcacaggcttcgcgaaaatccttctcaccgctgcatatcattcaccttatctctacaattcgcactcttgcatttagg

SEQ ID NO: 4784 - DNA, 700 bp, Nannochloropsis_gaditana
aggtttacatcttggtgctgaataccgagacagaagctgaagcgaaagaagaaaaataaagtcgacgcattttaaggtgggcgcttggagtctgtacgcaaagaatcccacaaaatcaaatcgttgcggcgcgtagttggaagcctcaatccttgtgtcgaaacggtgtgtctgtacctgctcatttggtgcctcaaattcatttttgcctctgaacgggcaacaatgttgctaagctgttattctcgatacatatatggaatatagcggaagctttgacgctgtaaaaacgaagttcgagccgttgtataaaaagctctataaaacccctgcgttgtgaccgggggcaatcaaccctaacgtcacaaaggaaagatttctgcccccccttgcagtccccttttactttgttgcgcagcctgctggcacgtgatagaatgcgcagtagccttaatgaaaaaggaaatattggtacaaatatcgttccagtcatcgtcatgtgccgacaggggatgaaatcgacgacttttatctttccttcagtagatatcagacgtacgtactcatattccctcgtgcatctccttatcacttgcttatcaatacctccccagacggcaggggagtggtcaaagcgcgagagggagaccttctaagtgctgttgagaaagcacgaagaggggtggtggtacaggccatg

SEQ ID NO: 4785 - DNA, 700 bp, Nannochloropsis_gaditana
aagtcttttcgacagtttctggcgttctccgcatccgttgtccactacgttatctctacgtgcctgatgttattccgtgcgctttgcgctttctccgagaaaatcctggctgaaacgcttttccttcatggcactccctcaaccgtaatctttgtatcaaaatgttattcgggaagagataaacatcgtgtcgtgtccgagagacgacgaatgtatgtgccccaaaacttgggctatcagcaagctcttcaaaatcgcggacccgcttattgctgagattcatgccactgccgaccctgttcccaatctcgatcttccaaacttggagtcgtagcctgtcagttacctccacaacaactacatcagccatatgaccatgcaggacttgtccgttttggggggggctgcgtggtggtatgcgtgtccgcgagcgtggcggggttcgaccatgtagctcacaacggcggtattgttctcggagcgaaagtggcaaaaaacatcacccacgcgaacaaccctattcgatcttacacacatgtagcttgacgcaataaaatggtcatcggatgccggctacgaatttcctttggcgtcaagtctgttgctgcccctcttcttcttagagcccggggccggaatggtaaccgggaaatacgccgtaacatacttaactctcctcatgtcagcagggaaagtgatg

SEQ ID NO: 4786 - DNA, 700 bp, Nannochloropsis_gaditana
gcatgtatgagggacatgacaccgacactagcctttcattcctcctttcaatttcccgcagttcttcccctgctgtgttcacgaccgctttcctggcacggtaatatgcatgcacatttaacattgaattctatagaagcgatgttacccccctttccccccctacgtacctgataatcctccaccaacaagtcgattcgtctccttccctccatgcaccgtctccataactcttctccacttctcgggtctctcacgccccgtgtcgcacgatccgtcccgcccggctgatgaccatcgagctgatcctgttcatgatggtcctctgcctcgccaagagatggtattgtgctgccactcgcgtccgggcattgcgccctctcctcttcaaccctctcacactgcagagcgacaaactccctgctatccacccctgtgccgcccaaggccaggtgcgacatgccttatatactgtacaaagatgtattgggatggaaacgcgtgtcattcaagaggtaaagcacgctgtcctcgttgtgaagttgtcaggctcgctgaagcagtacgtaagggaacttgacctcctcttgcctcttttcccgttgctgtgctcccacccagtaaagaagaccctctaccacattattccttattttctgaaatgtactcctacctttccaatccatccttccaggcgatg

SEQ ID NO: 4787 - DNA, 700 bp, Nannochloropsis_gaditana
cgtgggacataagtggcatgcagacgggcgaaataagaacagcaccacagcccaaacgcccgaggcggcaggtacaaaacccacgaggattccatgaaaggacagagagtaatcctttaaatccactcccatcctgcatgaacccacctgtcaaagctccccctgcgcgctacgcccgtgtccatggcctgagtttgtccaccagctggcttgaagtcatcgagatcttgctgcggcgccggcgcgagaagaggagagaggccctcctccgtccctcctcacacccaacgccttgacaccaaagccgattttgccatctttcaagggcactgacctccggtttcatggcgtgctttggcaggagtgggggaaggcgagtgctgagggagcgtggggggggtttcgggggcgcgatggatttttgaaggtggtgcttttttgggtggctcacgcagcacacgcacacgccgaaggggggggtcggccggaattcttcctggtgtaatttttctcctccagcttctccacgctgtgtctaacacccgcatcatattccatccaccggcgttatggcctggaaacgttttcgtcgtgagaaagactgggatgatcagacttgaccttctttgtactcatccatttcaccgtgggcaccgcatccaccccctcaacagcaagcagcagaaaagcaagaaagatg

SEQ ID NO: 4788 - DNA, 700 bp, Nannochloropsis_gaditana
gaccacccatcccccggcccctccggcctcccagacccagcctcagcagcaagacaaaaatgccgggccgtcctcctactcctttcctccccctccccacccgtcctacccgccctatcccctccctcctccccccggacacggagtccaaggctcgtaccccctctatcctccccctttctcgtcctcctacctgccccccccccctccccctacctcgggctcggaagccgccgacaagaacgcggcctccaccggcacctccctgccgccctcctcctccggccacaccacctgtgacgccagtagcaacaacagcagcaacaacccttcccccgccttgggcgcggcggcggaaggggcccacccgacctcctccgcccctcagcaggacttggccgtgggggtcatgctctccgtggcttcggacgacggcggggcggagggtgggatggaggacgggatggaggaaggggcggagggccacgtaccttcccagtaccccggggtgcattgggaccgggagaagaaaacctggagcgcctggttaaccttgcccggtggagaataccaatgcttgggagaaagcttcagggacgaacacgctgcattgacggcccaaacggaagctatcgcgaattactacaggaccctggggatgattcctccccctcccccccccgccttggcggcggccatg

SEQ ID NO: 4789 - DNA, 700 bp, Nannochloropsis_gaditana
aagtggcctgataccagcaccaaccccccgaaaaaggagggaatcctgtgagtccacacgacggacagatccgccggccaatgcctttaggtcgcacgtgtcatgcctgctgaaaccgtggacgcaggagagagccgccaatggctccgtaggcggtgtcatgcgcggtgtacatatacggatttatcttctgaggccatgggtgttgccttcctcaacgacaagacccccctctcttcttttctcgcttttgcctcgccccttttcttttcctggtcctccttgcaccatgcgctgcgcacacatgcacgtgttgttccttcgtcgacgtgtgtggtggttcatagggtggcaggaggaagggaggccggtgtcacgtgggggaggtggttgcgtggttagcgaggtagcgaaggggaggggaggctaaggagagcacggacctccccaccccctggtgtgttttctgcaagcaggcttttcccatgcgtggtgccgcgctggatcgtcttaccatgccttcatgtcttcacaaacatgtccagattgagaccaaggccgcgtgtgcgcatttttgctgccaatttaccacggtggcatctggcttgaaaggcggtttctcttcctttctcccgcctgcctcctcacccttgtgacggccaggctattttttgcacatcactgcgtcctttgaacaatg

SEQ ID NO: 4790 - DNA, 4 bp, Nannochloropsis_gaditana
tgtc

SEQ ID NO: 4791 - DNA, 700 bp, Nannochloropsis_gaditana
ataataccaccgtgatatttattggatcatgttacaagttttctttccgtagatcaactttggtgactcttgagagacgagggaggaagctctcactcacgatggtaatgtgataagcgtgacgatgacgatggctggcctgttaccagccaaattcattcatagcgggtcttctcggagattttgatatcatatgttttgcgtacacgtccctgtatttttaaaaagcctttacgaaagcgaaagcgttcattatttaacagcgtaaatcggcgtggtcgaggacagaaaatgaagtgttccaaaacccctacagcccacataaggttcttctgatctacgatacgtgccttgggctttgtcatacctgagttaggtcataatccaccacgtagcagctctagggcaggccagtaaatcttgactggtcaaacagaaaagcttaaaaaaaagaacaggtgcaagcttcaactggcgagaagagcgacgaccccctatgttctagctgtctttccgtaacactcccgttcaatatagtggttgacagaaaacaattcaccccacaaaaagcttcgacaaaaatgcctcagatgagtgatgaagaccaagtagctgatgatgcggctttgctgggatcaacgcaactttcaggaaaacatttcaccaaagaaggacctcagagcccaaggccactgccatg

SEQ ID NO: 4792 - DNA, 700 bp, Nannochloropsis_gaditana
gctcatgtacttcatttcatgacttttcaactggaaacttatgcttgtcgttatcagggcattatccatacgcttatagaagacgaaatggtatggtaaaagacccaaaaaatgtttatgacgaggttttacgcaattcttccgtatgtagagaatcattgacctagaatggggagattctgcctactccgctccaagaaaatgcctctcacgcatgtcaccgttcccacgacaaggattgacaatccatggtatccctgcgttcaactggatgtgcagacgctcggaggtccatgttcggcacggatgtgaaaactgtggggtcaaaggtcgcgtgtaacggacttttgaaagtttgaactgaggccggcgtcagttctcgtctgtgatggcctttgctcagggcaacctcttgtcccaatgtagcaccagctttctccagcacataggcttcgcttgcgagtatagacccttttattattctatgtagcttgacaacgctgtggagcacagaggcgcacgtactgatgtgagttttacggcactatcttgacaatctttccatcgtgcctacctcttctctcctcctgctacgggcagaatgcttacttaaagaggaaacttcccgctcatccaaacgtaattctctagacatattgattgtctgataaaacacacaaatagggctctggaagacatg

SEQ ID NO: 4793 - DNA, 700 bp, Nannochloropsis_gaditana
aatcacgcgtggacagccaaatagtgatgagctcatgacgcttttgctggggttgacagggctttcatcacgcctcatgtcaaatgtcgcgccaagcttgctgtccagaacggcattcatgatcggtgtacacgatgttcgaatgtgaaaggcgagtaatgtccgctgctgtctttcgacaatcgagatgagtagaatgtgcgttaatatacgttgtgataatatcgtatacttacaatcagacaaatactctgcttcccactcactattccgaagttatcacagccagagcttcaaatcttcctcaaaacggatcacataacaccaaaacaattattcacgacaccaaagcccggtattttccacgcactgcctggcagggtgcaagctgtatgggccgcggtcggttacttccggggtatctccgaggatcgagcgagggacgctcgccctcgctcgccggcgtcccttcaacacgcagtctcgacctggaggcacgcaaaggacccgtggcaactgagcacccatcccacatcttcaggacattgtcatgctgaaaattgttgtcgacgaagggcttcgcgaccgcttgttgcagaatgtggcagctggtcccaggtgtcaagttggggccatagttggccgtcggctgccgaatgggagccggatatattgcctgctcgccatccccatccccatg

SEQ ID NO: 4794 - DNA, 700 bp, Nannochloropsis_gaditana
cctttttcaaagcgagaggctccaaatatgtcacctttctagggagaagatatatcgactggtactatgtctagacttccgatgaattactctccctattgcaatgatttctgttatgatgcaatgatttctgttatgacatgccaattaattcgtgccattcaaggtcactggtgatggcccctgcttctcgtggcaggatgcgctgccgaggacatcctcgcgtctctctgtgagcatcaacggaaccaagcatgatatatattgtcgttgcattttagatgtaaaatatcgaatcaatgcacttctacccgtattgcagatagctgcatcacccagaattcatgtatacctcgagctcatgtttccgcattttttaaccatccgatccgtcggaagcttcaaagcgagatccacaggtgccctttcaagcacagattcagcgtagcagagtatgaaaattgctttaagcgcattccttgtcgctctcctgggcttcacaagcattttgaccaccgtctctcaagaatgtccgcggctttttctcaaggccaaagtcagaccgaatgcaaggcgcgggatcctggcagggaagggtcaggccaagattaccgtcacgctcaacagcaaagaccctgtcgacaatctggattttcaactgaacctgccaaatggcttaacggtagagcggacggcaatg

SEQ ID NO: 4795 - DNA, 700 bp, Nannochloropsis_gaditana
ttggcgaggtatgaaggccgcttgttctgctttctttcttccctctgtttcatgtcgttttcgccttgtcttttttcacatgggcccatccaagctcgcttcccctcccgcttcttttgcctcctcctttcctttttccacagtacatgaagatgaaaggcaagaatgtcgaccctaaggtgaagtgaaaaagccatgaagcaggctccggtccgaaccccccaccactattgtaaattcaatctcaccatgcacgccatgccagccctccacattttctttgctcgtataggactatttatgtggaaattctacctgtcccacgaatagcttaattgcggcatgactttataatccccgttactctctaggatttctcttacactcgtatatagtgaatcctactcgtcgaatcctttatttccctccaggatcacgcccagcgcttctacgagcacattcaggaatacgggcttgactcccaccgctccggcatagtcgatgcgatcgccagcaaggtgggagagagggaagggaacggattgagagcaagggaagaaaggtcgaagaagcaggactgtggtcccacgagttatattggactgtccgactagagtccaactcatcgcttcaatatttcttgcttccactgtccctccttccctccatcgtcccgtaccccttcttccaggtctctatg

SEQ ID NO: 4796 - DNA, 700 bp, Nannochloropsis_gaditana
tccatcagcctcaaggcagcgcggacgatcgagaaacaggaagggaggaggaaacgggcccagaaatcggggaggaaagtgcatctacccttgcagcagcttgcggggtcacacgtgtcttgctgccttctcctccctcctcctccttctcctcaacctcctcattccttccattgtcatcgtctcgctccccatccccgccctccctctcctccgccttccatatgatgatcagcgacgtcctcctcgcccgggccatggccgcggttgacggggcggacgagacggaaaagacggaggaagcggaggaggaggaggaggaggacgagggaggcataatcttatgcagcaaggcaagaatgttgatcgatttgagcctggccttctactcaagccccctttcagccccacctacactccccgtaagacagcgccggggggtggggggtgttgagggaaggcagtggcatgggcgggcggtggacgcaggggggggagccaggacgcgtgggaggcataaaaacggggggggaggggacgaagggaacgagggagtcggtggagggaacaggcgcaaggcagttatgctggcagtctttgaagtcaccctttacttccttccccattcttctcttcctccctcgacccgtagcttgcgcatcgagctgcctgcctccggcacctcccattgctctccttc

SEQ ID NO: 4797 - DNA, 700 bp, Nannochloropsis_gaditana
cacccttatggcgatgatgcctgtcagggtgattgccaagtgagaatttgctatctttcatttttcttactcaatccttgtatctcaatacgtatccttcaaaacgtgccgcctcccttaccgtaacatgattaggacttccatctcttgtccattagctctataagggtagcgccaaattcttgtgactaacccagagagtgtggccttagtcggtggttggtttcccatcttggactggcctgtccaaggatgaatgcaggaacacaaagggatgcattaatgttgcatgcgtacctaccgctgcccatgccgtcattttcggcccaaattttcaaactacatacaagatgcataagtcgatcaatggaccctcaaccgtcccacgctatgaccccgtcttgacgatgcaccacgccttgccacctgctttggtttagccgttagcgaccgtttacgacggtttagagccctcgctttggagtcgagtcttcccttttccaaaccctcacgccgaaagggcaatgaccaggaactgattgtcgcctccacttccatagtgtaatttttcacgtgtattcaattatatgaatcactccaataggccagaaattgcaaatttgaacccacccgccagcggagctttcacccgcgtcacggaacgaagctagcgtccgaagcccgacttttatcacatatg

SEQ ID NO: 4798 - DNA, 700 bp, Nannochloropsis_gaditana
tcacctcggcaaaacaggtgacacatgttaacgactttaagaacttgcatcaagcgcatcagacggaaaaaaatgccagtagtagaggcatccggccgacagtggaacgtgacggaaagatactctccacgtgttgaccttgcctaccttcgcgagcttgcgctttttgcgcttgtcctcactgccacccatggcagctgcagattcttgacgctactttaacctacaggctgggaaggccggattatacaagtgagcaggagtgatttaagtgctggtagtctcggtggcccacaggtctcgccaacgatggacgccatcgccggcggtgttcgtctcaaaaaaaagacataaagcatgacatatccctcgaaaagagtgatagcttgatgcacgtacaaagaaaatgatagcgcggcatacttggaggataaaaatgcagtattgattttccgtggcatgtgctcgcatgtcgccccgggaaagagtagtcgtcgcacgcccgagttcatgctcttccgactgaaagtcatccaaagcctacacaaagacgtcgtgcttattacgcggggaagagctgctcgtctctctcatatcctactttcctcaaaacgcccacttgcaggattatacagttgatagatagccgccgaggggaaccagcctctcctttttcggcatcatcggcggcagagggatg

SEQ ID NO: 4799 - DNA, 700 bp, Nannochloropsis_gaditana
ggacgaggggggaagcggcgacggcgattgaagcatgttcagggagcgctgtcccttccccctgtgaacaccgtggcgtccatgcaaggcattgtctcccggtgcaaatggtacatggctgataaactgcactccagtgtccatgaggaaaatgcccttctaaagtagaccctgtgtggtgattaattgaacttccaagacggggaggaacactgctttgacctccccacctctgccaagcccagcgactttttcacaacaatcgtacttaagtgcctatttacgatgcaaatgtgacaaagttcgcatcgcacgtcttatcaatcggctaaaaggtgctttatatgctcttgcaggaattaaaacgtcacgattggactccttttccaccagtacgctccgagcgttgaaggggatacactgcgttgcgctgcattagaagagctcctgcagccagggtcaggatataacatatggacttgttcatcgagctaggtttgttagtcggcttggcgtcgttgcttctcgtcgtgtcctcgatcaatgccaccttggtcacgctctccctcctccttgggtgcctgttgctacttgctggtgtgcttggtaagtaagaaggatgcgagataccacccactcaacgccatacggtgacaaccacatcaacctgtgatcctcctttccctcacccctaactatg

SEQ ID NO: 4800 - DNA, 700 bp, Nannochloropsis_gaditana
acaaccttctaagtgtttacagtcttcttccctcgcctcatgccttttcatactcatgtcatactccctctcttggcgcccttctcctatccctgggacctctaccgtccttccccattagatcctggcctgtatattcatctgtcccttccttccttcctgcaaagagcgtctcctcttgctcggttggattttccgttcggtgtcttcgcttgtcatccgtctaaacccctactggcacctacgcgtgctgggaccacgcccgacacgccctccctccaagaccttgatcatgtgcaaccacctatccaatgcagacgccttcttcctctcctcggcccttttgccttgggaaaccaagtatatcgccaaggcgtcgctctttcaggtgcgggggtcaggagggttggggatagggaggaggatccctcagtcagacgacctttactgcgtgaggtagattcttagttgcctgactttcgctacatccattggaggggcgcgtggctgctgcatgctggctgcccgcggggcactcaagttccttacccgactttaaaaccagcgttctgttgaaaacgtcgacttcctttacatttgccgtattttcctcccccccctctttctccctcatcctccctccctccctccctccctccctccctccctcccccaggtgcccttcggcggatgggccatg

SEQ ID NO: 4801 - DNA, 700 bp, Nannochloropsis_gaditana
cgaaatccaaattgttacctttcaattttaacctctagactcatatgcaataattatggaattgtagatgttatagtttcacaaagcatcaacaagaggaaagaaaaagattagagggaaggggaggttcaacttaatgcgtcacggttaatccgctttaccatccccttaatgtaagtctctgtccatggcaaggatgcgggcacggttgcctaggaaagtaccattgcttccaaccgctataaaaccatgttgacactgcaaatcttacgttgatatcctgtgagattcgtgaactggaacgtgtgacatcagacagcaactactcaccgagctccgcggatcacatcacaatcggatcctatatcttattcttcccatctgcttcctgtatacatctccaaaattgtactccataagtgcagaaaagcagtgcgagcctgagctggagcatggccgcaaatgcggtctcgtaactgccacaagtgttgagaaagatttcacgtccgcaaagtggcacgttcttgtgcaaaagcagccatttacaaagcaattgagcattaggcacataataagcaagcaatataaataagtacgaaaggcgtgaatgggttctcctccacgcggtccggttattcctgcggggcaaggcggactcgctttgcgcgttgttgtatcaatctgggggtacacctcgatg

SEQ ID NO: 4802 - DNA, 700 bp, Nannochloropsis_gaditana
acttatatttcacttctccctccttccctcaacgcttccctccctccctccctccctccctccctacctccctccctcttttcctgccttctgcctcccacctacattggcctttaatctcatcctcttccccctctaaccctaaccctcatcctgaccccaacccttagttttgacaacatcatggtcaaactcctccctgagcccaaagacatcttccagaacggcgttctctcctctttcatcgtcaaaatcggggatttcggacaggtctttcctcttcccttccttccctttccttcttcctcccctcctccctccctcgtttccgcatttgagtatttgccaccacctcctgtttgctctttcatcaagtcagaacgcacggccaaagccgagggcacaatgtctgcgagctgcttccttctttccttgacatttcatacctcttcatttctctaaatcctcctcagtgcgaattcgactttccctttccctcctcctcctcctcctcctcctcctcctcctccacctccacctccacctccacctcctccacctcttgctgcccacaatatctgccacaagtcgaggctgggaaggcccaatgtaacggaaatggaaacgcagctgccgtcactgctcctcaccgaccaataaataccgatattccccgagaacccgaattcacccgaaaatg

SEQ ID NO: 4803 - DNA, 700 bp, Nannochloropsis_gaditana
gtggcaatacactgtgagtaaacggccgaggataagccgaagtgcatgcatggctttgtgaaatattcatcactttggttgcatgttattacttcctatttgtagccgacttatctttgattcagtctgtttcttttctccaaaacgacattgcctctgcacctgtgaggcatccatgatccttacaagcccccccactctctattggcagggcttttattgcttgtcatgggccccttgggacggaatcgagccgatcttaccggctccacaaacaatatgtccaagttcaggtaccataaaggggtagataagacgaagggggaatggtgtgacatagaatttagtggaaagggtacaattgaatcaaaccaaaacctatggatgctattgccatcgaatttattgcccgtcggtgacgaatgcatgtacttctcacacacatgcccttggatcacgcagaaacgatgctaggatgcaggccctcgcaaaggctgtacaaaggggggatcgggcaggcatgaaagaggtgatgaaaagaaattatataaatatacacgggaaatatgggggaatatcctaaggaaggcgggaatgcaacaagtgcctttcaatcctccgtatcaggagctcagtattcacgaagttttctctcggactccctcagatcatcagcaaccgcagtgagaatagtaaaatg

SEQ ID NO: 4804 - DNA, 211 bp, Nannochloropsis_gaditana
ggagggagggaggagggagggaggaccctgggtatgtcctacaagcaaaatagcccacgtcatttcccccttttctcctccctgcttttctcctttcctcggcagtcaactggtcgataggtatatttccctcttggaggaggacgggaaggagggagggcgggagggcgggagggagggcggcttcgttgtcgacgtccacaacgacatg

SEQ ID NO: 4805 - DNA, 700 bp, Nannochloropsis_gaditana
gctttactcgcgcgcgatagtctgcagcctctgtcaggtggcaatgggctgtgctggagcatgcaatagtgcgtttcaacctcccccccttcgctccttcccgacacgacgtgaacgcacaggaacaaatgaagaaaggggctcatcccatccatgggcgagatgcacgaggggcctcggaatctcaaagtcgaagcgctcaggatgaagaggacaacgcggcctcatcctcgagcttgcgggcttcctcctctcgcacagagttccacgaggacgagtccctcattcgctcctcccgccaacggtccacggtctcctcctcttcttcctcaaaggatagtgacagcgacgacaggtatgatagcagcagcttggaaagtgaaggtcgggccccgcgcaaggagaaggagacgtcagggcgaccgctgtctgaaaatagtgctcgcagcccgggccaggggagcccgtgtctctccacagcgcaagaaggtggaggcaaaagagggagtggtgaggaggcaaaacagggtgtgcgaagcctgcaagggcgcgaggggaagggaagggatgtgatgcaggaggaggtgtccagcagggatgagggggagaggacgagcgggaagagcgaggagagggcacggaccctagcagcagccgcggtgcccgcctctagccgcgctattgaggaagcggtgcaatg

SEQ ID NO: 4806 - DNA, 700 bp, Nannochloropsis_gaditana
ttttcgttcgcaccaattgctttgcatgatgattgtgtccgtgtatttggttctccaaattatcagacgcgtgaatagagtcaaagggtgtgacttgacgccggcctccatcaccggttcgtaatggagtggtaatgccctcctctgtgggggagaggatgaccactttctcctcatttactagaacaggagtaataggtagctctgtcatgccagatggaccacctcctggacttaatctgttaccataagccccatttacacgctttcgagggctggcgtccatagcagagcctaatatatatgggttagggggggagggttaaggcaaagatctgtgtcgaatccccgttgtgatcaatgagcacgccccctattttttgcttataagaaagagatattgaggaagcatgcctagtggagtctcaaataaattacgcacgcattcgacgtttttaataaaaaaaaacaacgaaaggaaggaagaaaaaaagctccatccttcggagagggacccaaaaagcggaggttgatctttttaaaattttgaatatcaagcccagttgctatgtcgcctctgtctcatctgtacatgatgtgctttaggtcccacgcgccatgctttcgtaccactgcacgattattaacctgcgcttacccattctgtgtacagacttatttttgacgccggacaatcatg

SEQ ID NO: 4807 - DNA, 700 bp, Nannochloropsis_gaditana
gaaaatcctgcccggtttaggaagttgtaccatggcccgcaggaaacaaggaaaaaaatgagacggggttccgagattttttcccaaaggacgcacctgtcttttggtcaagccctcgccgcgggctttgggcgcaaaataacgccctcctttactgcgtcccccttttcgaccgcgtggggctttacccataccgaagcggactgtatttgatatgcggttaaaaatggggagggggggaggtatgccaggaggtagaagagagatagcagaatcaataaacgcctcaaaaagggcagccatcgctgtctgccatcaaagcactttcaagtttctatacaagatgctatttcccttgagttcgtcgcggtattgtggtagagaaacctcgcattaaaggcggctggtgcgcctgagcatatcgctgccatggagtcgtctctcttcagctccatctttaccctccaccctcttccatactattccagaatctatgacacgccatcgcccgttctcagtcgaaaatgaccaaccctgatagagggaaatccgaaaataggcatgattgtgggcaaggagggaaaactgttgtagtgctaaaaaaccaacagacctcaagcactgagcagagagggcggtgctcgagtctcactgcgcatgccatttcatcttctctcacgagacgacgccaccccataaa

SEQ ID NO: 4808 - DNA, 700 bp, Nannochloropsis_gaditana
ttaagcttaaaacgtttctgtttctgatagtcttgaaatgaaggggtctacacgccgggtgttatcccactgaactggttgttctatgcagcaacgagacatcacaatttcatggcaagcgggaaggaatacagggataacctgcgtttctacttataatgtatagactgcaatcaacctgtgtcggtagaaaaaggaggattgagaatttttcacaatcttttcgataggccataataacagctcggaccggcgacttgtagcttcgctgcctagacgctatggcctattgcagcacccaaaaggacgtctgtgcatatcatagggatgtctaaccgttcatagatggcatcgttggcgatatccttccttattcattgtaagaggatcgagaggagacggaaacagaggcctgcgtccaagcaggaaagacagaaatctgacgacttgatcagagcatcatgttgttcgatatgcacttcttgtcacaggtttgcctgtctcgggaatacaattaagcttagcttgcctggtacagttaaataatacatttctatggagtatttaagtgaacgcatgtgtagtcagtgcttttctgtcctcactctcataccctctgtggccctcgttaccctatacttcccagcttattttcctgttaacgagggaaccacctccgcggcacccagcgtccatcatg

SEQ ID NO: 4809 - DNA, 700 bp, Nannochloropsis_gaditana
tgaaatcgcaaaaaacactgctcataagacacacgcatcaaaaaaagtgcaacacaatgtatgcgtccatgacaagtaccctcagaatcatttatctttgcaaaaacacaaatccggcggtcaccggaggggcgaaggggggggggggttgaaatatcacacatgatatgacgaggttcgacacaccttttctcattttcatggagaggctcaaatctgaaggagcacaccccgccgggtgggcgggacgcctacagtagaagtttctatcagtggaattgtcggtgaaaagatgatacgagtcgttgtgtggtgcgaatattttgccggtggacatggcgggatatggttccagaacttgttcttatgcaaggaagcagatgtcgtcataatgtgggccgcgtgcatggcagcataacccgcatgcctgccggctacgcgcgcacatgaagcgtttgaaatctaacgtagccttccagtgtgtaacctttatgacctgttcatgaagagacgtgcagcgacctaactgtttttcacgcgggcacacacctcgtgtgcccctagttcaacatgtagcgagttgctgcccgtatcgatgtcttgttctacactaggtactcttcccaatctaacaccatccactcaatgcgttgatatttcttcgacagtcacaaagaaaaagcggccaagattcatcatg

SEQ ID NO: 4810 - DNA, 700 bp, Nannochloropsis_gaditana
ggttttcaagggtctgttgacactcctaaggcatggtgaatctctgtgctcgtgtctccgtagaaccgtgattgaccgacgaaatcctaaagcgcatttatcccgcgacttttgccgcatgcgctatacggctcaaagacacgcggcgtaacacgcatcgaaaatatggacacgaatacatggaagactcgatgcggtttgcatgtgaggtgcctgctggtgtctcggtcgctcatttctccaagattactcgtgtggtctaggcacacgtaagtaccgaaatatcggcagatgaaggcagttgcccaccagtgaccgaaaaagcgatgctcatttttgttagacagctcttggaggagatggacttcaggtcttgcgctgtgtaaatatcgtaaaataaggtcatcgagccgacctcaacttgtctccagggatcagaagctgttatgcgagagttccaaactagtgcactcaaggagagggacgagttgacttaagacaacgaatgcgcagtaacttatgacgtgagagtcccgaacttcgagctacccattcaagtgatggtgattcctgtttcactgtggcacgacgaagcgtaaaaggtcttcaaccagcaaatattaactttctgagtgagtaatggtaaatatgccctcacaaaataatatctgcaacgacaaacacagtgaagctgaggatg

SEQ ID NO: 4811 - DNA, 700 bp, Nannochloropsis_gaditana
ggtggtccaaggtaagtatgacgcgctcccaggtagcatgtggtcgaaagtacttggcttacacccctcaatttcggtgaaaaagatacgcgagttagtcatccttgccatgtaaaacttggacagtggtttggggaaaaaaaaaacgactgctatttctcaggcccactcaggtcaaggagatgaggaggctggttggggggatcctataccaccgataagcgccacgtttgctacaacatgaaaatcaatccaaccatagacataatttcctcacattgatgtaggaatggggtaaggctttgccatttcgcgagcgatttttgattttcagaaacaggaatacttgctaaggtcgctgtgcaagcgatcagatctcccgacgcggcacgagaagaccgatatgacacagcttggaaaaaacccatcaacgcccttcactttccacaaccttcgcggtcggcacatttctccccacgttaccaacctgcgaggcatcttttgccttgcatccacgcttttccatggaaatttctcctagaaccccacgggggagggtcccaggggttggcacgaaaatcgcgagaagcgagagacaagcctgaagccaacctcaacaagcacccccctgggccatgcaaggatggtaatggaccgagacggacacgcgtgcttacacgtacgcttctaatcatggaca

SEQ ID NO: 4812 - DNA, 700 bp, Nannochloropsis_gaditana
cctcctcctcctcctcctcctcccttcccctcgtcctaccacccccttcaccctgccgtccagccctttcccacgtcgtcgcctgctctccctctcccccgcccctcccccctcgcctcctcctcctcctccctcctacaaaggccttcgccttctggaatggacgaacggcctcatttcccagaaggctctggtcaagacggcgcggacctcttggaacatgctctggaaggtgcactttgtcccctcgctccgctccacctcgttatatttgtacataaattcatgtcccaccctctccctcctttcaccagcttccctcccacctgtaccttgtccttctcgtttgatgagaggctctgtccaccgcttttccgtggtctctcttttccctctttccctccctcttcccctccctctttccctcccgcgccagatcctgatgaccgagctcgcccctcaaggcaaagacggtgaatatgtccgcccgacgtactccttcacggactcgctgggctcccccgcttttcccctggaagaaggccgctaccatctttatgtgggtaacgcctgcccctggtgccaccgactcaccctcgcccacgccctgcgcggcctctcccaatcccaactttcctactcctacgcgatcgacgaccccgagagagcctcccgggggggctgggccttcgacacgatg

SEQ ID NO: 4813 - DNA, 700 bp, Nannochloropsis_gaditana
agagcactcgttgctttcctctgcgcgccagctctcgtctatagattacctctgtcctgtcctcccctcacctacttgccacgttcatttctccctctctttttccatcccgcacagagatgcgctccttctttcggctcctcccttcctccctcctcctcctcctcctcctcccttcccctcgtcctaccacccccttcaccctgccgtccagccctttcccacgtcgtcgcctgctctccctctcccccgcccctcccccctcgcctcctcctcctcctccctcctacaaaggccttcgccttctggaatggacgaacggcctcatttcccagaaggctctggtcaagacggcgcggacctcttggaacatgctctggaaggtgcactttgtcccctcgctccgctccacctcgttatatttgtacataaattcatgtcccaccctctccctcctttcaccagcttccctcccacctgtaccttgtccttctcgtttgatgagaggctctgtccaccgcttttccgtggtctctcttttccctctttccctccctcttcccctccctctttccctcccgcgccagatcctgatgaccgagctcgcccctcaaggcaaagacggtgaatatgtccgcccgacgtactccttcacggactcgctgggctcccccgcttttcccctggaagaaggccgcta

SEQ ID NO: 4814 - DNA, 700 bp, Nannochloropsis_gaditana
gatgcccttctcatttgaagtgttgctcttgactattttggtccttcagaacaccttgacggcgttgctgggtcatttcacgcgccaagccgtcgacaaggacaacttatatgacattggtgagttcattctggtcagcgagctcatgaagctcgtgacaagcgtccttcttgaactcgcagcaagttttcgaatacaaacactaccccgcgctattacccaaaagggcttagagattttcaagcaacggctttacggtcgtcctcatgatctcctcaggatatcggttcctgccgtattctactgggcgtccaacacgttattgtacgtggccatttccaatctctccgtcccgatattccaacttatggctcaaaccaagcttgtagtcacggcagtcgtgagcgtcctggttttggggcgtcattactcgtatcggcaatgggcgtgtctggtcatcatttccattagcgtagccctcgtcacactcgaggaaaagaaagccatcgatactccaacaacaagtaatgcccacatattcttcgcggaaagcaacgagccattaatcatcggtctcgttgccgtgactctttcctgcctgatgagtgctttcgcgggagtctatttcgaaaaaattctcaagacagaaatcgaaggttcgccaaccatttggatgcgtaacattcaattggccttctgc

SEQ ID NO: 4815 - DNA, 700 bp, Nannochloropsis_gaditana
acaaagctctctaggagatggtaaagagtggctcgtcaatctctgtatgataaagttgatacacaagtgaattgtgaatttgctttcaatttttggaggctattcgagaaagatgataatttaagataagataataatacaatatagagagacaccaatttgcgagcaattgcactccataatgacattatgttccttttttgaataaccatgttctaggcatgatgaagtgactaacaatatgaagtgcgacacctgtcgagaagccatagtcttcgagaccatttaaattgcacaggctatatcatcgtctaatcgaaaggagtccaatcacaaatttcatacagggtcttaagaggaagctgacatcgttaaacctctatcctgtccttggcgtcatctcttatttgaagcaagagagatgcccttctcatttgaagtgttgctcttgactattttggtccttcagaacaccttgacggcgttgctgggtcatttcacgcgccaagccgtcgacaaggacaacttatatgacattggtgagttcattctggtcagcgagctcatgaagctcgtgacaagcgtccttcttgaactcgcagcaagttttcgaatacaaacactaccccgcgctattacccaaaagggcttagagattttcaagcaacggctttacggtcgtcctcatgatctcctcagg

SEQ ID NO: 4816 - DNA, 700 bp, Nannochloropsis_gaditana
cggagggggccggtcaagcgcaacacgactagcaaggaacgggccgtctgagaatactcagtgacgtacgagggataccgtatgaggatattcaatgacgtaccagggatataggagccagcagatagatatacgcgacatattctggatgagtactgctgtaaagtgccatagagaccgggatgccaaaggcgaaatcgttgctctgagtcgccatgatacctaggacaccagagaaagggagtggatgaataggggagaaggtgcgtaaaaagccaagccattgagcctcatccaagacactcaaaaagtgggatggtatgcatggccgcaggtcttcgagcaatacctacctcgtaagccagcttcaaccatcccccttccattagaaagaccacgccctttcttctcgctcatgtaggtcagccctacaacaaggacaaaaaccactaatttcgctgatgccatccctcccacgaaagaccactgaatactatatagatccgtggtcgataaatttaaaaagagcagagcgggcaaggcgaagcaaccgaggagcttatttattccgcctatctccaccggtgaaattaggccgcagcggacacttacgtatctacacaaaattgacgagaaattcgtgcaagaagtgaacaagtgctaataaaatccaatggagacgggtttgcattaaaagatg

SEQ ID NO: 4817 - DNA, 700 bp, Nannochloropsis_gaditana
tatgcggtttctcaaatgtacccgtatgttattaagtatgcagggcgttgacatccccctgcgtgccctagtcacgggcttcaacttgacgtctgggacgggcgagaaagtatacccatgcccccaaattggcagagataagtgttgcactttcaaacaggcctacgacgaaaggatttattcacaacttacgtacggagcggtgcgtggtcgtgtcttcccagcggggtgtgcctcccactggaacgtgtcacggtcattaaagatcaagatacctgtgctccgaatgtcgccgaggtctcagcccacggcgacaagaaaacaggggcttctgtcacacacggtttgtatgtttcgtgctggagctgtcggatctatttatttaatgcaataatttgaacaagcgtggaatgtaatgccactggtagtcattgagagggccgctgaataatgtgagtgagcgcacacggtatatatgcaatgtgatcctccgccgtcgcaggcggtagaaggaaagactagcaggtgccaaaatgctgtccaagcgcaccgcgcgatccgcaagtaatgctcgcgcaccagcctacagtgctatggggacgtccttctcatattgaagtaatctctatgatcggcacgcgttaattattacagaccttgctcggtaagaacaaatttgcccactccattccgaaccatg

SEQ ID NO: 4818 - DNA, 700 bp, Nannochloropsis_gaditana
gtggccaccacctcggacgggcgtgtctacacctgggggtgcaacgacgacggggccctgggccgggggggacacgaggcggagccccatctggtgtcggacgtgcggcatgagaccgtgatcggagtggcggcgggggacagccactcgctggtcctgacagtggagggcagcgtctacgggtgggggtgctacaaggacaaggaggggaagatgttcttcaacagcgcctcctcggagcgcgagatccttcggaagcagacggggcccatgcggctcccggggctggagcacgtccgggagatccgagccggcgcatccaccaacctggcgctcttggcggactcgacggtggtctcctggggcatcggggagagcggggagctgggccgggcgatcacgctcgagctccgggcggaggaggcggaggaggacgggggaaaggcggagtatgagctctaccggggtctggaaggagcatttgacaccgcggcccatgcagctggcggggggtcggctggccacgggcgtgaaggcgatcggcgccgggtacaaccacagcatggtggtgatggccgtgcgcgcggaggtgtgggcggcgggcttgaacaactacggtcagcgtcgggctgggccaccgggagaatcgttatttgctggagcacgtggaggggttagacgggcggggtatcacggaggt

SEQ ID NO: 4819 - DNA, 700 bp, Nannochloropsis_gaditana
acctagaagtgcctttacgatacgcgctcgagccccgggcatcccgctctctcattcgcgatgcgaccgtcggatatcctgttttccccctctaccgacggggtgttgaacgagagcgttttgaatgggcaatatacctgctcaggaaagacatccaggggctgttgcacgcgcggggtgtgcccacggccttgctgcccggaagaaaaggcgtggggggtacagggggtcagtggggttttctgccagatccgccgcagggggcgcacatactgcaaaatttggaggctttgttcacccacgaattgtcacagtcattcgcttttttgtgagggtgttttgtaagtaatgtttatgaaaatcacaagcttggaaaaaggcgagaggtagctttcaggaacgtccctgctttgttccatgcccttgctttcccttaactttgtggttaagcccctgcacggactccgcacttcctacattagggatggaaggccctttttacacattgtcttctactaccattttcccggtgtaatgtactgattcctggagtccctcttctttcgttgtctatacccatttagtactcccaccctgcaagcttccagttgcgttcgaccatcgcgtggaagcgatttggttcttttgattgatcgattattttctcgcattggcacaaatattcatttaatccaggatg

SEQ ID NO: 4820 - DNA, 700 bp, Nannochloropsis_gaditana
tattggacttaagggtggctcggaatagcagacgacctgttccgatttgcttatctgtagatatgacacacacaaaattagacaaaattctgtcctttcaatccaccttcctcttgcctggagcttcgaaaatatctaaagatatgatattttactctggaaagcacgtatgctcacagaggacgtcaaaaagggcagaaagagggctggggcaggagggattcggggacatgggccttggaacagccaagtgacgcacgcgtgaacgtgaggcgagtcaatcgcccaccgaggtcagacgcaccgtgacatgccccgtcccgtctcgccagcatgcggccttacatcgagcttgtacatgcacaggggaggatcacgcattcaggggtggactgcggctttgtccacctcgggcgcctcgccatggaagcagaggaaatagcagtcacatctacttcgcggaaggaggggagaatgctttttgtaagaaatcaggaaatcaccgtggcataaattaggaaactatcgtggcagaatcatgtccgaaattattgcatggcgactaaagttgcatggccatttcttggtgctagtgtagcttgagtgggtttttgttgcgaatcgtatgccaccttctcatccgtcaagctctcctgttgctgatttgcatctctccacttttcaaccctactcaaagcga

SEQ ID NO: 4821 - DNA, 700 bp, Nannochloropsis_gaditana
tggatcacatcaaggtcgagaacccagctcaaatccgctgaagcagcttctgctgacgagggaagtgcagggagagctgccaatggaattgaggaagagggcccctttcgacgcagaaggtaacgtgggagacggggcctctcatgcgaagtcataatagcgactttgtccttttgcggcgcaacaggaaggcgcctttcagatgctcgttcacctttcttcagatgtgttgtgttttaggggtgcggattgggaatgagacggagcgaaaccccaaaaaggatacatgtccccaatagaaagttgacaagtcagacggacaaaaaagaacttgagggctttagtcttctacgcctaatcagctctttgcgcgtgacggaagagattgcctcttcctaaaagccctgttgttgctcacgggaacaacaaccgggttggtaggaaacggttttctgtcaacgggtttttaaaaacctgaagcatcactatatgccgtactccatccttgactccaggcccttccacgtagggtgcgcgatcaacaagttggctagatcactcttatgggtgtttatcatgcatttcggagcgagtagggacgttgaggagagtatggtagactgttggataacatgagacgtgtagttttcacgttgaagaatccatacacacaggacctcacatcttctcccctaccatg

SEQ ID NO: 4822 - DNA, 700 bp, Nannochloropsis_gaditana
tggcgagaaaaaacgtttgctatcgtagcagataatatgatgaatactgcaaatcaaaatccaggatacgaacaaagaaagtatgctcaaaaaaacgttcgggattatggtagcagcgcttcgtggtcaaggaattctacgttctcagtgaccaggatatttcgcgagagaaataccatgacaaaagcaagacaagctttcactcctggtgcatcttttctggttcacctttttgaagctcggctgctgcgtgtagcaagtagagtccgcttcctactctcttcttaaaaggagaaggcatacaggattctcgagcatgaagcgttcctaggtctgacttgggcagagactgctgttgtagctctaaagctgatacacgcaacatttgttgctgaggttttggctgttttttttgttgctgttctgattcccgtgctggatttttgatctggtgatgacgcgttgtgcgtgagtccacacgtaaatttaattgggaccgcatatcctgcgtaagctctccatctgttcgctgccgcttcttatttcggatttttatttctgatcgttcgtcgtactgtcgacgttcaatcaatggcggagaatataagagctgttgctgttgctgttcaacaggcatggctcgtgttggtaaattatcaaacagctgctgccgaggatttccttgattaaggagcagatg

SEQ ID NO: 4823 - DNA, 700 bp, Nannochloropsis_gaditana
cgttattaccatcactcccacaaatagtgatggaagctatgttgccttgtcggccttgatctggttttgaaatctgtaggaaatttcaagcctttcgacggacatatctctattttttgcgagcatactacatgtgtataaataaccacgctcggatggaaagaagtgcggtctgtatggggaaaaaaagaatacatacaaaacgtgtcatgctttgtgaagatgtgaccatgcctccacgtccgaatatgttactgctccctttttttattaaaggaaaaggtgcgaaatttagaaagctccatcaatcccagatgcataaaggcgtgtcaatctttgacgcgaaaattaaatattatacgaattcagtgcaggtgtcggtaatcccggggccgctgtcagtggcctctacatactcgtcggaccgttaatattcaaaaagccgttgaatatcgtgaaagagatctcggacacttgtcagcgcgccattttgataggctttcagcttttcctttcgtgtaatttgctcgatggcacatgctgacgcagatttatattttaatcatcagggatcctgcatagcacttcagaacttcgcgaattccgatatagcatggaaggctaacctccgacggttggacaaaaagtaagtcaagacctacgggcaactaagtaatccaaaattttctgcaaagccatg

SEQ ID NO: 4824 - DNA, 700 bp, Nannochloropsis_gaditana
gtgtagaggagtacgtcgtcgaggagcgagtggctggcacattatgcccacggccatgtctgccacaaaataataacccgctgcacctagcgacaaaccatccctgacattgcccggtatccatctttctgccttacaaaaagactggtggccgtggccacggggtgtatgggagatctccccccccccggtggccatttggtcatgtgcgtgtggtcatcctccgacctgctccccgccgctcgctcgccatccaccactccctcccttcatcgagcccgtcacgcgttggaggtgtcgtgcggtgcccacgtgttgtgttgacccggacacgatggcaaataatgtagtgtgtgatgccgaagagtgggtggctgcggcagcggaggtgaccaccgcaggcgcggtcgtgtccagcccttccctttgcttctttctttctctccaccaggctttgatgggggggtggtagctgtaaatgcacctccacggtgaactacgttggtgatcaccccgtgcggacacaccacagtgtatgttttacaagcccacatgcgagtggtttgtggtgaaaagcatgtccatggaccacggtgtcttgtggggaaggagaaatcaagcgttcggccagggcaccatgcatcctcccaccttgctaagctttcctaccacacgcacgacaatcacagggtcaagtatg

SEQ ID NO: 4825 - DNA, 700 bp, Nannochloropsis_gaditana
agacggtgcagttattgaatcagtgtcctctgcggtggccaaaaattgagctctggcgttcacaagctctcgtccatatggatcaaaggcatgctcgccttctttttgccaaaaactctaagcatatcgatgtatacagcggtattaaaaataggttacagtagagaaagaaacaaaaataaatacgggtccatcatatgctcgtcttggacacatacatttgtatgttggggggggggaaatgagccgcggtacgtaccctttccatttcagctctgaatgcctaagttgagtaatgaaataatctgctttaaaaaatatgccgagcgattggatctgtttctgtgcaatgtgcaggtaaaattggttgcttttggtaaagcgtgtgggggtaacggccgccgatggagcgagcggcgacgagggaatgcgtcgcgggttgagatccacggaaggagggggggggggggggttcacttgcaccatttttacgtcgattttctgggttatattgtcgatttcacagctagtattcatccatgtactgatttgctcgcgttaaactacatttcgatacaactgtgctgtccagtggcaggtgcattaaaattccaagatacttgaagcttttccacctgaaagccttcctgacactcgcataaaccaacaaaaagacgtatctcctccactgggaaatatg

SEQ ID NO: 4826 - DNA, 700 bp, Nannochloropsis_gaditana
gacatttttacaggtacaggatttgtggggtagtgcttaatgcacggaataagtcctcactgccgagctgcgtaagacgtggcgaaaaaagatgggacccttgaagagggcgtgtagatagcatgtgagattgactattgtagggtttcggtgtaaatgtgtggtgtgtggtagagaggtaggcaaagaacggaaacgggtttggacaggatgtccgagcccgccacgtactgacgaacagctctgctgctatttttgttgtctttttgcttggtggtcctttgtagggatgtacagggctatttgtgtatgcatcggtcctctatacttcattgctgtgacacaagtatatttcaccaaggagagcccatctatctgtctcgtgtgggcagctcagctctagcctccttggttgctcgctttcacaccgtgccacccacaacgtgatggcttgaacatagtcaacgctggtagacaaacgctctgcgcataaagatctcatttatctctgttcctatatcaccgtaatatccattcaaacatctatgtgcatgcctacgtgttgcctgtcggggaggccagatcatgaatttcggcctctttctcttcgcgatactgccctttccggcttgcgccttcttcacagcccccgctgtgacgcaaagccgagtaggttccacggttctccgagcaattcatg

SEQ ID NO: 4827 - DNA, 700 bp, Nannochloropsis_gaditana
cgagggactgagaaaaacaggcaagacacagtccacgcatcaatttaaaaactacctccgacgtacccctgcattgtttcctcctgtcgaatgtctggtgtctcctgcatcagccgccaccaggactcccgccctcgtaaagcctgtgagcaaccccacgaggccgacgggcaacaagaaggcccttacagccacatggctccgtcctcccaacggccttttccttcccttccgcggcgagcatccatgaggcggagaactttgtgcgcagtgatgctgcatgacgacgctggataatggtgcttgagggctacgctttctcccttgctagagcgccagggtgatgttggggagcgtttcttgggtaaaaagggatggggacgaaggagtggcgagggcatacacagcccacttaataagaagtgcgatgcaggactgtcctcttgtgcctgtcacgtttgcgtgtcctttaccctgataacccgttaattcatgcacttaagccaagggctggcgtccctcgctgggatgtcggtcaccaaggcaacccctcgccggggaggacgatttcccccgtccctgccgcatataccgcacgcggacagtcccgtcgtctacaggctatttccacttcaccagcttattgtgtacatgtcaacgaaatttgaaaccctcctctctaggcagtgagggagtgatg

SEQ ID NO: 4828 - DNA, 700 bp, Nannochloropsis_gaditana
agaaagaggtacccgaagaattatggtgcacagcttttttctgattactacaattgagcagacccagcatgaatgtctttccctgccacgtgcacgcagggacaatcttaagtaagacctcacaatttaaaaaggaaatacatccattgctctcaagcacactggcatgccatgtgtggacgtacagggcacacatactcccgtgaacaaaaagcggggaggttaaagtcctcaaaccacaggaagtgcagacggcaaatttgcagcataccatgcatatgaacaagcaatggcttccaaaatgaaatcatgggagagtgcctacgtccaaagcctgtgacgcaagcatgtatacagcccgcataccttttctaagatggacgacgtcgagacaaaggccacgtaccccgtgtcgctctccagccgcaaggggaagcaggcgagaggggaagataataccacctcatcaatcgggggcaacgcgacggggtcgtgatctcaacgtctagatgagaatagttgagaaatgactcacatgttcgcgattcctattttttgggggggggcgcaggtggttctaatcgtccgaatcggtggaacgagtaaggatctgaagtcatcagagcccggcagctttcttgttcctgccgtgccatgcccactttggccttgcagccacgaccctgaggtatcaaacatg

SEQ ID NO: 4829 - DNA, 700 bp, Nannochloropsis_gaditana
agcacgagccacggttctccgcttcgggtgaggagctttgtagcatatgctagtcctttaagcacgacagggaccatgaagggacatccgatttttaaggccaccttacgagagtagataatgagaagtacgcaagacacacaaaaacaatggcatggggaataatgaggaaatttcccgatagtattggcagtatcggcgttctctattccttttgtccatttatgaattttacacattcaagccgttgtttttgctgtaaatgattgatatattatctttagaccaaaggctctctttgaggcatcattttctattcaagaaagacatggaatcgaaggggcacttgcacacttgttcaacaccttgcaagagtttctgagctcaaaattggccatggtaaaatgctgccccgatctccgagctcaaataatgccatatgatctattttttgttaagaaaatacaggcccactgggatttaaggccagtgaagaaaattacataagacggcatgctatggacgctcctcaaacatttgaatatccgttgctgggggacgacacatacggggttggcgcgtccttccccatccccccttgcttatttgtcttttcgtcctttatcacaattatttttaaaaacctcatctaagtactaaatatctattatccaaacacagcgattcagcgtcccacatg

SEQ ID NO: 4830 - DNA, 700 bp, Nannochloropsis_gaditana
aagccagtcccagctcgatgggaggtgagattcttcttgctcatgggaatgcctgccgatcaattttgtcctacatcatccaggtaaaggaagcgaacactgctgcttcaatatatgttgcattcttgcttaagtctttctcgaggaatcaccgtcaggactcgaaggatgcttacctcgtcgctccctcgaatcctccccctctccctccatcatccccttagaatggcgtggatcctgttttctggcattgggctttgcatgccatctacatatctttcatggcagcatttttctggattccttaagaggacagaaaagtactcggtggaacatattgaggaggtgggcaaacagggcgggagggagaaggacggcgtctatacattccctataagttgagcgatttttcacaggaatcgatttattcagagaaatatagagcattagaggaatcacagcgcaaggtttgtgattcatactcatttctccccatgccccctcccataccccaccctccctctaccccttcctccccctccctctccctcttgccctctttctttctctttccgagctcccaggtccccatactccatccctctgtctttatcatcggccactaccggaacggcacctcccttctacatgagctcttgaacaatgacgagaggtttgtggcccccacggccttccaatg

SEQ ID NO: 4831 - DNA, 700 bp, Nannochloropsis_gaditana
gttcctggctacggtattcaattccttccaagctcccatgatttctcgaggtaggccgccatgtcccacgcgttctcaccacgtacctgccccctttgtacgaaaaattcactgggatgatacacatgctcgaaataaaatctccgagagtttttcatgtgtatgtgatgagcacttttagacgccccacatccgggtcgcctagtactacgctaccctccctccccccccccccccaaacgtaggtcggcagttaatctcacaatagagcgcaaagaaaaataagtatgtcagtggaggactggaagtatttctccttcgggcaaggttgaaagatcgcatgacttatgtccttctttttttcgcatccgcgtttgcgattctggagaagaaataattctgcacctcatccacgatcggtacatgtgtcgtcttccctccctcccttccttgctttctgtcctttatttttctttcttccctcttgtctccacgccaaacctttttctcctcacaatagttcctagacgcacccggattttttctcccaacccatcattcccacacgtcctcctctctctctcccttcctcaggctatccttggctggccaccctgcttctacttggcctctggatgcttctgtctttgaccaaggtctaagagcaggacctaggccgaagtctcctgggggcgggatg

SEQ ID NO: 4832 - DNA, 700 bp, Nannochloropsis_gaditana
tatccagttaattcttcagtacgacccctattctccctgagaatgtagaccaatgattcacccaagaatctcgtactaagataaccaatacgatcgacaaccaaagacaaccaaagacactggtcgacgccagtcctgttgtcgtacaataatataacatataaatgattaggtggacgcaaaccatgacatgatacggtagcgatcagcacatcacgatacagactgttggatccatcaaggatataggtggctcgcttaacctcctcggctcgcttaacctcctatcgccgatctcatgctcccttagcaccatcatgtcatccttatattcgcgtcaggtttggcgttcattttgatggaagaaggggttctgtcagaaccgtgtgccttctttatcggcctcaactgggcgacccgatcgggcaggtcgggcgaccagggccggcaaatttaacgcaaaaggatgccaagcatgggcggccggcgtcgagactaaatacatttgattcgattgatcctataattttacgatttcggctagtctatcgtcctctgaaggtctagtactctctcatttctgacgatcgtgttcttcgggtctatttgtgttctcaggaagtccccgctctcggggtctaaaaacgatacactctctacttaataggcggcgggtcctaccaagcttggcagatatatg

SEQ ID NO: 4833 - DNA, 700 bp, Nannochloropsis_gaditana
gttgccatgttctttggaaacatcttattcgtcattttgtattccttcgactaggttgagatatcgtcttgggccctggcgtgccccaggctcgttcctcgtgagacgagataagagttcggggcaaaggaggccgttccatcgccctgggatggaaagtcttcaccatgcaccatcatcactacggacaacttcaactgctttgaatgactcaaccgcagtgcaattgaaggcttcgaacaaggggtcgtcgcgcacaaagaaagccctcttccttgtaagcagtatcgctctagtatcatcttcatccgcctcagctcaggcctcctcttcccttcaccactccgtggcattccacaatggcctatcctttttttcacgactgaatgcccatgcgtgggggaaaaaatatgctgccgggtcaagcgactcgggcgagggaaatgcctacagcagcatcagtctaaagactcccaacacgaaggtcacgccctcaaaccccgtcactcccaccacaaattcccgtgcccgcacgccctccatccctgtccgtctcctcgatgaatcggccgctgctggtgctgcggctgccgccgccacgggcgcaggaagtgagtccttcaccctgggggggcttctggaaaaggaccggcaagcagtcacttccctgccgcccgcgcccttccaagacatcgaaatg

SEQ ID NO: 4834 - DNA, 700 bp, Nannochloropsis_gaditana
tctgactgctcttctgataagtatgataatattgagttgtactgaagacttattgaagtgaccaaaagagtgcatgaaaaacgtagaaggtaatggaccgattcattagcaggtctcttcgatcaccatttatatgctttatcgcagaagtggtttgctgcggttccaaaaggaaagtcggacaaacgtcattttagaagtaccagaagtacacttggccgttttatgatcgaatacgctctacatactactgacgtataagtggacgaaagcaaatcgggtatgtagaaagagactgaaaaaaaattacgcgttgggaaatatcctccaggccgcctcaaaaagatccggtgggtggtcgttcacaggctcaagacatgattgatgtccggatcattaacgaggagtttggctcttttgatatgtgtctatgtggccaaggaaaaccgctgacgggcttcaaacgagtctgccagcacggacatacgacaggtcctcgcgggtggcagccaggtaaaactttcttgccttatgactatgttgacttgaagtcaccccatctgcatcggtatcgtcgctgtatccagtcggatctgacgggggtccattcttttttatccctctctcacttaccttatgtcatctccttctcgctctaagcggctggagggcctggttacgaatacgctactccaagatg

SEQ ID NO: 4835 - DNA, 700 bp, Nannochloropsis_gaditana
tgtccacacggcccacgtcctgccaagtccccagcatcattgatttaaatgtgcgcaagctatttacctctccgaagcaaagcttgtgcgctattagcaccgtcatcacctaagagagatctctgaccgtctcttctttcagcagggcaacatagccatgtcaagcagcagggaaagtgtgttgtgcgacagtcaacaagctcctgtagaagtgcgctcgacctggagcaaagggctattatggtcaatcacctgctgtgctgtgcttgtcatagctttcattttggctgcgttcagtgaaaccggcagaacacgagcgtcccgctggtacggcacaattattttcaagatcaaaccacctatggttccagtggctcctttcctcttgactgatcggaagtcattcgagtcggaggagctccactatttgtggaaagtcgagaaccaacgtgaaattgcagctactacagaagcgaatggggcgagaaacgtaacgggccctggagcaggtgtagccgcttgcacactggtcgttgacgggtatgacatgcaatcatttgaagaccggacagcagcgctttcctgcttgcgtaacaagagcattgttatggtgggggacagtctgaccaggtgagattccatcgtgctcgaaattgtaattgccatccctttcccgccggttggggtactgggtacgatg

SEQ ID NO: 4836 - DNA, 700 bp, Nannochloropsis_gaditana
cattcgccccacacatccgggtcgcctcatgttgacatcctccgtcttgggacgtttgacagccgaagttgccaccttcgtgaatgtgtttacattgtgctttgcctcgcagtcgcagaagttgcttttatattgtgttttccttgcttgatactgatatcctctcattctcgcaccgatcttgtatcttgaaccttcatgtgacggcgcataaaggtgcgaagccttttccgcgcatgccatcttgatgcgatcttgagctacgactgtgcgcgtttgaaacttattgatggccatcacgacggcggacgctggcattaatttctaggtcattatcttcccttccacgtaacaagtgcaatgtaatataccgaaaatgacatcgtaactgcatttagcagcagcacgactgccgcgattgcgacactgcgcatcgggatcgagaaggtgacggagacgacggtgaaggtgcccatgccgccaacacgtatttgccaagacgtgtctgccctgggtgagcaaagaggctacaaaattacctttttgtgctgatgtgttcgggacttgcgcagacatgtggcttccgtaacggtgagtggagggagggagggagggagcgataacgtgataggagaaggctgagcgagcgtccccgccagccctgcgtcttcgtgctgaagaatgactcacgctctctatg

SEQ ID NO: 4837 - DNA, 700 bp, Nannochloropsis_gaditana
cgttacaaaagcagctgcagcggcgcttcagtaagtttgaagaacaagagctcatcagtatggaaaaatgagatgtgcacagcaacaattgcatcgcatgttgtgatatttaacatgtgatgtgttccctgcatggagggggcgaagtgaagacggggcttcatggtcattcagaaaaataaatgaaaaatctaagggaaaaagctgtttcttttgatagaagaaagcaacaaaaaggctttaaacacttaaaccactacttaactttgtgaggggcgcatctttcttctattcgactcctcagacaagatacccggataatcttcccgtagcggagagcccaagaactttctcatttctaagccaagatggtctacatctctggcaacatctccacctagtacatcacatgatattgtacaagacttgattaaagtgtttttaaagctggtgttgttaatgtcaccccagagcgtgcttcttgcatggtagaggaacgcgcggccgaggcgacgggaagcatgagataacagaaataatgaaggacaggaaaacacaactcgtggccgttcaaacggtcgaaaatcctgcgggaacgattgaaaggagcttcatactggttaattgacaaagttgtgatggtttagtaaagtcaggagtgtaaagtcgcgaagatagctcttcgactcgcgaagagatg

SEQ ID NO: 4838 - DNA, 700 bp, Nannochloropsis_gaditana
gttgtcgttttgcgagcgagaggacttgaagcaatggtgtgtgcaacaatcagcttcaaaaaattccgatccccatgccagagaccgaacatgcgtcgtcggcctcaggcgcagagtcgcagtgtcgccccccccaaaggtgaaatgaggcgctcttcgacagagaaagagcacaccatcataaatcactctttgatgaccaggtggtatattgtgaaaaagacgacctatcatgcaaaaaaaaagtgcggcccgcatacttcctcatgctgtccgtctcgtatagtctgcccaccggggtttttttggcgtgtgatgtaggaaggacgacacagtggcttgcttacttttcattaaattgaccttatgactagaatttaatatggataaacgtatctatgtgggaattagctgtgtatagatgagttacatgtctcaatcaaggcctttgggaccttgcctcgaagcgcctccgtcctgacacgaagcgtccaccactcccatacaactcgggctatcctagcctgcactaaaggtagtttcacgtgctaaagggttgaatatatttaaaaaaaggaatggcatacctgcttcttttgccggacccgttttgtcctttctcaccttcacccttcctccccctctttcctcttactcgcgtcccggacgcccagacccaagacactctgaagacggcatg

SEQ ID NO: 4839 - DNA, 700 bp, Nannochloropsis_gaditana
tgacccgtgatccaccacgcggtgccccaccgcccttctctctgcccaaaaatatcgtatcttcgcagactcatctttctcgtgaaacaagcgcaactatctccccaccagctgataaagctgcgtctgctctcatgagagctagcgaagcatccctttctgatcatgcagccgatagcctgaggcacaactgtgacatcatagctgaaaacggacgagtccacgcgacagagtgttcaagtacagcaccagtactagtatcctcacatagtggagaggatgacccaatgacagtctttgtgggaagactacctccaacggtcccggaccatgtaatctacaccctgctggagcagtgcgggaaaatacttgaatggaagcgagctatgggtaaaagtttcggcttctgccaatatgcgcagccgagctacgccaggcgatgtcttgaactgatgaatggggtcaaattggactgccaaccggttctcgtcaaattagacaacaaggagcttgcgcgcttggtcgagttagctgtcagcgaacaggatgcagcccaggataaaatcacaaaagaacgattaacaagtatcatagaacaacaacacctgcgcgttcatgttggggaaggggaggttcgagcatctgcgaagcggcaacggtgtaaacatggggcagaggaagaaggaggctgtggcagcgg

SEQ ID NO: 4840 - DNA, 700 bp, Nannochloropsis_gaditana
gaggcagtcgacagccctcagcaagctcgtctagcggcaatcttgcccgccctgtcggacgcagccgtcgctgagctcctaaacggtgtttcgcgtgcgcgtcagtccagaagctgtgacccgcacatctggtcttgtcgtaaataggttctcctgagctaggacgtggccccaccaccgtgatggctcttgtgcggctttctcctagcctgttatgcaatgcatgctgcgccttcctccgctaggtctgaggaagcaaagtcagtggatgggaaattaccatgcttggcattgatggcgcccagtatccttgctacttacgtacaactaagtgtgtttgatttaacgcctcaaattccttttttacagggtcagtagctcgctccgacgccgggaccgccgctcaacatgacccgtgatccaccacgcggtgccccaccgcccttctctctgcccaaaaatatcgtatcttcgcagactcatctttctcgtgaaacaagcgcaactatctccccaccagctgataaagctgcgtctgctctcatgagagctagcgaagcatccctttctgatcatgcagccgatagcctgaggcacaactgtgacatcatagctgaaaacggacgagtccacgcgacagagtgttcaagtacagcaccagtactagtatcctcacatagtggagaggatgacccaatga

SEQ ID NO: 4841 - DNA, 700 bp, Nannochloropsis_gaditana
tgtcaagattgatctggggaactttacccgtgtggatgcgctgacacttcattctggagaaaataacctttattcggcggtcatcagtggtaatttcgcgtattttgggtaagaaaagatgatttacagggaatttatattctaattagactgattcttcgtaaactttcttgctcctgctgcctacagagctgtaacatctcctggtgttgtagttaaaatcgatttgcttaatttcactcgagtcggtaacgtgaccatgaataccggagaaaacgagccatactcagctgtagtgagcggtggatacgcctacttcgggtaaaattatatacacacgaaaatagggaagaaggaaatgctgtgattgatgaactctcatggagctacgcattcatcattctttctatttagaactggaacttcaccaggcatagtagttaaaattgatctgaacacttttactcgagtcgacgccctgacgctgaatagcggggaaaatgggctttactcggctgtcgtgctaggacataacgcctacttcgggtaagatgaagttcttcaatagaccgtggaaattgtattgcttttgtgcttgaatatctcgccatcgctccctataggactataacttccccaggaattgtggtgaggctcgatctgacgacattcagacggctagacaacgttacgctgaatg

SEQ ID NO: 4842 - DNA, 700 bp, Nannochloropsis_gaditana
ccgtttcgcttgtgtggctggcccgaggacgggatgggacgtttgaatgacctgccggcggtggttttggggaagctgcgcctgtgtggggatgggtcgaatctccagccaccttagaagacattaaagatgcattaagtggtgatgttcccggacttttgtgtgcgacgtgtgctattgtgaaattcgtggaggatagtgtaggttcccaagcacgaggccttttacggatacgggatctgagactcgcgcttcgcctgctccctccctctagggtaggaagctttccatgacggacatggattctgtatgggcgctccttgcactcacctcaaccgaacagcgcgcacggactccacgaaaaaacgcatgtctccgggtccaagcccctgtggcatttctcatccgtcgctttgtctctgacctccgaccccacaggagcctcatcatccatcacctgaatggccacccatcccctaccctccccctcctcccgccccccaacctcctcccccccctccgccgccgacagccctacccccgaaagcccacgcccgccctccgtctccttccaaggcgagcagggcgggtccgagggccgggaccggggccacgtcagcgcgccccccgcatgggtgggatgcttgcgaagggctcttgtcgctcctgtctggggatcacgctgctgacccgaaagatg

SEQ ID NO: 4843 - DNA, 446 bp, Nannochloropsis_gaditana
gggagggagggaagcgggggaagcaaaatggaggatggcggccacaaagcactaagttgataccggtccctctcctttgctgcgattggaacagtcgctatcgtgtgggtgttgaaacagaggaggatgatggaatgcgaacccggcggacgacgttgcgaagtcccgcaaagccagggcccgcgcgaattgtgctccctccgagtgcctcgccgatccgatccgatccctacatccatgattgtgtcgatgatggtgacgaccgtgaagatcaccgtgactccacagggctcgcgttcccccccctttctttgcccctcccgtcctcctcgaccccccctgccactcatcccatcgatctcaccctctcctttcactgccttttcgtagcccttcccctccccctaccttcccctccttctagcccgcacgccaccgcacgcatg

SEQ ID NO: 4844 - DNA, 700 bp, Nannochloropsis_gaditana
ccagagcttttgagtactattgcgcggcaccttgacgaagaggatgatgtcaagggcaaaaaattaggagatacagcgcaggatgcttattgcatgtccttaagaaatgctctggaggcctcgctggatctcttggacgggtaacgacaggtggtgaacagaacgagataatgtaaagtttatggaaggtgctacaaaccaaagcaaatcctgtgtatgaggagaaaggcgttctaagttctttcaaaaacatttttcctcctttttgttttcacttgcttttactcttggctgtttcccttcgaactccttttttccttgtagggaaagcaagctactgcatttccttcagagagaaaaatatacatatcccttgatcaagcagacttggatctgttgatcagaagctagctgacaatttacatgcattgattaaattgctgcttcaatgcccagctccacggcaatgatccggacagtgcattttttttacgggtgtagccgggaggttaactactgccagtaagctaaaagcctcatgtgtggccgaccaaaaatcgaatctgggcggcgatgcacacctttgtcgcacatttatagactagagaatttggacactcacgctatgtacatttattttttgcagggtcaagcttgtctgcggggaattttacgcggggtggacgagcgcggcatcatg

SEQ ID NO: 4845 - DNA, 700 bp, Nannochloropsis_gaditana
tcttgttgtccctcctctcaaagcctatggctcgactcctgcttatccctccgccgactctttaccccagaggagaaggaggagatgaggaggggcatggagcgaaaaggtttcatcatgagggtggcggattgaggagcagtgggtgtggtggaaggttgaaaggcaaaaggagaagagagaggaggatcgtgaagtgaagcgaaggggcaaggatgcacggaaaaaaatggaaataggccggcgcgcacgagcttttggcttgtgaaggcaataaaagcacatccgtatatcgtattataggtataatgtaaaattttagcatacttcttttactttccaccgtgttgtcgtaggagtgccccgctggcttcttcacgggcccgtgtcaggcgattatttccgacttgcttggcacttttatggacggataccgatacacgccacgtctctcgataatctttatcctggtgcattaaactagaatgcagcacatatgttccattgagtgatctataaggtaacaagccgaaggacaggtcgtggtgggggaatgaacctcctcttactccgtatcaagcccaagagtggggaaagctttgcatgtacattccccatcctcaagcatccattgcccccgcgtaacgtacaccaactgaccaggtacaatcttacggaagtgacggagacaaagacaatg

SEQ ID NO: 4846 - DNA, 700 bp, Nannochloropsis_gaditana
agaaaaaagaaagactttggaaaaatcgggaggggggtgcatgtgaaggaaaaaaagcatgcgcatataatctccatcaaaaggctcatccacgtcacttctcctcattctgagaatgatgcgtacatatggacggatcgaccacactagacacgccggcctaaggtttccttgcgtgttttgggggagtttattatctccaaatgctttctggcgcgaagcttgcccccgaacccgaaacagaaaaagcgagccatgacgttgccgtacaccagaccttggacacatttcaagcgaaaaaccatggtgccttccccctttgaaggtgatgcaggggaacgaaaggctcaagacggttggcaggacgtgaaataggtagtgtggcagcgtcgaatttctgtgaaaaaggatggttggcatgcctttggtttacaacgggcttggaccaaccacgcatgtggtggggtagtcagtcttgtcccttttatgtcgtagacaattcattttttggtaccttttctatgtgtcatttttacagtctcagtgtagtgcgtattgttgttggcagaggctgccatcttttccatgatacacccctttcatggacgtctaagctacatgcgttttcccgttccccgccacaatttcctctaaccaccaaagcctagcaaggaaccagtcaaactaaattgaaaggatg

SEQ ID NO: 4847 - DNA, 700 bp, Nannochloropsis_gaditana
cagaaatttagccctgacctgaaaaattgcataaattgtaaagataagttaattcagggacatgatggattccttctctttttcacgttttaaaaaatgaattacgcaggcaagccacccagagcacttgtcctccggagatttacccctcaaaatatcaaaataagcccacagcagaattttaacacgtgaaataaaaatgacaccctcgaagccctgatataaacgaaaagaaagaatttacaacgggagggaaaggacggagaaacccaccgtattcaaccatcgcgtgagaacttttccgagtcccgcgcgttgcgtcacgtcggtctgggtttgtcttttttttggtattttgagtgtttgggttttggttttccgtgggcgctgcccttcgccgactcggactccgggggggtggggggagcatcaagtgcgcttgacctgagtcgtaggaagtatacacgacatgacacccgccacgtagctggtccatacttcttctcacatgttttcaccgcgcaatggttcataggtgtcgccggccctattgctgtggacgtgattacgagcgtcgggtgcgtagaaggccccgggttcatcatagcccacacctgcttcggccccccgcgccttcactctttctgccttccgtcttctccacgcttggcgggccattcccacggactttggtgccatg

SEQ ID NO: 4848 - DNA, 700 bp, Nannochloropsis_gaditana
tcattcgcgaggcgataataaggctcccaaagcaaccgaatccaaaatagatgccccccttcgtattgcatggattgaggatgacatcaatttcgtgatgctggggtgggacggggtgttgatgtcccactcgccgtttttatgccaacgccaaagcccgccccagggacgaggaatctgatgcgcgaagcagctgcatgcagcacagcagtcatcttacctcttacgggtccgaatcaaagacaattacgtgtacacacgtcatacagggaaaagaagatgatgcaacggtttttccaaccagcaggggcgtttccttccggaaggggccagaaaaggtacaagaccgaggatatatgcgaagagggtgggccggcggagacaactctagacacagtccaggacgtccacggaaaggatcgcgcagcggaagtgaatggggagtcaaccgtggaggaacaaggtgatcatagagacgggagtgcgaatgcgagaacggttttcagggacggcgagatggccgcgcacggtatatccggagcagagttggtgagagaagacagacagacaggggtgcttcagaacggaacacctgtagcgccagcagtggaatcaaaagggaacgtgaatgaggtatcggcagcatggcctgcggacgcgagggttgatcagggtagtgacaagactgatggccttgatg

SEQ ID NO: 4849 - DNA, 700 bp, Nannochloropsis_gaditana
ttattgatcccttttgaatttcgaccgcaactagtgtctcaaactcattcaagagccggatcatcaatgtttcatgacagtatgtcatgacaaggcaagcatatttccagtcccccatcattttcaaatatccgttactctttcctccgaggcaaaccccggaaacacaactttcacaagaaatcgacctcccaagtgtttcaacattcatgtctttggatgccttacatgcaaaacaaaattctttcatagttgcagcttgtaagaaattgcgcgtttttctgggttctgtcacatacatgctgtcaggtttcctccttttaaatctgtatcccactatgaatcgatcttttgctgggatgtacttatcgtaccgaaaatccatgatatctcaagacaaaatagccatacgggcatgacactatttcatatagcacttgtgtacatattccctggcttcggtgtcatcggcggagcccgtcttgacaatgtcaggctcttgctagaggatgtagtgtctagaaacatcccaggggactacatagagaccggggtctggcggggaggatcatccatctttgcgcgtgctgtgctgcggagtcttaatgagggcggccgaatgtcatatgtctgcgactcgtttcagggcctgccacctggaaaaaagaaactggatcacaatgataagagatggaatatg

SEQ ID NO: 4850 - DNA, 94 bp, Nannochloropsis_gaditana
gaacgtgacctcgcacaagatttttctgggcaatccaatcgatttgcccaagctcaatgcgaccaagaaaatccgacgacttttcaacgtcatg

SEQ ID NO: 4851 - DNA, 700 bp, Nannochloropsis_gaditana
ccaacatctcaacccacacccaaacttcacattctcaccctactgctatcccatttaccacattaagcaaaccatcacacccttgttgtccggctttgctctcttttggccgcgtcattgcgagtgcattgggaatgcgtgtttttggcgcgaaacgcgcgcgtcgcttcctcttcgccaaagccgaccccgccttcagcatgtctaaaaggccatgtccacggcccaaaaagtagagccgattcgtccctcccccgacagggcagggcaagcaaggaaataatccataagaggcacttctgggccatggaggttgggtttcccggtgttttgggttcgtttttgcggatcgtgggaggaaggaacgggaccttaagttccgtcagcttccttcccgcttgggcaagacacagcaaccagtttcgaggttgggtgtggtcgaccgcttttcttttcgatgggggtattgtggctattatcatgaccttagcttccttgcagatggcgtgacattcgtcacgtgtggtagagttcctttcttaatcttttgggaggcaaacctgaccgccatcgtttctcatcgcttatttcccccgctccttgacgtgcctatacctccatcatactatcccaggggtgaagtgcttggtggcttgtaaattactgcatatttgcgtatctctgtcatagcaacaagatg

SEQ ID NO: 4852 - DNA, 700 bp, Nannochloropsis_gaditana
tcgacaggcatgttgtatccctgacacgaaggaaagggttgtgtgaggtcaagaagggaaaatttcaggcgaagaaattcccaacgttgccgtagcttactagcagcagccgttgacgactcatcggctcctgtcgtgacgcccccttacatagacttgcatcacccgaaccgtgcatttgatcattctccatgcttacttgctgctggtgcctctgcgtgggacgctaatttgtttgaatgggaaggttcacgggcgcacggaatgcgcttgacgtattctagcccctctcgatcttaatcggatgcgacatcaaccaggcttccgtcgtctgcgaaaattgtaatcctttcccccttttccctttgtttatacagggaaagaacgtgagtaaatacataatttcacgatgagcctctactgccacgctggccaggcacctggaccctcctcgtattgtcttcccctccctccaccctccctcctcttcgttccacctcctgtcatgcggacctcagttccctcccggttcccccgacctttgaagatgaaaatgcgcgattccccacgacaaaagcacgcacaatggaaagaggatgaaatggagttgtggaaggccaggagagggatcagtcgaagcttcttaaaacctgtgggtatgctcacgagacgaagagaccgcctcacacgtgctcgaatg

SEQ ID NO: 4853 - DNA, 700 bp, Nannochloropsis_gaditana
cgagcccgacagccattcctacagcggctcccaccgcctctccgactccctcgtccttcacccctgcgcccacccccgccgtacctcaggtgacgcccacgcccgaaggccaagacgtcgccgttcctatcctggacccggccaccaacaccacctctggcggcatcgagtttgccaacgtcacagcccccgggatcacggtacgcgggcatgggaagcgggtctctctgctggatgtgctgttgacgaaagcgcgttgcgtgcgtggatcttgcagggcgggaagctaatgtttcttttttcgtttgtctcggatcatacacaggtggtagtgaacgtgattccggacccctcggaccccctcttcgtgccgcccagcaacttcgtcctgggtgaccctcctacctacaagtccatcgccaccaatgccagcttcagtggagatatcaccgtctgcctatcctatctcccttccgccttcccggccggcacgcagcctcgtctctttcatttcaccaacaatgcctgggcggacgtgaccacaagcgtggaccccgtcgcgcagctggtgtgcggcgtcgtctcctccctgagtcccttcgccctcggcaccgtcatatcgccgacctttttggcacaagcctacttgaagtccctggtgcaggctccgggtcgccggttcaccctcctcttggacctg

SEQ ID NO: 4854 - DNA, 700 bp, Nannochloropsis_gaditana
gacatacgcagtcaaaccaaccaaagtgtccttgctggcggcaaaagtgcggtgcgactttctgagccttccaaggattttcaggcaggcctctgacgtgctgtggtccatgcttcctgaagaatgaagttctgcctgacagccttctcttcagaacccttgcaacacttcgtctatccgtaccacctatcaccatacgaaagaaccttctacctccgtggttccatgaatcaatgtcaaattgcttgaaggtgctgccaatctcctctgcctgttcaagaaaaaggtggccgcgtggatggtgccggccggtcgcccatgaagtgcccgggtgaacgcaccgccaccctgcgagggtcggccagggaagacaaaaagtcatgagtatttacgaacgacgcatggcaggtctggtctcgcgcggcaaggtgataggccggcggcctccccacctcgccaggaaagcgggtcgggagcgagcgaagagtgacggtcgtcacgtcttcacggcctgcccgcgggcactgcccggcaagcgacgtgcacgtgggccatcacccgtacctgcatggcctggcgaccaggacgtgcaagctgccttgtttttgagggtcccggtggggactggacagctcaagaaagaaaaaagacgcgttacccctggtgctgatgcatgtatcccctccccacctccacccag

SEQ ID NO: 4855 - DNA, 700 bp, Nannochloropsis_gaditana
ggtcgacttgtgcatgtagtttaaaaccctgaacaaggagccgctgccggaaagaaacagaagaaccaaacgaaattttatctggttggggagaaacatgcactggacactctttggactgggttccgaaacgagtgctaaagtactccggtgtgttgagctttcctggttctcccctctgtctcaacgagctcgaacttctctgctccatcgaccggttcatgtgcactcgcacacatcttccttattccaatcatgtttcgggccgtctgaggcctctgagtcgtatatcttgaccgctagcacgcctgccttgtacacacattgatgtttccttgtccttttttgaagtacttggcgacagttcaagtcgtggtttcttcgccgaccatacggccgagacgacggcccctgctgctcagaattggccttgacttttcatgcggacgtgtactgtgagctcacccaatcacactctcttatgctctgctcacatatacagggagatggggttggtcgttcgctgacgggcagcatatttctgtacaacccgccattgcctcctacttttctgcccatcatatacatgggggccgtgccgtcgatgcgctagatgcctgaaaaatcctccctcgctagacatcaagtgtaaataccggttaagtcgctcattaagtccacgatttgtgcctttgacatg

SEQ ID NO: 4856 - DNA, 700 bp, Nannochloropsis_gaditana
cccgaattgattttctttccaaaatgagcggggatagagtcgagaattggtggatcaggccatcatctcaggaagtgactgcggacttctaagatctggtctgggtcacaggtggcacgcgtcatgagcttctacatttccgagttgtccaagcatgcattcatctgtggcgctatatgatagtcataaaggacttcgaacacagctttgagcactttgtagcctgttaatcctgccatttttgtgcttttgtgttttgaatgcctttaaagtgcatcttgtaagtcagggtgagactgttcaattgttttgtccttctcctttctctttcttcccctttctctaggtgatgacttgactgccgctgtaggaagagaccctcatgatttggtcgtaaagtgagtgaagtatttcaaattgcactgctacttgaacaaacgcgttgtgactctcgatataaaatacccagaacgataaaatcagatctgtctaatgttgagtttccaatttggtgtcctttttacgtttttgcccaaacaggcaaattagcaaactccttgacaaccgaaatgtggtaaggagtctcatcaagccccagtcttctaaaactaggttgacccataggcgtcgtttcagggcctacgacgtattgacagtgcgggctcagagtggaaggaaattcatttgttgccaaagtatg

SEQ ID NO: 4857 - DNA, 84 bp, Nannochloropsis_gaditana
ttatccgtttgatcggggggcgcacggatgaacaattttaactctccacgcttttcctacttcatttgctcctcttaagccctg

SEQ ID NO: 4858 - DNA, 700 bp, Nannochloropsis_gaditana
gctcttcattcatgagtggatcggcgtggatgaactggtcaagtcaagaatcttcgcgatgctaccagagttgcaccataccattcctgaaagagttagggttatcaaccacacagtgaatgaattaaatgcttgtcacctgtgacgaaagcgtcgtgaccccgtcaccttcacattccgtcagacacactctgccattttccccgtcgctgacagccgtcgccctctcggatacccggatgtgaagatgagatggcgccgggacggtaacacaggccataagccttcccacgatgcttaggctccgcaggtagtctccggtggagtcatgtgttggaagtgcaaagtgtcgtgaccggcgagatgatgttgagcgacagattccttcgtgcacgaccactacgggaaatctggtccctgcagtccccctccaagcctgccttgcaggcgtcaataacggagcatttgtctctctctccactcccgcgccataagtcttgaaaacttcttgcgtcgatgcgttgtaagcgtcaccggcaccattgcccccgtgcattgtcgcaagttgaacgtgctaatccttccgcagacctcgacctcccccccccgaatatggacacgacagccaagaacatgattgtggacttattgcgaccaagagctattcctctacccctcattccttccgatctacttcaca

SEQ ID NO: 4859 - DNA, 700 bp, Nannochloropsis_gaditana
tatgctcgtcgctaacccggttgtttaaatgtcaaaaaggacgacgtcgctctaacatagcttgcttgtggtgacaggtaggtgaaggaaaacgttaggctattaattacgactttgaaaaagttaaagtaacaggaacagcggcgtgctcctgactccacgatcaagtctcagcaacgcagaatgtaagcagccgatgtggtgcttgtgtttatcaatctggtcggtggggatgagaaactcgatggaaagcaatgcaatgcaagtcaagcctagcgaggaggcagtcgctgagcgactttagacccacttgcactttcctgtgaagtccatggagagaagccgcggacacgcatggcgcaggcacattatgcatgccataccctggtcgacgcgtacagggctttgaggattgcgattcccgcgtgcgacgtcgtgtctgtgcccactcgcttgtcatgaggctgaagcctctaaagcggcttccgactggcgctcgccctctgttcaaagatgctgccactgacacaacgccagcccctcgttctcttcgtttgcctcatgatgcactaccacctgaaatgttctttccatcctcctcactttccgcagggtgggctgatcaaatcaatcacgcaaattgcgctgcctacgcgcgcacgccccagtcaagggcctccaggaagtggggcccggaatg

SEQ ID NO: 4860 - DNA, 700 bp, Nannochloropsis_gaditana
tttgaaagctacctctcttgtgataattactattgtagaagtcaaaagtttgggttttaatgataactaaaatttgtaaaatcgaaaatgaggatgacgaggaacctctcgggcgtcgaccttgtgtttttttacttaaaatgcttactcaacgtcctctacttgtcgaccttctctcctccttttgccatacaggcgacagtgataatgcaaaattagacacttttggtggttgttgaatgaaaagcaattcgagcgtgaaaactcgacgggataatgcaaagacgcaactttgcaccagcttcagtgtccttagagaatggtagactgtacatcatgaagtttcaaaaatagtatggacatatcaaaacgtgcacggcctgttaacctagaaagagagcaccttcaagcgcctggacctcggggcaaatttgaaattttgaataacgtggcggaggttgcacgaggggcaggtgcccagcgagcacaagcaagttcggcacatttgaattgtaactcatgcactcgtgaacatggtgaagggcctgaaacatcccacaagacgagcaaagcatggaagtgtcggacaaaatacaaggagagaactgcctaacggatagacacttcctgtcatttaacatttacgcatggccttccgccactttttcagccaggcaccgaacctcctcttcaaaccatg

SEQ ID NO: 4861 - DNA, 700 bp, Nannochloropsis_gaditana
gggttggcagcgaggctgagggcgcggtggaggacgtgggcgtcctcctggggctcgggggggacgaagagggaggagggggaggccagccaggcgggaggtagctccggggcgcgccagaggaagtgcaagagggaaggggagacccgggcgagaggagaggagggggagaggaggtcgagcgcgagggcgggcacggggagggcgagcggatccatggcgtagggcgagcggatggggcgggcctcgaacaggtcggggtggttgcagaccttccggagctgcatgagcacgttcatcatgcccatgaagttcccgccggccagggccgcgcgcgtggaggagcgggccataaactcctcgtagaggtgggcctggcgccgggagagggggcagaggaccacgtgctcgaacttcccgggcagctgcttctccacgtccttcttgaggcggcggaggaggaaaggacgcatgatcgtgtgcaggcggcggatgaggccgtccgagagggcgcgcgccccctggaccatggagttgagggggttggagaaccagtaggagaactccttgcgggagcggaagaggtgcggcatgaggaagtgcatgagggaccagagctccatcaggtcgttctggaggggcgtgcccgtgaggaggaggcgccggtggctgttgaaggtgaggagggtctgccagcgct

SEQ ID NO: 4862 - DNA, 700 bp, Nannochloropsis_gaditana
atatggatgtgcatgcgttgtccggtcaatggatgctgtcctccgatggcttcaagggacaaatttcataaaatgtggagagattggatggcgggcgaggaaggttccctcccaacctcctccccctccttgagcactcccttttgccacgcatcgtacatgcctcacagcgatggggcacttgaaagaatttacatcctttacgtttgtcgacgcttcatttcagacgcgtgtcgggtttgcatttcgcattcgacccgagaacgcctcagttttgggcgcctataaacttcctcgctgttgtgtgacggcgatgcgacgtaccatcctccccccggccagcacttgacgttcacgtttccttgtcacataaacatggtgcaatgccacgcatggccaaaggagaagagggtgaaggacagagcaatcgaggaggacgtcatagaatccttctgagatatttttttccccccacagtgtacaaagtacttcgacatcgcctcatcgtaccttgagggcttaccagcgcccgtgtgactgcaattaaggcaaaattatacaccattatggctgaaagagtgattcaatgcccaagacaaaaattaagacggcgagttttttcaatcaagccccccttgcgtcacctttcactcctgtgtgcggcgttactttcccttctgcgaagaggatgggtgccatg

SEQ ID NO: 4863 - DNA, 174 bp, Nannochloropsis_gaditana
cctccctcccttccctccctccctccctccctccctccctccctctttccgtccctccctcaggcgggcatcacgaccgtcctcaacacccgtgcctccgttctggccgccgccaatcccatcttcgggcgctacgacgacttgaaatccgcagctgagaacatcgacctcatg

SEQ ID NO: 4864 - DNA, 700 bp, Nannochloropsis_gaditana
taacccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccttttgtggatgaatgctgtgattcatgtttattgcgcttctccaatccgcttgatacccttgagcctcgaccaatcctgctcttctcacggggctccgtttttaatcttgtcattatcctctccgctattgtaaaaaaaccctctcactatcagcgccatgatccttactctaccctcaccgccccgtagggtatttcctgatcgctaaaaagagcggagcgggggctccggattagacccggcgttcaccccaagaagtagcacaccagcaaacaactacaaggtcgagcggcctctcaccttggctcgctctccactctctgccttgggtatttttccatttttaacgacgttacggccatgcaccctactttacgctgcaggctgggccctcagagcttccttttgaggctgcaggaccctttcctcccatccttacaggctgtgattccaaggaaacttacttattggtcagtacataccttgttcaaggccaacatg

SEQ ID NO: 4865 - DNA, 700 bp, Nannochloropsis_gaditana
caccctcgccagcttctttttcgtgttctatgctgaaaatggccgtaccatgctccataatgcgtccctagaattacctgcacctatttctagtgtgattgggcgcaacgatttttcaagaagtgggggggagaggcttagtatgggaccagagaggtgatgatgggcagaccgacgtgacaagttcagccatgccggcctccagactctccttcattcacatcttaagctgaacatgaagaacgcctcacaaggctgcctgcgcgcgggagacggttattatgcttgctaccagtggtcttacaagttgaaggcgtttcccctaagatcaatgcatgataagcacgagccccacgactcataatttttaaccccaacgcagcaaaattcaaccctttaaatccatcgaatgcatgccatcgatccatctactttttccatgccccgggaacggggcaattttgcttgcctagaccccttcacatacttttatgtgctcgtgttttttttttcctagttgacgatcgcttgcgctcgctgaagcttgagaaggaatggaccgagcctgttaaagctgtcgtccacaattcctcttttccaccaactctcaccgcaaatcatgacacacgatcccaccaagacagatcttttgcattccttgcaggtcgggccgccaacgcgggcccgggcgtgatttatg

SEQ ID NO: 4866 - DNA, 700 bp, Nannochloropsis_gaditana
ttgtgaatgctgaagtagcatttagtaccctcgggagggggaggggagggggggagagcagtcacagagagcgaaaaaccacatgtcaagtccaaaagacaccgtaattggcatgtagttagattttcacccgcgaatttcacctcggaccagtgtccaggctttttgacggcatgaaaccgcgtgttttcctccttccttccactacccaacggggttggaccggtatcgacaccatctttgcttaggccacttgattggtattaaaaatgcacaaacattcatcgctggcacataaacatggtcacacgaagcaccaagccactgcttttcatgacagcgtatttaaaaaaatgcaaaaacgtatttgacgtgccatgtgccttcccctggctaccctgcttgacctttccctcgacctcccctcccccccttcctccttccctccctccctccctgtcgtttgctctttatttcaccttttttgcaacaatatcctgtctctcatcttttacgactctatgctccttccctcacttggttttccgccgcctacactttctcttcccgatctgcttctccctaccaccttcccttcctcccttcctccctcccttcctccctttctccctccgcgggcgccgaacaaataacagaaagcatacaaccaccacatccgcttctgtcgttcaacctgatg

SEQ ID NO: 4867 - DNA, 700 bp, Nannochloropsis_gaditana
gaggaggagggagggaaggaaggaaaagaggaggaggaggaggaggcggacggccccacgtcttggagagggcaacacagaggtggttaggggagccgaaggtgataaaataaatgaaggaggaggaggaggaggaggaggaggtcgctgctgctggagcgatttatacgtatggaggagagtgcgtaccctctgcctctcaagtcgacgtgacatgaaaagataccgccatgacgacgctgggcaccaatacggtaggcatgaagacgaaagaaggcgcacaggttgtgacaaggtgggagaaggaggaggaggtagagagtgcgcaatgcccctctgaggggatacggaggcgcgtggggaaggacgcagtgatcgggaggcacaccgcttgagcagtgtcaggagtggcgagatcgatggagagcagcatagtttctgtttggtgcaggaggggagtgcgggcatggcgcctacggcgggtaaaggacagaacggcttgtaaattacaacggtaggggcggaagtgggaaggtgcctggggagggataaaaactcttcccagatgcacgcaaaacaaccaacaaacctcgcccgtgaccgtgtggacgtatcccacgtttttcattgcagtctcttgcaattttcgtgcagaatggatgtaatttcatagcatttaatttttaatccctcgttcatg

SEQ ID NO: 4868 - DNA, 700 bp, Nannochloropsis_gaditana
ttaaaatcgattttatgctaatattaatgttatcctctcctaccttcgatccgtaccggacttgatgataatgaaatgtgcattagggcccctcacctgatgcgaatgaactaaccagaacgctgcgaataagccaatatccgattcaattcgttagcacaaccacaattccccgagagaatatataccaatgatttgatgcagcgtcgcacctaaggtcatcaaaacttttctggctcgatagacatcgtatcagtcttgggaatactccttcacattggatcgtcccggagttattagtcccaccaatttgtccaagtggaagacgcgccgcataagtgtgtatgatcggtctcaaatgtttttatgattccctttaacattgatgaaatacgtagtaagataaccattcattcgctccaaagaattcagatcatgaataacacaaagtagaagacctacagaagcctcgagagctcgagaagcatactaggatttctcattaaggaaacgcatttcctccttccagattgccgcccctgtctttttatttatacatctccgtccaacgtttgattttcaccacttcaattttatactgttccctgatttgtggggcagctttgtgtagatatggcacgcggcataagcgaagcgatgacggcaatgtaaaacaggcaactttaaggactttttaatg

SEQ ID NO: 4869 - DNA, 700 bp, Nannochloropsis_gaditana
agatgggtcacatttacacgactctgtctgggcgcatccactcttcgcatcaggttggcgacgctgccgtggtgattgggatggatgtactcacgacggaagagtgtctcggtgtgggagccctcttgtatgactttgtgcccatcgagttccacccgccggagctcatggaaaagtttgagaaaaatgagcgggaaggtactgctgaggacgttgaggacaaggcaggaaagggagaaggggaaagacagtaggccttgtagactttgccgttgtacagagagtggaagcaataagggggtaaaagacttcatatgtgcacaaagaaaaagtccatgtatgtttcacgtttctaggtcacgctggcctcttatgtcctttgttgactcctaatgctcccacaccgtgacgtacaagcggtgactgcacgcatcgatcccgccggcgtctcttccatccctccctgtctcaccctcctaacgcgcagaaacacgtgcgtcagccggggagacacggcctgttcgagcccatacatctccgtggcaaagcatagcaaggcatgcagcggtcctcagcgagctcgctccgactgtgaatctcctccatcaagtctttccgccaccggttgtcgtcagacctgtagtcccaagcccccgcatctcccaaggtccttcccctccaaccccgagacaacaccatg

SEQ ID NO: 4870 - DNA, 315 bp, Nannochloropsis_gaditana
tgagacgttgattttccttgtctctcgcacgcatactagacgcagagtgtagtagatctgtttgaagcgctgtcttggaagcgcctggataggaagacgctggtggacagggctcggttagtggtggcggagaaggagttggaggtagtcaaggctgtagaggagaagaagagagtactggcggagaaggagttggcgtctgtcaaggctgtagaggagaagcagttggagtttgtcaaggctgtagaggagaagaagagagtactggcggagaaagagatggaggtattcaaggctcgggcggagaacgaaatg

SEQ ID NO: 4871 - DNA, 6 bp, Nannochloropsis_gaditana
gaggag

SEQ ID NO: 4872 - DNA, 700 bp, Nannochloropsis_gaditana
gcccgccttccctctcgcccactttccctcctcagtcttgttgccttcgcccttctcaacccgatgcttcccgcctccagccccccttccgaatatccagctcattgtccccccctttctccttttcccctcctttttctcagccctacctgcggcatttcatccccaacgcctctttggcccaagccgtgactcgggaggagcatgttgtccctttccataagtgggccaggtgggagggagggagggagggagggagggagggagggagggagacggatgatttgtgctagagatagtggtgtgatttttctcgtgctacggaaccgtggctctcaagagggacgcgcttcctcgctctccttccctctctcaccctcccttccctccctttccccggcaccacctccctgaaaccctttcctttctgtggcagagtgatagctcctgaatatcgagccctttttatcgagaagatggttgaaaacatttatgaaggctcttcaggggcagaagggagagaaataacgagggggggaggaggcattcgtggaggacggggaaggggaggaggggaaggaggaggaggaggaggagagggaggggcagagtcgtcgatgattgcaaaggtaggtttatgacgcggcagaataagacgaggagagagggggggtggggaggaagggagggaggagggtac

SEQ ID NO: 4873 - DNA, 409 bp, Nannochloropsis_gaditana
tccctccctccctccttcccttccaagtctcacggggtgactcaacactccgcgaggtcgtcttctctcactccttcacactgaccctttccctctcgccctcctttcctccctcccttcctctccctttttcctgctcccgtccctcttctctggacaggtcgtgactttaggcaggaaccaagcgttggaagtcgccactggagcagagattgcgggtgtgtgcattcgttttatactcggtcgctcttctttttttcttctttcgtgcgccctcctcccttcagaacatacccccatccctccctccctccctccctccctccctccctctcctcctccagcggccgactccctcgtcgccagcatgctcgcgtcgtggcgggcaatgggcatagagatccccatg

SEQ ID NO: 4874 - DNA, 14 bp, Nannochloropsis_gaditana
ttacaaatgacagc

SEQ ID NO: 4875 - DNA, 628 bp, Nannochloropsis_gaditana
cttccttgcccccccatccccccggcgacgcgccccccccgcccttcctcccccctttccaacccaccggggcccccaccggcgcttctcccgcctccctccctccctccttcccggccttctccgtcggcgcctctcagaccgcctacagtcgcaaggagaagagcctgggattgctctgcgagaatttcatccgcacctttgggcgggagggggaggaagggacggaggccggggccgagaacgggatctccctcgacatggcggcagtcacgttgaaagtggaacggcggcggatctacgacatcatcaacatcttggagtcgatcgtcttcgtcgaacgcaagtgcaagaacacgtactattggtacggtgtcaagtacctccgagacacgttaaagcagctccaggaggcgggcttgaagcaatggccggaggacgcgcgcctgaacggagtggggaaaggaggagaggagggagggcggatgctgggagtagtcacgttcacctccaaaggggtggaggggtcggcggggggggacagacaagagacagggaggggggagggtgcacgagaaggaggaggaggaggaggaggagggaggggagggggaaggaggaaggggaa

SEQ ID NO: 4876 - DNA, 220 bp, Nannochloropsis_gaditana
cttccttgcccccccatccccccggcgacgcgccccccccgcccttcctcccccctttccaacccaccggggcccccaccggcgcttctcccgcctccctccctccctccttcccggccttctccgtcggcgcctctcagaccgcctacagtcgcaaggagaagagcctgggattgctctgcgagaatttcatccgcacctttgggcgggagggggagga

SEQ ID NO: 4877 - DNA, 30 bp, Nannochloropsis_gaditana
ctcataaccaccctaccttgatcgaccatg

SEQ ID NO: 4878 - DNA, 140 bp, Nannochloropsis_gaditana
tcccgacgacctccgccggcgcccgtgtctttgtgcctacccggatgtatgctcctcttcgaaagaggcgcgacgcgcgtacctgaacaggatgagggggagggaggaggaggaggagggggaggaggagaaggggagga

SEQ ID NO: 4879 - DNA, 700 bp, Nannochloropsis_gaditana
gaaataaattttacgagcccttgctagctgcaccaactcgatttgtccaggacgggtataaaatagccgatgaaaaagatccagggtattgtacaaagatgatagatgcaggatctggagatgtgaactcgctcctgctaggagcccggacacctctattcaagaaacgccgttacgtgcgtacgaaattgcacatatctgtggatccacccatttctctcgatgtggcattctacaagaccattcaacgatgtcgtaagccgatgcccgtaaaactagcagctgtatcaaacaggagactggccacctccaccaagtggatgtgtgaggacctagtgcagtacgtggaccccgagcttgacgtagcatgtggcttggagtttggaaaaggcggcgtcactattccgctacacagcgctgcatacgaaatgaagcagcgcgtttgccaaagagatccgggcctgcatcttttggcctttcttccggcagaagagttggcttgggagctaaacgtgaccagcagtaccctgatttatccagaggagatggctctcaaaggttgtacgcgagccttctctgctatccgaaaagccatgctccagcaacataagatggctttagtccggctccacatcaatgcggtgtcgtatccacgtctggctgtgctccttgcaccacctgccacgcccggtctggagct

SEQ ID NO: 4880 - DNA, 700 bp, Nannochloropsis_gaditana
tgtcgatgtgcatcccgtcctgcatgtccaactctttggcctgcccacctgccttgtgcaccaaaggggccgagtataaatatccaagtcggcagggcgataaaggatctcgagtagcccctccagagtgcagcgcgaaaggaggagatcgggagggtacatcttgactagatgatgtcggaagctgtgtgtgacttccgttgccatttacttccttggctttggatcttgcggacttggcgtggtggccggggaggtgaaatcttgcaaacataggctttctcgccctttcctatacatgaaatggttgtgtcagaagcatgtcctgcctagtagcctcccccggtcgcagcgaggcagtggcgaaacgggaaagtaacatgggcgatgtgcgtgatggaggccgagcatggtggggcgccccgctggatctgccaggatacactcgcccgtcacgcgacgtgtcacgtgcccgtgtcccagacaccgtcgggggcacatgtctcatctattgcatgaaaaaatgctctagcactgtctcgtgctttggtatttggagctcgaggtggcgtcgcgtcgcgttcaggcgggtctgaccactcgtgccatctctgttgtcggaacggcagagcccgtcgctcctaccctgccttcctggctgtcacacgtattgacacacaatctttcccctcctgcaata

SEQ ID NO: 4881 - DNA, 700 bp, Nannochloropsis_gaditana
aagcaattaaaaaacaccccgctatgcacctggtgtgcaaggctcaaatatcatgaggtcgaaccggccgaggcccagcagatttctgacaccactcacagacaatacacagtgacgcacaggaacgatagagggatgggtaagcctgtcttctccacaagagtccggtgcatccgatgcgatagcttctaaatctccagaccatgttgtcggtgcgacgaccttcgttcagtctggattgacccgataatccacacctgcgagaccagcgtatcttagagcgccaaccaggtgggcgagctcgggcagtccacggacgatcccttcctcctcgcccacgccccgccctcgcccctgatcctcatcctctagcgccccgccgcgtcgctcatgttcgtaagcgccttacacgccatgtcctagcctgcctcggctctttgctagccgagctcagcaggacgtcgcatgactgtcgcgtcgacttgtcggttcatttgtttttcctcaccggtgcgcttattaacgattaatgtcgcgatgatgccgttgctgtcatgatctgataagtgatgcggaaccacgcaggtcttcggtactttacgcgtcttttcagtgcccaagcaaaagctctgagtcggaaaaagtcacatgctcaaggaagttaaaaaatggagttgacctttgaattatctctttccag

SEQ ID NO: 4882 - DNA, 700 bp, Nannochloropsis_gaditana
agcgtgcgcagcatcctcctctttcaatttttcacgtagccggtcaaggcggggggaggaggataggtttttggtcgcatatgccgtgaaaatactttctatccgccaaaatgttggaagagcaggggctaaatatgctgactgcttcacagcaggcgatatgcggggggcccgcactagagcccgcattttaccggccaggacggggacttttgaaagaagagactctacgagtaagcaacaccttgcgaggcagccccctgattcttgagatcgcagtggagcctgtgagcatcggcattggaggcagtgagagggacaaaggggctccagcggggcacggcgggtcgagactctaagcggcgactcgctgagccgctcgcatacgtcaccgccccaagaggaaggactgtctgccgcgcacatttatccaggagcgtgagatggtcaaataaaacggcaatgtaactctgccacgccaccttattggcatgattttcatgggaccttcttctgtcgttcgccttggggtctcaacgctaaagcatgatgtctccaatcgccgcgtcatgttctcagccggccgtagtaaaattgcgagagccatgtcgtgcgttccatcgattattgtacaaccattttttcagccgacaggcgacgcattcccatcaacgtaatagcagcttccagggaaaggatg

SEQ ID NO: 4883 - DNA, 700 bp, Nannochloropsis_gaditana
aggaatcgactcaagagcacaaagacctactctttttgaaaaaggaatgcggataacgcaagaaattgtcgcaaatagcgcatctccagcctcgcgctgtgacgatacggatttcggggcgatgctgtggcgacgaccgaggcaccatcagatggggatggtatgatgccctctgttggtcgtgcatggtggccaataagttgcgggcgccgcctcacatccatcatttaaatcaattcaatgtttcgccagttgtagtgttgtgagacctcgcgcgtgcaggcacaggtggtgtcctaagaaggcttcgcggcaacccctcctcgtcgggagtaacggacacgagccctctgcttccagcgtacccatcccgcgctgtccacgacgcagtaatgttttaagccggcaccactgtccaattgtgcttttcactgcctttcatgggttcacatcgtccagaaaccacgtgggactcggtgaacttgatcggcaggagccaccggaatggtcgataatactcagtagctgacgagcgaagcaacgaattccacaagaaggatcgactcaagctgtaaacatttttttccccacgcatgcacacagggacgacagcgcgggccgatacagggcagtttacgagctccgagccgtcaagtcgggcccaatcacataaggagcaggaacgggagctgcagccatg

SEQ ID NO: 4884 - DNA, 700 bp, Nannochloropsis_gaditana
tggcgcgagcagagccccagactgcctgctgtcacgcgagacggtgttcctcgtcgtcaggccgatctttggcgcacatcacttgttccattcccgtgcccagcgaggaccgcggacgagaaaggattgctctggtctttatgacggggaggatgtttgactatggcacgtcagtgcacaaaggtagggagatggtctatgggcacggcaagccataccacatattcgacaggacgggcttcgggggaagcgacacgacgggcagacgtcggctccaaggcgtcgcctgtcgtatcgcgcactttgactaatgggagggcataacggcctagaaattacttatagcgagcaggtgttgcaccaagcatgttaagaccatcacacgactcacctcaaggttgtcacgtgctggacagggtacactcgaaaatgcctttcagatgtcgacaactggcatgttttcaacacctggctctgcaattgtttttaaaccataatttctagcatttgagatcccagtgcatgagtgagtttttgagaatgtgcagatgtactcaagagtttcgctctatgctcctgcacttgagcaaacaggcgacttcgcataggcacgtgtcgggaggcgcagattttccatttctcctctctacgtccccctctccaggtcagccggtacccacacactcttctgtccatcatg

SEQ ID NO: 4885 - DNA, 700 bp, Nannochloropsis_gaditana
acgcattagagcggctaggcctccccgaaatagagcgtgtggcgagcgcggggacagactctgcaaaaatatagaacttaaccatactgggccgacggccttgtcgcggaggaagggcgagtgccttactgtgaaggaggaggaggaggtgcaggaaggctggttcgaccacttggaggagccggactctccgtgagacagacaggcctctgaaccacgcttttaattgcaccttggcatgcattgctgctttatctcgcgccttattgcttgacgctgatgcctgggtctgcagatacatcaaaccatccaaaagttcttgaatctcgggtgtgcgccgtcgcataggttgggaggtagtcttcatgttttttcaaatgtcggccttcttaattgtgtttcagctgtccgaacgcttttgattccgtgtgcgcctccatatcgacacaaatcctatttgttacaggattttttgcgtcaatagttctttaaaacagacaaatatcacatgagaaattcttcctccccttcgccgcctgcgatgataatccgacccctgtgcttcgttccacagtacacgatagccagcctctttgtctatttgcgctggacgacgccttcacgtacggacactgaaattaggagtaatttcgttgtggggggaagggtggaagtcaccggcactgctcctgtcgtgatg

SEQ ID NO: 4886 - DNA, 700 bp, Nannochloropsis_gaditana
gcaggaagacccagcacagagggtcaagcgctgctacgcaccgatctgcccacgggctgcgggcaggcgtagaagggcaaaatcgcttttctggagtccccgattaaggcgcagagtcgccatcgccgcggtgcccgccagggatgataccgatttcaacttgccagcgcccgtgtcgaaatgcgtcccagggggctctacatctcgatgatcgtcaaggtagtaagggactgcatggctttcagcgtaatgagggcaaggggttcgtggtgccattttttcgacggacgaaatgttggctttctccgcttgaggctggtgcctgaagtgatcctagttcaggtctcccaagccgaacgggtgttgatcggcaacttgtcttccttctttgtaattgggcagtcatagacaaacaaacacacacatggttgtagaagcaggagagcacgggaacgcttttacaggcgcacgttgactcttgcagcagagtgtccggcagaacgtcttgatgggtatgcgcctgttgcggctccctgctcttactccttgtgtgcaagttatcatgtccaaaagacagactgagcattctccctggaagatctagcgtacaatgttgagttcaagctgcgagttctaacccttttccaaaatcttgaaattttatgcatataccctgcagaatcctccgtctctcgaaatg

SEQ ID NO: 4887 - DNA, 700 bp, Nannochloropsis_gaditana
aagtcgcatgaaccgccacaaaacgcattggcccagagccctttcgtgatagtaatttttcacaaaaacaacatcatactcgtccgatgcgtgtttcaccttcgaaatgtagcgagatattttacgggaaggtcctctaacttgacatgactgtccggaggctggaaagatgtctttgatattcgcacccaccctggtatttaatcaatctacataccatctgagagactaaatgatttacttacttcttttttgctttcgttcgcgtcgtctcccatgcttgtctgaggtgggtaaagagacccgggctctgttgaagacgtcgctcggtagttcccgcgacggactcgcaggctgcggatgctgtgcgaaatgatatccagagggttgtcagacgaaggctctagaaccatcgacaacgcttgcccctgcaactgaggaagtgcttggagtcctcgcgctcgacccttgcctggaagacattagcgggactatacccgggatcgccggcgcgactcctcaggtcgcaccgactcggagcgccggcgacgcccatgctgcccgacctcctccctaggtctcgtgacccttatacaacccgtgaccacgtctgcctcattcagacctcttccatcaagcacagacaagtttaattttatgccatactgcccttcggtccaatcctccgacacactgtgct

SEQ ID NO: 4888 - DNA, 700 bp, Nannochloropsis_gaditana
tcgagataaaactttgggcgaaaagtcacccgagtgaaggtttcttattcctaataggtcaacgagatctgaagaggtggagcaggttagcatgctatggggagcaataaaaattaaaggaggtgtatatcttgagcggcctgaacaagagggaatgcttaaattgacacctttctccttgcaagacatgaacccacgcttctgatggcgatagcgtcgtaagggctgtcattttatcagtcccttcagtagggtcgttggcgatacttactccactcaggcgagcgagccgtcgaggacgacagggcaagcgggacgcacgacgtccagacttcatcattttttagctttcgacaggaaataacccgatatgaaagatttttccaaacctacatctttctcttcggatcctactttatccacaagaaccctgccaggcacactatcactgactccacttcgattacttttaccgagaagtcgtcacctacgtggaacaacaacaaagcagatgaaagggcatgctattttctacttaacaacgttcagcttcttggagattcgtggttttttgcttccgcagaatcgacttatcatcactcggaacgcttattctacgtgtacgacagtcgctgctacagctgccacatgcccttcttcaccaagcaacagttttataggatcaactttgacagatatg

SEQ ID NO: 4889 - DNA, 700 bp, Nannochloropsis_gaditana
accaaaagtctttgtttgctgccattgccagacggaatgcagagcgagaaagcaatcataaggactatatctacgaggcgtaattgtgatgggggggattttaaaaagggcacaagttggttttcaactgttgtgctggaaactgggggggggaggttactaccaaggtcagggcttgacagcaaggaacaaggatgctgctttttcagacaaactcgcatgagatgtgcatgtgtttactcttttgagttgttgatgaataacaggatcaaggcacgccacacatcttgtcagtgtctcgaattccgagcggagttttcatcttcaagtgcaccgtgagtgacgacattctgttctgcatgtctcatggtctcgtgcttgatgcctgtaaaagttgcttgccctttactgctgactcaagacacgctgcgaaagctcttttgcgtgatatttttgtcaagccattagaaaaacacattttacgacttgattccttaaaattgtacccatacagctaacaccgtcttgctgccgagtattaccccccgaaaaaggtgtcgctgagtagaaaatacaggacttgctcttacggctttgaggttgatatactcgtatatttttttggtcaaccgctctcatttgttttgggtgcatcgcccccacatttgaaaaacaaaataaaacacttcatcgtatcatg

SEQ ID NO: 4890 - DNA, 700 bp, Nannochloropsis_gaditana
acaagcttgacttttcgcctgtgcttccggttttgtcgaagcttctgcacaaaaaaaagtatgcaaagcgcctctcagtgacttcacgcgtcgcgcatgtaagtgacggcccaaaatgcaacttggaaattcaggcgggaaaggcgagagccggaagcactgagatgtgtccccgtcagaccccgagtaatgctttaaaatgccaagccctgcccctatctgaaacaatgctctatagactatcagacaaggaaaaagtttccacagagaagtcacgtctagagcttcgtgagcctggacatgcgaataatgccttgtccgatgcaaaacgaattatgtaggagatcaatcgggggaccagagcatagagcatgactatatggtgcggattggcataaatcacgtatgccactggctggggatatagcacggaaatgttgtgagtaacttcaatcctgactagctcatcaaaactatgttatggcttgcgcaatcgcaggtttttatatcactacaggggatgcgtgacgctacagcatcatcacaggagcagctcagggcgtgcctcaatctcatgcggcgactgcctccctataagcaacagaaaaatctccaggagctgcagctattagttccgtctattgtaggggaggagcttttgcagcgagtcgacgtacctctggaagaaggaattgatatg

SEQ ID NO: 4891 - DNA, 700 bp, Nannochloropsis_gaditana
agcggacacacgtagggagaaggccccacctgacacacgtagccggcatcgatcatggtgagacgcccccccgaactagtggagggggcaccgatcccttttaatccgtgatgtgcaatttcttacaggcagccgaccgattcaatatcaatcggagctgggagcatcttcaaaataaatatgtcgggacaggtcatcccgacctgaccaaacagtaagtgcagaggacaacttctaggcttcgaatagtgatgaaataccccattcggcatttcacacttgcgacagaaacaatctacgtatttcaccagaacgccgtgtacattcgattttttttttttgcggtttcgactgttacagaagggatgatgcaagctgcatgtgcatgtcgttgcatgtctcattctgctcacgttccttttctcgacagcgaatggttgacgaaccagcatcgggacacctacgctactcatttgggtcatcacgaccagcttgcctacattgcagtggcgcagaacgacgcggtaggtcgtgtgcgctaccagctcctcgagaaaatgctacagccctgcggtccccccccggcagcaaaagatgatgaggatgactaggaagggagtgggttctcgtgaaggagaacgtctggcgcgtgtagagtaaatttaaaagaaagtaaaaaaatacactacatttcgacttc

SEQ ID NO: 4892 - DNA, 700 bp, Nannochloropsis_gaditana
cggtgccggatgaaactgtgcttttgtctgcctcaaacgccgccatcaccgttgagctcgtcgtcgtgcttcgtctcctgagacatgtcgagctgacagcagcatgagggacgacaggtctcaagcaaacacgcgggtatgacaccaaggctcgaagtgacgacacaaatgctgccgaaccagtccattgccgactttgtgcaagcacccatccaagtagaggcgacacccttctcatcccgtcaccgacgtccacaagctcctagcgtggtgggaaaaccgtgatgggaccggtcaaaaagtcagaggctcgaaaatagctagcggatttccctaacacacgcaatgagaagaaccaaatgtgagacaacctaaaacctcgactctgacgagctggtcaaatgtgtggcataacccccctggagtttacatggaagatactgcccccggttctcgccagcgacaggaacccccccccgccttgcgccttagggctagttctcacggtgtaatcgactgggttgcgatcctccctttgataaggcatcacatccattgtatcttctatattacagagcagatacgagagcggacacacgtagggagaaggccccacctgacacacgtagccggcatcgatcatggtgagacgcccccccgaactagtggagggggcaccgatcccttttaatccgtgatg

SEQ ID NO: 4893 - DNA, 700 bp, Nannochloropsis_gaditana
cttgcacgcgatagcactttcatacccgctgctaccactgtgaaaatggtcgggtcgcccctcagagcaagttagcagcgagctctacgagggtgaagggaacgacctcgggaaaataatgtaacatcatgttttaactattcattgcgtaagacttgtttagacaagacgtctcgaatgatatatttatacatatgtatataagtttgcatcaacaagttgcgcacggccgtcaactaaggcaagcgacacctggacgtgtatgaggctttatgcagtcgcaaggcgtcaggggcgtgacgtcacaggagggagaaatatgcaattaggcaagaagaggagggacagcatgctagaaaagctgtattttcattgtgaggacgtgcttccctcaagcagcatcgtgaagcgggtggtagttctcggggggcttctcaaattgtgtaagtgtttgcggtcgccactttggcgggctgcaggtcgggatcgttcggcgagcgcgggcgagaacgactgtcactctgccaagtatcacacaataatgatgcggacctcccctcacacacccgagttgcgaagctgtctttcgaagcttgttacctgctgacgacttgaacattgtcgccttaattcgtgttacagccccgcaacctcatcgtcagcgcgtcctctttatcgtgaacgaatcagccttcccatg

SEQ ID NO: 4894 - DNA, 700 bp, Nannochloropsis_gaditana
tgagggtgtgcacgatcgacactaggatcgtgagatgacccgtcaacatcagtcgcacgcgcaaggggcgggcacgataagttcccatccgagcatcgctggcgacgccaaggaatcctgggggcaccaggacggcggccagccagccatccggccgaggtatgcctattaccagttcatgacggcttttgtggacactcgacccacagtgcatacggggaatgtgaggtgaagaacaatcttggcactggtgagaggttcccctcctacccaacgtcaacctcacacgacacgaccccgcctggccttctccagtccgcggcccaccacacgtgtgggtaaccccgtgcgagtctttttcggagcgcttgagtgcgagcattcacgtgacgatctgatatccaccctttttgaagagcatcacgcaggactatcgcgatgggcaaggggaaaaagcgtcaacaactgcccctggcagaggaggtgagatggtatccagcttccatcaaaagaaaatttctaagtcacgcgtccacaggcccgtccctatcatgcctcacatttaatttgtatttacatgcagctcgatgaagcttctaaggaaaagcgcatattagaaagtaagagaaaacgaatgatacggcgacgcgcagagggtcaaggagatgatggggaggagttgctttcacatcacaaaatg

SEQ ID NO: 4895 - DNA, 700 bp, Nannochloropsis_gaditana
atcattgtctccactagcgtgttccacatcgcattctgtttgtcgcaattttccgtgttcatcggagaaaatagaacaaggacatgcaagactgtgagtatcttctcttggaaacatttttagagttcctgcttcattccatcactaaccttcgccagcggctgaagtttcagaaggagcagaacctgtgcccgcagattttgccttcttcttctttttcttcttcttcttgtttgccgtgccgccgttgcttgtagtcgcatccccttggccctctgccgctcctccctggtcgtcgtcctcctcttcctcctcttctgccccctcctgaactttggcttccgcgtgcaccgccttgacttctgttgttgtcattccaaatttatgcaggcccactgtgccagagaggatgcgtgagtaagacccctgactggcggcaacgcgaggccccatccatcagaagggatgaggcgggagggtcgccaaaagtggctcgatgttccaccatgagcaagcccgcgactccatgggcggaccgcccatctccaggcatacgctttgaattgtctttcgctgcacattttcagggggaaaagtacaagccgagcacgccagatgcattcgacactaatttcgttcttttcttgtccttcacgttctcatcagagcaagttaaggaaggaggcacgaagtagcgatg

SEQ ID NO: 4896 - DNA, 700 bp, Nannochloropsis_gaditana
tctttcgacaaggacaatactaacacaatcttattttctggatgtgtgtctcttagtgcctttttcgccccagaggctctctgtcatgcctccacgaggagcgccaggagtcaggacacttttcctttgcagggccagcagggaatattggcgcgccagcaatcattgcaggaggtatagctcgagtatatcaaaggtaacatcgcaggcgcggcgattgcccgtcgatgatgaacgtaccttgaaagattttctgtcaggatcacggggaaaagagggcgtagggcttgctacggcccacttgcaaatcagccaaatgagtgtagccgatgcgtcaacatcttccaacaatttttcgcagccatttgctgtcaatcctgaacccaaaacctttacaattgaaagctacggctgccaacagaacgttgcggattctgaagtggtgcgagccatcatggagggagctaacttcaagtgggtcgaagggggaagaattgatggtcattacagcggatgcgacatcatatttctcaacacttgtgctatacgggataatgcggagaagcgtatctggggtcgactcaaccatttaaagcatccagtacgccggtcaccaggcaccggtcctttgccaggtcggcgacaggcacgacgagacgggcgaaacaaaaagcccatcatcggattgcttggctgcatg

SEQ ID NO: 4897 - DNA, 700 bp, Nannochloropsis_gaditana
aagacatgaacaaggatatagagggtgatttagacgccaatcgaagaaaactgtaggctgcactgtgaccaagggcgcgatttggtttccgatgccttacttcattgttaaaccacttatttttaccttcatcttcaaggtaaatgtgatgtatcatcattaagcacagcttgattcgagtgcctcacagcatgtgaccggtaacccgtatggcctgctgcctagtagcccacgttccggagcgaaaattgaggtggtggggaggtacgaaggacaaataaagccaccactccgcctgcgcccgcggtgctcttgccgaaatgcgcagtgcctgtaagacgcaaagagctttatttgccaccccggcgtcaccagctcacgcggtgtcgatggacctcgggtctcccagggggaggacggagcctccaaggacgtgtgatagaacagcgtttgcccgcgtcagctgccgttctcggctgcggccggggattcaggtccgagattggacgcgtttacggcgcagtattactgatgcacaaacttgtccacataaacccttagacaagccttgtgcgacatcatcagcgtcacgggagaaggaaacgtgaccgcgcgggggcagtgataagcagcgtcctgctaagggaacggaaagctcgtgtcggatcccgccggggctcactaagtcgcggacctcatg

SEQ ID NO: 4898 - DNA, 700 bp, Nannochloropsis_gaditana
cgtcaaatacttgctgctcatgggcgcggtcgcagacgaaggaacgtttatgggagaacgatgcttttttgcggcgctcaatgaccctctgcgtcatttgcttcgatgtagtaagatgacgcgcgcttatcgcgaaccttttctagaaagtttacgctttatgtacgaaaacaaggaggtgtggtggcctgacgtagcttttgtgtgtcgtgccacggcctttgacccaaagtggaaagccagcgaaggtgtaggcagcgcgggcggtattcaggagaagtcaggtctcttttgccatcaagttattttgcgcgcccgctcagcatttctcatccaagagttcaataagcggcgcgtggaaacacgatgcggtcggcgtgggggcctcggggtcgcatggggcaccgcatcgtctttatccattcctcttttacactcgcacaaggcgttcgcatgcatattacagtacctttactgctcacggttagagatgcctctctatcttctcgacgacggcatacgcatctctcggatcctgcatttgcctggactgggactagagctgcaacgagcatcggacaagattgctatggctagagaaagggggatacaatgccacagggaactgaaaagtttgaaataccattcttcctctaaacacagcgcattttacgtgtctcggcagcgacgacaagaaatg

SEQ ID NO: 4899 - DNA, 700 bp, Nannochloropsis_gaditana
tcgggtggccagagctgagggaaagagatgcgaggcgtggatgacaggaagacagcgagcaaaagagaaacacgtgctttcaatgtattactttttgtttgcctatttgcatgtgaggaaatgggtaagtgctcgttttgtgtattcacatacaggtccgtactctggttgtcgccaacacttgtaagcgagcaggaacaagacaagcgggtagggaggaacgactcgaagatcccttccctccaactttatgccttttaatttccctcaaatcatatttttttaattcgaggtcccaatttttccacaccgacaatttcctacccagatgccctcctcctcggttttcccaagcggtcgcggagccaagcgtcctctccctctctcactcaccagtagcacaagcaacaagcaaacgatcacaggtttctctccacaacaaatctgtgcgggcagatggatcaagcgcagcaatgacccggatggcggtcttctttttcggaacgagtcagcagtgccgcagcgggagaaggtcacaagccccgaaacgacttcccaaaataacttgggcgcgaggtcgatgccatgggccaatgagacgtcgcaattatatcagccgattacaagctattttgcaggaagacaagatcgggagagtagtacgtctactggcaggtacgcgcgtcgatacgactacatg

SEQ ID NO: 4900 - DNA, 700 bp, Nannochloropsis_gaditana
gacagactgggcgcgtaaaaatcgaagcctttcgtttggccacaggcgtaggccacgttcggcgcgtcacgttttgtgcaaatagttttgatccagaccaacagaccgatgaacaaaacagggatggcaacctgccattagatttatacgaaaatgatgggcgatgaatgtaagcagcgtgccccaatggaggtatacgttagcgcatatttcaaaggagaaggaggtcaagagctagtgctgcaacctatgcacatgcaaagaagccagtcccatgcagagcgagatggcatttcccaaaacgcattccaaatcaagaaacatacctcacaaaatgtagaaatccagtgccggcgcttcagcaggatatttttccataggatggctcgaagttgatgtgccgtggagaccatgactgtatcgtagtttttgacgacgaagcaaaaacggatcccccaacaacctcagcccacccttgtgaatggatgaactttcctgctaacgagaaaagaagatcggacgagtgtttcatacgaaatggaacgtcactcacagaggtggcggggagcagcctcctcgggcctgtctcctcgctggcatcgctagcacggcttcacttgcacgcggcttttcgcacctcagaccctaccacccgcactcccctcccgccctcgtcacgacacagcctttcagagggatg

SEQ ID NO: 4901 - DNA, 700 bp, Nannochloropsis_gaditana
ctctctgtatacaggttgtatacagattaaaaggggctgccagagcagacacattgacgagtagaaaaaaactatttctggcaaaggcgtctccgcctgcccgcaggccgagagacagaaagcattcaagtcatgtcgcggtcggttccaggaggactatgcttgctcttgcgagccccaatctgtcaaatccacccaaaaacgttcaaattaaaatttcgaaaagtacgccacaaggactagaatttcccctatcaccagcctaatgccatttgttttgtctcggttgaggcggaattgcaaggagcctcgctgatgcgaataagcgaatccagcacactctcgcagcttgctgttgctggcgttggactttacttatgttcgtatgactttgacacacctggacagcgccgctgagcgaagtccttgaaagatgacctcttgactcgcataaatgcagggtgcgaatttaatttgtgcccttggccgtccaaaaggggcgctctggcagcgactgtcgttgcctaccagagacctgctattagccgatcggatttctacgggctcctcttccccattttcctccttctcctctacaacgtacgactacatagtcgttggagggggtagcgccgggtgccttgtagcgaatcgtctttctgaaaaccctcatgtgaaggtccttcttctcgaggcgggg

SEQ ID NO: 4902 - DNA, 700 bp, Nannochloropsis_gaditana
agtaacaaggcagcggttccaaaccttcttcgacctcgttacggggattgcgttaaaattcatttaaatcccacgattctttacaagtagccatttcagcaatgtcacttccatgacgccttgggaaacttctgtccatgtaatcgaaaaaagaatcgaagccgtgcttccaggtgtgcgtatttgctactcgcacagcgcgtgaccgcccatcagcacgaatgatgtgggatgcgtttagacgagcacctatggtctggggtggaagaggcccgtccatactgctctcatacctagtccccgggaaaataagagcattgagtctgtgatagcttgtttaattcgagaaattcgtctggagcttcaaccatttcgccttcacgtcatacaatttttcccgcgccaagcgtctcgttccagcaccaaacattgttgcgcccagcctggttgtcatgttctgtcacgaaagtgctgacgtgctgacggaaaagcctgcagaacataaaaaggtccgggacgaccacgctgggagcgtgcgcacgtcggacgtgctagaaggcgaggcagctcgaaggcccgagccccgccatgcccaccccctgcgaactccttcctgcccgaagctttcctcaccatttacgccccgcttttagcattttattttaaattcgatttgacaaaaacacagtgctgcaacatg

SEQ ID NO: 4903 - DNA, 700 bp, Nannochloropsis_gaditana
tttaactttaccacaacaggacggcccaatatcgttttcagaaactcggtcaccttcttgttctggggaggccggggggggtcgttgtaaaatgagacatattgggacacgtctctcgtaatgaggatgtccgtcacgccgtctataattatcatatagttgcctcggcaagtattcaccaccaagtaggcacaatagtgccatagcacgtcgacgctttctcttctccccctcctgcctgttacctgcgccggtttcgcctcggcagctgcgggggcgcttgtgccttgagcaggagtagcagcgggtgtaccagcaggaggtgcgtctgacatagttagctgggtacctgttgcaaaaggctctcattcagtttcccataggagggtaatgcgacgtaatgaatttagggaacactgcaagagagatacagacgctcgactcgctcgttagaggacgagagcatgcacccctagcgacgcatgctgtcctcataagctatttttaggttcacgatcttgtggccatacgaatcttggctagcatacaactgttgtcggcggtacaagctaacattttttgtcatacacaaatgcctcgttgtcaggcgtatttctcagcccatcactcttaacctcccccaaacattgctctcactccagactcatcgaccccaaggtttttgatggctacgggtggc

SEQ ID NO: 4904 - DNA, 700 bp, Nannochloropsis_gaditana
cttatcgaagtcatcgggggaggacgcttccactactgcctgctggcgaacgagctgaacccttgatgccctgctgctgtggacgggtggtgcaacgaaggcgtccgacgcagaaaggagtacggctccaagaaggaaaaagtaaagcaaggttctcgtcataattctttgctacgactggggaattttcactgcaacctccaacttttgcgggtcctggtggcaccttgcggtaaggtgaaggttgacggggtcggacaatggagagatgcatgaggacgaggtacggggggaaaaaatcaaggccggcgaagcacacctctcagtcccaaaggtcaggatctccgagtcgctgtctcgcgttcactcccagcttgagcctgcggcgtgtgcggcagcgtggatctaattgcaaggcgccggggggccgcgattctctcatttcacccctcgaggcgagtcgcagcgacgccctaaagaacactcgagaaggaccgcgaggttctcgcggtcgctttggggtgggagcaggccgcatgtgagcggtgttgcacgtgtgcacaaaaaccggacccacggtatcacatcgtcctcatgttttttaaaacgcgtacaatttcaagttgtttcacccagcaggaaaaaccacgtactagccagacctcccccactccatccactacctagtcagacagacatg

SEQ ID NO: 4905 - DNA, 700 bp, Nannochloropsis_gaditana
ttgcccgtcatcagggcacgaaacagcgtttcaagccgccaacaatagctatgaatggaggcctttgagagatttttctttgactgaagaaagctgacgtattcatcgcgtgtggttattgaccagacgcccatgtcatacagactccgcgctcgtgccatcccctgttgttccaccaggcgataagaacgagccagcaaaaggggaaaaacctcaatacggtaatatacacctattctctagtagaataaaacatctgtaagatgcaagaagccaccatacacacgttttatcctcccagatacctacccttatcgtgatagtcgtaggccgacacggctgttgaaggagtcgaaaaaacctgctgccgctgccaaaaccgctccacaaccatgcaaggtctgccaactatgagatgatatattcaaatattgaaatacgacttgaataattttattaggcccacacactatcccatcagtacgagtctcactgccatttaataagcaggccggtatcttgacccgcgcgctccaccgtggacgtgacgtgaagtcgctgtcaaacctcctgaccccccctgggtaccctttgtctttaccccccgaaacaaagaatgttgaggctattatacaatgtcaacgcttccacttgtttttttttgtctacatctgtacattatcctccagtgaaaaccatg

SEQ ID NO: 4906 - DNA, 700 bp, Nannochloropsis_gaditana
gacacagctatgccttttcatcaaacaaggaaccatttgagcggtcgacattgcgctttttgtgatcgcgatgtcaagtttaagtagtagaaaggtggcgaggaggagaaaggagagaggaagccgtttgctgtcgcgcattcccttttggagcgctaaagacagaaataagccgaaaaatacagctctaaggctacctctcccttgatatgtcttcgcagcggcctgcacaacagaatgagatgagcaatcagtctgagaacgctttccgctgcaacagtaggaggaagctgaagtgcgggcgaggactgatgacgcggggctgtgatggaaaagacctcaaccgccagtgcccctcctcgagccgcagcggaggataagaaattgagagtgccaagcctgccccacatcatgaatgggggggaaagggcagcttacatggctgttggaatgaacgacgtgtgatgaaattcgtgttcccccttaattgtctttgcactttgctttctcgcttgcatcgcttcttcgcgcttaggaagtcttcgaagcccatctatcacagcgtttcgtttcgctttttcaaacggatgtctgaagaacatcgatccgattcgcgttgatgagtgtttccggtcctctacatatccctttccgcagggagctgtcaaactgtgcatatttgcggggagggacagatatg

SEQ ID NO: 4907 - DNA, 700 bp, Nannochloropsis_gaditana
agcctatttgcgctggatgaggcttctcgttggacgttaaagggttgtagatagaacaagcgagggctcaacaaggaaagggcaatgtctttgcaggacaggactgagtacgggcaacaactaaaaggcagtcagactggccttcacatgacaagattgtaggacgtgccatcggccatgttgccgtagtgacacagataagaactggtagcgtgaggaagtaaatcgtcaagcaggggcacgatgtttgagatggtctgcctcgagatcttcatagagtcatgtgcaagttgttaacggcactgaaaagtataaaaaagaaaagaaagtatgaactcgcagcacagcaaccgtcacgcgaacgttttctttcagagatcgcattgtgttgcgctgtggtatgttcacggcggtgccatctttgtggtctgacgggcccgcggtgtcataatttggcatttccttgagtcagcgacagacaactcgcctagaccatcgcaactaccacctccttgctgtcttttcatggcaggtgtgtcgagctcaattatgcatgaaaagccgtgaatttcctcacggatttagacattagacaggcatgtatatgattgaggacgggtcgcaggaggtgtttcggttcccaagtggacagagctcaggatcctggccagcgtcgactgaaagcagaagcttgaccatg

SEQ ID NO: 4908 - DNA, 700 bp, Nannochloropsis_gaditana
tgatctcctctagacgctgacggtcaaggttggcagcttctgggctcatggtcccgattcctcggactatacccaggcacattaaggcggtaaggcctcctaccaaaacatgaagccgcatatttttttgcatgctcttggtctcctaggcaggacacgaggatacggtagggataggttggaaaatgggagtgaactcagcaaaattagggtagctcgcaaacaaccatgtatttttgggggggaaaggatggaatggaaacgcggggaccgtgggctatgggtggtgattgggcaggtcggaaagcatgtgtgtgaggaggctgacggcccatgtcgatggaagtaaggaagcgtgcaggcatgtacacgcacgagggggtaagggggacatcatcttccggctaccagggcatacattgaaaaggaccctgcggggagaaagagacgatccttgcgagaggaagggaaaggaagcgcgaggcggggatggtggggatgcctcctgcgtccttgggggcgagaagaacaagtcggcgagagggcgagcacccacgtcactgcccggacgacatttgaattggggccagagggggcgactgcaggggctttccgcatcctgccccttgcttgctcttccaattctcacatatctacctcacgggctcctctcgaggacagggacctgtggcacgagcgg

SEQ ID NO: 4909 - DNA, 700 bp, Nannochloropsis_gaditana
aggtgcacgacgcaggccatagttattagtcttgtaggaatgtagaaatataggaatggtttgaatttgtgtgtccacgggaggacttccttctctacaactcacaatgatgaaattttcgtccgaaatatttactgccaggtggcaaaattcctccgtcgggaggagcactgtgcgtacttctagtcatttagactttctacttacagtaaagacccactacccaaacattgaaacatattaatctcatgcaatttattctcgagggaagatattcaatatggcttttaattaatcgccattaaataattaaaaggtatttaatatatatgctatgaagtaaacattgccaacgtaggcacaaatgacatgacattttgtcgctctccatcaattcattgataaattacaatcgctttgtgacgatataaagctgaaattctatcatgcattctccttcccgggtctcacgagtccggttgactggcgagaccaacttgttgaacgtcactgttttctcgcgcgcagggggacatcagctagcgtgagcaggcgcattgcaaaggctcataaaaacaacaaaatggcatgttatgccacaaatcttctggatcccaaaatttacggatgtatgatccatgtacaacagaggaggccttaatcaatgacaactttatgatattcgacgcaacacgataca

SEQ ID NO: 4910 - DNA, 700 bp, Nannochloropsis_gaditana
tttcagcctcgaatttggtgattccttggtttgttgctttctcagggtcaacagtcgatcgatttcctccgctcgggtaaggtatttgttggccgcccgtttgatctgatcgttgccagccctatcttgttttacagcagcaagcaaaagagcgacagcctcttgatacagtgggaacgcctcctcggcacgaccgcattcgtcgagctcgacagcgcgttgagcgacctgcaatgcgcgttggacggagggatttggcagcgacgacgaggtcggcgccggaaccgaagtcttccttttcacgctcccaaagaccgagacaccatgaaaggatggtccgtccgacggcccgctcatatttaatcgtctttgcaattccgtgcaatatcaaaaagataatgttgtggctactttggcaggcaaggtcggtgtcctgcgcacatgccctcagcaaaagtaaaaaagagagaacacggcctcaaattatttcgaggcagtccaacagcttccaaatgctcctaacgtccgtgaaattacaaggaaaaagttattatatgaacatgtcgagaaaaaagtagcacgggcaaagcggttgcgagccggtaacgcatatcacgttcaggcgatcagaagctgtcgctgtcgctctgcgccgtgggactcacaatatgcactcaaatataacataacattttgaggg

SEQ ID NO: 4911 - DNA, 700 bp, Nannochloropsis_gaditana
gtaactacatgataaaggtattgtcctttctcacatattctaggagtgattctgaaaatagggtgtaacgaacggccaggcgcccgcgagaacagggatgccgacaggtggttcatctttcctttctagcttgacgaagcggaaaaaatcccccgagcagttggtaaagctcgcggtggcatgtctccacgaattacctgcagtagaggatgcaagctggacatgtccaggcgtagatggcacgaaagcgactgtgcccgcgatggacgggctaaaccggggtgagccaggccccagcaagcagcagaagcaagatgagctaacctcgtcgaggcactccatctcatcttcggcaccatccaatccagacgcatctcgcacttcttcagcgggtagtgatgccggagcctcgcggcggtccagcttctttttgagtgcttttggcaagaaagaagcccactcacatgattctggctccgcgccacccccacactcgagcgcgggatcaagcagagacggcagcgcagctgacgcgtcaacctctggaaaggtacgagggattagcatacgccccacaggcctttctgtcagcaagtttttctcggactcgagtaggaaaccaccaatcctaagcccgcaggaatcgaattggtcacagggaagcgtgggtcaatccggaatagagggtgattctgtgatg

SEQ ID NO: 4912 - DNA, 700 bp, Nannochloropsis_gaditana
ttatggagggcaagggactgataataaggaacgtggctctcgacatggaggagaaagacccaggtgagcttgccacaggcatggctgatgtcaagctcgtgtctgggttttgcggtaacagaccggcgcggacgagtttggcccgaggtcgagacgaggaggcggatgtcgaaaccctgacacggatggagcaggagggggataaagaacgccggcgtttgcgaatacaccttgcatctgctgctgtctttgctcgagtggaccgaggagcgttgacaaaccggttggtggaggtcctgtacgaattgaccaagtcggtccgtgaccggcctcccccgagccgcgcccgcaatgacgacagctctgacgacgaagagtcctcttcctgggatcccgccgccgtggccgggggaggagcctccctgacaaccgccagtgctgggaagacaagtgacctgcgtgcgcagggctcgcgtcggggaaggctggcggcgggaggggcgggagatagtatggggttgcgtggggctagagacttgctacggcggccgtcttgggtcgaccagaaggagtggacaggcgacttattcgggacggacgggagcaagcgggagcagtcctcggtaccaacgccggcatcggaagacgtagccctcgtggaaaccaccctagacttgttggtgtcgctaggagcaggcgg

SEQ ID NO: 4913 - DNA, 700 bp, Nannochloropsis_gaditana
tcagctaagttgcaggataaaggtgcctaatatgctcagttctgattgctgttatcgtaaggatagaaatatgttgacaaacttgggcttaaaggcttaaattctgttgacgtcgaaacacatgttggtaggaaccgaaatgttttttttagttgccgttccagtattaacacatgctttggctgaatattgacacattcccctgtgtaagtaggacttttatcgggctttatcttaatagggcaaatgagttttgcgacgcctgaaatactgggtatatcgtgtgaatcatgcgtacatgtgtttttttttccatcacccgacacctcgtggctctctctcggatagtgcaactctttcctggactcgtgaaatttccaacgaaatcaagataattcaacagcatactttaaatatgatgatagcaaaaggttcatgagcacctttctgaaaattacggattgacttggccatgaccacatgtttttttgggtgcctgcctcgactcgcctctcggaacatacgctgtaacagatttttaaaattcttgacagctacgactactgagtcggcaatctcaaaggggtttgtatacccatgacagggtcgacgacatcgattcgatccaagcaaagcgtggcagagggtaggaatatttgactataaaacctgctctaccatcccggttgctttcgatatg

SEQ ID NO: 4914 - DNA, 700 bp, Nannochloropsis_gaditana
agttcctccttactgtactcgccgacaacgggctgttgaacacggaccacttggacgccctctggtgggcagcgtcaccgctgcaccctgacgcccaagtccgcaccgtctaccggctcattggggttgtggcggagaagctcgcgcagagaaataatcggtctttgcttttggccatgcatgctcggctgaaaagcgacttaccgcagccatacgagacacagcacatcgagctcattcatgccgtggccgaggccgccatcaccttggagcactccctaccccgggagcgcgggcttaggccgggaagtggcaaacacggcgaggaggacgaggacgacgaggacgagggtgagggagcaggaatagaagagaggggtaaaggcgtcgagggtgaggatgctctcgctgaccccttgggactgaatttgttatggaatgccgtagtagggccttcgggcgagaatgacgcagccggtgcatcgagcattcccaccgagccgcccgtcggattgccctctgtgtcgtccacgtcctctctctcatcatccattacggtgcctggcaccacgtcagcgatgggaatgtttctaaaaagggaggcggtcgaagtctgcgtgcaagcgatcatctccctccttatcaaacaagggaacaaagatgttctcgcccgctatatgaagcggtctgtcctggccct

SEQ ID NO: 4915 - DNA, 700 bp, Nannochloropsis_gaditana
aagcaaatggtggcagatttagaaggggtgcttgctaacattaagacgagaatgcgagttattctggaggcagctggggaatcagggagtcaaagaaggggataattgccggcaaagagtgcaggaactgccaatcaattcttttgtacatgggcgtggtgtatttttttacgatggtctagagatgttaatgtccagaaaatagggtgtataataaaaaaagcatcaagtaacgaaatctgggggggcggggaggttattctcagcgaccttgaagtgcttaagcgatgcttccaaaaccactttttctggctcgataggtgtcgggtgtactgtcacataacgattccgaatccggcagaaataagaaatagggatgtgtcccagattgtctactcataatgtcgcttacgcggttgttaccatttttaaatgcgcatttgaacacagaaacaagtctactcgcccaaagacgaagaacaaaaacgctatgacctacgcgcgttcctctgcgctaatcttgatccccgcgcttctccttcccgtcatgccctatgccttttttctccgtatgtcccaatcccctttgggtgtgggtgtaattggctgcggacgtatcgggcagatccacagcaataccttggctttccggacgcctggtgcacgactcgtagcgatcacagacccgtttgaagacatg

SEQ ID NO: 4916 - DNA, 700 bp, Nannochloropsis_gaditana
gatggaacgcaaccatcgctacctgggtcgagaggttgaggtattggtggagagtcgtcatgtgaaagatccacgcctcgtcaaaggccgcaaccgacaagggcgacctgtgctctttgaaggaaacatagaggagctccggggaaaacttgtgcctgttctaatcaaagaagtcaggtcgtacatgctgtcggggatacgtgcggggctagcaacgtgaaagtattaatccgcaagaggaacaattgtaaaaaggatccaaaaatgggctctcatacatatatttttaattaatgatttcagtaaacctcccacttccactccaacgaatgtgaaactgcgaagacttagaagtcgggtgaaatgcaaattgatggcgttgaaatcgcatgaaaaataagcaacgactgattatacactttatttcgctggaagaaagtagctttcaaagcttacgggagcttgtcatgcactcatgaaaatcaaatcactaccgagtgctaggaacctcgatggttttcccttcaacgttttttcaaaaaaatgaatgcgggtcgcttccatacaagcttagtatcgggtgtcggagacagccgtgcgctatgaatattgattcttaatcatatatatcccgcgaatttcctggaagagtatagacatcagtaaacattggtctgtgcttttctactgccaggacttc

SEQ ID NO: 4917 - DNA, 700 bp, Nannochloropsis_gaditana
catctgtgccggtttgcaggattcgattttacgtttttcaagggtttacgcgtgactttccccctctccatgctattctggggcctccttcatgttgctgtatggtcagatgatccagagcatggcacgtggcaactactgtctcgtgatggtaccgatgcgatggctctattcataagggaatgatgttgtagccacgcgaaacaaggcatcatattccttcttctttccctctttggcagggatttagtcgcgccacaaccccggccaaggactgcgcagacataagtgcgggcgcgaccggtagtggcgcagggaggacattcctatggtatcacaaagggttgaacaggggcgagcccattgttgccgtcgacgtcatctacgaggacgagcccgtgccccaaggctttgtgaaggtagcccgcgatatgagcaaagggagccaccagcggtctttcctctgttttcggcgggcgcgttccccgccgcaagaatcgggggccggggggatagccgaccgcggggagggggggtccgaggaggatgcgcacgcagaagaggacgggccgttggtggatgtggtgatcgtgggacaagatgaaaacccgggagaagggtttgttcgcttggacaagcccctgtgtaggagcgagcgtccgcttttcctgtgctaccggcgcgcccgcagcttcggcgg

SEQ ID NO: 4918 - DNA, 700 bp, Nannochloropsis_gaditana
aaacgggtggcagcggaccgagtggcaacctaaatccgttactgcatgggtgaagggcgaggttttatactcatagtgaatccatttcacaggcgacaaactttagaaataaacaaatacgcaagaggcgaattgaactggctcgaggtgatggagacgaaaagatggaatgctttcggtgttctatcccttgtggtcgggttggtctcagctgcttttgcgatgctagttggcgaccttttcggcaaccaaggcgatgaaaacaagcttaaataaatattacaggtgacctatcgcagacttatgattaacagccattgcacagcgatagcacttcctatctgtttgtttccttgcacccaggtggtgcgagggccttgaaggcagaaaaggttgttatgaaatgattccagccctgatgacctaaacaccgtagtgagaaggaaaaatgtatattaagcttacaaagtaagctgtacctcgatacgtccgccgtaacctcaaaagtcattaatagatgggaggtatgtctcggatttttttcaaattttgaaaattcatatcacgaaacgtctcctggcgtctcttcgcaccggtcgcaacgccgctaacaccgtactccttgcttcgaatatctttccagacttgataatgtatcgctcactgacatgtgctttttctctctgcttgactcgtagcg

SEQ ID NO: 4919 - DNA, 700 bp, Nannochloropsis_gaditana
tttctcatgtttttttagcgtgctcagcgtctcagattatttttcgtatcgacgatctcctgtccgacctagttgggctttttgagacccacgagattaaataaaataacccaaattcctaattctctcacctttcacaaagcgatcaaggactgaaggggaaaaagcatggagtctcgtgctatgcttgcctgaatttcgagctgcaagagttaaaacgcgtttgcttccttgcctcctccagcatggacctgctcatctcaacagagccgatcctaggagcttggggcctgagttttacagatttagatcattcatatgaagaggaccgcgcagtagtgcgtaggagcggcgtggatggccgtgtcgcgggtcgtccgcgtgacgggtgcctgattcaattgagtctatgagggacggcaaccacgccgccagctctctcgtgcagtgaccggctgcggcctcggcgcttctcatcatgttgaggctccccgagtctggaaccgggcttgaaatgcgctttacggcatcaatatcaattgtggcgtcactttacttgcacaggcgactgtcattgcgaatgctgttgagcgcgcagccgcgctcgaactgtgtgcaaattggggactaaaaaagcgagcgagcggagaggtactgagcgcacaagcagagaggcgttcataaagttgccaagggcatg

SEQ ID NO: 4920 - DNA, 700 bp, Nannochloropsis_gaditana
gaacatctttgccacaaccgaacccttttcccgatcgtccatgtgcttcacccgtgagatggacgacgatcctttgtatgttgtgaattagggcattgtaaagtgactccttgtcggtcgcgacggaaaaagtgaaacttcccagagattacttcagagttatttactcgctttcctaccgagtcgagcttggcgagagattccacttgggaggcgcagcggaggatactgcgtgatttccctctctctctttgtcaatttcgcacctcatcacccctgacaccacactgcgcaacctgcataggataaatcgaatgccatatacgccttacgaattcttgtcgggtcgataaagggtcacaggatccttgggtagtcaactgggatgagcaccgcgggaaagtagaagcacagcaacacctggatagggccaagacggaaaagcatgactttggatgaactcgtcgacggcattgcgcatgcgctcaagttacgtagggcaccaatactgcccatgtccctttcccaaagctctgccccccttccccggtttcgcgctgtctccgactcagcgtccaccgcggcattgcgtcgcgatctcacacccaggactccgcgggtctcctttatgcaagtggctacatacatatggcttttcctttcacttagtgtagctgtactcggttacgcagcatgcatg

SEQ ID NO: 4921 - DNA, 700 bp, Nannochloropsis_gaditana
taacacaaacgagctcactgccgcacgagatgtttgatgtgaatgcctggagtgattcgcgtgaggagatggcagcttttaggaataagagggatcatcaccgcattcaagtgccccaggccggcgtctcttgaggatcgtgccccgatccttgctacctccgaaccgcttgaccatccctccacaatcacgcgaaacaatcgagtcaaagccgtcttgaccttcactactgaatcttgcgaaggcttctcttcgcgttatcaagtcgctagagcattatcagctcagagtccgtgctttgaaaagcaagacctcgccctatccactctcccagtgtggagacggagaggtctcatgcctcttgtcgtgagaacaattccacgctggacagcaacttcagataaatggaagagaaactattgcacgcaagccatatgcggacgtgctctggaaaagcagagtagagcgattttaatctgcaggatctccgctctcaagtggcaggacaggcctcgaaatccaacctcggggcaaggcgcctggtggtgaacgcctttggtcgccttttacgatgacagcattcacaatttgcggcattttttgtcgtgagatttgctgtgcactatatagcacaattgtgaccctcacactgctttttttcaatttttgtgctcctcacttgcatttattcaccaggatg

SEQ ID NO: 4922 - DNA, 700 bp, Nannochloropsis_gaditana
cagtaagcgtggcctccaaattctcgacgatgaacacggcagcaggctgacagcctatgaacagggacacagacggcttgatggcgcctctcatcaggacaagtctacagcttgtaatcgcattgggcgcttccacgaccccaagaaagcgatcccatcgataaacatagagacgcgaagttcctgacgtgacagcaatgtacacggaagtgggggagcttgcagggaccaatacatcaagcactgtcgagaccccgcttcgcaccggtccaggaagctggtgtttgaacaacattttagctttttagggtcatcccatcatttttggccgccgcacccgcacgatgtcggagctgtcattgtagtggtgtaaatcatggtacgatcagggtttaaaaaaaatagaacataccatgatcgaggcagattacgtcgacacgagcgtaatgggagacggcgagtcaagtcgctttcttttaacgcgctacaagttgagcgccttgagatctgaaagcccagtccctgttctgtttcacgaaattggcgtgtggtagctgattccgatgccaatatgccagtcgaatgcaagcttatcctgccattctgccattctagaccgtaagcctcctctcctccccctgtgacctcccccacccccaacttgcccctcagcgtgcagtggtctgcccagcatggtatg

SEQ ID NO: 4923 - DNA, 700 bp, Nannochloropsis_gaditana
gtaagatgtttctgtgcggtgcgctaggaggttcccttcgtgctgacagcgagtctatctccgcgtcatccctcaaatccaccaaaccgagataaggtattggctcacctgaaggtccactcagcaacagcaagtcgccagaactgttaaacatcatgttagtaacacgcgttccaccgtaaaattggtcctgtgcatcctctcctgcagagcttcctatcctcaaaggcctcacaccctgctctagatccgaaagggttaagaaatgcagcatttctgtcgcttcttgcacaccatgaccgaagaagtacagacgctgtttcgcgtcgctgtaggcgcaggtgttcagagactctccagcctctgccgagagcccgccaagggatgacgccttggctagcttcgagatagccacacgcgtcccctgcatcgtacaagagatccagaagatgctataatgctagcgtacgagacctggatgtgtttgaaggaagtacgatagtcatgtagcggtgcgcccgccctaggccttggtcctagtggctttctcgtgcgaagcaagcatcagcgttaccaagcgtggtgccctgccggcgatagccttcgctggaagcgctctcatcataaatacgcatctggatgtaaacatctccaatatatatgtatatatactgaaacagcgtgaacgaacgggcacatg

SEQ ID NO: 4924 - DNA, 700 bp, Nannochloropsis_gaditana
ggacgcgcgcgtgctggtgatgggcctggacaagggcttggagctggtccagagcgagccccgcaggaacgggaaccacatgctcgtcttccagttctgtccgagcgtgcagcagctgaaaaatgccaacggcttccgcaaggtgggctggaaggcggtgctggacaagcgcccggacaagtggcgcttcggctttaatcggcagggggtgcggaacgcggggctccccgtcttttactgccctgacctgcggatcgcgaagggccgcgagatggtcaaaccagtctttttctccatggaggacctgtactacgcctgggacaggagcacggccggcaagcacggggcggcccccggggaggtgaagactctggactttctccgtgtcgtggagtggatgctcaatgagcccgagcagacgcgtctggttggcttccacgccagcactcaggcgcaggagtacgtggaggcgcagctccgggtcaagggcggaaaggcaaggccaataagggcgagctgaggagggaggaggggaaggagggggagccgcgtggtgaggagcagggggcaaggcgggagagggattgaaatttcgtaggcactcagcgaggctcatagagagcgcaaaagaaaattaaatgcaccagcgatctgcgcgctcttgttgcccgaggaacccatccacgaatagaagtaatat

SEQ ID NO: 4925 - DNA, 700 bp, Nannochloropsis_gaditana
tgtttcctcactcgtccttgtaatgtctcttctttggacgactttctgatgctcaaaggaatggggacgttgccgagcccgagtggggcacccaaggataccatttagcctccttagccgctcatttcttgttgccctaccatgtcttcctgctggtgatacaaaaccttgacatcctgatttttttttatctggaacaccacatgatacatgcacttgataggatggcacgatgcaggggttctggtgccagctttatgctattggttctcctgttagtggaggtcctgcatggagtctgcgtcctggcttttcagcctggcagcagcggtccgttcgcacacgcgaacggagttcatcaccgtcgatcaacccgatgcgctagtgaaggcgataaaggagagacaagaagtgcatgtggtagggaagaagggcaaacatcgcgcacagtctcggcatggggtactctcaagacaaagttgagcttcggggttgaaaatatgggcaagttgacgtttgggaccggagctgccattgtggcagggtttggagctccgcaaacagtggacgtcataaaaggttggtatttatttatccaaagctccaggcatgaggttcagacagtgtttgctgtgcggtggttctcgggatggtgggctgcgcttgtgcaagtcgtcctcacgctcctcctccatccatg

SEQ ID NO: 4926 - DNA, 700 bp, Nannochloropsis_gaditana
ggcaccgcctccaatcctctctaatggcctgtggtggtaatttgtccgagtctccacttccaagggtcggtgcatattccctttacgggcacgggggcgtacgacgcccttgcttccctagattgcggctgtcctggttgattcagaccaatttaaattctttgtgagcaggatgcatgaaaattgagtcgtgtgcatgcatgacgtcggaaggcacaatttccaattcctcccctggaccccctgtggcggttagaggaagggaaaataaggacgatacggacgcgtggagacagatgcagtgggaggagcaccatgaaaggttacatttgtcccgcgagtaagacacacagctttttgggcgacctctaccatcacgcaccatccagagggatgcataaacgcactgccgtggggtttgtccgggcacgtgggacatgcgcggacgggggaaggtcgggctggcggcgatggaaaggggagacgaggccgacgcctggggccatctctttttgcactccagcttgatcgggtggacgagggcaagaagaagagtccaatctacctgtgacattccttgaagatctgcaatcggagtccaagtcgatggctcctggaagctttgtcttcatctttttttgagtgacgcgcctgaggaacactataccccatcacataaacgaaacagcgagagaccatg

SEQ ID NO: 4927 - DNA, 700 bp, Nannochloropsis_gaditana
aagacttgcctttacctcccggaagcacgcggccgccgctctcagagtttgaaatcgagtgcctgatgcgagacagagtgtccctggttgacggacgtagcaatcgaatcgtgcatcgcgatgggattgtactcctgacctcgcatcgcatcatttggcattgccaaagtcagtctcgcgccttgcacggtcacctctcccgggtcgccgaggcgcgtacctctcgcaacatattcaaaccctccacgagggtgcatctatatctgcaaggaaaagtccaggacctagatagtcggccagcgaccaagattgaatttgcacacggcggccgggacgagtttctaaaacaagtgcgttcgctgttaatgatgcgggattgggagaagccccccccggtgaagcttaggctgagtccgtgtgccatcgaagctgacggcagcactccagccagcatgccatgttcctcccccgcctcccctgtccagacggtcgagcccgtcttcaccacgcggctggccggggtgggaggaattctgcgccagcaggagaccgcgcgtgccgcacaagatcgactcgccaccgaagccttcgcagacctggaggcgctcatgagcaaagcgcgcgaggtggtaggagtgattgagcggtatgctacggtgctggcatccaaagacaagggggagggcgagaagggcggctc

SEQ ID NO: 4928 - DNA, 700 bp, Nannochloropsis_gaditana
taaaaagggcgctgctggccacgtacgctggcctgtttgcagggctcctggtccatcttcgtcggctataacttgtacttctacctcaatcgagcttctcagatccttatcttcggcatggcaatcaaaagggccggtcgttggggcttgaaatttatgccgtacccacgccttggcggccgccgcatcgaacaaaaacccaagcgcggtcaagtcttgctccccatcgccgtcgacattttcataattcgacactttgtctctataaatcatttttctgctttgtcggagcgaagcagggtaaggtatcgttaaagacgtcgatactttgtacgcagcaaggataacctccccccaactgggacgctcttgctcgccagaggggatcattgccccgcggcctcacgttttcgatagcgagccttttgctacttctcatgaacctatgcaaagcttgcaacacttagccatcatcttctgacaccttacacgggttggaaccctccgtgtcgcgcacgccacgtcgttttcggcaaatgagtagtatggccggtggtacggttcaggctgatgaaacaaaatgtttatttcacatcctctcatttggtcttttaatctcgaaacgtttacgaagcttatcaggtcgaccgtgattcttcttctcggaatatattcttgttttagatggccaagcaccatg

SEQ ID NO: 4929 - DNA, 700 bp, Nannochloropsis_gaditana
cacaggtctgcgtggcatataaatacacgagagcgtgttcagccgctttgtttagtgcgaccgatgtgaagaagaaatacagaatcgcacgtatcagacttgataggcttcaatttcccgccttcagagaggggacctctactagtccatgtatgagaacagagggagggacgcaattgtggaaacaggtttttgatgattctcgttttctttatgttttcggtagagtaataaacgcctgacaaataaattagttccgtgtcgtacaaaaatttcaccacttacactcttcccctcatcatcacccttgttgattacgtgttgctgaaaagattgctagtacttgtgaatatttattcctgatgtttcactttatactgttgtgtcacagaagaaagcaacgatacccggatacgcctgacaggcaggagacgggttcgaaagggaatgaatgatcctactttcactgtcaacgacccctgtactccaccctctcgaatactaccaatgccccctttaggtgttttcaactttatggaatgtcatcatatggcttgttactgaaggcgaaagaagttttgaccctcgctaggcgtcctgcaactcgcccctcgtggagcccagcagctagggtcttctactagtcctcgtctattttatcttctgaaagttttatttcttctcgaggccaaaccatatg

SEQ ID NO: 4930 - DNA, 700 bp, Nannochloropsis_gaditana
aagtaaagttcactcatcggactgacggtaaggaaccaggatctaactgggtacttacatttttcaaaatgtctataacctcttgatgaccttagcatagctagtttgatgcccttgtgacaagtatagaatatacaatcgaattgactggagaaacgctcaagatatggcctgtcgcggaagttcggcggcaaatggtaggagtcggttgctcgcactttctggatggctggtcacagtctgtctttacataatgtgaaaagtggtttttgttatgacttccatgatagtatcaacctcgcaagagtcctttccccaaaagttcagctcaggtaacgtacacaaggcaagaacgggaatagaagggcagaaaaggatgaaacggctacagccgtttcaaaaggccgagtcctcggtccccgccccctcggccccgacgggcgtcatccacccctgccggccgcgtgccacctggaatagggtgtcagcacgtgcgagagattggtcggtgcagagtcaagaccctttgcctatgatgaaacatttgatatatgcattccagatgcttctttaaaatggcagtcgtgggtaggatctccttctggacgtgatacaaagcaaaaccctccttctcacaagcaacctcctctcacgctcgtaaagcagttttcatagccaacaaggccctcttgtggctatg

SEQ ID NO: 4931 - DNA, 700 bp, Nannochloropsis_gaditana
gccctggtctccgtccaagtggtcagacgaacacaggccgggccgcgaaagcctaagaagaaagcgaggcctccccaccacccgctatgccgtagtgaggcactcccctcgcgacaagtaccgtacaccacacagttgccacgcaccacctctaaggcatcgtgcatcaaatgtcccagcgtgtccgacacgaacaaacgctgcctcctggcctgagcgccgtgtcgcggacacgcgtagtcgtgggtggtggtgctggccgcccggaagggagggaggggccgtgccaggtctgtgacagcgtgagttggcctcgcacaccgcggaggggctggtcgggatggtgtgcatgaccgtgtgaattgccagtttccgatttctttgtgaagtggacttgtgactggcaacgcgtggatgcagtgcaccgttttgtgcgtcccactaaccttccccttatctacccccttaggggcccctgggctcggacgacgaggctcgtgtacagcaagttgaggccgtcgacataccacaccagggccaaaacgacaccaatttttggcattagcataggacgggggacatgagaaggagacggcaaagggctgaggagcgtcgaagatcatctgcgccgtcatgtacgcgcattcgagtgccagcacagcgggtcttacacaaggcgccgcttccttcacatggaatg

SEQ ID NO: 4932 - DNA, 700 bp, Nannochloropsis_gaditana
cgcaacgtggcacttatcatctttccgcccttcatctccgcttacgcgagagacctctaaaacgccattaaacatggtcaaagccaaatcgtctaatcgctcctgaatcaagcttgcctcatcagacattgtttaaacagacagaaaaatacgccctcggcagtgtcgtcgcatgaatttccgatgggtctgcgcgttgtgtctgttgagatatgtttgtttggaggtcaaaggttgaatcctttgtcatgcacaggccacaccatctacacgcgctactcagtccctccgccaatgcctctggtattttcactccatataccacgatcgaagaaggaacgacagcgcacgggccctgtggccacaggtgtggcctcctgctcccccacgacgccaagacagggcagggagtaggagacgggtgagggagcggctcggatcacggcagtccctcttcacccgtaacccttctcctagattctggatagctagcgtcgcagcctacttggacgactacagaggagtcaccttcagtctcttagcatcataccttgctcatacacgccttatagggggcgtaagacctctggcgcgaaacttaccatctggactgtttctccttccataattccatcagcgtctgaagtggaaatctcagaagggcgcagtaagccgtcgcgatttacctttttgagaaatg

SEQ ID NO: 4933 - DNA, 700 bp, Nannochloropsis_gaditana
cccactgcaacggagcgtacgccagttactgtatcatgccataagtcgatcacgtgcttggcacctgcaggactcagccacacccaagaccggtgcacttcgccttgcagaacattagttctcagcatcctccttttgatcacttgacgaggatcactgtgggagcttggaagacgtgaaacccataaaataaattgcgtgtatattcttaggggagcctatctttggtcatctgctgtaggttctcgagggacatgattaaccctccacgatattaaaacgtaaccagaaaattcaagatcattcccctctcagtgtttttatgcatacccttcggccaaaaatgttgttttctcgaacattttgcacggcagagatcctgctccttacctcacttcgccagtcttgttcggacttgaggtgctatgcgccgctgtctctgccctccctcaaccctctcagctgtagggttctggcaatctttcctcccggctcctaatgatagagaagatgtgatacgggaaggggcgcggtaagcatgtccgtagtccagtcctgggagggaggcaggcagggtagaagggagacagcccggccgtcgcccaggttgagaggctttcgccgaccccgaggctggtcgctcgcccgcggtctcacagcgcaatactttcacaatcctccacacagtaccacgagaatg

SEQ ID NO: 4934 - DNA, 700 bp, Nannochloropsis_gaditana
gagtgcaaggctgtctgcacagaggcgggaatgttcgccctccgagagaggcgaatccacgtgactcaggaggactttgaaatggctgtggcaaaggtgatgaagaaggatagcgactcgaacatgtctattaggaaactctggaagtaaataagtcaaacggaaagggttggaaacaaggagcacgattgaccagaatcgaggattacacgcgtcctgtacttgcaaggcttatggcgtgaaatttcgcttgcgaaggaataaaatgacgagcaggggacaggtataatttacgaaatcggttaatttagtaatgttatagcccacacactttgtcacgagaccgcgagtagactttggaaaaaaacatactcatcatttaaagtcctatatctctggacgactcgtcatcccgcaatcaacttctatccctatgcccctattcgtcgaatatgtggagagggtgagcctcagtgttgaagacctgacgcgacagatccacctcccccggctctgtctcttggatgaggtacaggtacttgagggtctccgccagaaagaatgactccatgtcgtcctcctgagtcaccagccccatgtccttcgccttccccgactgctcggcctgcgacgctccttccccgcctacatcggaaggcttcctctccgccccccgcaaagccacgctccgcctgcccga

SEQ ID NO: 4935 - DNA, 700 bp, Nannochloropsis_gaditana
tcgcaccgagaagagcctccaggagtatttctggaggtggtagtgccgctgctcacatcccttcctcgattcctatcttctttcacgcccccactggctttgcctccgcccccttttccacttttgggggaggagctctttcgcacgcgggttggggatgctcccgactgctgctgcttgtgcttaggtcgcaacgtcccttttcccacaaatcctgggcttgcgggcgaggagctcagcgccgaccccggacgatcatctcctattccaccgagactccgggacccagttaaagacatctcactcaaggacgttgactgttaaaagaggaaacggtaaaattaggggagcatactacagagaggaggggaaaactttcttaccagttcatcgtcccccatcttgttgtcaagcttcaccaccactatgacctgtgccgcatgttttattgtggattgatcggaaaccgtaagaggaaaaagggatgtgtttttaatctttcactccagctgtccgatggtgcgagtggcgtgcctgtgctcaaggcttgcgtcgcttccactcggcgacccgtcacatacaggtcaggacaatactcgcatcactcatcaaatgcacttgaaaaatcgcatgctcctcaaggtgacgacgcgaccggcattcttgaggggagaagctgaaaaagacaattgttgccatg

SEQ ID NO: 4936 - DNA, 700 bp, Nannochloropsis_gaditana
atttgctttatcggacctttgggtttgtgaaagaaaattgtgatggccagtaaattctagtgtaggagcgcacagtctacagatacccgagcaccagtctgagtggcccaagggcggcggacttcatctctgatatttctcataaatatgtcgttctataccattcctttcctagctttgaagtcgtttctacacagagttgcagaaaggcctagggtgccatcccacatggtttccagacatcaatcgcagcgccagacaagaacgccgcccttgtcaatcattgcggtctttttgattaacttccatcacataattccgactgtagaattgcggtccatgagagtcaacggcatgtcgtcaatacctcattttcttcataagcattattcgccaattcacattggtagagtcattctccgtcacccggccgtttcaaagcgctatgcgtcaagcattactatgatgaagcaggagcacatgcacgctactcgaggggaaggacatgacctattattgcgccttggcaacccccgatggatagctgcgccgatggtacagcagtcggatttggccttcaggacgttggttagacgctatggtatgaaggtcttattatccattcatgtcgcgtgcttataaaacgaagcacgattgcattatgttgtaattatctaacgttctcccactcgtaacaggc

SEQ ID NO: 4937 - DNA, 700 bp, Nannochloropsis_gaditana
tcaatcacttcaacttcatctgtcctgcgacggatccgttcctcctcacaagtaaccggagctgtcagaaaaccccttttccaacacttgcgccagcatagaagcctcacatcctctgttgaaatgataccttattgtgacatgggggcggcaattcgtcggtctcaagcggcatcaataaataaatgttcaagctgacagtcgtcgccaacgagaccactgtccttgacactaggcccgcgacattttcagagcgacttaggctgtctcttctacatgcgcggggtcctctcgaatatgaccgtgtgtgacggatcttattcttgaaagagacactgttcatttgccatctcagctttataaggctcataataaatgacgcctgtgctttgaggtgtatcggaacagaacagggcgatatctcgacaaataccttctgcttacttgaagtcaaaactgtatagtccagccgcgcaatgtattgatgttatgcgtgtgctttagcgtctgcaacaagccacgatcgggcaattagcacatagatactttggtgtcatgcgacccgtacataaaagatctccacttttatctgtttccattatatctgtcaaacttctacctctcaatttgatattgattgtctgaactgcttttacagcaagacacaaatagataccactcgtggtcacttataagcatg

SEQ ID NO: 4938 - DNA, 700 bp, Nannochloropsis_gaditana
cagcgcgtcgagccggcagtcaggatgtgtagtaggccttgtctaacgtcacccgctccgagacaaagccgctgccctgttttgatttcttcgccccagtccacttcggcgcgtactactaaaccatactttttgcattcttccgtatcttgtactgaaagttgacctttgcgtactttcttcctgagctttttaagtttacggcggctcgtcttgtcgagccctccatcggacgtgccttcattttcccgggtctccccttcaccattttctttgttcacgtttacgttatgggcttgaagtttcgggagaggcctttttctggccgcgacggcgtcagaatccaggagtggttgggaggtcatggcccctcgttcaggaaggtggggatggtgacgaatgcgtgaaggagaaggtccgcctgtcgcgtgcaggtgagctttcctgatgcgagtaccctgtgatggatttgaagggcatcaaatcgcatctctaaaaagccaggctacgtacgagagtccacctttccgaaggctagcattgccggcacttggacgggtatcgctgcttcagcccgcctcaggctccaccagctatcgctccgagacccgtcggggccgccacgaatcccgggccaagaccttacgccaaattgtgccacaacttttcttacaggggtgctggagaacgggtcaggatg

SEQ ID NO: 4939 - DNA, 700 bp, Nannochloropsis_gaditana
tccatcacctctgacccgtgccagtgctacagttcattgtcaacgtgagtggttattgtggatatcgcaatcttcccagccttggcgcgagaatcggccaaaaaataccttaaatcaggtgctgcgcaaatatacaacaaacgaggattgtgcgcagctcaatttttcttgcttccgggagacggcctcgacaggcaaattggtgaacgcttactttctgagatagcctattggatcggtcttgtgtctaatctatgacgctgtcaacgccatgcctagctcctcctaaaaaagtcattgagttcgttgcgcatgctgggcaggtgaatgccgtaacattggaccgccaaatgcattcgctagtcgcaacggggggagatgacaatatcattaatgtttggaggatagacaatgctgctaacttggcgagcttaaaaggtgacagttcccccgtcaattgcctcgcttcggatcccatctcgctgcgatttgtcgcaggaggctatgagagtggtgccatcaaaatttttgatgtcgccagtggaaaggtatcgcgctctctcccaggtcatgcagaaggggttacatgcattaactatgacactggagctggcatgcttatttcaggctctttagacacatcctttaaagtgtgggatatgcggaccaaaaaatgcgcaatgcatcacaaaggccatca

SEQ ID NO: 4940 - DNA, 700 bp, Nannochloropsis_gaditana
aatccgcttgatcaatttcgtccctggtcgcttcctcttcacccaccaggccgtaatacgaagccagcatgttcatggtatttccatcgtctccactttctttttgctggagctgcgggcgggtacttcgtctagtcgacttgacaacgagatcgccgtcctcccacgtctcttgatgaaagcattcgttttcgtcaaaatgctcctcctctaggtccagcccagaattcgacaccatacgatcgtacaatctggcagccgccttcgcgcttgcggtcacgaggaggataaagggaaaatactgctgtaagaaagagtgtcgtcacggcactgggggttaagacacgcgacgggcgataatagggatctgaccacgagccagatgatttatccacatgactcctgaataggataggcgctcgtcaatcagccaaaccttaatgaggagatgtctgtcttatgttcaaggtccgaggcgtggaaagagcgcgcagtacaggactaaagggggggggttcccccggcgctgaccgtttcagggcggggccgacatcgggcaatgcccgcgtgactccgattggaaggactcatttgctaacacgccaacaccactatccgcctcaggagcaacgggtagcacggattttggaagggtacgtagactcctctccgtgcagagggattgctgggaagtatcatg

SEQ ID NO: 4941 - DNA, 700 bp, Nannochloropsis_gaditana
ataggtgttagtggcgtccccacagtagatttccacgtgatgaaagctcaagactttgaaacggtctgatttagggttctgtcgtacaaacttggccgctcccacgagttcagtacgagtgatgtggcccctctcgtccgatgaggttgccgtgctgaacgtcagagccgttggggtacgttgccgtacgagctggctatgatgattttgtttagccgcaaaaacgcgtgatttgcttacaatcgggggcacatgtgacaggtacgagagggctggcccggcaagaaggaggaacaacgtcagaggaagcgcggcgctggctgcagaggataagggcatgaccagatggggtcttcttttggccatcgggatgtgatatgtgtgctgcagcacctacaattgaaagcgcaggatgatgagatggtgtgacaaccacagtagcaacaaatacgggcatatcaatgggcaatcgagccgcccggacaggcatccactgggaggaggttggtcagagaatccaaatgcggaggaaagttaccgttctcgtcgtctgtattttaaagtcgtgtcgttgtcttgtttgagtttgttgtggtttgatattgatcaacgataggcgactcctcacacacttccttttttgatgtcgatgttcggcagggtttacgctcactttcccagttagggtcctagaagcatg

SEQ ID NO: 4942 - DNA, 700 bp, Nannochloropsis_gaditana
atactttcaaaaatatacccgaagttgtgaaacttttctttgcgctgaccgggattcgaaccaggaaggttatgagagctccttgagagcaggcaaactatcctccaaacccgggcctcctccttacagcgaatcgaactcaaggtgagccgagcgatggaagggagaaatccttatggtacgatgagcatcatatcgcttatccgacatgcaacctaccgtcaacccctagacaatcagcgctttaacgaaagcatctggtgaatctcacttcatataattcccacacacaccactttcacttgcgcatacacatgctcaaaaattatggatgcggccgtttcaaaatgcccattgctatgattataagtttcaatagtcgcacgacaaaccaagaccgcaccttgaccttttacaagctgggacggacacacgggggccaagaattgccccggccacctcccgcccccgtcgctccttgcttgtttcctccacacgcacgcgtatactaccttgatcgctctcctttcacagcacatgccatatcccatcacgaatcacctcacagtcagttcttacaatcgcaggcgagtggcaagcatagtccatgcttgttcgccgtgcggtgttcagactcacaaaccagcatccttgccgccgcgcagtccttctttcagtcctccttcccgctgtactcatg

SEQ ID NO: 4943 - DNA, 700 bp, Nannochloropsis_gaditana
aacacaacacgccaacttataatggctactatctgccacaccttataaaacatggtaacagagcagccgtgaaaatttaatatctatatcatgcgaacaagaaaaattatggcgagaaagtaaacctgtgttgtgccctcgtgtggaattcaatgaaagaaaacagctgcaaagtccccaatgttcatatcgatgcagaaggtgcagtgcgcccgatgagttttgcgtcccttttgatctgagtcctacccttgttgagcttatatccgaactacaagctatccgtagtattcttttctccccctatggacaacggcatttccttgaacctatcacctgcgaggcagatactattttagaaaaagtttctaagcttcagtacccggaaaatggcaaaatgagtggatgtctgccttttgattcctggaaggtgattacggcgtagttttctttcaactggagaattatatgggatgaaatgtcatcaactgtggaataaaagatgtatgattccattttaatgcgtaataaatttgcacttatacgaaatgttgccattttggcgcgaaggaacttgcttccttgtacgcctcgtttcctgttagtgctgtcagctaaccggccgatggatatttcccctactcttacacttctgctgattaaataaattcttacggccatcaactcaactgatgtgcag

SEQ ID NO: 4944 - DNA, 700 bp, Nannochloropsis_gaditana
gcgcctccagcccttgttcccgatccccgtgtccacagcatacctcttctacaatacgccgatatgcttccagaagatttgtgagtcgctttcgctccaaagccgcccagcgatcctggtccgggagatgccataaggcatcaagcaccagagctttggaggaaccggacttggcctgccgcagggcctccacaagcagggacgtcgccgtgtggcctacgagcggatccgccgattgcagcaaggtaatcagacaaagtacctcgcgtttctcttgattttcatctattgaagataatgcggaggggaataggcgggctagccatcgcaagtctgcaacgttgcgagagtccattgccttggagcataatgcagctctaagtcacgacgaagtggagtccgcgggtagcgcagagtgttctaaaatatgccttaactgtagatacacacgtgtgcgcataatcaggggttgcacgtgcccgcaaaggccctgtcggatgcttctcagtgagctttggccagcgtacgctctgtgtgccgcggagtgtgccatcgcccgccgccacaagcgagcggccctcgccttccattcctttaccaccgcgcgcttgcggaatgctttccctgcttatacccaacccttcgtggtactcaactgctacctacgacgaaaataaagttcttggtagcgcatgggatg

SEQ ID NO: 4945 - DNA, 700 bp, Nannochloropsis_gaditana
cacaaatcccttgaccccgacgacaccgagatatttccattcgggggggcgtactccgggtggtacaagttgaaggaacaaggcgggcgaaaggacatgaagcacgaggagcgggaggtgcagctcgcatttcagcgcaattccgctgggggctacaacgtggaagggctaggccgaaaccagtacgggcagtacaagatcaaagggcttttgacggaggtgaagacagacacggcattgtgcgagatcttccgcatctaccaacccgtggcggcgcctccccctcagcctcgtgccccgcccgccccccccatccactcctcagcggcggcggcggcgggaagacgatcgtccaattcaaagagcgtgccatttccacatacagggacagatgcgagcaaatctcaaccaccaccggcgcaacgaccgggtgtgccgactgcccgcgctggctctggaagtgccgctccctacgcgcccatgggagactcctcccatggcttggggtcggcgagaggcggagctggggagcgcgcggctgccgctaagaaaagagcttcgtctgggagcatgggtggtggtggaggtggggggggggggggggttgtcgcgcaaatcgacaggcggggcgggggcaggagggaggggtgttggtgcgatgggcggaaacggagcgaaccgggtcatctcggagaaaatg

SEQ ID NO: 4946 - DNA, 700 bp, Nannochloropsis_gaditana
caaggtgctgaggatctgcttgttttgattgtcacgttgtgacatcacgctattgaagcccggacaggccacccctcagactcacaactcaatattctgctattgtttgcacttcttgccgtgcacctctagcgacaagtttgaggtgaggcaaaaaagatatttatctttaagcgggtcatcatggacatgcagaatgggataaggctcacatcccccttgctctcctcccctcttcgtccccgtcggcgaggcttttaggatgagctcccgagagactcgaaggattgcggcgaccacttacgttgctgtccaaaaaggtttacgaggcgctggcaaccattcggcatttttttaatagggcagcacggcgccgctgctcaaatcgtgcaatgtgagctactgcgttgttgttcgagtaaggacaggaggctgtatctttttctttagctcggatattgttgagtacacttatgtacactctgtgcgtgttcaattcaatcgcttttccccccatacttttagtcttcatgttttgatttgtttacttacgtccaactttgaacgttcaaatacattcaatagaaacggggcttttagttcgaggccagcaggcaagcccgggacgcgcggcgccttatgaaaggggaaaaagagcagcgagcgagtaagaacccaccgggacttctcaccaacaatg

SEQ ID NO: 4947 - DNA, 700 bp, Nannochloropsis_gaditana
ggagggagaaagtgttcgggccgcccgcggggatcaacccgtagtggaggccctcttgaggcaccccttcacccattccgtccctcccgtacctcaaattcgtcgtcttcctcaagaacatccagcaatggagccgcgtcatccttggcagcaaccttaggctcagtggttgccatagttgcggaaaagggaatcgcgtcgctttgtttgaaggagagggaaaagaagtacgaagtcagtctgggagatggcactcgacgagcccactctgatatggccgtacacaagtgaagtataggaacacgttgcaattgattgccgacgatgaatcgttttgagtgcggggaatgcggtgcttggaagtaggggtgtggccgggcctggtttagagttcgtcgctccctgactgaagccgacgtggagacagcctcaggccgtccacagccaagtccttccatttacaatcatgccacactgcggcgcatgcaacgggaagtttgactcaattctgagggttggaacgggaaaccaggcaggccgaagcgtccatgcgtttttgggtctcctggagtactacttcccaaaaatgacctcttcctcctcagtgaataatcagccctctctctctcatccatcccaccgacatcaaatttttctccaggttttcccctcctcggcacatcctgcctcaataattatg

SEQ ID NO: 4948 - DNA, 700 bp, Nannochloropsis_gaditana
tatccgtcccagcaggttgggaagaggggctcgaggaggcagcggtgacgccagcattcctaactgcagcccaagcctcacgcttatgcttcgcgggagggcccttgacgagtagggtcgcctcgacgacagggcctgtcaattggcttctgcgacgattgctattagacgtgacaggagggtctttacccctcggaaagcagcttcctgttggcatgtttaggggacacgtaggcaaatggcaaggtccaacgcgaagggggaagatactcctatgagagagcttaaatggcccacgtacgctatcgtctgttcgagtggaatgtcaacggtgatgaaaatcagcgttaattgtgttagaacgcatcattacttccaggagatgccggagcgggagtgggccagaaagagttgcctaattccctgctccctccccgccactccgggtggtcaccgatgctcgcttgttcctcctcgctctgtgcgcctgccacctgcttgtgcccaagcatcctttaaaggcaggacacattgcaatgcatatgattcaggcccgcaagcatatcgtacgcagagctcagcccttcctccctggagggaagtattttgggtatcatacatctcaaataactccagactgtccctgcccctatgatacaacctcctcacactcaacaatccctacgacgaattctttcag

SEQ ID NO: 4949 - DNA, 700 bp, Nannochloropsis_gaditana
taaccggtcactgaggcattcatgagcattgaagagatcgaatgtctccacaacaactcggagcttgtgtcgggcacgtatggctcgcttgtattcgtatgcgttggcttatttgtgacgtgaagacgacgtgcgaatcgagggtaccaattgcatcacacgcaaccagccatgatgagccatcgccagcaacctcctcgcccggacaggcaaggccagcgccgattgtttgctgtgtgactctctcgagggcttcaaacgctcaaagaaataagtgaaggcgattaatagcacgcacttgtgggaatagcgccgtggtgagagtcgcgcggtggtcaactagcatgtcgtaattggaatgttttcctcatacggggaaagtatcctttgatccgccattcacgtctgtctttttacttcattcatatccctgtatgcatttgtccattccttttcacaaggcgcgttgattctatcaggctagtagattaaaggactctagttggtcactcttttgactgcgtccagccatgacctctgggcgcgagttcaaatctcatcgggcaaaactaccaaatttcgagcctggcaagtctctttatgaccttggtactttcagtggacgcctcaaacacttcctgcgtgttctggaccccaggacgctttttatttcagcgcaatatctaaaaagatgtgagaa

SEQ ID NO: 4950 - DNA, 700 bp, Nannochloropsis_gaditana
acctcgtcacgtaccagcagtttagagcctgattgacggaggggaagcgctcatccttagcaggcactggcaagtccgtgacttcgagagtggacatgagaataccttaaatgcggtcctgtgaaattggtgagtgcgtgggaatcagagatatgtggcactgtccaaagaggaacctccgccaagaccagaccaagagtagtgaacagtcccatcgaatctaagggcgccctcacgcgcttcgacgtgttagctaggatggcaaccaccgataacgatatcggtgcatcatgtttagaccatcggaggaagggcacccgataccgtggcttaaagacgggggcagtcttccatgtggcatgtagggagtccccaatctggctaaccctctttccgtcctcgatcgctcatcacccagcagacaaagcagcaaaaaaaggtttccgagaaagcgtagaacaaccttcatgcatgcgttggcttgttatttttcctttcttcctcattttgcccgcagcaactatcgttctagacatggacaacccgcgcctatcagacgcaactctatgcatggcctcacctgcccagtgttcaaccttttctcccggccctcgaagataaccagacaggtcgaggtttttggtgcaacatcgcgttgtatcactttctggacgaaacacctgaagttgacggcgcgatg

SEQ ID NO: 4951 - DNA, 700 bp, Nannochloropsis_gaditana
gagataaacacgatttgccaagcagacatggcgagacactgcacctgcctgagtttgcactttttcccataagacacccggtctgccgaggatgaaaaactcattatatatgttaggcgtattcaccgcgatttatacacaatcagcagtcatttgaggtgcacaccccaaacatttcataacaaggcggcatcgtgccgagaaaggctgcaattcaacacccgccaggcaaaaaccgtttccgaaccgttacagggtcgggggccgtcggcgcgtcggggcataagaaggcggaaagaacgcggaaaattgcgcgaagagcacctaccagggggcagaggccaattctaggtgtgcggcaaatggatgcgggactacagtgtagtagtcggatggtgtggggttttcttgctacgagggctccggcggaggactgcttgcgtgctcgtatctgtcatggagagatcgtgtcgggtcaccacggactgtgggttggatgatggcgcacgaacgagagcgccgctgtatgtatagtacgtcttcaaatggatatgcacgcttacaggccctttacttccatttcacctacaagatgatgtgttagcttgatcttggcagagtgtgagtgagctttgattgcttggcagtgtgcatctacatctcttgcctttccttccacaacatgagcagggacatcatg

SEQ ID NO: 4952 - DNA, 700 bp, Nannochloropsis_gaditana
ttatctgtagatgtaagtgtacatttcgcaagcctccttcatacaatgtaaaccaaagaaacgcgtgaccacgcccgtcgaaacgagggatgccctctgcctgtcgtatgggccgtcccgctagcacaggctgcggtccagcgagcaagatgaagaggcgatcaaagcggacgcgctgccccactctcgagtgaaatggacatgtcctggccttggtccttgtggtcgttttcccctccaggacttcttgagtgcagaatgcgtgtgtagttgtattctggaagttcatgaacacggcaccgagccagtttgtcatgtcagttgtcatgtgccgtgattagcccgaaagcagtggaggcgttgccaagatacctcttcactctggcggcgcgatgcacgggcacatgtagccgggtccgaagttttgcctctacgaaacatattatctctctcttaaagtgtcgagaagttcatctcaatctcgaataaatggcgtctgtaatgcgaaagctaggagatggttggaaatcgaggcgactgcgccgttcaagagcagagccatggtcccggtccccgcccgcttggtgtatttgtcctcatgtgttgacgaggcccaccatgaagctctcttattccttcttgtgctataaacttgtttttacaggcatccttcctcctcatcttcaccgtttaagccatg

SEQ ID NO: 4953 - DNA, 700 bp, Nannochloropsis_gaditana
cgccgttactcctcctaccagcggaaagctacacaggtgtgcgtcaaatttttcggctccaacgacatcggatggattcaccctgcctcactcgtcaacttcgacgaggggctgcgcaggagttttaacacaaactccaaggtcacgaagaacgtgaaatttgtggcgggagtggaagaggccatccgcctctggaaagagagacatgagccgcagttcccgggcgttacctcgcctacctggcctcacgcccccccacacctcggctggcggggcgcccccaccacacacccgggctcaagctgctgccgttgctgcggtcaccggaggagcgtgtgcaaacgggattgaggcgcatgcatccgctctaggggcagtctggacacacggactcccagagagttgtcttggctgcacttttccacgcggggaggaacctggctttctcctctgtcggtcttgcggatcaggataccattctaggtgcgcttcgatggagagaacgggggccgctcgtggagtagaggctgataaggagggaagtcaggccaaagccacgtctccacggtgccggctttgcagcgatggggggtcaatgatcttggcaccagcgccactgcccttccgccaagcttggtccccgatgccagggacggctggcagtgcagacagcgggatgcagcggcaccagtctcacatg

SEQ ID NO: 4954 - DNA, 700 bp, Nannochloropsis_gaditana
aggagaagaaggaggggagcaccacaagttgttggcggcgcggtgtggacgaagtggacgagaagcacgggactggggaaggagcagggagcgggtagaggagcgtggggatagtacatgaaagggaggagcaccttgtgcgcccaagctgaaccctgactccttttgaacaacacaaagcaagaaacaacaaaccatgtagcacttacaaggcatatacccatcaaagaaggcttcgtcaaggaagagaaagctggctgaagtgttgaaataaaagacagtaacttggaaagaaatacagtactggcacatggtactacgcgggcggagcgagacgttgatgccacaggtgcagcactttttgacaagacgcatatcagccagaccaattttaagccggagactgctggcgactgtttctgggccccggcctctgccagcgacgcttttctccagatacgtagtggagccccgaaaagtgactattgttggagcacctctcgccgatggacagccgcttttgggcgtcgatcgcggtcccacttttattcgtaagcgtggcttggtgcaacgacttgaaagggatgcctggagggtggaagatcttggcgacttggattttgagatgcggagcggccttgggcgacaggaagatttcgcggagggagctgcacatggttccacgaaacgcgccaaaatg

SEQ ID NO: 4955 - DNA, 700 bp, Nannochloropsis_gaditana
accgctcctcacgagttctacgtgtgcgcctcttgctggcgccttttgatgatattcaatgcgacaatgggtggtatgggtcatgtggagcatgggaaatgcgaggttgtgatcgtttgtggtgtgaagatgttggaggagacaagttggagctttgaagctcgtctgttatccacgcttgagctcatccacgccacctacaagaataacgctcgcgaaaaagggtggttggcagcaaatttctcgtattttagagacagaccccccagtcgattccaaagagtgaagacgccggcacagcaaaacccagacgtcttcattaatgccttttgtgtggcttcaaaactcgtcagaactgctttgaaattgtgtgattcaatgccattcagtaggtgcccgaagaattggcggtatctgatggcgaagtctcgtgaagcgtggtgcactttgcctgtgcatgtggctgactcaaccttccgagggctgtgttttgcctcccgccaatgcttggaggtcaatcgctttacactgtatatttgaccaactcgtttgcatctcaagcacttcctttcatttacgccacgacttttgtacattggacaggcaagtggatgatcagcgcggcgagaggcggactctaggcgattaggggttgcgcggcaaagcataggatctgaaagatcagcagggagagagaatg

SEQ ID NO: 4956 - DNA, 700 bp, Nannochloropsis_gaditana
tcgatggatttttgtcgccctcctgtcgtggacatggtgggctttgcccttctcgccttgactgcctacactgtgtccctgattctccgcacccggccttcccgggtcttcttcctggaataatgacgagtggataagtatgtggatgtaaatcagtattcatgtttgcacataacgccatgcttgaatcaaagccgcatcgtcgcattgcgcaggaccgtggggcgctaggctcccgcttgtagggggcgaagaggcagcaagacgctggcggcgaggtcgacgacgcagtggcgctcgctcttgtagtcggcggggagacaaggaaacctctttttcggcacaaaacatcacacttcttgtgaatgatatgtcacatttatcatggatttacaatgcagccgtcgcgccccaaacaccgccatctccggctagtctggctagttcacgctctgtttcccggtcaaggaggtgcgccgcatggagggcaacgatttgaccacgggactacactttcctatcttcgacattttccatagcatattgaatccactgtcaaaccagcttaaaggggaaagggtagctgcatcccaggactcggaggaacgctgtgttagtgcgtgctgctgaaaggtgggttcctaggcgagacagacgataaggtggaggcccttgcctccgttaatgaaagcctagaatg

SEQ ID NO: 4957 - DNA, 700 bp, Nannochloropsis_gaditana
ggtctaagtcgtgatgaaacaggaagaaacagatggaaagacagtaaataatcaacataaaattgcatacgctgtgcttttccgaaatagtgtgataaagaggtgaacatgtttcttggcgaagaagaaagagagagagaagaggtaaggggaaagaaggaatggcgggaatggatggaactcacgtaccgatccattctgtttgcctgtctacggtgccatctgccgcctcgtaatacgccgcagcgtgatgttgaattgcgagctcgatggcgagacgcttgttgtcatgagacggcattgccttgaccttggaacaaattgggagaaggaagaggcgatagatgcgccgaaggccaggccggggacgtaaagaataaatctgccgtagtttggaaaggatgagtggacgatagcgtgatggaagctccacacgaccatcatttcgacacatttcccctatgacaatgcactcgatgtgagtctgaggtcgggctcagcgggggggagtcacacgatgaggtcaatcgccggaacccctgccgccctcgccacccacccgccgttctctacttttggcgtcttgcactgccgaaattgacaccgtgctgcgcatgggagctgatgccatagtgtcgcgttactaattgaaagagatttgcattgaacatttctcacctactgccacccgtgatgacag

SEQ ID NO: 4958 - DNA, 700 bp, Nannochloropsis_gaditana
ccgtcaagacgaatggcaacaaactgaaagcaatttgctgcactccgacacgacgtgtcgccatttcacttcttctctccgcatcgagtgcactgcatgatcgtgaaggaggtcccgtccgcagcaggaaggccagcgtggccgtaccaatcagtcctaccatgagcaggaccaacagaaacgaacgacgacctaatgccaaggataaagggtgttcagtatgacaatgatgcagacggtaaagcacctgggccttggaaaacaggatgcacgggaggatgtggtggcgaccgttggtgccagaccctgccattacctggaaacatgatgactccaaaagcgtggctctgatccccgaaattaggctctgtatgcgcggtggcgtacatatgatcagcaccatcggtatagagtgccgtgcgtgcgcaggcgtgcacttgtccatcacccgtgccccggcttcgacgacctcatcgccttcgagaggaggctcgtatcgctttgccgctacctctaaacctcgtttagcggggagccgcccgacaaggacactagcttttggcactactcacgctcacaatattttcaaccctccgaaaccccacagaagacacgaagaaggccgcgcttgcaaggggaatgtttacacgcacaaaggactgatccaaatcagtgaacagaaaataatccgggcgccatg

SEQ ID NO: 4959 - DNA, 700 bp, Nannochloropsis_gaditana
cgcctctatcggtactcatgctgtaagcttacggtccgtggccggtgttcgacttattgtagcagaattctttttttttgctgatgaaatgcaaggcctttggccgtcctagcaatgtctgttttgatgagtaacggagtgagaattgatactatctcgtacgtatgatatcgtactgttcgccaggctgccgggcatgtcacggcatctcaattccaagacaatgaaaaagaaacacgcgagtatcaccaactaagtcgtacagttccacacgaggcaaatagcccaaaaatcagttccgaagaagtgcaacctgggaacactggttgaattttcttgccaggcgggcgagcacgaggcccccatcttgagcggcgaggccgccgtgaccagggtcgagggcgataatgctaatggcactgcggtcacaggtcgagcgggtgtccggcattttgcaaagattcctctgaaaaacgatgcattagtatggtgaatggcacgttttgggcatgtacgggagcgtccttaccgtagaggtggtggaagtgcgggtccgatcgcgtatgccgaaaagcaagcttgcctatggcctcgtccgccttatgaccagggtcgattagggcaagattctcccgacagtctgccccttctcgagttcttcgccctcattgcttgattcttacaccccgcgcacccaggt

SEQ ID NO: 4960 - DNA, 700 bp, Nannochloropsis_gaditana
ggcagctttacccctcgtagaaatttgtcctcaagtcttttcagccttgatatttgggctttctatcatatcactcagtgacaggcccagctcaagaagccagcaacccggagccccggtctgtcagaccgggtcgatccctctgccttttccatgcgctttacgacactgaacttggtaaagtttggaggcgcaacagtatgcactataaatatgtttcgaagcaggtgagcaaaaaaggcattgatggcgtggaaattgagtcctaggctcgactcatcggcgcctcacgactccgttccggctacgcagccttgcattctctcccaagatccacgtggaaacccgccatgtagcccccacacttcccatcaaaccctggcctacgcgttggcaccaatctttgagaaaagagcggagacaaagatggttctcttcgcgtggaatagcgttgctgtcagtcgaggcagcagctgaagaggaatccttggctgctacgacggcagtgccctccgaagatgctgcgcccgtagcccggggcaaaaagaaaaatacactacctgacatcgcaccttactctacaggacatgaaggtaaaaagtcagggggtgccaaatcaccgagatcaaaaaaagctgcactccccccattcatccccaaccctcgctggcgcgatcagctcgaaattatccgtgagatg

SEQ ID NO: 4961 - DNA, 700 bp, Nannochloropsis_gaditana
cgcttggctcgcctcgcaccctgctgactcaaggggtcgcgctccctccctctctatgtctctctcgcctgggtctggcaccttttcgggtcacatctgtctctgactcgcacaccagtgttctcgctttatcgttgtgctaggttttatctcctccgttcgcgttcgcgaggcagccgccgcgtgcctcaagccgaggcgggtgctgtggggcatacgtggtggttttcggtcactgaagggctcgtgaatcagtgaattcatgggaaactcactttcaccttgcccaaaagagtgctctgggtgttggtgcttcaggcctatccgtggacgtctgagccaggcccaacacctgactaccctaccctccactacccctgcttctcccctttgagctgccgggtccctatgagatgatagattggtccatcctacgtgttagcgcgcactattagactctatgtatctcttccgctcgtgtttgggcgctgaaacccgcctaggatatgacaagcgaaattctgtgacggaagtcctgacgtccaggagacgcacgctcacgagtcatgaatgtcaaggtcagcctgcacgtagatgtcctcaccatcccttcactctctctcatacataacctcgcagatcatcacctgggatcgtcatcgacagaaaccctccgaagtaaagcactcaaaaaaagatg

SEQ ID NO: 4962 - DNA, 393 bp, Nannochloropsis_gaditana
acgttcccttacgcgcgaaggggagcagggagaaaaatgacaagctattaatggcacacacggtgcagaatcgtgaagttttgattcgatgtgcctttttgggttgtgagaggttgtctcacgtggccatgttgtttacggggggtaaggaggcctttcgatcatcgtaggaggccgggcagcttcaactctcttcatgtccgcacgctctaggcgaactaattccagcggacttccacaggaaaaattagttgtgagtactgcgtttggctccatatactcttgtgggtcggttgaggtggaagaggggcggaaagcggtcgaggtgaggttcttggtggcgcaaatttcttcgacgacgcatcagcaaagaacgagatcaggtccattatg

SEQ ID NO: 4963 - DNA, 700 bp, Nannochloropsis_gaditana
tggcgcctttccgagagggaaaacattgttctgcgcttgatcttgtgagttgctcgcagcgcgtgattgcttttcacccgtgcttggactgtttccgaggaggccacctcctacagtaggtgatggttgcgacacgcccgcaccatcgcctccgccgcagcggacaggaaatgacataccttctgcccacgcagaacgattttaggtctgtgcttttttaattcggcatgggttccaggatgtatgtgtgagggaagaatcagggctctggtctcgcctccctctgtcttggcagtgcttgcttggcgacagctgaggcctcctcgcctccggtcgctcaagtcgcgtaaaatggtcactgggagaaaggtgctaaatatcgggaaagcatatgtcaaatgaacgagtcacaggcttgtattacctgtggtaatactgtagtcagacctgtacatatcatcgacataatcgcgaggtatacgtagcggacagctttactatcatcgtggaacaggcatcgagaggagaaggaagtccgaatacatcaatgtatgttcactggtccctgaatgcactccatatatttggcggcaatctaccgcaacgtgtcactcacacgaatctttacctcgggcaattagctgcaaggcgatcttcgcaaagtgacgcgcgtccggggagaggaggcaaatgcgaccga

SEQ ID NO: 4964 - DNA, 700 bp, Nannochloropsis_gaditana
cggtcccatagtctctttgcctagtccttggggctcttcaagtggcgtggcactgacgccatgtctcaggggcagcaatgggcccacaggggatggaagataagccaaaaaccccgacttcacctcctggacatcgtcctcttcatcttcttgccgacaagtagggtcatgtgcttttcgcttgtgtgttacccctcgtgacgacgaacgacccgccagcaaagaccaggctacagctgcacctaaaaggaagacgaagagcagctcgagaggcttggcggaggaccctggtgacatgctgaacaggattcatagaagtgttaagcattcaattagtaagttacatgtagcgttatgtccggcctgcgcccaacgtgctgcgccttgcggccatactaaatttgacatgccctccgagcatgagggcaagcggcgaacagcaacaagcgagcactcgcgcgtcgccctgtcacatgtcgtagcgttcccacatggaggcccttgaagcaaaagcatgtgttttcctacccgtgaccatcctaaggcaaggccagtgatttggtgtgttgcgcccgtattcgtgtgtctacccaccctgattccagcttttgttcatctcccggtatgttatcctttcagctgaaagcggacgtgtcagcgactgcaacaaaaggaatcgactcgatccatcgcaaatatg

SEQ ID NO: 4965 - DNA, 700 bp, Nannochloropsis_gaditana
gtgctggaccactgccccgttacaaagccaagttcgacttctacttcggccctgactccccgtcgactcgggcggaatcagatttgacgtcggccgactgtttgtcctggagggatgtggcaggcaaccctgccccccagtgcctgcctataggggggcaaagcgtctggggaacgttcggtgggcggacgggcctgcagacgaagccaagtgtgcttcttacaacagccatggacggcctgtctttctttcatgagaggacccctgcggcgaacgaggcagtggcctccatcctcaccctcctcgcggctacaagtgcccttaaaaatgcttcacgcgctggagccttggacctggatgcggcaccctataacctggccgtcgccttcttccaagccgacgaatggggctttgcggggtcgcgccgcttcgcgcgggatatcagccctgggggtgtcgactgcacggccacggttcccgacaacagctcgcgggacgggtccggcgcctgtgtggggccggacggcgtctacccgtccatggccttcaaagacctggcggagaagggtttcgtccacgtgctggctgtcgatcaagtgggggtgctgggcaccggcgggcaagcaggctcgctccctctaaccgccctttacgacaagaccccgccgacggccgtactggacgccatcgacagggccgc

SEQ ID NO: 4966 - DNA, 700 bp, Nannochloropsis_gaditana
cggatttggggaggatgaccaacacgagtatatgaatcttgaggagggggtcgctgtggttatgcccgcaagcatgctaaattctaccgtgctcgagtttttgaaagctcagtccccagcacgcacccgaggagtcatcgtactagaagaatccaaagatatggccgcagatttcgagcgagactccgtttctccggatgtttccacgccacaaggcgatggtacacccagtgcagcctttaccgttggaccagatcacgcctggaacccccggggaagcgggctgctcaatcaaaagcacgacttccccgtcgtcttggcgagcgttgatggcgatagcacaggggttggggccgctcaggtcaaagcatgggcgcaacataacggtggattaggtcgtgctggaccactgccccgttacaaagccaagttcgacttctacttcggccctgactccccgtcgactcgggcggaatcagatttgacgtcggccgactgtttgtcctggagggatgtggcaggcaaccctgccccccagtgcctgcctataggggggcaaagcgtctggggaacgttcggtgggcggacgggcctgcagacgaagccaagtgtgcttcttacaacagccatggacggcctgtctttctttcatgagaggacccctgcggcgaacgaggcagtggcctccatcctcaccctc

SEQ ID NO: 4967 - DNA, 700 bp, Nannochloropsis_gaditana
tgcacggtcgtcttgctttgtagattatggccttggcgtagctctcaacctgtttttcctcaccgatgacaaagactacacttcacagccggcaggtgtcccgtctttacggtcgcacagggggttttaagcgtgattcgagggcagaagagacgagatcgccgctgcctcgctaaattttcacgtttttactgcgacgcccactatgctccctcgagcccgtcaagctagcatcgccctgaccttgctcgtaggggtaacaatcccattcagcgctctcacagagtatgacgggattcatttgggaaaaggtctcctcaaggaggtgactcaggccccctgtgttcggctttttagctcgcaaggcaccgtaggctgccgaactcggagtcgtgagggagcaactgcccctttatactacctcagcggatttggggaggatgaccaacacgagtatatgaatcttgaggagggggtcgctgtggttatgcccgcaagcatgctaaattctaccgtgctcgagtttttgaaagctcagtccccagcacgcacccgaggagtcatcgtactagaagaatccaaagatatggccgcagatttcgagcgagactccgtttctccggatgtttccacgccacaaggcgatggtacacccagtgcagcctttaccgttggaccagatcacgcctggaacccccgg

SEQ ID NO: 4968 - DNA, 700 bp, Nannochloropsis_gaditana
attctgtaagaatggcctggcatgctggaagcgggtcggagtgtaccgcgataatttcaccatcatcgtaacctcccacagtggaccagcgtgcgtagtacgatcacagcacttgttcgcgaatggtatcctgtagtcgcttgatcgagattagaaaagtaccgcatgtacacttcatatcagtatcatgttcttaccaatcaaaggtgaagattggcattgttctcacacgtgaatcctggcatccatactgtacggcacacagcacgatggcgacttttcaccacagctcgtcctgggcaatgagtgctcttttactctgcaaattatggataatctcgatggttgtcgcagaaggtaagagctcgtaggatgaggtcggacttgatggaaaaagaaaaggggttgccgcgaaattgtcgccacaacactcctcagtgactgaagcatctctatataaattttccatgcaatgtgtaacatctcatgcgtcttggcagcaagacgcaaatgtaagccagaagcagtatctgtgacgtgattcttcaaatatgaaagaaaagaaagtgtgcttccatcctcagcgtccgtgggattcatgaaactcaggacacatgccgtaatgatattgaatttccctacatcggtaggtccgtcggaatctagccgtacttcctcattgccatccttcaaggtgatg

SEQ ID NO: 4969 - DNA, 700 bp, Nannochloropsis_gaditana
ccgtcctccgtctcacctcctctccctcaagaaagccgagtgttgtgagagtaaatacagagactgtggtgcctgtaagcgcggcatttatgtgcagtagaattataaagcgagaaaagaaaattaactaatggtttccaagcgggacggctcctataatgcgcctgaggctttgcctgagggagagaaggagtgacgcatattgaaggcttcgacacgcctcttctcttttattgtatccatccccaccacctaaaggacggctaaagcgcctgccgtgactcgagctcgtcctaacgtcaacagaaccacacatttcacgagtctctgcccaagcgggcgtggtgcgggacatgcggggagacgctaccacgtgctgttacctgagaggcctccccgacaatttgcagggggcgggcgagctttttggcttttgctgcctcgcctttttccttgtcgcctctaacctgggtttttccccgagcatgcctctgcccgaattcccatcatcctcgacttacattgaagcgcctgcccaccgggtgcactcaaagtagtgaacttgtgcgaccacggaaccagtacttttcttatctccctcactgacttgcggaattctgttgccggcaacgatacacactagaataacagatagcttcttcgaaattcaaccggcaagatatcccacgcaattggtatg

SEQ ID NO: 4970 - DNA, 700 bp, Nannochloropsis_gaditana
tggactcttaatactgtccattcgcttgaacctttcgtttgcatttttgtcttttctaccatcgcacttctcacgtatcccacacatttataacagtttgtgttgtcttccgtagaactcgtaaatgtaagtttcggaaaaactcttcatcatactgtcaaacctaaagccagaagggctctttactgataagctttgtcgtcttcgacaaatataacatcgcgctcttatattttgtgagaaatctatatagaaacgtctgttatatcgcttatcgaaggcactgtcaggttgtaccacaattatggaaaatttggggctttattttgttaccatgacacttgcttcgggtcgaaaaatatgaaaaggagactgggaggagttttttcgccattttgggggatctgagcattgcaaccctgaaatagttagccaacttaaaagtagcgcgagtcgcgagttcataaggtcagtattgtaccctgccctattttacccgtagcatcctggcggtctggccctcttacggcggaaggggaaggagggcgacagcgacgactcgtcaagcgacctcctgaccccttgctcctaaccctttgctcacacgcggtaacacgcgcaagcagctagatgccttgccgttctgttgatgagaatattcacgactatggttatgttcatatctacagttctcaaaatg

SEQ ID NO: 4971 - DNA, 700 bp, Nannochloropsis_gaditana
tcaggcccccgctccttgcactgacgcgcctgccgtactcacacgacaaccggtcgataggttttccgccgtagtgtacatgccgtctgtgaagacaggaggagatcacgagctttcacggcggaagcgtaaaagtacccttttgacctcgcttcatgctgcaaacctttgctgcttcggttctgccttcttcctcgttgtcatcagtccaacatggtgccatctcaattatttggccaacgctttcgtgccattggtgtacagcgggaaatgtcagctccacaacttcagagccgcttcgtcggcaggcactatggggccccagctttgtgcacgaccccgtcgtgcagcacagcgtgtgggggcgatagcgatgcgcgtgaaattcgacgtaaaaaaggattactatgcccgccttgacatcgacaaatcggcctcactcaacgatattaagcgtgcataccgacggctggccctgcagacacaccccgacgtgaacaaggcccccgacgccgccgagaccttcaagcaggtttgtgaggcctacaaggtgctctcggacgccgaggcccgcaagggatacgacctggccaggggtatgcaagggtcagggtttggcagtgggggcaggcggtggactaacgtgggtgggcggggcacggcctcctcctcttcctcctcctcctcgagagggtggtac

SEQ ID NO: 4972 - DNA, 700 bp, Nannochloropsis_gaditana
tcctccgccccttccctcctcctcctcctcctcctcctcctcctcctcctcctcactctctttctcaccgtccacttccccctctgcttcctcctcctcctcctcactggcggacggatttctttctattacaccattttcttgcatctcctccccgtcagactcctcttcattcaactcttcctcagtccgtctgtttgcggcctcttctttctggtcttttgtccatcgggccatccgggcctcaagctccttgcgctgcgctttgtttgaggccttgaccttgggttgcgtcagcgttttggttactttggctacttttttctggtgctgtcgctgctgctgctgcagctttttatgtttacccatgacgtgcagccctgtgaatgcgcaagtcacgggcatgagaagacgtgaggggtcgcttgagtggccatgggcagtgactcggaggggagaggtcgatccagtgaaaggttgcccacaactttttgatggacaggccagacacagaaaatttaccatagagagtaccacatataccatcgtaacgtgctttgtcttcacaaagtacgctgacattgccaggacaaagggtctgagcgcaggatgtatctttggccgccctcgccgacctcccccctcaggcccccgctccttgcactgacgcgcctgccgtactcacacgacaaccggtcga

SEQ ID NO: 4973 - DNA, 700 bp, Nannochloropsis_gaditana
tcctcctgtctatgacctcccaaccggtcacggccccctccatcctatcctcctctccgtcttttgacctctcagcattcctcttctacacgtatggcgcccctgctccacaactttggccacggttctcaccctcttcctctcctgctgcaattgctgcgactctgtcctcctttctccgctccagcggccttaccaccgcattagtgagcagtccgcaccatgccgtcacaatcctcttggaccgaccggacgagaaaaacgaaatgggacgtagatatgacgcaagacagagtaaggttgtgcatgaaaacacggagggaatggccccgggcacgggttatagtcaggaaagcggcatggagaggcggatggagggggggaggacagctacgtaatgctcatgctgggcatacaccccgaccaagaaatggccgaatcaagctatcgaaagcagagctcggagaggaagagtgctttggctttcctccacgcgtgcctgtcctctctgcgtccgtcatcgttggctagagtggagggcttcgtgcggagcctggagaggcaggtgctggagagtggcgagaaaaattggactgcggtcgtcgaagaggtggtcgagtacgtcgtgcgcgtgtgtcctggaaaccggcgggaaacgcttaaacgggaagcggcgaggcaaagagccaggtaaggaatg

SEQ ID NO: 4974 - DNA, 700 bp, Nannochloropsis_gaditana
ttagaaaattgaaacatatggaattggtaaaggctcaattggctggcgtcagtaatacctctgctcatcacactggatatcgcagttataacgtttgtacgcagagatttctttgtagggaatggtcgcaccttcaaaatcgaggtggtatcggaagtgcgctggagaacatcgaggggcgtgaggggcgcgaggggcgcgaaaggtgcggtacattttcaacatttttagggcttcttagggccagccacatgaggctttttattattttaaaaaggctgaatgaatgagtacttagaggctggggtaaggctcactggtggtccctgaatgttgccctatgcagtcgtgtgacaaaggcgtgaagggtggcaagccaggccagcttctctgggaggggaaccgaggaggagggagatgcggcctggtccgcggcatccgaccccgagcccgcgtgggtgctatgtgtgagtccaagcttgctcgagtcgatagtggggtaaaagggatgcacaccacggctctctcatccgttctggaggaggtgcgagactctagccatgtcgtcgaggggaaggatgtcgcctcgcttgaacaggaggcaagtagatgaccaagtcatcgtaatcatggaccgaattaccatcttgcgtcccgccgcttgtatctcagatctctccatcgtgcaccacagtgcatg

SEQ ID NO: 4975 - DNA, 700 bp, Nannochloropsis_gaditana
agatgccacctgcagtacgtggaaagtgccagcgtatcgggccattttccacaaagaaaattcgaggaagcgcccaagaccctgggttaagggcctttacggcgatatcagtcgtacggctctccgccttccaccctatcacagcaccgaatcagcgtgaatgtacagcttgagaatatcgtctgccttttagaacaaaacagatgacagtaatccacgtgatattgtcagacgttgaaacgtctcggtcacgcttcggcaagcttgtttctgccacgaggcccaaatgaaaagatccttgctgaccgtgacgggagacatccggagaacagaggggcaccgaatcgcagcgcacagcgcctgaatgtatctcttcaatttgtgatacccttacaagtgaagcacacaaagaactttctcgcctctcgcgacacatggaaatgcatagaggacttgtatgtgtgtcgctttattcaaataactggtgtcacccctaaattctagtttcggaccttcgtttattcagtctgtgcctttgagccgcgcggtgcacttacaacacaactcacccgtacatctttgatacatctatcgcagtggactgttttgacgtagtcggagcgcttagggacggcggtggtgtctttgttccgtcagaaataagagcggaagtgccagaaagagccgactggagaacatg

SEQ ID NO: 4976 - DNA, 700 bp, Nannochloropsis_gaditana
attctgtgtcgtgacctggacgcgccacttgctcggaattccggcttgagatcgagacaagtcgccatcaacaggcgcagttattctacaacccatgcaccatgtccaactgagaccttggcaactaaacatgtgaaaatatcccacgtccttcccgttcatggaatcggagtggcggaatcacggggtaggcagatcgttcttgaccaccgggggagggcggcagtgagaaggaagccgtcgctcgagaagaagcttgccgtcttccgctctctcgccccggtcgtgctgctttcttggtttgccttggtgagatctctttcactcgctcatcgcatcttcttaacaattacagctctacttgacccctttcgactgagggcgctcctttagtcatggcaagtcggtacgtatttaatgaagaagacgacgaattctagcgataggcctccatttgctccctgcgtcccgcaatgcccttttctctgggcaatttggtcacaatctttccgacatcgatgtatattcatattcatattcataatatgtatgatattcatgttacgagggaggaccttcttactctgtgaccgcagtgagattccaggatattatgatcctatcaggccgctctgcattatctaggacctggccgttttttttcctccatttgtacagatgtattttgttcactctcatg

SEQ ID NO: 4977 - DNA, 700 bp, Nannochloropsis_gaditana
caagatacgacgaaattgggtcggaggtgctcgagcccaaacgaagccgtacggacagtgctttcctatgagtcaagctccgttggcctactgagtggtaaaagggaggaaagaactcaaagtaccgcacgctagcttcccttagtggaccgtgcagcaggaaaagaaagcacttggaaaatcgaagtggaatcaaaagtgcgagtggatacgtcgcagtgtgaataaactgcaaataaagtgcgattggcatatatacatttataggatgtgttagggtcacagaatgctcctaataggttcctgaaggccaaatgagcaaggactgaaaggcgaggagcgagagagtgcactgctgataggtggcactgctagtaggaccgccgcttgaaagcacggatcgatccgatcggagcccccaagcgcctttgtccttcgtttctgaagagtaaaccttccttacagcttgacttttcaattcatatttgctattacctattgtgtgtgcacatgtgttttcctcgcaacggagagaagacagtatttcaactcaattacaagagctttcggggactcgtcgatcctggatcccaccactctacacccacgcaaaaactcaatgataccttgattaaatcgcaacctaatggattatagacacccattcactcttggcttcattgagatcccctctaggatg

SEQ ID NO: 4978 - DNA, 700 bp, Nannochloropsis_gaditana
gggctgatccgctactctctccctgcgaagaccccagagtcgtctatgctggatgaagatcaatcgatcctggcagcaagggcttttaaaattccttacaaaggcatctcgctgtcaatgcggggaaacccttcaaaggagcggggtccgccccgcctgacaagaaccgggcacatgccggtactagcccggcgtccggcacatccctccctcgtcagcggccccgggctaccggacccctcgctgtcttcccgggcctcgcgaggcggtccctgcggcgtttgccgggggcacacgcgttttcgtgctcccttttactttacgttgggtttcactcagtctgactacgtatgcgcgcgtgtaaaagcggagcagagtggggtggccgggaaggaaaccaagaaggaggaggagagaagaaatcctgacgcggattggtaggaaatggcgtgccgagcgaattctctctccttggacccgccagacattccatccgcgacatttttgttatgatttgtacgaatgaggtggattttccaggcattcttcacttttgtgctctcacgctgaccttctcctctctatcccgtggcagcaggtctgcacttgcaagtaccggtgaaccggaaagtgccatttggctccacatcgacttcagatcaaacttttagcttgcataagctcgagatcgataggcatg

SEQ ID NO: 4979 - DNA, 700 bp, Nannochloropsis_gaditana
aacctgcatggccttgctcagtaccgcttgtcgacctgatgaacgcttagctccctttttcttggtctgctttatgccggcgccggccagtcccatggcttcatcccatgccgaccttttatttgtcgacatgatcaagggacgattttcgcctgccttcaataagataggaaagcagaagtcgattttcaaggagtcggcagtgtatgttcaagctgtgatgaccgcgacgtccttctcttcttctagacctgtgggaacgaagaaatcagcgggacaaaatttacatttggattgaaaatgtcagggtagagtaaatggtagtctataagttttaaagaatgtttgtcgagacttggtctgatatgtattacttcgcaagatggtggcctgggaagaagtgcgatactccgcagcaactgtacggcgattcctctagaacaagaaaagtacgacaaatcccggagcacataacaacagaatcatttttgggctctggaacacacagacgttcattaaagcaatactacacgccgaaaccttaatttgtaacttacgtgcactgcgagctgtctatttattccctcacgttcacacaggccgcttcaccctgggaggccgaacgcatccctttttcgttgacgtttcaagtaggaaagagcattcggcaagtctgcgcgacaggtttccatcgaaaatg

SEQ ID NO: 4980 - DNA, 700 bp, Nannochloropsis_gaditana
cttctcaagcgcgacattgtattgcgaccacaggcgtccaaacatggtgttaggtagaaaggtgacctgtatcaagtacgggaacaggaggaaacgttaattgactcgcgtgtcgaaacccgtgagccacttgcagcatgtctctccacacccgccgggacaacgacgcactgcaggacagtggaaaggttaactaattgtccaatgtgatagggttgttcttgaacaggcaccgcatagtaacgggacagagagaagagatctatctcatgaatggctacacatagtctcagtagggctggacacaaatctgacctcggccattaatgccgcaaaaactgcctgaaatcaaatatcagtcttcaatcatacctaattttcaaagcatagtgtaattctggttcggattatagcccagtcgcgtctgtcagacaggaagggttcacacggatgttaatgccccacgggccacacaataatatgtgatgccagatctatttgactgaagacaacgtgtcggtcatcttgcaaaacaggcatcagcacgcacggagatgtgtgtaccctcgtcgagggggcgaggggttactttgagatcaaatctctcaaagggcggcaggaaagatcgtcgaggatagcgcggacgtgtgctgagtcgccccgcgccctggtcggcgagggagacaaggcctgagagatg

SEQ ID NO: 4981 - DNA, 700 bp, Nannochloropsis_gaditana
ttttgaattcatggtgtaatctcgaccaggtgagtgtacggtcgagtgtctatcgactttcaagtatttttacacatacggcagaactccagcaagaatacgcatctagctgtcagaccgtggcaagattgacaattctaagtgcctcgcgtaatttttgctgtttacaacaactaagttcacatcgaacacgccctaacaaccccaaaacttgttatcatacctgtcattatctgattcattatttgttagtcttcacgcggaaagcttcaagcctctggtctattcaatgatagcggggacatacgccttcttcgggaaagacatgtcgcgtatcttatgaagggacttacacacttagggcctggctttatctgtcttgacgcgagccgaccatggctgtgttattggattctccactctctcgatctactgcggggccttgagtcgaggagtcattcgatttttcgcgctgatttagctcggaaagtcacaattacaatgaactcatgccaaaactccgggggaggcttcggtggcggaccttatcagatatcgcattgcgctccaacatatgcggcagtgcttgccttactcatactcggtacggaagaggcctataagactatagatcgcccggcgctttataagtggtttcttgcacgaaaacatttgtcaggtggtttttgtatgcacgatg

SEQ ID NO: 4982 - DNA, 700 bp, Nannochloropsis_gaditana
tttgacgtatgataaaggcagccggaaggatctggtggacgtgatatcttttgacagtaaaatgacagccactagcagtatcgaactctttccagatatagagcacatgaatgaagaagctgcgtggtgatgagatagagagagattgaagtcatgagtgagacgattcccggcaacagcatcatctcgtaaagaagaatttcttcggacctctcgaggggtcataggcatcctcgtgacgatctttcttacaacggtaaaacaggacttcgccaagcccaggctttttgattttttttggggactcgtaggttacgagtcgtagcggtgcgttgcccttgccctactactagtagtcggtctcgctcgccaagacctgtcgatttttctttttcaacagcaaccagcgtgccagcgcgcgaccttcatgtgaaacactaggtaaagggtacaacaacggcgaagaactcgaaagaggttgagatttgtaccatcgaaaatcaggtgccatgaagctcgggcaatggtaggcgttcctggtcaagggagcgacactacctgagtgccggtgcgtcctcaaaagaagtttgttgaactttataatgacaactattccaaaccatactcgattcttttgaaggaaacttattatgaccagtctgccatgcgcctcccgtcctctatcacgtgtggttggaaa

SEQ ID NO: 4983 - DNA, 700 bp, Nannochloropsis_gaditana
cttacccatgaaagtgcttgatatgtttggctgccaggtaccagtgtgtgcgatgggctttccttgtttgtctgaactggtgcgagacaatgtaaacggttttgttttccaaacagccacggagctggccgtgtgcttggatacccttttggggcgcttcccgatggacacatctaagctggatcagttgcgagccggtgtgaagggcatggaaagatgggaggggcattggcggagacatgcggcatcatatctggcaataaaggaagtgaccaaaagctggtgtgtgtttggggcttggttcgggctgttacttgcatttgtgtttgccgccattgtcgcgagaccgaggtaatcatttactgtgcgaaattgaagaacgaaaggcaattaagaaccgaaaaattgtagcattgaatagcaaacacgacgattcatggcatgtttgtgtgcgtagtgagcgtgtcttgtgtatatgaccagatgaatgcggatatgggccatgcgctgggggcgaagaacatcgttacgggctgtcttgcgggtcgcgcgggcacgccacccccgctgaagatacattcctagtaccacggactgcacgtttagttcccaagttccaccctatttcgttgggaaatattctaaaagtacaacacgagtgcccatttcttacttggcgtaccctgaaccccatgaagca

SEQ ID NO: 4984 - DNA, 700 bp, Nannochloropsis_gaditana
acaagttccgttcctgactccctcgcggccaatttttcagctttcacttcagcagataagtcttttttcgcggaagatcgttgcaggcggtcgagttgagcttcaatttcctgcatataaagttgttctttgacgacgtcgctttctacgatgcgttgccgcatttgatattggaatcttatactctccaataatttgtgggatgcagaagtagcagccatggatgtgctagctttgtacttgttccttcgttccagagcgtcagggccgtatcggctgtcgcgactgtgcatgtaaacatacataagatagaagcagtagatatttcttatagtaccctttcaattgtacaccaaataccttcgcaaggtggtagtggttgtcgtgctggtggtggtttgctttttcattgaaatcctgcgggacacacgcctttaggcctaaatggacaagaaacgtggataataagacgacatatagccataaattgcctttttatggtatagggcagatacaagagattaaataccatgttttagcgtgatctacacctgacatcgctatagatgtaccatgattttttctacaattttgagcgatgggccgtctagcgtcgaaaaaccgttacgaggaaggaggagaatgcgctaggcgcactaagcaatcatggcatgctcccgttcattgtcgaataaggatg

SEQ ID NO: 4985 - DNA, 700 bp, Nannochloropsis_gaditana
cttgatttgcatgtgacaggttccgcggctgtctgccattgccacagactcggacatgtcgatgaatacacctcgtttgcattctccatctttgctcaagtccacgcagtagcgccctgttgtttcgattcttgaaaccccttcaagttcagccttgagttgtaaggcgaatacgggcatgtatgagatggaagtaatggagtgcacacgtatggtaatatttcttgatttcagtttgcagtctgagttctaccgcctcctgttcagacaaggaaaaaaatgatgagttgaatgaaaaatgcttcgaataccgggtatatgcatatctgggggatatcggggctgcttggaatgcttggaggacagggaaggcctgaggtagctaaaggggaaattatttgcgagcttgtctctcaaagtgcgacaactctgctgcagctggcagagcaaatctcaagctattatgaaagagaaaaaccttagcgaaagtgtgcgagtaaggcaatctagaagtcgatcaggacgtggcgctggagcgatgatacttaaccggaatagcgggcccctgaactgccggcacgctctcagttttcacagtttctaattcaaatataatcgaatcacgcttcaggcgcacacgccattgaaatctttccagcgttcttccaggagctcgtcattttccggggagtgcattatg

SEQ ID NO: 4986 - DNA, 700 bp, Nannochloropsis_gaditana
tacctttttcaagcgtgcggcttctttatccgatatatctggcggcaggtcgggctttggatcgatgctgcccttgtaagctccctgactcgagggttttccgagccgggctgtactagtgctcccaattccgcgcgtaaagtcgcttttaaaaaaaaattacgcgtaagggcttattacatcaatattaaaatattggcattgttggattagctcctacactaccgatttaccttctagcaatcttggataactcaaaggtctgcatcaaggacaggggaggttgaaccctcccgcgcattatcttgagtgtgtgcatgaccaatttgctgttgtgctatcagtaaagacgcagattgagcaatctcctcataaattgctgcacgagaggcctcatgaggacgattcccaggacaacgagtgatgaaaagggcgtaagcaagaacagcgatgccgcaaggcttcagctccgttgcttctcctttcgtaggtctactctatccacgcaacacgcgaacgcggcctatacacacaacactgactctcacaggcattaggacgacacatagaactcaaattaggaatgcagttgatgagtggaaggcctggacttctagggatcgtgttcatgatcatgctggcgaacaaaacttttgcttttcgagtacccgggaaattctcgtttagaaagcctgacatg

SEQ ID NO: 4987 - DNA, 700 bp, Nannochloropsis_gaditana
tgatgagcgagagggcaatccacatcctcgaataagggcattttgggactcactgttcctccttctgccagacaatgcgttgtgccaccaatttctgctgcagttgccaagccaaggagtaaggaacaagacctagatgtcaaggagtaagggacaagacctgaaggtaaatttgtaaaaatgtgacggaagagagcaaccgcattcaacgtcaacttgacatgcttaccttggatgttcagggtagcgacgcgtcgacgcagtccagctctcatcgtccccactaaagtccctgctatcatggctggctaggtgccgcctaccctacactgtgttgcgtgtcgggataaaccgatcaaacaatgggaaactcgatgctgctaagagaaaagcttgcattcagtcctgctcgggctcgaggcgcgaagagaatcatcagactggatccatagaagttgtgacagaccttgacggaggtccataatacttcttttgtgaatttttcgaaacaaaaggacctctgaatattcaattcgccagaccactaagtcttcctcgtaggatccaaccccacctgcggaggcgtgctcgacctcccggcgggcagactcgactcggaggaggaagctcgcactgcaactacctcttgatgtcgacttattcgcacgccttaatacctacatacaggtaacgagccatg

SEQ ID NO: 4988 - DNA, 700 bp, Nannochloropsis_gaditana
cctctatccataacctgtcccgaaagcgaacttaccagtcttgatctcaccgggagccgcaggaggagggcccattgtgctagcaagaagtgtgtctgtgttaaaaagatgtcgaaatgttgcgtctacagtgtgaatgaaattgacttcgggtatacatcaccggcaaggaggaacgggtaaggaaaggagcagggggacgacattgcaccaagaaggtcgaacacgctcccacccaattaatgcgaccgcggaaaaagcagccctacgaccatcgatgcgctttgcaaatgatctcaatacgcgctaaggcacgttttgtcgtgtatggcgctcgcggcgcgttctctacccctcgctccctccagccgccacccacagccacccgccgaagggccttttccatcacatcatcgccgtcatcaccgtcaccgtcatcagcatcctcctccccggtttccctgcctcagcgaggcggtacgcccggcttcggcttaactgcagcgcgatgcagtccgatttatcgcatcttttcgtgtcgtgcagctacaaacttagccatggcgctcttgacggtacccttgccacttcaaaagccaaacaggtgcttccaggagccactagctcatcacgcgagaggggtctgttatgtcacgtaaggtaagatgggtggtatttatgcttgtaccactaaaggatg

SEQ ID NO: 4989 - DNA, 700 bp, Nannochloropsis_gaditana
tcctccgcctcagccatctcctcaaccgctgcctctacgctatagaaatcacgtaaatttctgggtccttcatcctgtatactgtcttgctcttgcttcttttgttgcctttgcgctttatcctcttgaatggcagccatggcggatttcatgatcgcttcgtcgacgctttggctatccagtccatcattactgacgaggaggaagggcttccgaacaaataccacttgcgaatgcttgcccccctgatacggaaaggcaagaaaggcttgggtaaggcggatgagacaaagcaaagcaacgatggctggcacgacccggcgggctccatagtaaagttgtaggttgaaggggggtgcgtggtgcgggctcatcctaaagcgcgcgtagactggccgatggagagtcaggcgcctgatgatgacccttccgggaaaatgagagcaatcgtaaggtcgagaagtcgtggacaagccaaactgtggcatacgcaccacgggtgcgctccgagcaggctttgagaggggagagggagagcacagagggaggggaacgtcgccgtgagagaggagcgaggatgccgccttggccacgaggttacgccgctgccgtaagctactttgcagatttcataacctcctaacctggctttcttcctgggaaaatatcacatcaacacaataaacttcttgttcacagg

SEQ ID NO: 4990 - DNA, 700 bp, Nannochloropsis_gaditana
caaaggtggcgcaggataaggttcgagaggtgctgtactctccatcctcctcacaagtagactacagatgtcgataagggccccaatatcctgagccgaatataatcacagtcccttgcagtgcctacccagttgctataagcactgtgctgaggaaattcaatcaaaaactggtcagtcctgccatgttactgtcctgatcgtcggcgatgctgagggacgctgagaggagatgatccgcgtgactgcgtccaacgtcagacggtttagagcaatttcgcactgaaagtgaagaaacatttgtatcttgtcgccctgttcagatagttgcatctcttcggctgcggaaccccccgtcttgaaacgttttcacggctccgtggtaacctccccactcgctcgctctccttgcttcactttgctgggtctgcatgcacccgtgtctgccctgacactgattttttgcgacctaagattttcatcatataagctgaatagatcatggctctcattttgactgtttccaactatctggtacgcccgtcttgcagatcaaagcttggtcaagactagtcatgacggacgatgagagagacggtgatgcatctgatgcggcagcgcggctgttacagaggaaattgcgcgcaagcaatcaacgcgagctatataaagcgctaaatgtgccaccttcagcatcatc

SEQ ID NO: 4991 - DNA, 700 bp, Nannochloropsis_gaditana
agatagtctgagggagcctctaaaaaagatgcttgtggctggacaatgcttcctcatgtaaaaaaactgcaccatggatgattcgccctatcaatcgccctatcatttatggcgttggcttggtaaaggtcatatgtaagttagtttttaaaaaaaatattctatgattccaaagagttgaatgtcttttcaattgaaggaaggagtaaaacaagagagctgaagagatgccatagtcttccaaaggaaaatcaaaattctgatgtacgagtctaaaattttctgaatgatgcaatttttcttcaaacatacaatttataagtataatttacgtatttgaataccacaaattacattaaaagccggctctatgatgtttcctggtagttttccactagatggagaggaggttatatagtggcccatattgtcttgacgtcgtcgttggcctgatggggggctagggttactttgatacctcctgccgatttctgtttgaccggccttcttgggaagcacaattacagcttcatgtattcttacatttcttcctaccgtattggatttaaagacatgttacctcatacatttttctatttcctgtcgcgacaggagctacagccccgatgcccccaatacttcaacgtcttgcaaaactacggcttgcattacccaggttagggcttcaacatcgatatcg

SEQ ID NO: 4992 - DNA, 700 bp, Nannochloropsis_gaditana
ttgatatttgggccttgggaattctgattggggaggttgtagagcaaagtcaaggcaagcccccatctggagcactggctagcatccaacgccggctcctttcgggggacagctcggatcgaccctcggccggtcaaatcttgcggcattcatacttctcaccaaggggtactaaggagctgatacgcgtgctcgattttttggaaaatttttctttaaaagaggacggggagaagatggattttttcaacagcctcgttcagtcggtagcgcggttacccccggaggtcgggctccacaaaatattgcccaccttccgggattacgtgcacgtcggagtcgggggtagtgtctctaacacgcaagtccccgatcaagcgcttgtgcagcagcaagcgcgacaacgtcaacttgtgctggctgccctgcccgtgtgcctggagatcctgaagagcctcgacgatgctgccttcgcggacatgggggagcctctactcgtcagcctctttggaatgaacgaccgggcgatccgggcaatgctcctgcagcatctccaaccgctggcgagcaagctttcacagaacaacatcaacgggcggctcttcgactccgtgctgacgggtttcgccgacagcgctccccagctccgagagctgaccctcaaatccatgctcagcttcagccatcgcctcaacgagaa

SEQ ID NO: 4993 - DNA, 700 bp, Nannochloropsis_gaditana
gcccgccctatcaccacactgcggccgaggcgcatggctacgtgcatccatttgagggttacaggcgcggctcaaagcacaagtgccacgctctatgtaggcgtgtgtcccgacgccttcgcgcatgttgtccgggagcactaagtcgccttgaccatctctcctctcgcagaggcgggcgaccgatccgcttgtgaggagcccgcccccggttttagttgccgatgaatggacggtgactctaatcactctgagctctcacaccacaccatcatattactgtcatatgttaaaggcaatgtgtttcttcatctcttcccattccctttccgcagtacgtgcagtcagtagaaacggaaacgcacgccgcgcgcgaagccaagcagcgatgggccaagcggcctctttcccatttgaggtatcagagccagccgatgcttcgcattcagcacgtaatcctgaagcctattggaagcatttcaaagggcggcgcaaagcggatcaagcagaggtttccattcataagctggacaaggttagcacgcctcagctgaaggtcgaggcaggccttcatggattccaaaagatgaagacaatgcgacatccatacattctccagtatttggatggtgtggatttggaaagagaagtgattctggttaccgaatcagtgacgccactaggagaatggttggctgga

SEQ ID NO: 4994 - DNA, 700 bp, Nannochloropsis_gaditana
gtgcggggctctgtaagatattccaccttgttaaaatatgataaacatacaaaactcacccttccacactcggtttcgtcttgatgcgctccaggatgtcctccacctgcgacttccagaatggaaattttacatagttatgcttgtaatattcgaaaatgaaacgaaaaaggcttaccataatgaaactgtggcctttggtgtttatccttgaataagtacctatttggatgaatgttggaatgaaactttgttctgctaatgttttaatccacctagtaattgcgccgtgaaagtgaggaaaactcggaaaaccgttactagcgggagaccatgtctttagggcctgcgttttcttgtgtgaacacgaaaagaggccttgccccttgcccactacgcttggcaagtttgaagccacgcttggtaggtgattcgtgtagcggttgcgatacaggggagcagaactgcgtgctttgttcgagcgttgggcgacctcctcgttcaaaagtcggggacaagaagatgcaaataaattcaaaactccggcatgacacgtaaggtcggcataaacacatgtaatggagtccaataatggatctttttttagaaaatcagtcgattgaatgcttcatctttcgcgcactgaataaagtgttaagcagccctcttcatgacgatcgtgggtaactttgaatcgatg

SEQ ID NO: 4995 - DNA, 700 bp, Nannochloropsis_gaditana
caactacaaccggtgtatgcactaggattgcaccagattcgctcaggggagcagtcgcaagacatgtctccccgggcggtgcatagcctatggtggaggcaaccgatgcgaagaacccccgtaccgacatggaccatgacggaacaacactggacatggaaggcccatcactgatgtgagaacaacaacttctagtttcagggactcttcaatatcgctctgtatgaattatctttatgatgggatgcaggctattttttatggcacattatggagaagcgctttgctgccctcttattgtacacggcttcagctacctgttcattttcctccttagcagagcttgcgatcctttgaaccgttcaatcaaaaaaaattaacgtagcgcattatgttattcggccgattgcgtggtttagaaaagggtccaatggtttttcgcattgaagtgccactagaagtgccacagtacccggaggtacaaagacgggctccgactggtgacaaccatgtagcttgcagctttcaaggtttgggaggcaaaaccattctggcagacgtgattcacttagcttcttatgagcagcctgatggagcgtaagctgtgtgaaaagctcaaggtacctcatttcatgactttctccatctccaggaacgactccaggcacgtactacgtgatactttgaagcactacgaatg

SEQ ID NO: 4996 - DNA, 700 bp, Nannochloropsis_gaditana
gccctcaaagtatagtaggtggtgcggcaggcaagtgagcatcttcaccatatatttcactggatgcttgaggttgtggggctttgcatttaatttataatgtggcggaaacaagcttaagaacaacaaagaaagggtgtagtgggattgcgagggtaggacaatcgacttacttcacgataaaggaacacacccaagagcgcaatatcagttttactgaaatacgatatgtgatccatattttgggcactttttgcaaagactatccttcctttgtgtaaatattgctgctgtcacaccagcagtactgttgtgtctgcaatataattatcaggcaacatatccggctaccaattaatcatccttcgtgacgactccgatcgattgatcatatgcttaactttatatggttatttcttgaaaagggtgcgtagtatagggacggacgcccacatggtgtaattttaagtctagttggctacttacatgggccgatcgccgtgagctcgtgctccctcatacagcgtgtccgtagtttctcgctctgccatatgaagcccgcgctcactcatgaaacacacatcgaacagagggcttttgtggaattttaggagacagtgtgtaacaattttgctgggtaaggtgttcaaggggggtcgaacaagcttttcgtggcatttgcttcgaaagcaatatcatg

SEQ ID NO: 4997 - DNA, 700 bp, Nannochloropsis_gaditana
gacgtggacgagctaggggggccgggaggagggcgggaaggtggagggtgctctccttcttatggcgcaagcacagcctccacagctccgagtgtcctcagcttcatgacaagtggagcaggaggcggaagtagtgcaggagctggtgcaacagcgagcgtagtggatagcttggtggttgtcggttcggtcgctaccactttaagtagctatgactcaactggctcgttgtccacaatagaaagcagcgcttccaccgaggtgtcacaacgacggccatttcaacaccgctcctcatttttaaagcctgtgtcaggacccccagggggtgggggcagcaacggggatgagacgtgagacttgacgggctcggaatcgtccacatgtcacgggcaaaagcaacattctatcgacccactgtaataatgaactgaaaaatggagccaccaatcacgaaaccacttacatggatgttccgctccatgttgaaccatcgcatggtggtaatttcctctgtgtgcatgtttttgcttttggtcgtcggtatcgtgcccagtaacctcctcccctcccctcatgtcccgcccggttggcggcctccggtccggaaccgggaaggcacgcgttgcattcacgtggcgttctttcattatgctcacaaccacagaaaccacagcattgtatcttaagggtcagaatg

SEQ ID NO: 4998 - DNA, 700 bp, Nannochloropsis_gaditana
tttcccagccaccaaaaatcgaaaaggcccgtcgttgggatgctctgtgcgctttttgtccaagaaagcattgatgtccttaaaaaaagtcaatgcaacgcctacgtagggcaaaaaccctcgatgtgacggtggcagcggaccagcgcttgccgtctgccggcttcgtgatggtgcccgtttctggtgcatgtacataatcacgatgggtgtcacgatcgccatgaccatggccaagaccacaggatcaatgtgtccactttcactcatggaggccgcgaccgatggatgtggtttggtttcagtcggacgagctttcttgatgtcgcttatttgtacgtgccacaaacggattcgtcttcctgttgattaggccccgtatatcacgccaaaatctgtaccaaatttctggttatcgcctccaatcgattcctcgacaaaatcaagcgaacatttgccaacctgtgaaacttctgttgatgagacgcattttccctccgtcgaccttatttagtcccaccccagtccctctcgccaacaggaagcctcgctttaatccgctcgcgatccagaccgcacgattccatttctgacacttacccactcttttgcgccacaaaacttactttcaacagtcccgcgggcataatttatgaagatggcctcgtcagcgtccatgttgttgcgtagcgctggcatg

SEQ ID NO: 4999 - DNA, 700 bp, Nannochloropsis_gaditana
agtcagcttttcgagcatgtgctttgggcaccacgctgaaatataagcacggtctcgtgcgaccgacaaattaattaattgattaagctttccttcctgggactgggttttcattccttggtgggggtaggcggttcaaagaagttgcatgggagaagacgagggagaaaaagttcaacaaatactaacttgagctcattaaagacaacaagcttttatgaaacaagagggtgttcatatatcttgaccgtcatttatatcaataacgataagattcaggatcgaaaggatgatggatgtgaatcgagatataatttatccgaagagatatgcatgttcggtttccccccgaggaccaagaatgttgagatcagattagtgtctattgtggactttgaatagattttaataatgctgaaacaaaacttcatgttgttgagctaggcttctcaagagatggccttcctatgctgtgcgacaggaagtaaggggttgaaagaactcacttttttcgtatgaacgagtcacaacaaaattcaagtcaaaccttaccacaacgtcgtaatatttccttaggattttttcgataagccgatactttttcctgtctttattcgaccatatgaatgcgatgctgcatttgcttctactggctcaatttctccgcccaaacgccgctgtgtgcttacgagacaatatg

SEQ ID NO: 5000 - DNA, 700 bp, Nannochloropsis_gaditana
ctggcaggatcggatctcaaggcctctagaggcttggctcgaagcgggccccttcagctggtttcaggacccagacgaggtaatgactcccgaagacaaactcgagtatctgcagcgtgtaatggtccagattaatgtgggcgctggcctggtgcagcagcatttaagccgcaaacttgtgaacactgacgtccagtatttgggggagtggaccgcggaggccctggccctaatagatgacattttaagcgacgactttgaaagcccaggacggctagaaatgaggacatctgcccgccaactcttgcccgcgtcagctcaaccaggctttgtcagctccgtcgtggctctgaaggagtgcatggcacgtctcactaccctcaggacgcgcatttcgacgcgcgcagcctgctttcataaagccacttcccatttgcgcgccccctccttcttgcgccgtcgatggctgcatattctcgttgccgctcctttcctcttctttagtctccggtgggtatggggaaagcgcggagacattccccgatgggtggcgcaagccgtccgcagcacacgcgagtttttcctcgagcacgtctcggagccttcccgggcgatcgccaaggaactcatttggaacgagcacgaaagcattacggacgtggcggccttggaggacgcgaaggagagcttggccaggatg

SEQ ID NO: 5001 - DNA, 700 bp, Nannochloropsis_gaditana
atacatcggtaacgtcccgtcttattatgggggcgctaggggtccgttctccaagcaacacccgcccttcaatcggcaataagcgggagggaggcgtgcgccgctctgctaggatacaagagagacatttgcaagaggagcaacgtagacaggagggacaagaatatgcagacgcaaagtcaacagcaacagcagaagatggggtgttaagaaaaactggagaaaaccagaacgaaagtgccaaaaagtagatagatatatcaaaaaacgcagtagaggagtgcgcaccagctagaaattgtgcataatttctttattgtgtttgtctccatgcgaggtggtgtttcagtcgcaaaaaggacaagaaaagtaactcatctcgcgtggtcaacgtcacttggacggctcggatctctttccattgttgctctcgcaatatcaggaggcgcggctgctttccctcgaacctgaatgtcctttttgtccttggtgggtcgagcaacgcaggcatgctcattttaccacgctttgaccttcgatatccaggtgcagtacaagtgtgcaagttgacttccctcttctagcctactgctatctccgctgcagctcgtgcttttcatcctcaagcaccttggttcctacttgtggacacgcccctgtctagcatcgcttctgtgaaggaagtagcaccctcataatg

SEQ ID NO: 5002 - DNA, 700 bp, Nannochloropsis_gaditana
atcttcaccatggtggggaggacgtgaagtcgcaggttttttagaagcagtccactgccacgatgaattttcaccacgatccgccttggatttgattttactattatcgccatcctcttcactggtgcctcgtgatttgacgttcagtgacgaggatgaaaactgtcttgcgaagggaagtggccgtcgtaactgtctctgtggcagtgcaaatttgtatgcctgattccgcgccggcaggacggaaagagagaagaaaagaatacatgttgcaatgcgtggccatgatcgatgcggagtgtctttccttgcgccacgtggtgtgcacggggcatgcagagcgagtgtagtcatggggatgtatgcgcaaggtggggaggtcggagtcctgtggttttagctaaagcggcgtgtacggcatcgtgtggacctcatccctacgcttcttaggagttaacctgagaactttcaacatcctgtgttgaaaggggtgtgtattggaaggcatgtgtatgtcaattgtggtcatttgtctccaatgaatcgattcccaggtctggaagaagcgcctgcttcctacaaccctcctcaatccttatgacctttttggcgttcatttcacggtccttctgtcccctaatacatgtatataactggaaacaccaacgctcatgcacacacacctgcatggatgcacaca

SEQ ID NO: 5003 - DNA, 700 bp, Nannochloropsis_gaditana
gcccatagggtgggatgcttcggaaacgtcaattatttgtggcctctgcgtaccattggcgcaacaattttatgccctggaccactataagactgaaagtttctggtagggtgaaggtctgtggcaaatcttcaggtcctacagaaatgggttttctcggtcgcctcagaccgtcggtgggatgttggcgcgaaggacgttggactcctcatcgaaaccttgacttcctttggcaagactccatgaccttgatttcaggtcattgttaaaccattcatacgggtaggcagacaggcaaaatttttattgattggtacctgtgtgatcttcttcacacgaaaggccggggtcttgatgatcatacaactcgacatcactcctcacaatcgagaagcaagtagtcctcgctcgctcaccatcgccttggtgtgacgtgactccaagcatgggaacgcattttcaaatgtttatggttataactcgcacgttagttttggaacagctaggcacggaccccttgtgtcaaacggagttggatgtaaaccgtgcgagtctctacaagtgcttatccactcatggcctagaaccccattctcaggtaaacacggcctcataaatgcagttccacaaacatcctcgcgatgagcttgttcacgataaaaacatgccatacgatgctatattgcaaaaattgcccgct

SEQ ID NO: 5004 - DNA, 700 bp, Nannochloropsis_gaditana
tgaccgtggagatacacgtcctttcgcgctagacctccgcgatgaccttgtcgatgtcctttttgaggccctgacaaccagcgatggagactttcaaacccgcccgtcgtcttcccttccccggtgccctctcacactttcatattttaacatctgcccagacacccagaaagcagatcaggcgccagccgacgagagacatcctatgaagaagtcctcgcagttctcgtcatttgggaaggtcaacggtactgaggaggagaaaaaagacactcctttggacgatccgcaagcgcacctctcgcagatcgttgaggcctccgatgactcgaagcccatcttcaaagatacagcatgcttaagtgagtatgttagagtttcaacgcaatcagagtcatttatgcttgggagcacaaaagaagcattgatactcattcaattttgccccccacgttcactccgttaacagagcctgagcgcattgtccttcgtataccaccggtttcctccggcacaagccttgagagaagattttgatacaaacaaagtctctacttttggtgggggcctatgtgcattttgttccatggtccacatacgcgagtagaacgtgacattttacatattttcttgagaattcagtgtctcgcttgtttcctccttgggtaccaccttgctgcttcccgtgttcgtaaacatg

SEQ ID NO: 5005 - DNA, 700 bp, Nannochloropsis_gaditana
gtctggtctgtaactgtgcgtgtagaaagaaggtatcaatgaccttgaaaagccacagtacgccgtgtgtacatcaagagatcaatccggacatgcttgaatagtacactgttagggccgctgcacagagcgaggagtggtcgccggataggagaggaggttggtcatatggcttgtatattttctcacggcgcagcgactcccacgcacagacggacgcatgccgcaagctaccgaagagaaagaagggagtgaggacggtgttgattcggcgctgttgcgtgggtgtttgcagcggcagctagatgagctggaagcactcgaactaatttaccctcccacgagcccctcttttcctccttcatttccagccatttgtatcgaagaaacctcccgtatcgcagtcctatcagccttatctgtggatataaagaagtctgtccaatttctttcctccagagacttgccctgtctcgctttgactgtgggcacctgcccccgtctaggcatctcgttaccagcctcctacccggagcttcgaggttccttgccaatcatccggtggaaggaaggaggaaacctgagcacactggccaaaaatgaagctatgcagcgatttacatctgtatctttatcgcacgacgggggggaacatctgttgcctctaatacaagagatgcaaagctggctggaagagcta

SEQ ID NO: 5006 - DNA, 700 bp, Nannochloropsis_gaditana
cactggtttcttggaaattgggcccaatgaagctcgggagcaaagcctcagattcgtcggcggggtgttgattgcagcgccgtatttcttcctttcagccgttgctctgggagcgccgtggaaagaaatggtggatcgtactgcggcgtgggccctgataatgggcatattggttggtggccccctcggtgcggctgctcctagcctgcaacaactgcggttgccgcctttgtggcaaggtccgccgggcgagactgctttgatacgctttcgcgcactggggtgctgcgcgggggcgtgggtgggtgcgtttgtcgtaccattggactgggccatgcccttccaagagtggcctctacctttggttgtgggagcggttgccgggcacagcctgggatccttcgcggtctactgcgaccagcgatggacgcatgccaagggtgtggggcatgtcgactgaagtgtggcgacatgtaggcataaattgtaaatattcgcgccgcctttgctccgccgactatttgtgacgaagaaggaaattgaaacgtagtaccactctcttcacatcccttaaacatcgacgatgtggtgtttaatatcctgctctacccgtacaggcggccccccgcccacctcttcaccatcccagcattcacatccacaccgccaaacacacccctttcaggctgtagatgccatg

SEQ ID NO: 5007 - DNA, 700 bp, Nannochloropsis_gaditana
cgtccggtggtttgttggctagcacaagctcccttcgctcgctctcagaacctcctactgcctcctcccccgcagcttttccgctcttgacagggctgtgaaaagtcgcggctgcaacgcatcccacgagtgacgggaatgattgtccagcgcaggatgatgatgtcgaagggtggagcacccatgcctttcctgcaatcaaactgagcaggaaaagaaaggcagccgccattgcccctttccttccatttatcatgacaacgtggtcaagggcaagaggtgggtgcgtggatcgagcgtcttgtcgaggccaaacactgtgtgtgcggacgtacgaaatggacatgtatgtcgagttcaaccggctgggacacgtttcctttcacgagccttcaagtcacgcgggagggcatgaggtcatatcggtgatatcgagaactttgagagggaggagcccaggggatttaccttggccattgtgccatgatgcagcgcaactaaacaaaaataaatgtatgcacgacactagactgccaattacccttttgcaggccacatataagggaattgtggacgtgtgtgggagccatttcgcctttccccttccccatactatgtagtacttacatggacgagggacgactcacagcatataatttttcgcaaaacagaggtttgctgctacccatcaccagccatg

SEQ ID NO: 5008 - DNA, 700 bp, Nannochloropsis_gaditana
gtctgccctgtcgcaataaattgaggaaaggtaacaagtgacgttttggaagtttcgagatggagtgaacaagaggattaggttagaagccatatcgacaactgaaaatcagtaatatgctttcttttaaggaaaaaacctttgaattatccatacgcgtatcttaaatacttcaggatgctcgtcattcgtgaagacgtcattttgccttcctttcggagggctatattgaggcaaagaaaaagacaatgactcggcgactacggcattgctgcaacttcaggcggggccactgcaatattgtgtggatgagcggcctcctgaagcagacgatgctttttccaaccaggctggagcatgggcgtgtcgggggatgtgggaggtcggccgggctaaccgtgccgtcgggtttttatttccttttcgcgccaacgtcaggaagtgaaggggaaaggcgggaagagctgcttacaaaaacaagtgtaggtatcgacctggtcactccatgggcagtgaccatttcttttgtatttgcaacgccctgtggtcctggctgtggtccatcgtacagcagaacgtgacctttgtttctttgtttcgacctgccccgccctcgctcactcgccaagagactcgaagaggtacatgttccccaccccatccctcctttcatggcgaaatcataaacacatctaccatg

SEQ ID NO: 5009 - DNA, 700 bp, Nannochloropsis_gaditana
gtcgtcgtccgtttgttctaaaatggcgcctactccaaaaccgcttgaatcagtgtatggcgtataaccttttgatatatccggacaagctaatacttctggtgtcatcaaggcttgttttaatggtccgaatgatttctgctgctctttttcccatttccaacgatttgtggtgcataatagttttgtggagggtcccgctatcgtagacaatcccttgacaaattttcgatgataagaacataaagacaaaattaatctattatctttggttttcttttactggatcatttgagagggtagagatcatgtctgggtttggtgttacgccttcttgagatacgagaaatcccaatgatcttgtttcagcaatttaaattttcaaatttgagctgcttgttccttcgtgcatcctcctcctcagcctacaccttgaatctcgttttacattttttgatgagataggacttgtaaaccaatgaaaaataatgatcgcataccatcttggctttcctttctcgtacaggcggttgatgctgcgtccaaagagacaagaactccgaaacctcgctctttgctcatctttgttcctcctgctgtgtcgtccctgcctctcttttagcagcctttgcaggagttttttgcctgacactggatccttttccaatgaagttcaatgtaacgacaggggaataaaatg

SEQ ID NO: 5010 - DNA, 700 bp, Nannochloropsis_gaditana
cgtctacgacgaactcctggatacgaacggcacgcccagcctgcccgagctccccgcggaactctacatggtcacggcggctcaggtcatgcgtccggtcgaccaagggccgtacttgaccctctcttcaaccttcgcggaggccgagaaagtgctgctccggtgcgggggttccgagtggttgatccccgtggtggacacggacgaatccatgcatttgcaaggggcggtgctggcggaggatttgaaagtggctgtgaacggcttgtacgtccaactccatgcattggaggacggggaggaggaatgcgtgcgtacgcagccgggagggagcggggcgtctcatcggcttggcagagagacaggaaaggaattcttgcgtcgaaaggtgaccttttcagacgattctgagcaggaaaagcgggggagcaccctgcaaagggggtcggaagatgagaagaaggggccagcggaggcaccagatttgggggtggtgggcggtggaaaggatgaggaaggaagggaagaccacattgatctttccaacagcgccaaaagcgtggccatgggcatgcctctgcacattgtcgtcctccgtgaccgagacacggttgacaccctcactccctcccgacgacgccgactttcctctctttcatcctccaaggctacctacctaacccctcctcccctaatcatg

SEQ ID NO: 5011 - DNA, 700 bp, Nannochloropsis_gaditana
gaagtagcaccctcgcacgcaagaatctctgtcacagacggtctgaagccgccgccgagaaaaaaatcgtcgtatcactgctaccaactcctaagtaactattttgtacttgttcttcccatcaatttcccactgcacccagaaacgatcattattaatgcctttcccttcgatgcatggtgaggcaaatattgtggacgaagaaaaggcatgtttattgaataacggaggcaagcggtatgatggggaatccacaatcgacacgagcgccaatcctacgacacgattgcggcccccaccgataacaactcgcaattcatcaacggatataaatagtgacgagcaagatgcaattcgacggccgggtagtggaaaggcaaccaagaaatcgcggggcagttctatcacggacgtctggcgctcgctttcctcctcaaggagctatacctacggtcccacaatccatagagcaggtgcttccgaagaggagtggaggagccttactagtagaattagtggcaatgacggtagcgcacacatgcagaactggggaatgggggcgcgaaggcaaccctcgcagaagtggcagagcctggacgtctatcagtccttggctggcgtgacgcggcatcccaccctggctcacgaaggctactacaaccggggcgctaattgcttctttatgttgtggcgtatgatg

SEQ ID NO: 5012 - DNA, 700 bp, Nannochloropsis_gaditana
ggctggaaagaaaagcgcgcccggcactacagttgtaccttctcttcgtgtactcttccagtattggtacctcacgtacttagccagctataatttgtttttcgacaaaactcagtcgttttggtggcaaacgactatttacaattctggtacgcggtagaaaagacctgactagagaatgatcttcttatttgtttaccaacacagggatcagggccggcgacaagtctatacatcttgcgcgcgtccatgggacgtgacgtagtgcgtacattctttcaatgcatttcaaaatgcccacgcacaaataaaggagacaatctgataaaaacagcagtcgaggtctgtaaattatatgcatacaacccatcctattgagggagcgaaaatggggcatgtgggggtcgggaggttacagccggaggggagtgcttcgagaagtgatattcggatgcgacgaccttttattccacgaatgaagttctacttgatattttataggaaatcctagcaatgtccccattcaatcgagaaagaaggtttttttgaccccttgaagtaattaggcgaggagacgcgtcgccttttgtcgacttgcgaggctcgacgatgtcctaaatgtgcacatttaccagtcctagaaacagctgtttagtctttgcattgtctacatctctgttcatcgtagcaaagtagcatg

SEQ ID NO: 5013 - DNA, 700 bp, Nannochloropsis_gaditana
tatgtatagatatgaatgtatgtgtgtgtgaatgtgtatgtgtggatgtatgtatgtgtgtattttgtgtgattgtgagtgtgagtgtatagatgtaagtttcagtgtccgcctacctctttggttcgattctgcctgtcttcgtgcccccttcttccttctagaagggtggatgagccaaggatagcgccaagcccccctttccctcggcgtttttgcgcgcaggattgggaacgggtgtgtaattgttgccttcttggtatgctcccggcggggacacgaaagactctgtgagggtcttcttttcgctgcatctcagcctcgttgtggcttcccccagctccatgtcgtccccttcccctatggtccttttacgccctctccagcgtgtcgtgtctctcccgctcatctcttgctctctatctgcttctccttctctcctccctcctcttccctctccatctccactctcgtcgcggtatgctatctcttgcctcgggcgggcggtctcgctctgtaggttttggtacgtaacatccatggtctctttgttcccggcaaccagagcaagaaaggcaacttagtcaccgccccaggcagcaatagcagcagcagtgtgacgagcgcctctcccgctggtgcttccatcagcggaggggggcgacagtcccagaaacaaaaacaggcggcggcgacgatg

SEQ ID NO: 5014 - DNA, 700 bp, Nannochloropsis_gaditana
gtaacggagagggcaagcccggacggaaaagaacgagtttgggggggtaattgatctgctacattttgactatcaaggtgtcattcttttccttgagactgtgtctgcttggatacggcgcaaatgacgtactttcgacgcttggaaatccttgccaaccgatttgctcgttttcgtcctcctctcgctattcccgtcttggcggcttgagcctaaacttcaatttgtgctcgtcgaaggaccatctgctagtttgtttgaatctcgttgtccaatgcacttacccatttgaacattataccgtacagcttaaatgaaggggtcagatgtcctcggtttcttttcagtatttttagtcgctcacaacgcggctgcatttttgcgacctccctgcctcaaagatgccagccatggccgtgggacatacccacatcaacgctctgtattcaccctcgtcgcaagccctctttccgcaacatctaccgccaacgacatcaacagcggacccactagtcatcataaaattttgatacttggcggaggcactggagggtgcggttcggctgcccatttaattaatgagggaatgcaagcggccgacatctgcattgtcgaacccgcctcgactcactattatcaacccctgtggactttggtgggcgcaggcatatttgatctagcaacgtcagcacgaccaatg

SEQ ID NO: 5015 - DNA, 700 bp, Nannochloropsis_gaditana
aggaaagctgggatccgtaccggtatggccctcccaaaaagaaggagaaggtctcaattgccgctaccttttacgatacaaaaactggagaaacggtcacgaccacagaggcttctcgaacgcacaaaagaagacatcagataaatacgttggcaatacaagcagctgagcgggaggcggatctcttggaagggaaggcgcgcagcatgcaaagtaaagcccagacccagggcaaatatgggtggtgaagtttttttcttattttggttttaaaattgccatgagaaagaaagaatagattccgttcgtccgaatcatgttatttctttctcgctcgagtagccggttcctgcgactaagatctcgctgaagacgtgcttgcacaatgcatacgactcataccagtacccggaatcgggcctgaaacgaaggctaccgtatctctcctagtatctgctgcattcttaactcactttgctggtcggaaagcttcttaatccgcttttggtctgtcttcgccctcaggtttatgtgacgtacgctcggtacttcaattcgatgcatgcacgacgcctcaagtcactcgactcgcgtggacaaatccccgcccactggcatatttaacccatcctcagaacgtctcattcatacctaccccttattttgaaactgcaggacgaaaggatgatagaacgctatg

SEQ ID NO: 5016 - DNA, 700 bp, Nannochloropsis_gaditana
gaggtggagaggaaggaactcgatgaagaggtaggtaggagaggcgagagggatgcgatcgcgttgctcctggtctgtcacgtgcggccctttgcatatttgactaatgaagtattggagcgtgtcctgctacgtagggtaaatggtgcactggctttgtcaaatgtgggcgaggagagagattgaaacgacgatggccaatccctcgcagtagagtagcaattcgctcccatactctccagtccccggtaccccttatcgctacaacctcgtctttttcattttcatcatgtgtaggagctggaacgacgtcgcagaatccgtgaacaggtggcagaaagcaaagccgtcgcgaagaggcaggccgccggcgctacggggctatttgctctccttccgaagcccaaagtggagaaggcaatggagaaagcgttgaagaagagtggtgactcggccgcggagaagaagaaagataagggggcgaatatggaggcggatgcagtcgctgtcatgggggctgcgtcggacaagaaagaggaggggggcgaccagggagcatcgagtgagagcgatggggcggaggaggagaaggaggaggaggaggaggaggaggaggaggaggaagaggaagggctcgggcttctccactcctccctcatggcaggcgccacagccgccgctcttccccgcgtatccatct

SEQ ID NO: 5017 - DNA, 700 bp, Nannochloropsis_gaditana
gaagttatagagtgacattcaaggggaggatgcaacgtgttatcatcagactgcattcccactgcggtatcaagttgtgatgcccccgccctggacatgtattttttgtgagtagacggcgcttgactttagtagctccacatatagtcgagcctcggacagtttctccggattttggtcgactcagaaaagatctcctcaataaaaacgtgatgcaccaccaatcatcctgtgtgtaatggttattgtatttgcgagataaatgtttggtgctatgggaaaagtgcagctagcgtggcctggctcgccgatgattttctgggagacaacaggttattttttacaaaaaataaacatattttggactccatccgcacgacttaggcatctatagaacattcatctccctagtccgcacttttttcataagttgaccagcccacgggaagacgctgttgcatgttgcgtcgtaggtgcgacgtcttgggccgtcgcgcgtcggctccgagtcgcagggggtgaggaggttggcggtactactgtcgatcagtgctgcacaaggacatgaactcaattcccatcttgcatccctacgacacaaagattttgcaaaacaatcgtttgacccttaaatggccacacttctcaccttgcgacttctaaaacgccagcaggtgtcgtggaaagtatatcagcgatg

SEQ ID NO: 5018 - DNA, 700 bp, Nannochloropsis_gaditana
tgcctgcgctcgcagagggggccgaagggacgttttggaggcggtgtgccggggaccctgccgtctcggtccgccagctcggagccggtgcacccgcccaacgcgccccgtcactcgtcgcgtcagcggccaagaagcgggaggaaggggagaggaaaggtgagtcaggctctggcatgggaggatagaggcgttgtggggagtcctctgagactgagggagccggcggggcggagggggagatagcttggggcgctctgtgatcaaggagcaaaggactcttgagggaatgctgtctcatagttgtggtgggaaaatagaagtgcaaacaaataagcgcacggaaaatcatgataaaatccgactagacctctgcctgggtggagtgtctggagggggattgttgcttacactcgaacgtacactgtctgaagatcttggtggatccatgcgcgcaggctaaggctaacgaggaatcctgtggttgcattcgatgcgataaaaattgtgtcgaatcacacgagagacaggcggtaaccataagagggacgaaaatttcatcgattccttttgagcggcattcccagctaggtggggagactcattttgtgcgagtcgacgccctattctgcctcgtcgttttttacattcacctcaaatttttcttatcctgcgcgcacaatttgttaaagcaggtatg

SEQ ID NO: 5019 - DNA, 700 bp, Nannochloropsis_gaditana
gtcggtttgcttggcgatccctgtccagaattcaacttttacagattgattggtaggtgtcttttcctgcatgtttggataaaaatatcgcatgcaggaacgattgaggggtggtgctgctattgctgatcagaaaagggctgggacgtgtgggcatgtctaagctgaaacgcttgcactttttccatcgaaaaaaaagtcaagactcaacgtcttgcaaaaggctaggaatagcatagatcttgccgtactcgacgaaaaagtacagatgtaagcatttcttgtagtattttcgtccttgtgcttcgtgtttgccgctacgccggcctcggaggtggatgccccccgagtcgccgcgcctgcgcagggaggaaaggcgggccgcacactctgtcgagatcgaattcggtccctccgcgcgctaaacgagttcacctctagagacctttttgtgtctacgttatgagacggtactaaggcgtgcggtctgcctggatgttaaggtatgtcagactttaattcaagatctttgagagaagctttgcaatcgtaggctgctgagccgccggctggtcacttgtatgaggttgaaaacgtcgactatacacttgaaaaaagaccgtaaacacattttgcagagagtgacaatctatttcctcacacatttaaccacatatccctaggttgtgctgctagcatg

SEQ ID NO: 5020 - DNA, 700 bp, Nannochloropsis_gaditana
gcgggagacggaggtgaggggcgccacggtgatatacgctacccacatcttcgacggcctcgacgactggccttcgcatctgcacttcatgaccaatcagggtcgtaccgggtggcaggggaagctggaagatctcgagcactaccaagagctccgcagggccggcgaccctgggcctctgctgcgcatcgccgagaggtggctgcggacagagacagaggagcagaagcggcggaagttgcgggagaaggagcttgggactcaggtgctcgacgacaagctgtcccaacccacactgtcaggaggaggattcgcagcagggcgtatgtacgaccatttccatgagggtgtctgatcttggagggcatgggaagcaaataaggcaaataaaaattggatcggcaaaggagggaaagtcccttttgctgcactaggggatgaaagtagaacttaaaccgaaaatattggtgatattttatgaaggagtgggaaaggtagccaaaaagaaacaaaaatcgtactttgaatgaggatttccaccctttctgctaaaacctggaggatgggctggggcaggaggttaaacatacgcactcattggtcgtgaccctttgatttgcaactaatgccacagtatggatctcaacaggggagcctactggttgtgcacctccgcatgctggtatcgctgggccatttg

SEQ ID NO: 5021 - DNA, 700 bp, Nannochloropsis_gaditana
ccgtccagtaagctttaaagaaggagggcttgaggcatggggacgcacgtgcgtggtggttcgtctgcccgaacacgctctttcgactgacgttcgtcacgtctacgtttacccccaaccccgataggttttaaagggcatcaatatgcggcttaaaagaggtagccggtacgttactcctccatcgtacacgcctgatgtgtttggtgaattgtggtagcatgtacgtcactctctcatcactcatcgcgacctagacatgtttctgagcaatgctgttttagcattaatgcgatgcttctactgtaacctgaatcagacatcttctcgacattcatggtatctagctgtcaaagcccaacttttccttcggaaagagacatggtggcttcgtgccacctcgaccgcgggtgccatcgatccaatacatcttgtgtaaatttatttgacttgccctgcgcaagccatctgaacattcattatcaacatgaagcttgcataatgcttatatgaggtcttttccgtgacgctgccacttgaatcgctcccctctccctaatctcccttcgcttgtcccccccaatccgttctatttccaagatgccttcttatcggcgcgaacggagcggggaaaagcacactactccgtatcctaggaggacggcacttgactaagcctgacgacgcggtgaccgtgatg

SEQ ID NO: 5022 - DNA, 700 bp, Nannochloropsis_gaditana
cgtcgaaaagggtgccgtccgatcccggtcaagagggactgcgcgtcgtggtaggcgcctatccccgcgcaccgcgcgttcagcaggtcaggaggccagaagagctcaagcaagcaacctcgccccttcttttcgcagcaacggcaagtgcagaactttgagcgatatgcaagcacttagcagatcttgcctgtggtgtgcatgagcaccagtttggcaccttattttggaggctgacaaagccaagtctgcgagtccgctattggagcctcatgcatagtcgttgcaacaaagctgcatttttctcgatagtttcagtggggtccttgctgtcgtctacgaaccgagtcgagaagctttgtcggattccacgggcctctctgactttgaaagtggctcacattctaagcagcagcctctcctctgttgcggagcgagagagcgaatgtttgcgctttcgccattcaccgaaaattgtcttggtgtgcgacacagacgtttctgtgtctgttgatgaccagaaccggcaagctccccgtgtggactgaaatgtgcgctgagcgacctacgaaggattgcgacacatgcgagtgatgcggcgcctgacaattccttcactggcagagctgcggacgtgggctatgcccaggcctggtcactgcaagaaaggtgctggcgcatttcagcattcatccagatg

SEQ ID NO: 5023 - DNA, 700 bp, Nannochloropsis_gaditana
cggctgtgcatgcgcaaattaagttcacaaaatgttagcatgatgccagtggattatatgatcatatttttatacagatgcagtattgacaagcgtcgcaagtagaaactaattttctttcacatggatcaaaggaggattcaagaggagcgagaacgcgcgcaggcgctaatagtagggggctaataaaaacgtttaaatctgatatatattccgaatctatactcaatcaatcctagatttacatttctaaagcgagaggcttgaagaacattatattttatgcctttccaatgtctacgcgttcctagtttcaggcttaacgagtcctcgttgaagtccaggagcggcccccagcgagttcaacgggcagcaatgcacctcggaggcaagttcaattttataaccttgtcgtgtgatgtgtgactcccaacctgttgccatccctaacgtaccaaacgtgcttctttattttcaaggcacggtgaacctgttcggcacgtggcttctcttggccatactaccccttttgagccggaggggcaatatcctcagccaaggaatcctctgctaaaagcttcctcacctctcccttctctgcactgtttgatccgacagaaaactagcccttacaaaaacgaactatgccttctcttgtgacaaggaatctcatcctctcgcttgtgctgctgtcgtcatg

SEQ ID NO: 5024 - DNA, 700 bp, Nannochloropsis_gaditana
gagagaaatgcttgtgggtggaaaatcgctcgaagtggtggtggtccctgtcatgcaggtggcagatgtccaggcaacttgcctcgttgtctgagcgacaccgcgactttggggtgtgatgtggccctctcactcagttgcgtccgatcctgctatgttaacaaaaagtgtcctggctgaatactcggaacttttcttttgcgtggatggtgcggaataaggtagtagatgtgggtctacacgactcagagaaaagatcgtggaaagccgccaaccctccttatccgggcaaacatatttcgtggtgcggcgttgagactattgctgaggaaaatgcgcaataagcacgctgcctcattatgctacacgctttatgaccgtctttcttgtcctgtagcataggcattatcctcttcctggtaattgcctgcggaaagtaattcaacttgccccccttctctgtgagctaggttgagtttgacgccgcagcactaaggacttttaatggcaccatatgaaataatcttgtctcatttctatatcctcatatattgtacttcactagtgatttctcgcaccgtgaacctgccggatctggtctccaaggtgttcttgtatttgcccgacagagccgctccagagagcactggcgcgcttcctcgcttttgagcaatccttattgacttcatcaagcaatatg

SEQ ID NO: 5025 - DNA, 700 bp, Nannochloropsis_gaditana
aattggtccaatgccgcccttaagcgctccagtgaccggaaggatggggacaaaaaatgttcagccgaaggcgctgaagaggagggagggagaagctgctgccggggctccacctcgtcggagatcatgatgggtttggtgacagagttgaaagggcaaagacaggaaggcttgttcaacgatcgataaccatattggcccgcattcttcaaatggaattagggctttcacagaactatgtagtgtatattcaggggtatgcttggttttcgagatagaatttgcgtgcttgctgcatgtcgctggcatgttcaagcgtggaagccgcctgtcgctagcttcgccaggcccaagcgatggggggcgctgaggactgttgcccaattgtcgggcccgccaatacggtgtagtgtgtgaattaatataacataatcaattcacctcttacattttttcttggtccctgtatcgactgattccgcctcaaccactttcgcgaatgatctcttccatattggaccatgcgtcccacagccaggaggttccttccttatcaacgttccctccaagccacgcaagcacacaatattggaagcaggaaaaatccgtcaggctagcgtctcaatttttaaaagtgaagtacacttcctcaagcggcccggccattctcagcgcgcgagccaaatttctccgcagcatg

SEQ ID NO: 5026 - DNA, 700 bp, Nannochloropsis_gaditana
tttgccccctttcgcccgtacattacaatctcacagccctactgctattgttcttgtgactgtttctctaattgcgtttttcgttctcgctaataggctccactcggaggcaagcgccgcaagcgcgtggactcagcgtccggcccatatcccgttcctctcgctccctcctctcgctttggagcgagggctcgggcacgtacatgtcacacacgggcttcgattcctctcactttaaatccgcatgcaataagatagtgacgtttaatctgtttcatgctgtcagtatggagtttagagctgcgttagtgcgagtaggtacaaatgtgactttctcttgggggtgagctttgctttcctcaagttaccgtggggggaatgcgcaggagcctgcaaagcagatgtttagtcatgtggtgccccaaattaatggctcattatggcataagacgttttagatgaatgacactccacgtagttgacattgtgattgaatttttatcttgaccgttcttcacattgatgaagcagcatgacactcatttgctactctccctcttcagaacgtcgctgacccgacttgtacatcgttcaggtgtaatggagcctggcggggcaggattacttcgtgaaagtacaagacccttcctgattttctcaggcatccatatttccgtcgttttgattctcgtcctttatg

SEQ ID NO: 5027 - DNA, 700 bp, Nannochloropsis_gaditana
tgaggcacatagcacttcgctggcacccccgcgtgtaggcgtgtcctcatccgtgtttggtttggtacgtcggttaccggagaggcctgtgtggctgtcacgcgcgacgaagacgggggagtgttgcctcgtgcctccaggtgctttgatgacgcgcattgcgcgtttcgcttatccaaacaccgcaatcactatttgaccatgcaatcaggttgatagggacgtcaaagtgcattttctgcctttaaactggtcgcgcgggtgtacatgtggcatctggacgggaccctcagaacgaagaaaacaagatagggatggctaagaattgcacacgcccctcgtgtggctgaaagacttttgcgccacattaacgcgtaaacaaattgagctagtcttacagttattcaggaggaggacaaaattatgtcgtccgaccgtgtgttatctaggaagccatgacgcgagacatatgcctagtatctctagtacggctgcgtcttctttcctccctttttgaaaggaagacgtcggtgtccgcgattctattttatgcgaaaggtgtgggaggtgcattagtcgcgcttttcttgatagttgaccgtctggctgattcagggaaatcctcacaccatcctgtctttctcacacgacagcctcttctttcggaatattcccctcaacacctaatctgtaaaccatg

SEQ ID NO: 5028 - DNA, 700 bp, Nannochloropsis_gaditana
agtgatgaggggatggcgggaggaaggggaacaggaggagggggggaggaaataggaataagggtcctgacgatgggcataaaacccttggccatccataggtgccgtaatgaatccctgaatttcatatgggaaaatcaacaggatgacaaagcgcgcaagtgtggcggagcttccatgctgtccgggcatggctaatgcttccccgaccccttaactcctcgtcagcccaaaagcgaactcaacaattgtctcgctccctgcagtgtgaattggaaaatatgagtaaatcagaaacatttgctacaactccgggtgcaaggaaggcctacggctttatccatggacgtggccttggtatccttgtgtccctccttcgggtcgctgcaccccgtgactcacgcacttaagaccctgcgttcaagccaccgaactcaattaacctgtgcgaccccgcttaacaggtatacagtccttctttgcttgagtgtatttcattttgataatcccatggaaatagtgatggcaatctgtgctctggacgggtgaggtttgggttgatacagcctcccatatgcttgctagccctttcactacggtcatgtttcctcgctctctccctacacgatacgaagtagctcacaggccaaacgggatggatgcactgatcgaggcctttgtttgtgcctcccagaaggtt

SEQ ID NO: 5029 - DNA, 700 bp, Nannochloropsis_gaditana
accatcccgacggccggaacaatacaatgtcgattaagtcaaagccactatatgaaacccatgcggagactgaaggtagagaaaagcagggttcgatgcgcagtcactcgaagatggtttttcggccggcctcgctccaaatggctttaaaaaattttccgaccgacctttgaaaaatgccataaccctcataaacgagaccacacgcgcatggaccgtggaggtctctgtttgcggccccctcgcaagcgatgaaccaaaaacatctacagtgtatttgattagcttcaaaaaagaggctcttgttctttgtacttgtgtgcctgggactaaaacgtgaattgtttggttttgatcggtgcccgatgtgggacataagtatgttactcttctccttgtcgaagtgaagtacatgttggcgctatatgtaagggtgcgaccgacatgtagggtaaaaaagatgatttctcgtgctacgttgcagagaggtcgcgcttaagtggacactatgataatatttttcgactcgcgtctctcgcttcttgttgaaactatgatagacaccatgaccgctctttatttttgtgatggctcacatcgacagagttgcataccacaaaggaactatagaggacgaaggtctgataggtggccggtgaaccagcgcgggctgcattggttgtaattttatccaactatg

SEQ ID NO: 5030 - DNA, 700 bp, Nannochloropsis_gaditana
aaatatgctcgaaatttgcagtccttgctcgttcacggtatcaatgaggcgttgtagtatttgctccgcacgctctaagctcaccagaccacgcgcactgacaccctgcaaagaggctggaaaattaggatcactagctggtagggctgaagctatcgaggcggaggaggcagacagcattggcttttccacagctatccagaccttttaagccttgttgcggggaaccttgaggttagaaaggaaaaaaggaggcggagtcaaagaacatctgtaactttttcgttccttaactccaacaaggggactctaaggaagtcaaagaattaaaagcgatcggtgcgaacaggtggtctctcacgttgcgacattctacgttgtgttatgtgaacgataacatccgcctcaacgaggggatcaagttctgcgcgtggtacagtgtgggagggcggcaaactgctggcccgacagctgtgacgccatgatccttccgcgcgttactcccggatggaaaggaggatttctcttcgtctctccctcgttgtgctatcgtcgttgacagttgtggacatatctatcatagtaattgaattctaaaaatgtgccttcatggatgccattggtaccgcgggcctcttcttcccaacagagctctaagtcagaggagccgcacagcacggactccaggagccccgcaatg

SEQ ID NO: 5031 - DNA, 700 bp, Nannochloropsis_gaditana
tgccagagtatgaatttgatgttgctgctcgcgtcctccaaaaagcattgtcctccttcgcggtcatcgacgattgtacaatggcccggatgggctacttcgaacacgggagatcctcctgcacagcgtggctggccccgcaagaagcgcggttgagcgatgcagagcttcgacacgaagaagaacttgccagcccagcaccgcatccgagaattatacagctacaggctgcttgccaagctgcgatacctcactgcgccgacctgaccgcctctttcggagggagatttacaccgcacctgtccataggccagttccaggatagaaagggcgcgaaagatttcatcgactcggtcgactgggttgcagaggccttcccagtgcgtcagctgtacctgctggcgagaaacgggcctacggaccccttcagtgtgcgctatatcgtccgcttggccggcggcagcgtgactagagtagagcccggtacactcccacgccatgcaggcgctaccgtcgccgatcagggtttctttcgcctgagtgctgacacaaagaacgcaacacctcctgcccgcataaacccagcagaggtggaggtagacgggagcttgctagaggaggggggcaagtcctgcgcacttccctggccctaagcatcttactacgaaagcgccttcgcatcagctccattcgatctggt

SEQ ID NO: 5032 - DNA, 700 bp, Nannochloropsis_gaditana; identical to SEQ ID NO: 5021

SEQ ID NO: 5033 - DNA, 700 bp, Nannochloropsis_gaditana
aaacaatagccaggtggttatgtgtatctgtcgaccggtgtgagtgtgtgcatgctgtgttcggtcccaggtttcccccctaaacagaaaagacgacgaggtcaacgaacttgtccaaaccttgtacatgcataatccccgctcaactcctcggcttggcacgggggtgtattccatgtgggggttttcatgcggaagagcgaggccggtcgcccacggcggcgactccgagtcggaggggggcggggtcgggaggtgagtctgccagcactttgatacacaatattttcacgcgctttgtctcaagggcattccccgccgcttaaggcgtgcccttagaagtcttggaaatgtagaagtgaccgcaacccacgcagatggcggacgacttgattttttttaacggagttgaatagggatgtctatcggatcgagcagcgtacgtctctcactcaccattgatgtggtttgactctaggcgtgcacactctgagttcgtaccacagagaggtagtagcgactttcatcactcagaaccaggccatatctcccctccctctttttgaatttaagcgactgtgcccgggaacatcgacttgtggaagtcgtacgcgccctgcttcaggattattactggtttcaaataaaccacgtacaggacgcaaccacccgcgtgcaagcttttctaaagttgcacatg

SEQ ID NO: 5034 - DNA, 700 bp, Nannochloropsis_gaditana
gaacactgaagcacgagcactgtactgctcactcctccacccggtgtatgtccgacgcaaagacgacgaggtacattgacccgcgagaaaaaacatccaccaacccacaagccgttgattatcttgaatgccacatataattattgggaagtacttctgtaaagtttgatacaggcatgaaaaacgtcataaattaatcccagacgtggttgcgaagttcccggaaccttcctacacgaactagtcacaactgtgcgcatgcgtgcatatcttatcatggaaatatcggtcgagtgtcttgtaacagtgttagatgcccttttcctttaatttggtgcctacggcaccccataatcattccatttccgggtggctcggtgtttcaaccgtctgtttaccaggcacatactaattcaccgcgtgagtatccgcttgttctgttcgtacttttgtgtattacgcagatgtaagagaaattggcgctatcttattgagcacaccctgtagaactactgcatttgatatttctccatgagtggccgcgaagggaactcaaaagtgccgtcactcgagggccagtcgactatgtaacagtagcggcacagccgcgctttgctccagtaatgttgtcagcgcgtacaattaactgcatgatgtgaaggaaataacccgcacatccaatatcacaccgtgcgcaaac

SEQ ID NO: 5035 - DNA, 700 bp, Nannochloropsis_gaditana
ggacgccaccttgactggcttttcgtgcgtaagtgatagaaattatcccagagtgagcacttcttgcctgtcccctacaggcacgtgaaagctagccacgacctctgtcacctcttttccattgatggaagggccggggcagtttggactgggcggtggtggagatgttggaaacggggctgctgcgtccactctcctagacagcaacttccctccccccccggtattcgggtttgcacgggatgactcgattaacctggaggatgttttcacagactggttcaacgaggacaatttgaatggtccacccactgccttcgggaacaaccaaggtgtaaattctgaggcacagccccaagagtatccctcggcggtcctggaatcgaagccacaagcgccggttcctcaacagcgcctgcctcagaaatacctccaccccggagacccgaaaccggtggggatggtgcccttggacgggaaggccatggtgtcggagggggctgggagagcggaaggggaaggcggtgtagaagaggagggggaggaagagttcgaggacgacgacggaggggacagcatggggagtggaggcggggggaccgggggaggggggggcggaggcgcgcggaagaagaggccccgaggggggagccgcggagatggagggaatgtgtgggggggtagcacgagtcgccgtatg

SEQ ID NO: 5036 - DNA, 700 bp, Nannochloropsis_gaditana
ttttctgtgtctgggatatgacaagggcgtggggaacacatgaacaggcggcaagaacttcaatctgcagggaaacggagcattccacatgcactgtgcgcgaggggtcggaagacgtggcttgggaactaaaacatttgatgcgtcatcaaccggtaggcatcttatcccacgttacgaccgcacggcgaaataacgcttgaagcagcctgaatgaatttcgtgccctggtcctgtagcacggacgggaggcgtaatcgcatctcaacatacaagggcaacttgaacgacgttgccgccgcgccatatatcaacacgacatcgacactgtaacaaagccacgagagcacacaaataacgctgaagacatgtattagagcgattgcaaggcgaatgggcagcacgtggacgggtcggccagtgtccatggctctttctgttgggggcggaaaaaatggatagtaggggggaggtgagactgatcgcagcgagatggcgagtcccacccagggccatcgagatctgagcaaaaccacggaaagagggcaccaggtgggcgatttagggttggaatgtgggtttaatagcaccttttcttgaattttcttttttaaaaaatagggcacaggtaaacaggcaaggaacaattcgctgccactggaatactggtatcctgaaaacgtttcttaaccaagacatg

SEQ ID NO: 5037 - DNA, 700 bp, Nannochloropsis_gaditana
tctctagaaaatacacgaattgacacgaaggaactaatctggagaagccgggcgattttgcgcagcgacggcaatcaggatatgggcatgtaaaacgtccgaaagatttttgcgtgcttcgacatcacttgtacatacccgggaaaatatgaaaaaaaggtggcgacgcatagataaccttactgccgctacgtacagtacatatttgtgcagaagcagatgttatgcccacattcttttgataatgactagttgatttcattgaaataagattcatccactctaaaattttcagattgcaagatgatttttttttttagacaacagcctcttcttgtgggaaatggattccctgtattgcacatttgtacatatgtaagcataggtcctggatcactcgcacccactttctttttgttttggggggagctttcatattgcaccatttgatctcacggcgaagtgcgtcttcattctcttcgagcgcgctgccaggcttgcactgtgtcgtaaacagctgtttttcttctgcagaacgtttcggtcaattttattgcaaaaaaaactggatttttggcttcaacgcttaacggccaggacgactacggtgaaagaagagggagaggactctgagtgccgagcaacaacacatgcaaatctccacgtccaccaatcgataggctgtgcgcatagagccatg

SEQ ID NO: 5038 - DNA, 700 bp, Nannochloropsis_gaditana
catcgatcagctttcgttctggcgggtgatttatacaaagacctccaggaagagtggctcctcaatctaatgcgcaagctcgcgcgcggcctacgcctcttggcgcagaaagtggacaaggagaaggtgcgattcgatcccatcatgaacgaggccgtcaaagccatctcggataagtttcggctcttcggcacggtcacagccagtgggcgtcgacgggtggctctgatgcttgcgaacgaacaaataatatgctacctgcagctgaacaatcctcggcagtgcaaacctttgacggactgggcggacgcccggcacaagctcacggacgatgacttcacgtccggcgagtttgctcaagcggatgctgtcacataccatttccttcgggcgcgcctttttttgctcgacacgaattacaaagaagccgagcgcttcctgacctatgcgttccgacactgccccgctgccgctcaccgcaacaagcgcaccatcctctcctacatggtgccggtgaagctcaaccttggtttgctgccacgggtaagcccagcatgttctagcctgttctagccaccccgtcctctcgcaccgtggcgtagtctctcatgtgcccgcttccccaaccccacccagcgcggccttctcgagcgctttcagctcaaagagtttgaggcgctggtggctgctttgcgcgatg

SEQ ID NO: 5039 - DNA, 700 bp, Nannochloropsis_gaditana
tggtattgctcgggtcgaaagttcatttcccccccaccattgcgtcgcctgtccatatgacaatcgcaaatctttcttctccaatgctcatggacggcatcacggggtatatgtgcttctgtagaaagaggcggtacgcgccagacgtattagaggaagcggcccatataccctgggagactatctcggcccatgcttccagccctaccacgtcgctggtcaaaacgccgggcacaatcagatcacacagcgctggcgtggcccctggccaaagcgtatacctgggagaaaaaaccctcagagctcctatgacacacctcccacggctcaagccatggaaaaaggcagttcggggcggcgtaatcggatataaaatttctgaccgcctcttctgtcagctaaactaggaatacgcacaatttcctccccgcgcttcaggcaaaagctcggtcagcccattttcaccagtccgcgggcatcctcacacgacaaccatacatttttttaaaaataggaggaggaggaggaggatcatagcagagcaagaaacgtaacagcgccacaggtactgagtttttttggcccttggctaccacggccttcccaccttcgacgcattttttagtcaggtctccatcgcgggtgcgttaggggttttccctccatcgtccttgacaaaggaaacaaagtccccgaaatg

SEQ ID NO: 5040 - DNA, 700 bp, Nannochloropsis_gaditana
aaggcaaagtcacaacaactcagtttaaaagcgagcacgattacgttgcgcgaggatgtgtgaggtatgtgcagcgtttatgattgccgtgaaggctgtctatcatgaagcaatggaacagataaatgcgcggttcatttttctccgggagcagcaggattttttgctgcgccaccattcgattaaattgcgacatactatgtgccatgcgctcgcccaacaaaaacgaggtgttcaggcaaacttgcggacagacatctgccgcaaaaaatgtacactacgaccacagagaagtgtcacatccatgcagctgaccaagagtcaagtaactgcatgttttgaatgcttatgaattaacttaatgggcacaaaagtggaaatttcccgcggggtggactatcagcccgtgctagactgatgactggatgagcgacatccatcacgccaacgtaacaaagcatgattggatgcatttcatggctcatgcactcgaccacccatcaaatgtgtactcttttatggagcgcatgacaaaagtagtggtaaacttgtgacctgtgcctatcctggctttcgcggaaaaagcgatgttatgtccgtaaaataggccacctactactccaatacgacagtcctgtggacacagcagcaatgaagccgtcctcacacaggtctcttatccaatgtacaggcagttatg

SEQ ID NO: 5041 - DNA, 700 bp, Nannochloropsis_gaditana
aatctctgctcagtcaggtgacggaggcgcgggaagaactggctcgtttggtgtcacagtcccagctggaaatggagggcttgcaaaggtccctgcaggcagccggtgatcacgccctcagcccggaggactccctcccaaaagagaccgtggaggccgtccagaccgcctctttaagcgtgactacgcagctgtcggagtggaagggcatcatagccgccaccctagagtcgaaccgtctcctgaccgcgcataaagcggaagtggagtcgaggatgcaggaggcacaaaagattctggaaactgttgaaagcaccgctgccgatgcagcggcagcaatggcggcggcgaaagcggacgtgaaggagggaggcttcgaggggcagtccgaagtggtggagcgtttggagggagagctcgagtccctgaggaacgggcaggcgacgctcgcggcagccgtgcaacggagttttgaaatggtgcagcaagctcgttctggcatggcgatagaggcagagaaggcgagtggaggagaggagccggccggttcggctgtcttggcgggcgtcaccgcagaggatgtcaagcgatgggtccgggaaacgctctcggagggccaggcgctgcaggaccaggcaggggaagaggtctgtgcgccagaatctgtcgcctccctggtggagaggaccgtccgtctgta

SEQ ID NO: 5042 - DNA, 700 bp, Nannochloropsis_gaditana
gttggtggaagtgtcggagccaactgtctgtgtatacgactttgtattgatgactccgttggcatgtactgaggcagtattggcccaagcagaagagagactgaggaacttaggtattaagttgccaaaggatgagccgagtggcgagaacgtagacagaataaagcacgatgaattctgaaagcgcagcggcgaccaatagagtggctcaggtagaattttgttaggataactctgcaaaaggtttaaaggacagaaagagtagcagagcaatggcaaacaaagtgacatattgtcggcggggtgggagcagggcatgaacggctcgatttgtttggcacggttgacgttcgcgccactttgacctggcggtcctaccgcatttcccttacgctcgcgatagcactacttatacctggaacgacgccacatcctatatccctccatgtccattgcatggactgctccctggttggtttgatcgtgattttcctgaaatgcttccatccacgcgtacagggtggtgggccttccctgcgccgctttctcgcgtgatcgtttaggtgaagtccgttcaaggcagcaatcacacaacatcctgcggtcgggagggggcgcggaggggggaattgtcgactgccttttgcctggtcacgaactttccattacgctctcccctttgtgacgtggattagaaatg

SEQ ID NO: 5043 - DNA, 700 bp, Nannochloropsis_gaditana
cggaagttgagggcgatagaagagaggaaagaaggttgggagaacttttggtggcttcgagagaagcgaaggaggagcgtcggcaggacgaggctttgccaaggggagcgagagggggaggaggaagagtccgttgcggcccggaaatgcctgagagcgagacagaaccatccgcagagggggaaaaggactcaaacgacatggacgcggagttggcagacgaaggtgaggaccaagaaggcgttccttcggaaggcgctggggtcctccaccgcgtccgggtctccttgccggccttggaggccgaggaggacccgctcttgcacgcgatgcgcgctaccattgccaccgatggaagacgctccctctcgctccaagcatatttggacagcgacatggccgcctccgccaccgcccaggcggcttccaccctgaaaacggcgctggcggcttgggaacccgcggaggtcctggagcttaatctgcaagccctcggtgccctcatcctgggccctttttacatgctctcctgggctcttcgcctttgtcagaatgagctgtgggaggcgctgggcaagctgacgagtggtgacaaaaaaaggcatgtgcagcagggctttgaccgggggctggagggggaggtggaaacctttgaaacggccctttcccctggattgaagggtaagcttgaatgggccct

SEQ ID NO: 5044 - DNA, 700 bp, Nannochloropsis_gaditana
ctcttttcccattgatacgcagcatgtaaggcaatcgacatttcaaggctccattttttcttagattagcaggctcttgacgacacacacctccaactagcttcttcaggccttcaacgagcagcagaaaacgtgtcgctcgtttgcacgcgcgcaggcatcgtaagccggcacctgagccctcgttgtcctttttgactgatccattgacgaaactattaatttgatacaagctggtgcttatcgttacaggggctccaaggatgaatgcgcttgtgcacaaaggtgtattcgtgattaaaaagtaaggggtcaggaggttggaagggggcggagacggtacatactccttgatttatctagtcccacaggcgcaaatgaagcagcaaagacggtacatactccttgatttatctagtcccataggcgcaaatgatgcagcagagacggtacatactccttggtttatcttgtactacaggtgcgaatgatgcagcagagacggtacatactccttgatttatcttgtcctacaggtgcaaatgaagcagcagcaatccattgcttattaaaaagaagaaatttgctgcgcggtcatttcatggacagtcgattgaaattttgaggccttcttttcctgttccttgattccctcccgcgccataggtgcttactcccagtcccctggacgcgagccatg

SEQ ID NO: 5045 - DNA, 700 bp, Nannochloropsis_gaditana
cttcgagctggtgaattctttcctgggcaaaagatttgctgagaaacagcaggcacaggatgccgcccagctggtgggggatgaggctgaacttggctttccagaaccagaggaagattaaagtcaattgcttactacatgtaaggaaaataaccagctgaaaggtgttttctgtgtgccggttttccaagcgtttggtagaagaaaattcaattttccaaacaaggactcgactaggaaggcacaagtaaagggaccaaataaaaatatgccatttttccagatactgatgttgcgaagtcgcttcatacactggcccgcaatatcctattacgttttaggagcagctcatgcaacctcccccatgcgtcgttgttcttcaaccaagagcgacgccgccgaagaaaaacgtgctcttctttgacacgcttttccgcgcagtgccattccatgatcattgtccatccgggtcggtcttcgagaattattgatttcgatcaatggccagtgctgatgagtggatcaggtgttgaaccatttccttggggatacatgcaatatctgtgatgagggagtcgcgggaatacgtgcctggatccccctggcatgacaacctgaccattttcctcctgccacgcgcacagacacagagctagcgacttggcctcttattattttggttccgactccgtataccatg

SEQ ID NO: 5046 - DNA, 700 bp, Nannochloropsis_gaditana
gaacgaaactcacccggaagtcatgcagctgcactgtgtgtgacacggacctaaagggaacagcgctgtcagccacggaaaatgcgctcagcagttcatggaagaggagaccatttttgtggcatattcgttccgcttcgtccgtgacaattgtccccaccactagcactggccgcctgccttcaccctgcctgcgcccgccgctgcccagcagcatcgcgactttgccagccgcggatcaacgtcctccaacgtttcctcccttaggacgccacacctgtcccagattgaacacagccgctacgtctgatcttcaggctgcgggtaaaatggaaagcgtcagatttttgaaagctccaaaacgcgtgcgtgagattcttgttccttggcgacggcctcgagtctgccagcgagtaatggcctctgaggtgcaatcaacgccaagtttgcgcccctgtgcgcccgtagcaccacactctttgcatcagtgttaaatggcccagctcctttcatgcacatgtcccctcatcatgcgcgtagtagccgcgtgctagtaaacctcctccgtgcttgatacccagtcgaatgatttttattcttgtaacgacctctcacttcccccatgtaactacggacgttgttggaacgagttcaggtttttaatttcgtggacatccgcaacgtgtgaccgcggccaatg

SEQ ID NO: 5047 - DNA, 700 bp, Nannochloropsis_gaditana
tcaagtcttgaaagctaatagctcccttctctccagcgtcgaataaccggaaagctttaaccatttcttcgcgtccatctttctcccccattttaactgtcatcatttccacaaacttcttgtaggttatcgtccccgagttgtcgtcgtctgccgctgccgcgagtcgcatgacctcctcttttttgggctcaaagcccagagctcgcattgcaacacgtaattccttgctatcaatgcggccggtgccctcagtgtcgaacaattcaaacgcttccttgatttcttgcctttgctcttcggtcaactggacgagctttttcgtctttcctgcatttttatatgacatattgattatctccggacttctttctgtcgcctggtactcgtgctgtctgtcacaagcgaaggatggagtgtggtaatgaaagccactgtgatcgaggatggcgcgggccaggttaaaaattgaagattcgtttagctcgggtaaagtttaattgctgaatgatcggccacacgggcaacgaaactttcaggacgcaataggcacggaacaatcgccgctaccatcttccgagcgagagccgggcctgtcgccgttacctcgaccacagcctgctgatgatccattttatatatttcctacttgtaacacagcgaggcttcgacgaccgcagtaattgtcgtatttaacatg

SEQ ID NO: 5048 - DNA, 700 bp, Nannochloropsis_gaditana
gatcattcatagagaaagcgctctgtggcgtcaacaaaaacacgtatgcgttcgtattctaaaaaccacccaataagaccagagagtgccctctccgttcaccaaataggcaccagcgccgtgccaggcgacgacttgggccggttggccacgcatcggggtgttgtcgtggtcatggccgactgttccatgacgtgatcgagttacgtccgaaacgcccgggaacgcccagcggaaaaggatgcggggtgttgtcgaggctggacgcactcctgattcggattcagacaagcgtgctttacgaacgagaattgaacgtaacgtagtgggctgtttgtcgactggtgccatggcgtgtattgccgtagcgttgtcgttttgtgtgatgttaacagtttttccggggcaagaagtcgcccgcgcaaggcaattctcgaagatcccgcgcggcatgtgaacgagcaaagccgacggatcaccgaaagctacagagtatcattaccaggattatatcgtgccatccgagctcatcagaatctatttcatgtgtggctcattttttcgtgtaggatgcttacaatttttgtctgttcttgccccttgtgcctctttgtgtatatttttccagatctggctcactcttgtccatccccgtcatcaggtgagagactttgcggacgactgttccagtttgcagatg

SEQ ID NO: 5049 - DNA, 700 bp, Nannochloropsis_gaditana
catcttgtcgattaccctactacgcattgaaaagccttttaaaaaatgcagaaggccatatctctcgccgcttgcacgaaatggttagcctgggagctccacaagggcgacgagggcaggctggaaaaagtatcctcggcaacaacgacgatggtgcatttctcgcgcacctccacgtcctgtatttcacataacccacaaagcttcctttcgcatattctcaaaactcaactcgtttccttcctcgcaattaaatacgaatctagacttttcggaggacggtggacaaggaggagtcgtctgcaaggacagatcctgcttgaagaacagagtgccaaaaaagagacagctcatgggagatcggaagtcactctcctgatgagactataagaaggatttctggcacaaatacacaagtgcattacctaacacactacaactctatcgtagcttgtactccttgctccggtctcggtggtacgtgtgtcagtcgtggggtgcattagctttttccttcgcatacgacatgagtacagggcggattccagatatcgttcctttactcttctacccacagcttgctacatttcacatacacatctgattgcattgttcttagatatatgttattcaatcatgttcctgccgctcactatcatccacacgcttcaatggcgcaggtgattctcttagcaccatg

SEQ ID NO: 5050 - DNA, 700 bp, Nannochloropsis_gaditana
tagaggaggtcaccccttatcgtcccttcttcacattccaacagctgtaatatgtgatatttgttttcaggtgaaagaaatggatcctgctttcatttcacgagtccacgtccatcaacctttctggtcgctacgtgatgtttcatttcataaaaaattgcccaagagcagtccttccaaagcggtggatggttcctgcagactgacgcagcggtaaagtaaatctaggaagaataacatcaagaagtataaattcggcgcctttgatttaatgtgaccagatcacgtgcgcatcccatgcactgcgaataatttttctttgaataaatctttcgatcaacccaatccgatcgggcgtgacgtcatggtccccttccttcaaatttaaatcacacggagccacccctcacgtccaggcgttgctcaaaagagttcaattgacacgactctacacgacaaaaaatgcatacttccggtccagttgcctccttatttcatttttatggatttggtcggtgtggtgcgaattgacgggcccttcgcgggttttaaaataccattcttgtgcactcgaacgcccatgcgcgcgataatgatgatgctcaatctgagtgtcttgtacatctcattggactcaaatctcgctgctacacaacaggctccagatcaggcttcgcccttgtacacattttgtaacatg

SEQ ID NO: 5051 - DNA, 700 bp, Nannochloropsis_gaditana
tcgagttttaaatgcttggaccgtcaagacctacttcaatccggacgaatactggcaaggtcccgaagtggcgcacaagctagtcttcggatctggattgctgtaagtatgtatgggcttgcttgccatgcgcatgccagtttgggcgagggcccattctcattgctacggcactgccactagagttaatcttcactctcctacacccacaactaggacatgggaatgggaatcagaacgcatccgttcgttcatccacccgttgctctttgcggtcttttacgccctgctaaaagttaccaacctagcgtcgcgcggggcagtggcctacggaccctccatggttgttcaagctttccttacggccagcacggatttgcatgtgtactggctagcaaagcgtgtcatgatgcatggtagtggtgatggagacgatgcaatcgcaagggccgagacaattgcccgttgtgccctgttttgtcagtgttccaactggttcatgtggtatgccggtgtgcgcactttttcttcctctttggaaatggcacttctcgtccccgctgtgtaccactgggtagcgcttgtcgaaagagcggaaagtatcgaaggaggaaatcgaaaatctccccggtacctgcctccgtcccgcgtggggatgacagaacccttgtccatagtgctgggcaccgtctccatcatg

SEQ ID NO: 5052 - DNA, 700 bp, Nannochloropsis_gaditana
tgatacgggagagcccaatatattaaatactagaaagaaaaaatttgccaaatggagatggcgtttttttttgttctttaactgaccaaaattatgagctatctacaccctagtcgctggtgacgtcaaagagctctaaatagagtaccctcggtttgtttgccgcagcggacgtggctagaatccttggaccatcaactgcacgccgtgatgtcgtataaattaaggtacactgcagcaattggtggtgccacgttggaccttcacatttccacagtttcctgcgtggcccatctcaaataaacatcttggaaaatgcggcatgttgcggagagtaatacactttaaataaagcgaataatgaatgagatcttggatatgaatgagctacagcgatttttcaaactgtagaggccagcaggaaaacatagctcggcgtgatgtcgctggatttaatttttaaggcttcccacgggggagtcgaggtaccgcgaacaggctggggcgaattctccctgtcttctcgctgggcgactttttcggatgctgggcttcgaggtttattggcaattacagtgccgcccgtcttctcattttcacgcttttatcctacacagctggcctaggtatacaaaaggataaacaaagacggtcatagcgtgcggcagcagttcgagcccagggctgtcggacctgcatg

SEQ ID NO: 5053 - DNA, 700 bp, Nannochloropsis_gaditana
tttacccgcacacatacacagagtgctatcaatgcatcttttatccctacgacagctacatctaggcgtgagcctaaacagcaaagagcacagagcgttcacagccggcgcagtcataagtatactggggttgctggcaacggctttcgcctcgttctcctcgctcaaaaaatggaagcatcgacgctatttaaaagagctcggtataacaaacggttctaaaaattgcattggactagctgttgatattggcagctcctcagtgcgatgcagcgcctacgttttgcgggtagatcgttctgtcacgtttgtttccggtactctcgcacagattaaaagagacgccatcgaaatcgatggcacggccgacgccgaaaaagttttgcatgatgtagaaacatcagtggatgaatgtctgtgccgccttagagcgatggatttggcgcatttggtgtcggttgtgggtttcgcttcgtttgtgatgaacttggtgggggtggaccgatcggggcggcccatcactcctgtcttgacatacgcagataggcatccgagcactgcaacatacgcaagaaagttgcgacaaagtatgactgatcgatcgaacgacgcgtctcacctagagcggccatttaatcaaccgtcagggggtcaaagtagtgaaaaggagacattatcgggaagcacagcgatggcaatg

SEQ ID NO: 5054 - DNA, 700 bp, Nannochloropsis_gaditana
tcgcatgcagagacgacaaagacgagctgcatcccatccgttatgcggcaggagttcgatttgctgatggcattcaagtggtagcctggcaaaaaaaagggctagaatacggcacaactatcgatgctgtggtgcagctggcccatgccatggagtggcgcagaggacaaggcttaccagggccaatcctcttactgcagagcgaccaatttgggatccttcacgctccttctggccatgctcgtggttttttaatggagtacgattatggagatttgcccttacttgtccacgagacaagctcgggcaagctgctcactcttaccgtcagcgagaccgcgcccgagcgtccaataataaattttgagagcaggacgaggaaagaggacaaggtccaataacagaagcaaatggaaatagaggcaaggagactactgtgttatgagtaccatcttaaagcaaaaagcacagtattgcgacaacacccttggtaacctcccctcgcgacgcccttgtttccgcgaggcattcctcgtacttggtcttcgtgtcacatcgtgttttttccgaacatcttctccaccgcgaataatgacgactttctaatttattcgcttgcttggtacagggatggagagtggatgaatttccttcgtttaactcccttatagcgaggacacagctcatcagccccgatatg

SEQ ID NO: 5055 - DNA, 700 bp, Nannochloropsis_gaditana
agctaaagcgcaatagttctgccgtcacatgttttaatgggacttctaaaaaaaatgcctgaattatgtcagtcaatgcgtataagcgtatgtgaagtcgttttgcatattgctggaagttagcatcaaaattaactctatgtgaactttcgtcagatgctttagcactgcgtgaatgataaataaaagaaaagtttgaatgtttcatacaatatcgcgcttcggcacctgtgtatggaagctgttgatataaaaaggaagacgacacaggaaagaaaataagctatcggtcagaattcggtacaaactggtgctgatgatgccatgacgtttttattttaggggtggggcttggcaaaggcgaatggagagaggaggttgcttgctgggctggggaggttaaccgacgaggaacacaagtgcgtggcagctgcctccattcggcaaggaccctgatttggatgcacgaaatgtagagcataggaagggcagtgtcaccggcgtgaacatgacattcttgatttcacaagtgtaccttgaagggcactcggacgctgtgcgctctcaatttgtctgtcatggaacaaagaataatagatgggtgacggtacgtgctggtcggcttagtcacgatcagcacgagtgcttccacgtgacacctggacaggagggcaggcatgcaaagattgcacccgccatg

SEQ ID NO: 5056 - DNA, 700 bp, Nannochloropsis_gaditana
aggagaattgaggacgccagtggctatcaaaggtaccggtaagaactgagcggacgctttaaagtagagctttagtgggatatcggtgaggaggttttggggaaaatatcatgaactgactaaaatgtggaacctggaccaaaagtagtcaaatgtcattgaaaattctgacttgtgcgaaggaagcctgtccataggtaagacaaagcaaaatcgaaataaaacaatttctcatatcgtatatgttaccaatgcttctccttcactaaatgtttacatatgaattgcgcctgcaattatgattttcgtctggcatttgactgccgccctatctcgacatacaagacataaaggtgccctgaagtggtacattatgctatatttcttatcccaaaataaccctaaaaggggtgagaatgtaacggctagccaaatcagcagaagatgacttctggcgaggtaaacgcgggccacgggacttatcccctgtggtacagtaaaaaaagcgcgctcgactctgaagagacatttctggatgaatgctttgcatggctgtcttgcttcaagtgcacgggctttcacgcttgggattgtcgaatgatcgtacgagacgttcgaccgaataaacctcccagcccccaattttcccttttcaaggtcaactgcagtagtctgatccgaaacacatcgaccaaaaatg

SEQ ID NO: 5057 - DNA, 700 bp, Nannochloropsis_gaditana
tctgggaagactgcccgcacgtacaggtcctgcacctgctgaccatacgtgtacgtcttgttttgatacggtccttgcagccgaaccatcccaaaaactggaaagtgcctgccacgcacatccgtacgcgtgaccccaacatcaacgaaaagcttgcggtgccccgttccttcgtacaagctgatgacagtgccggaaagatgttgattgacgcgtagggaagatagagcatggaccccaggtctggccacgggtactttcgtgtgacgccgccacggtgtttcatatggtatgcgcatgctcaatgtccttgttgactgatagacaaatgaatccccgtagttaagggtcgcagccgccaaaaacatggcaattcttatcattctgggatgcatttctgaaggccaacctcccgtcctctcccgcagacccgaaacccaccctggcaagaaccgtggttcctgttgagctccgatggtagtgtacgacagccttcaatcctgaaaatgagatgattgatgcaaaaatgtaaaacctccatgtaagcacaacataaagaataatattatagaaaagtttgtgcgtatatgtgtcgcccgcatcgagccgttgaagccgttccgctccagtatcatacgatctccttacagccccgacttgtccaacccctacacgacaatcacacgaagaaaatagaatg

SEQ ID NO: 5058 - DNA, 700 bp, Nannochloropsis_gaditana
tgggtcgcgcattcaagcattggggggcaacctagtggcttcttctatgattaccagccgccacaagattcattccgcgtctcatttcatgagttcaagctgacaaacgccttgatctgggcgttccactttatctcgttcacgaattcaaagtcgccacacgctgacttaccgtagtgcattgccagtttgttgaagagaagcatggttccagagcatactgagtaactcgcgacagccaaagggacgcgcatatgcgccggtaagaaatgcattttcttgttctcttttcgtggtctcgaaatgattgcgggtttatttctgctcgattattttgattcttgatcctgtgttggtctgtcgtgtacaggttacgtaatggcattggaaaaagcaaggagaatgtactgtatgagctcgcccttaccatacaagacaagagctattttggtattcttcgtccagcaatgctatcatcgagacaagccgtgtctttcagcccccttgatagcttttttttttagcgggggccatgggccggtcgggcgtaacctctctctctcttggatccgagccgcccgagaggagggccccggcctccctccgccctcccccgtgtgacagcatggatgcgcccaatgttctcgacgccgactgtgttgaccatgctttcctgtttgctctctctgttcttgggaac

SEQ ID NO: 5059 - DNA, 700 bp, Nannochloropsis_gaditana
gcgctttattgaagtcgctaggttgcgttttcttggcatttttatgttttaattggtgactgcgtccttcaacgatgctataaaacttggatgtaggaggactgcactcataattgatgaacttttcatgtccgctttttcaaaagtagcgggtgccggaatttatctgtgtagatcattatttagattattatttagattataatttagattactaaaaggtcttacatccatcctcatggtgacaggacgacttcttgacattttcgtggccgaatacttaaatattcaaaaaataaattaaaaatacaaatctcatgcgatatctccatcgccctgggcggggggaggtcgaggagcgagcgacatcggggtaccagctaaagtcgagaattatgtgtagttcatagattgaaattttaaacagcagtagtatgtatgtaatagatgaaattatgacatgtactgttttgttgaaatgactaatgtcgcactttgtcaaacttcaaagagaaagcagcgttagcgtggctgttcctcttcgcacaaaaaccgcaacttacaaccttcatgcgaaagtctcgtgtacgaataaacatttctggaaaaacacattattggacaggttgaaataatgtctaccactgttgacattccctcagcaccctcaaagcctgaagagaagcatgaaccgctcctt

SEQ ID NO: 5060 - DNA, 700 bp, Nannochloropsis_gaditana
tttttgaactgttcttgacccgcacaacgtatctttcatgtcataaaatagccttccatcccgtttcagggtttgccctcccccccccccagtacgcatggcccgacggtcgcactggctgtacgagtggttctttattgccgccttaggttcgaactggctccaaagtcatgcagggcgatggggtgacgcaagattacagggtaagtctatctcatgggataaagtgcctcctgcgacaactcatatcccccgctcgttccaccacctttcccccacagctgccacactcaaaccacgctcattacttatccgtgacgcaagacactcagcatcaaattatcgtcgagcttctaatcaccgtctggctttccatctatggggcaaacaccacgagcacgaaggcagggctttggagcgctcgactgtttggcagcgcttctcgaataccacaggcgacgctaccaattcaagctctaccaccatccagcaattgggctcctttagtacgcgaaaaaatcccgtgttcggaattctctcccaggaggaccttgcacttgacaaagtcgagcaatgcgtgtgcagatgttgggggcagtgcaagccctttgtctcaaccgccgccaaggccttggccggtggaactatgtgcctgtttggggctcattacgcgcggtgtgccgtcgtttttcataccatg

SEQ ID NO: 5061 - DNA, 700 bp, Nannochloropsis_gaditana
tgtgtcttcatgccaagctgccgacaatttttgctgaagagcgaggccgcccggacgatggcaaaaagagccatgtaacgaagactattggtggatcttatgtggcaatcaagacaccaccactgtcacacagagaatccgcgctatgctttccccccctcggtccatgttttgctcaatatcccgagacagctcgaagcctgtgaccttcgaatcagcgtgggagggcgcttgccccgcgatcacaggcatgcgtgccctccctgcacactcccggggcctccgcgccgatggtcaagcagacgccgcgtcacggacacgcaggacaagctctcggccggcttaagtgtactgaatggatcttgtcggattttgacatagatccttgggcagttttcaggccattagtactcgaaattttcaagaagaatcctggtgtagcttcggaacacggtctcggaacgtgcaatgttctgcttccggtggggtcatgacacgcataggtaagcacatgaccagcagcaacaatggaagaggccttcatttgagaaagctttcatatcttgatgagggttagtgaaaacctgtttcctctatggatttttctttggctttgatagcttctctcaccaccttttaagtgcccacttcaagttcatcgtcctattttgtgtggcattacaagaacagggtaaaaatg

SEQ ID NO: 5062 - DNA, 700 bp, Nannochloropsis_gaditana
ccgagggcgggtctgtggtggagccatcaattgagtagggcgtgctgctagtcgctggggcggaagcattatacttgaggtggaacgaggtttgagaaaggtcgccgcattcttcttgtgggatgcctttgtggacgcctccgccttttcacctgccgcgggcgggaggtccccgaacaaatccatgacaccgtatcgcttctcttcgtcaaactgtgtcagaatgcatgccgtttaaatgagattctatttgatgaaaacgcgtggaagggcagtgcaacctcccgtctgtggaaagcctgccgccctcctggggcctcgcccactcgcttcttgaagacgctggacaggactggcgcggccgtgggtgggcactggaatgaagaaagtcttgatcgggcttgacagacataccgtatgcacttaaagtcaccgcgcaaacccccggatgctattcttttcgtctctcgatcactcattttctgcgagatagtactgtgctgtcatgcaacctcctcttcctcgggagtttctccctgtattattgcaaaagctcccacgttttatacccataactacgttatctcggaggctaacttacttgctttctgtgaaatatgtatgcaggcggagagggctgtgaaatttgtttgccacattcgtcacacgatcaagtggtctggttggggacaccacgatg

SEQ ID NO: 5063 - DNA, 700 bp, Nannochloropsis_gaditana
tgaaagtgtgagccggttgcatactgaaggtttgaccttcttcctttttcttttcgcattccgtaggtggacttctggagaagcccaaatgtgggttggatcgagacgacctacgtggacgagaagatccgcatcggacgatcccctggtgggctgggcggccagggcagtgtctttgtcttcgttcgggagggtggagctgggatgtggggcgccatggagagtactcgctagcctctgtgactggctaggacccttgggtaaggcgggtgctgccgagcggagttagtgtaccccattgtgacggagaggatagtgatttgtaacatggaagaagctgaaaggcatgagataagctataagaagcattcgaacgaaaacgtggggaaatcaaaagaaataaacatagagcgcgatgaagttaggacagcgggtaggcgtcagaaacgaacgaaaatgggaacttcaagatgaatgttttctcagcatctcagtaatactaaaagtattgtatttatgtacctcatagctaatccttcactgtggaaaacgagaggcggcctgtatatcgctggtcaatccaacctcctgacctcataaaagcctatcgccctccgcaacaggtacttactacccaaccggcgtggaccacactttcaccttcaaatgacacagcaacaggccttggtaaagcgaaatg

SEQ ID NO: 5064 - DNA, 700 bp, Nannochloropsis_gaditana
tgatttactgtgagacagagcacaggcaagcaaagggctcttaaagagccgccagagcagggcgggggaggtcgctgtaacggccagtaacggccaggccggcgcctgagcaaggcggtgatgaggagagagggcctctctcctcatcaccggcccctccacgggcacccatccctcgtccccactcctgtgccgcccgcggccgaagccgccctggtgacgatgtcaagctggcaatgggtcgtcgtacggcttattcacgacagtcgagaagctcatcgccacgtcttctgctcccctctcgcattttccacctcttgttctggaggaggactgactacgaaatggtatactaagcaggaagcttcctcttcgcttgtggtacttgcgaatagacgtgtccgacacacctgaaggagcttgtgacttgggtacttcattgctgttttctcccttaaaaactgtactgtcacggctatagtcaccctgagcacgtgtcacgcacgcaacgaaaatgttcctgttcctttctacctttcaaaacacccgccgtcatgcgaagctcctcctgatgcacacaatagcaaccacctcttcccgcaagtttatttgctggtggactacaagggcgttcgaagcaaaaactcacaccagtattcccctttccatttaatacagcaacatctttgtcggaaaaatg

SEQ ID NO: 5065 - DNA, 700 bp, Nannochloropsis_gaditana
atttgttctacaataccggaaaacagggccagggccttcccacgccgtcgcccggccgaggcgactgaggagatgggggcgaggaggctcccagctctattgatagaggatgtggtgccccctgctacatgactaggcaaacgaaaggcgtgtgtcgtgaagaggccaaggaggatgagggctaggaggaagacggggaggtgggaaggcaagtgcaacgctcggcgtctccaggacgttgcggtgggtgagctaagagtcagcgtaggtagctcgaagattcgcatcttgtgataatgaataaagtggtcctgtcgtagatgtaagacgcgtcgatgatgtgagagtggccttatcagatctgaggttagcgtctacagtgcaagtctcacccaacctgacccctcgccgcgccgagaaacctcctctccgactttgttccattgccacgcgcactgtccgagacgtcggacacggcggccagggctcgggtacattgcccgtgcatgctgggctggatgctgccgtcgtgcctagctggttttccaaacggagtaactgggcagactgcgcacaggcgtcggtgtgacagagcgtctgacgagactagaaactgtcgaagataaaagcaccaccatgcggataactcatttaatttcgtacgttcgcacatagaaacgcggttttaggtacagcaatg

SEQ ID NO: 5066 - DNA, 700 bp, Nannochloropsis_gaditana
ggcattgcccaccgctgcccatgtaagaggatgcaactgcaaaaaatcgctgtgtatcaagaagtactgtgagtgcttctttgcaggcgtgtactgtggtgaaaattgccagtgtgaagggtgtcagaataatcctgaggcctccgcgggtcttcacgtgaagaaaaaacgtggcagcacgactcacggaaaagggcaacacccgaagcaggtccaacgccgacagcaggcatccccatccctgtccgactcgcatgaccttaccccaactcgtgtcacgggaacggcggtgatctgaagacaatgagcagtctgtatgtcagaagagagagcgagggataagatatgtgacacagactttgtacatcatgtcattttgggaacatgaatgaaaaaagcgacgctacgggtccaagaaggacgcattctagcgcagtatacatatctatagatatgatcagaaagtagggaaacaatgtttggaaaataggcagcctattttgaatcgaagcgggaaaatacaagcgtgtagttgcttgcagcatgtcattggataaggaaaccgctatggaaccaaggagaaacagtgtgcagaccgcagtggagggaagatcagtagaaagggtactacttagtttgatctatacacgaaagcaaaggcgagacgccacgtaatcctttatttagaaaagaagcacct

SEQ ID NO: 5067 - DNA, 700 bp, Nannochloropsis_gaditana
atttgcatgtacgacaaaggattgccgcgcttatagcaaaagatgacctgatttcaatgctcgcaccctttctgtcggcagggcacacatggtcggcaccgcggatgagatccagtttgccttccaaactggaaacgaggtggccacgccaaccgtgacatccaccacgaataataatactgcctcgctcaatcttgcccccccgcctctgccgacgcaggcccttatgccaccgcccccaccacgcgttcgccctccgcgtgagcaggaaggggatcttgagagtcaggggcatgagggcagtcgacacgagcgaaaaggtctcgacgatttccaggggctagagcaacatgagcagcagcaacagcttctggaaagagaggaagaaattgacccgcacaatcagcacctgccggtggcggcccccgaggccttggggggcggggacggcgccctcgctgacaaactcaacttgatgcacatggtcatggtcgacgcggaatgcattatggaaggaaagggctcgctcatgggcccgactacccccacaatgcaaggggtggggatggagagctatcctcgctctttggtgatgggtttgggggcaggcgaggccttcgacgcctcagactcggatgagggggagaaaggggaatgcgaggacggtggaacgggggagggaatgtttggaaaacatttg

SEQ ID NO: 5068 - DNA, 700 bp, Nannochloropsis_gaditana
gccgagaaacccgctgggaccttttttattcagcatggtcatgctcttgagtgagctttacatttttccaatacgatataatgtgcacatttataatttttatttttatttgaacttggggctcggaaattgtgttaaaatgcataaaccagggcacgaacgagtcgacatggctattggcctctgtcgctcgatcattttcgggcttcgcgccaaaatctcaatgagtcacactgctagcttacaccacgcagccatctatgtgatccatcagcatctgtcagggttactgaagtattcgtgtgcagaaaaatttgtcatcatctttgtttttcttttttttttcagaaaagcacctaatctgctggtgggggactgacaaccctgcgtgcgctccggcgccatggagatcggccctctcggctgtgtcaacccgagggcgcccgtgctccaacgcttttcacgcttcaagtacaacgtacaagaccaatgtgtctgctcccccaggcgtatactcacatatcaatattgaagatcaatttaaaacatcgagagagctacatttatccgcccacgtgccccgattggaaggtcacgtaaccaaagcagccagagaccgccataccgccaagtaccgacgtcaacatcaaatcctcccccttttttcccttcgcaaatcagacgcagacgatgtaccatg

SEQ ID NO: 5069 - DNA, 700 bp, Nannochloropsis_gaditana
accgagatccatatacatattgaatgaagctaggggggaatatgaaagaacaaccatgtctgcctaacaagtaagatttcgccttcagtatgaataccattcgattaaaatagaaaacaggcgtgccatgctataacctttcttttctcgcctgacatgttagtcaaggttaaaatgtcgcggcgaacattttgccgagtgtaaagtgcgaacgatgcgaacatttactccgcatcaggcacaatattacaacaggtttgtgatcaatgtgccgtttttagtaaattttcgaaaggttggagacgcggggtaaaaggagtgaatcatgcagaatcttttgccgccggcggagggactctcgggagcagcgatctcaagcggacgctaggcttttccttgcgccgcgctcgcagctctggctaccttttacatcgcggtcacgacatgggtgcgacatgtctctccctcatgcacacgcgctgaatatttttcgaatgtgttcgggctgggataattatcagcgttctgtttaagcttccctttgatcgcccgatttccctcagcgacggaaaggctgccaatgatcgcaccacagaaagggggtttaccgaaagcagtttgtctattcgtcggcccgtctacctggagtcaaatatttaaagctcatctcgttgacctaacacaccacatctcattaagg

SEQ ID NO: 5070 - DNA, 700 bp, Nannochloropsis_gaditana
cgctcgtgttaatggcctgttgtccgcatcaatgaggctgactcaccgctcggaaactctcgatcagcctgccaaaatctccgtccagatgctgcatggtgaaccacgtgatgaaaatgaaaataggggtcgttcccatgagaaagagaggtcccaaactctcgcgaccaggcaggaggcccgaggatttgccattcttgttctgccacatgccctgagcgcgcttgtatttaatccggatcagcgaccgaccacaccgtcaaggcgagactcctggaggatttggtgagaatgaaaccgtcacgcggtcagttcttacgatgatgcaggcggcaaccctcctccctccccctgcttgctcccgtcgcccttgtaagaaggaacaatggagggggcggcgattcccggcgaggcagaggcggggactggcgacctcttcctcacgcactcgtgaccgccgcagcccgcccgacacggccatgttcgtctgacgttgtcgccctcaatttcgatcccgcctgttctagacagcccacacatagatagctcgcagcgagtgcgtgaggggcaccgtgagggtgagcagccggcataaggggattggcgagcaagccgaacacgaaaagacggcgtgcgtctctcagcaaccctcaggagcaaaacctaaaatagacattgaaccgcacactgcctcgcaatg

SEQ ID NO: 5071 - DNA, 700 bp, Nannochloropsis_gaditana
accctcgaaatcaaacccaaagccgggtatcattcccggagccgactcgtccctcccgcgcggcgatttaagtttcaggagagtcgattctcgctcatgcagcgctatcgctttgcggtcttggagacccaggctctggagcccgagtggggggatctcagggagggccccaactggggatactcgcctccggacctcttctcaggagaggtggagaagatgacgaggacgctgcaggccctgattcggaacccgcaaaatttttttcaattttttgtgggtccccggctcgtgtacggtcgtggagagcggcaggtggggctggcgcggaatgcggcccgccagcttttgctcccagggggggcatgcgccgagggcttcggggccgagagcgaggaggacccgttggataccttgatggaggcggtggcgcaggtgctgcagcaagaatgcttgctgccccggctgctgagcttgcagcgcctggacgtgcttgacgtggagggggcgggggccgtaatggagaggctggtggagctctgtgggggggaggaggcagcggcccaggcgctgctgcaagaggaggtcttgcaagctcgcctgcttaggacaggagcggaggaggaggggccgggcggagagtcgatgtccgcgatggcgcggcgcctggaggcggcgctgggactgggcccttgcggcg

SEQ ID NO: 5072 - DNA, 700 bp, Nannochloropsis_gaditana
agcgagaagaaaagtaaaaacgagtcgctactcggcaatatgtagttactccctccttgtaaagtgatgtgtgcaaatgaaagcaacgcagctagggcctgcacccctcacttcattgatgtgatgatcttgcacagtttttgcatcattactcgtccaatgcggcgctgccagcctggcacttcccatccgtcccgtttgccgcacgaggcgaggctttgaagggattagcctgggaactcactgtacgcgttgagttcatccacgtgtctcggaacaaaggtgacgctttgatcctttccttggactgtgctgtctcctagtgacgggttcccccctcttccctcgcatgccgtgtgaatagcacgtaagacctgctatctcatgccgcgcatcactgtgcgcacgcagtatcacacgagggacaagtacaaagttctgttggtaggaaaaggggccgcatcatctcaaacaatacccgtaggtgggttatttctggctcttcatttcccgctgcaacctcctcccgaatgtgtgcttgaaaccctaacagtttgtcagacaaacagatcgacaatctgtccccttttttgctcgacacaatctaagtaagcatgtaatttatcaatatctcactaacgcaactacctaccattggcctacaggccaggctcacggcaatgatggagggaaaggagga

SEQ ID NO: 5073 - DNA, 700 bp, Nannochloropsis_gaditana
agaggcttgctcactccccggaactcaccttcccagccccgcagcccgcgggctatggctcggcaaatattccgcgcttgattctcttcagattgcgaaatagccattaaaatttccctgtatagttggaggatattattaacagatagcatggaaattttgattccgcggcaaagttgcaaaccaggaaggagcctcagggggggcaggaggttatttgtcgcaacgtcttccattatttgtattattatcacagcctgcttgggtgtcgcacaatgtcgaaatacgtacaatgatgcgtccagcatttacagtcagacacttccattttcaaattcgccgcagattctgcgcaagagtgcttttccctactggtagtttgcatcaaccggtgcagcatgcgtttaagagactgggcgtggcctgtgggcatcattgccacactttggggggcatcgcatctagtcttacggcgtgcctaccctgctccacctcctggtaatcaagccatcatcgtgatctcaggtgacgatgacaatgccataattttctcgtggctccttcaactcctcacgcccctcgcccgacccgggtcctccctatcccaggcgcctccacgggcattgggcgtcacgctgcagagtatcttgcgcgtctaggtttcactgtcctcgccggagtgcgaagggaagccgacatg

SEQ ID NO: 5074 - DNA, 700 bp, Nannochloropsis_gaditana
tagccgctaataacgcgcaccaaaagaaaacatctctgccgcgaagagcccacgacgacaaatttggacctctctggcgtttgggggtgataaacgatccatagtctctgcgcatcccatcccagcccccgctatgggtcctgtgtcatattgctttcgactgtgagattaaatcgtgctaaacgcggtatggatatgtctgaatcgtttccccttcgcctgtgccagacccgcccccttcaagtcctcgtccgctcttagcgcttgggccgcgggcgagtctgttccgagacgaggttggaaatgaaggctgcgccacagcgactggcgcgtgtccccctccaccgtgataaattcgatgccgtactttttcttcgagccatgcgctcatcgtggcagttgttgcagtgcggcactgtgctaggccgtgacggcaggggcgagggtctcgctgaagcccaagacgaagacgaagaagcactcaatgccgtgctagccttgctgggaccctttgtcctgcccgcgctcacccagtggattcgtgaaagagtctaacgagaattctttgcccctagtacagcgcggtgtctatgtttgttgtactccagagcttacgcatgagagatcactaacttcctgcacccccttaccgtggacagatagcccttgctttactttgcctttcctttcttccgaaatg

SEQ ID NO: 5075 - DNA, 700 bp, Nannochloropsis_gaditana
tttgcataggaaaatttcttatcgttgaattgtgccttcttacttctcatgcactttcctcaaaattcacgaggggggctttttgaggaacaaataacaaggccgaggggacccgttcccgtaccttgcgtcgcttatgacattgtcctacaaggatcttgttcttggtaagtgcgtgtgtatgtgtgcctttgtgtatactgtaccaccgaaagtctcatgtcatgcaacgtacaaggctatattttgctggtgactgaaatacaacagtgtttctcatcgtgagatgactacaggacggcaattgtcgagcaattctatttgaaaaaagcaaagctattttgatcggcatgctcatttcaagtgacgtgcaatttcttatcgaagtgcctttcggaggtcgcgccacggccgggaaggaattgcagaacctacgttatacacgtgcaaatgaccacaatctgcataacaacatttacacacactgtacattttcgcgtctcttttctattggacctggagaaaatactatctcacatcttagcgcattcaatcacgcgctctacacccaggtctttgtgtcaatgcggacacccacgacgatgcagaatgcacgcagcagagtgtaagaaccagagatattgcccttcagggaaaagggcagcaacttgtttgtataaattcacctaattctggcatg

SEQ ID NO: 5076 - DNA, 700 bp, Nannochloropsis_gaditana
acgcagtagttttgagtgcaccgcagcaagtcacagatgaatgtagctttccaaaaaaatcacattgcaagtgctcgacacatccctctggtttgatttattttccctaagttgaatatacgcgatggctgaaggatgtgttcctgcttccttgacacgctttcctactactattgaaaatatagcccaaagactgtagtttttgcacatgttgggccgctgggtggagtgtgcaggcttggtaattggttaggggcgtaaggggtggggaggttatagagtgggacttgtctggcgggatcgaccacggccctcgctgctccatctccctcttagcaggtgcaactcttctcgcacgcttgtagtggcatcttgtcttcgatgcgagcaccacaagagaatgtatgtatcgaatcatcgagtcacgcgaggcattttcaatccttgctttggcggtctttcatgggatttatcatcgcgaatattagatgaataaaatgaccgaggcacgttctgctatagcaacttttcgcatgagcatccttcgcaatgtcttaatattttgatcttcacgctatcgtggagcgtttcaatcaagtcgtctgtccaagctatgccgcaaacgcagagtcatttctgaaaacggaactgcacaaggataaaagaccctccctcttcgtaccttatctcaggaagaatg

SEQ ID NO: 5077 - DNA, 700 bp, Nannochloropsis_gaditana
agaaagaaacgtgcgatatgcatgtcttccagggacactacgttgttgctgcggacgggtcttccagtgtcatccgccataaagctcaaataagtatgctcggcgagagaggtgtccagcatcttatgaacatccatttttcctctcgcgctttggcgcaggccacatcacatcgaccagctatgctgtacttcatttataacgcagaggttgtttgtgtattagtggcgcatcactacccatcaggggaatttgtggcccaagtgccctactttccgcctgctcagtctcctgaggactttggccctgtcaccgtgagggcattgctagatgcggccattggaacggcgttcacggatttgactgtgcactctgtgcgaccgtggatcatggactgccaagttgctcagcgctaccgatctgggcgcattttcctcgctggagacgcagctcacagatttcctccagctggcggcttcggtatgaacaccggtattcaagatgctcataatctatcttggaaaattgcttcagtgttacaaaactcggcgaatggtgcattattggacacatacgaggtacgatatataaggtgggccctgctacttttttgggggggggggagaatgcatgcgcacattctggtgactattaatgttaccttatatatggctttggatgaaatgtagacagagcgacg

SEQ ID NO: 5078 - DNA, 700 bp, Nannochloropsis_gaditana
cgagtatgtcgacggtgactattgggggtgtaacaacagatacagccgtattggtagggttcggtagggaggataagttggcgagagcggcaatgccttcaatcatcctctcttttggattgatgggtgtaatgcttttgccatgctggatatagcaacgtaggactttattcccgaacttctctcggtttgtactagcccctactacggcaaagctggaagctgacagaaaagccggaattttcgcggcagacattttaccgacgattgtcgagcgtacactgcagcagtgggcgttgtcaaaagaggattctatgatgcggtgaagtggaatagccccctcctttgcggtgcgagagcttagcgaatggccttcaaagacagataagctagcaaatggaacaactgtggtggcgggagatgtaaaacctcaagatgtgtaaatagaaggtagacataacatttccaattgtccgttgagcccttgaaccagatgaaatagcacctgcaggatacgtggacttctttcgatagatccgactgaactagtgaatgtgcctcctatcgggatttgtctctgacaaactcaagaggataaagttgagacgcacacaggtacattttgaaaacatataacagaaaaggattggattacggtcccatgtactgtcaaggcgcattatcaatcagtatcaccatg

SEQ ID NO: 5079 - DNA, 700 bp, Nannochloropsis_gaditana
agctgacgtaaggttaagcatttggaatgaggtagcacgacttaaattcaagtactccgcaatccctttgccgcgcgtctggaaactgcgccctggcaaaagagacgagagggcgagaaattaacctccccccacaagttgtcgaacggagcgcgacacgcatgcgtttccagaccatcgagcatacgtcggagacacatcttagtttcctactgtaaaaatcgggaaaagacggaagtgtgtaccttgacactctatattgcctcttgcgtcgttttcatcgagacgcaatttctactgagtaatgcgttgattaacgtaaacccctccataacgagcgtggttctccctcgcatttttatcataaaatacgatagggcgccatgcaaacatatgatgcatcaggttctaacatgtcaatgctttggaagcttcaaattattccaggcaacgatcaactttcttttccgatccctgtttgccgatcggcaggctctttcttattaagtcatttacagacataccttgccttcacagagcctgcgaagggttcaatctttgcagtgttcgtctctactatatgataagcggataatggaaaagttaaaaccggtaaagcacgcacctgtgcttattgctggcgcaggacctgtaggcttgacgttgagcgccctgctctcacgctgtggcgtccaaaatg

SEQ ID NO: 5080 - DNA, 700 bp, Nannochloropsis_gaditana
cggggcccatcgtcaagcgcatttggtggcattgagtacgtccacggctgtgacgagtgagtccaagctactcgaatcagcccaagaaagagaaattggggaacacagaaattcccgaacattttccggtacttatctcccagggcgctgaaacctgctagaacccgcaaaacctcctgtgtcatgtttagaagataaaatcatttagcagcccgccgtccaaaaacgtgaaattgcaaagcgaaaaatgagaaaggaggctcaaagaggatacaaaggccaagatcagagttcaaaatacgtcatagtggccgtaagagggcagcagagtatagcgttttgtgcgaggctctcagcgaaggggacagggcgcgaagagcaggagaccggaggggctgaggaattagcctttgccacggacaggccagagatggccaacgatatcttgccgaccttgcttatgcgccgatgccgtgtaagaaggtcggtgagggtgctgatcacattcctcggggccgcgatgattttttcatgtcattccatcaacgcccatcgccgacagcttccacaagcgaggtatattgtacgtaacaattactatttaaagttctcacgcgaactgtacacgccgtgtacaggcgagcttcaggggatacgtcggaaggtgctaaaaacagggtgcctttttaggtgtcctatg

SEQ ID NO: 5081 - DNA, 700 bp, Nannochloropsis_gaditana
ggcccaaggagacggggtgtgcagcagttgcggcggcttgcttttatagacgttccaatacaaaggtgaggattccgaagaagcctcgacccgtttgcgactttgaacagagcacgttttggtccttcgtgctagagagcgtttgtctgatcccagctcttgctgttgcggttggtggggtccgtaagggctgcccttcgtgtccatgctcttcgccctaccatttttggatttccatgagttaatagcacttatctttttttccagaaacataatctgtttcatatataaatctataatgaatattttgacatgcgtgtctactgtttcattggttaaagtactccgggggaagggaagagaaggaggttcgggaacgtaattcctcctcaacttctgagattgtgtcctcaaatatctcacgcagttacgtcggctctatgaaactggcattaaagtttactttctaatctgaaattttaacaatttacgtgttaatgcgggatgcttgcagcctggggttgactcatgagtttttccgggggaggcttgggaaggtacgcgccgtccgagcctccgcgaaagcgtgccggacttcgctgacgccgggcacctagaaggaaagcatcaaatcgtacgacgttggctttgtgacgctcgtaaacaatctttttccattgtccctatctacaggctcatg

SEQ ID NO: 5082 - DNA, 700 bp, Nannochloropsis_gaditana
cttcgatctctgccgcccccacaaatctggatgaatccgcgcacatattcacaacaaccagtttcaacaagcaatgtccccccacatgtttatgcaaacgtgtattttgatctgctgaaacaggcgaaatcatgtcaggatcttctatcaaagtgaaagatgaacaaggcaagtcatttgatctgcctcttcgtagcaagaactctggtcgcaggcctccaaccactggcagcaaaaaagctaccacacccaagaaggtgaccacacccaagcgtgcgacccccaagaagagtatgtctaagcagagtcaacgttcaaaaaggtgagatatcgaagacagatatattcgcccggctcagacggctcatcgtgccactctgaaaatcaagagcactgcgaaaagcacgctttggagtagtcctctgtgatagtatgatggtttcacaactcttcttagacatcagattttttattcgattggtggaactgataccacattttgatttttgaccatgcatcaataagatgttctccccaaacgagtacagagtacagtgtaacttaattttgtcagcctacttagctaggtgtaatctgttgatgttggattgctgtcggtcacatgtcccagcccctcactctgtggacctttcattcaattttaagctatagcaaacaggccggagcggcagacttaatg

SEQ ID NO: 5083 - DNA, 700 bp, Nannochloropsis_gaditana
catgccccagtaacagttgatcgccttagtgccggccggaggagatggtttgctctgatagctgcccgaattttcatggcattctaagtaagtgatacctgtgcattgggtattgactggctttttatctctcaagggatagtacgaacattcaccacgagggtacgacaaagtgataccgcggcgaggcgtgtacaatggcagcactagccatggggacaaggggaaggggtgtgaaggagggcaatgggagcgacgcgctggtcccgatccctcatgctcccccagccacacgctgtccgtcttcgactcgggcctcaatggttatgcagggcctccttgggattcacaaacgcgtactcagtaacgtgatgtcttacgaggagctggctatgtgcagtcggccgtacgcgactccttgcggaacgtagaaggttttatgaggacctcgtatgcccggccacgaatttttggctgggtggcagcgaggaatgaagaggactccctttccttgcgaactacgatagtgacggtagcatattttcaaggctccccgcggtgtattccagaatggagttcacacgactacaaaattacgtttttgatgaagagctctctcgccactccctattttctggcattggtcattaaacttcccttgtgcgcttgtccatcatcacccactttgacagaaaccatg

SEQ ID NO: 5084 - DNA, 700 bp, Nannochloropsis_gaditana
cctgcactgcctttgaagtgcccggagcacactcgtcgcgcgtcggcttccgcgggtggtgagaccgccgacagggcttttgtcgcgaggctcgccgagagcatagaacttggcacgggagcggtctacttctatccccgtcttgcaacactcgtcctgactttgagtaaatcacaaatcacagggcgctcagagcagtttgctgcgtcttcaacctcaataagggaaagaaaaagtggagagtgacgggaattgaccccaaaaaaacttgcttctggtttctacccgcctcaaacctccttgaattcaattagccatgccccgaatggaacttatgggacggcattaccatattgccagcgacgcggtaaccgtgccagctttctgtatggcagtgggtaggctagtgtggtcggcggtggtgctaggtcttttcttgcacttgcagtacttgttgcagtcctgctcgcgccccggcattgtcgatacttttgttgggctctcaatcaccctctttctagccacggtgctggtggaactggcaattgttgcagtatcacaacgtggttctattgtgcatacgcaggcccggaaggccgtgggtccgctggtcgcattgcatacttgtctcggaggtgtgcagctcgtggttgccttggtaggattggtcatcctctccaaccccaaggcattggtcatg

SEQ ID NO: 5085 - DNA, 700 bp, Nannochloropsis_gaditana
tttgctcggttcgaaaagccgaatcatgcgggtatacagtagagaggatacgttcgtaggaatccagaggctttgcagcctcgttgcgccaaaaatagcccgccaaataacttgcaagggcaccgagggtccccaccacaatgatcgccaggctaccgtgcaagttcttgacccattcgctttttttggttcctattaacctatgttgcaggatattcctgctcgcagcagctcctttgacgtccttacatgaattcattttattgatttcattggtatccttattaactgagcgtgttgatttcatcatgggcgcgacctgtgtgatatgtgtcccgtttcatgagaggcttggaagtagcacgagctcacaatgagagtacatagcaagacaactcagcatcacattcaatgtatgtgaatacacgatccgtcaacctctagcggcaattgaatcgcacagacctatttggacaccccgtctcccgctccgtttgccagctttctcctcgatgggcccacctccccgcgttcccgcccctgaggagccgtgttcccttttccatcacaatgatcgcgtcagctgtcagcctttctcgctcatgatcgtggggcaaggagcctttcgataccacctcacgattcccttttgttcgattttttaaagagcacaacctacgtaaacatatctacaggtatg

SEQ ID NO: 5086 - DNA, 700 bp, Nannochloropsis_gaditana
atgccggtcccgcagcaaggcatctaacaccaccaccgtgtcgtccgcgtagaacgcccgggcaacagcccggactagtcttttggctaactctaaggggttcccgcctccagcccccgagaccttgctgctcgtgtgatttgaagtccgtttggcatcattcgctactccactcgccgcgcttccgagcatttctaaatatttctattgtttcctaagtaaggaaagacgccgaggagaactcgagaagtagaggggaggtcgggacggtctaacctgctgtgcgtgctttcataatctgcaccgtcagccctctggcaagcgactatacgtaatgcagaggcctatttgtgagttgtcaggcaccatctgtgagaccgagatatcgaaagccatggtataccggggcacgccccatgggacaaaagctctccgtctctccccattacttccgaccgtgacagggctgtcttgtcgcaaaatttacggctgctctttgtccttgactgctcccataccttaatttgcatgaacataaaaatctaatacctttatttgcatctctgttggctgcttttcctacatataggaaaattacgctagcattgccagcagggcgatctcggcaccctcaataaaaacgcgcacctcctagagcgactcagagcgcggattcagtaatcgtagccagaccaccatg

SEQ ID NO: 5087 - DNA, 700 bp, Nannochloropsis_gaditana
taatggagaggctaggaagccggcgaacgaggaaaaactctttccacaggcattcaggcctttcaatcgcacaacttgttgcatcacaagcagaatatcgcgcagtcttttatccattgatggtgttttaacggtgttgacttatatccttcggataccgcaggtagcaacgggtgttagcaccgtcggagcactacgcttcggaagatactgaggtagtccgggaagtaatcagtgacctccccgtacacaaggtaaggacaatatgttttctcgcgtgtgcatgcttcatgtaacatagtgacacaattatggcatgaagcttagggaagcttagggtagtggaaaggaagactgtgcagataaagatgccgttcgacatgcatcaacatcatgactcattactttccatccatctccttctatccatttggccgggtgaaagtccagggaaaagtgagagatggaggcattactgggcagagttgcaaagttaggtgccggcgtggcaggggccgcattcgtaggaaacaactttttgttcaacggtaagcgggcctggtcactatttcctcagacgattgcagacgcctgatgtctaagatcaagctgtaaggccgacacgcatgttctacaagtatgacaaggctcaagagatagataatgttgaacttaatcaactccatcatttccccccatg

SEQ ID NO: 5088 - DNA, 700 bp, Nannochloropsis_gaditana
cacccgtcgtagcgccggtggatgcttgagttagatgctcgaagtttgagtccgttaactctaccacctccgttgctgaagcgataaggaaaacacagaataaagttgcctgatggacatggagcgcgattacatcaagttaaaaaaataaactatgttttttaatcccaaacgagcccgttcaaaggaccactaaaagatttcgcccatcatatatttgacaattttttcccgcatccctccgaaatgtgataaatatgttacttaaatgcatcgaacacttcaagaaccatctccctttcgtcttgaaaagcggaccacatggactccatatggaccatctttcgactgcattgcacggtacacttaccacaaatgtggagacagtacagagggcggccatcatgcttcccattgtccacggcgttgcttggtttggatccctgcgagaatggaagtgagcgggcgggccatgggcgggtgcacggaacaagcgagacggcttgcccagagggagccacgggacgggcctagtatctttacaggcttgctttctgaaaacattgcggagccaaaattagacgtgagacccacactaatgcgcttattacctaatatgtagtgcagggatctcatcgaggcactgtatttgcaggtgcgtgcgggcgggccgcatcaattcaatcgtccgcgtcgcatg

SEQ ID NO: 5089 - DNA, 700 bp, Nannochloropsis_gaditana
aacctttatatcgtccacgcacaaaccaaccgggcacccaagcaacgccgacggacttatcgggcccacggtcgcatcaatccgtacatgtcaagcccggctcatctggaaattatcctgactgagaagcctgtgcccgtgaaaaaggagccaggtgctcccaagcttacccgcaagcaggcagccagggttcgtgtaggaggaggcaactgaagaggatgtcacgacagagaggaatgggatggagatgaggaccatttatccgttgtctgatgtcttgtgggattggcttaattctgagtgaagtcagtgcgctgccctcgctttggggcctccgcgagaaacgtgaggagggaggcttgggcgggactgtacttggaaggaacattcagagcccgcatcgcattacgatatggagaaagaaatacttgaaaaaaattggttgcgccttgtttcatttttgtgggcacgttgtgactgaccgcgtcgactaacctgctccgctgagaggtcgccggcggtcactcgccctcgccgagatccgggggcgatactgtcgggccatgtccgccgccgacctgaggaccacagatcatgcatgcacacgggtagcaagtaatgctttacttctcttttggtactatgtagtacatttccttcaaactagcgtcgaaaccatcagccgcagacggaaatcatg

SEQ ID NO: 5090 - DNA, 700 bp, Nannochloropsis_gaditana
gtatacttagcatgcgaaaacggagtggcctgctcttatctcctggaaggctgcactgaccacagtgggcagtaaaatgaagtaccagaacgagataatgccaaaagaagtaaccgagctttcacaatcctctcatttatcgttggcttttgccgtgcacgctcctgaaaggcctcgcagcgagtatcggataacctcctccccctccagataggacagtctgcgtgtagtgcaatgctagaggccgtcgcccaccacccgcctacacaagcggcggggaggcgatgtacaaagtgtcttcggcgcttagtggtgagcagcgctttagttgaagacactggaggtcctaaatgatagtggatagacttattgagagacactgggcggtcagagctagcaataagtggctgggaagagggcatgccggcaaggttgttgagaaggacgaagaagagtgaaagcgaagggcactcacattctatccatagacattcctcagccccaatgacccacacgccctctatcacgccatatgctagtgataagtggtggtgcgggccagccctcgattttatatggggtcataaggtccaagggggctgaattgcaccccgacctcacgccagacggtcatctctacctagctctcaaacacctgaccgtcttttctctttgattgacaatcatacaggaaagaatg

SEQ ID NO: 5091 - DNA, 700 bp, Nannochloropsis_gaditana
cctcagacgtcgcgaaaagggaagccaagccatggcgccagggtcattcaaaagcaaggccaggatcactttggataggcagctgatggagctggtgtctgccttagaggactgctccgatggggacgggcgggacgtgagtgccacgtttgagattgcgccggacccggaagcgtatcctgattattacgacgccgttttacaccccatggatctggagactataaggcatcgcgtacagaccctcttttacgtgtccctagctgacttctgcaaggacgtgcaccagcttgttcgaaatgccaagaagttcaacgccccgcggtctcgggcctatattgacgcagatttcttgaaatgttttttcgagcagaaaaaggaggaagtcttgcagaaggagaaagaatatcgtacccttgtgcaagaggaagaggaagggcaacaaggaaagagcgatgggttcgggcgggatggaggcgtgcgggcgaagcgacggcgttttgccggcaaggatagcgccgtctgtgggtatgatttgaacaggaacagcggcataaaggatattgacacaagagctggaaaagggaaacagaaactgaagcggaagggaggcggcggacccacaccacgattcacgcgccactcccacaaaaacaagaaagtatgccttgtctgtgctgccggtgaggatgacagcatg

SEQ ID NO: 5092 - DNA, 700 bp, Nannochloropsis_gaditana
acagcgaggaaaatatatcgcacgtgcacttcgctcggaaatgagaaacgtttactgcattgatctgtattgtgtcttcctacggatggttgtttttctcgctgtcttcattaccctctctcagcgactgagcgtgtcctcggctcctccgctctacctccagcaccgtggctcaaaaaaggggggggcgggaaatagaatcagtaaggggcagcagtccttcggtctgcatgcagcacaagcttacggtgacaggctacttccacgaatcacaatcgtgtcagaccccacgaaatgtgccagcacgcgggaaggctggcaagcaggaggaggcctgctcctcgcgccctccctcacgaggcctcagctccgccggccccccgtggggtgaattaggagagggtattccaacgctcaaatgcccgctgttccggccacggcacaggaaatatagcccaccgtttgtggaagctgcaggagcatatcttgccggtatgtagaaccatcggtctttgcattaattaacggagatgtagctggtcttatccgtgaagcgggttcgagatcgtatcctttgcaccgcctaccatgtcttgctgttttcctgtgaatagagcgcacgtccttaccaaattgtccgcgcactgattgaactactctttcttgtccaatacaacagtcgaaaccaaaggaaatcatg

SEQ ID NO: 5093 - DNA, 700 bp, Nannochloropsis_gaditana
aaccccgcgcgtatcccattatcagctagggaatcatgatttcatggctgtggctcatggctccccctccatacacggcgaaagatacgtagtcgaaaggcatgaggactacgcagtaaatggagcaatgaataagatgttaagcgatagcacaagtgccgaggagattgtacaagaaaaggcaatgttacaaactgaaagtacgaaaccgttgggtcctggtggtacacttgaagaccctaataagcccggtcttcgaatatctcccaacttgaagtgtatcgcagtgcctgagctgctgcgaaatagtatcgtaggtggcaatgatgtgggaaactcgcaggtttcttctgcgcaacctttcgacgacgaggacttgcaaccatcgacagaaagcgttcaaaatacgccaaccgagggtgtttcccagccgatatcattacagccaagttcagtgctatcctcatcgccttctgtacgccattcctgtcatccaacatcgagggacggacggacagcctcctctcagcatgtgtccaaggcccggtcatcctcagatacctttacatgtgaagaaaggcgtccagtgtgcagtcaagcaccttttaaatatggtcatgatgatcagactaatggttacggcagtaagagcgcaagtgtggtaacatgggagagacttgattcgacacagaagaccatg

SEQ ID NO: 5094 - DNA, 700 bp, Nannochloropsis_gaditana
tagcactcattattcataaaatccacacaaaaaatatgaagaggggatttgttactgctttgtattgtgtcgtctttttcttggttggacccgtaaaggataatttatatctttgaaattttggaaagagccaatccgtgaatccatgttatcgaatattgggaataatacttgtttgaatacataattagtaagttttagtaacagtgagatatgtttttattgcttcacctcacgccttggactgtccgtggacgcagtgcctggggacaagatgccggacatgacgatataaataacattatgctttgatacccggaggagcctggcggttcgagcaagcggtcagttgggggatggatgtgttctgtgtgtagtgggtattaggggtcctttcaaatcgcgtctcgcgcaaatcgatctcatgtgacgccttttatatctttaatgactctaggccgcgttggtaaaggacaattaaagcaatcatttcgagtaaaacgatgaaatcgccagcgcaagggaagcccgactcatgtcgtgaacgagacataaagctcccagggcagatggtgcacaaatgaagtgctcccgtctgtgtatccttccttgacagttttagcagcggtgtgatcaggagcgagcctaggacagtcgtgcggttccctttaagcgcgtctgctccactgccagcataatg

SEQ ID NO: 5095 - DNA, 700 bp, Nannochloropsis_gaditana
cggctgtacggagctcctaaatgccgaaggctttttgacacaactaaccgagttaggtagaaaaagcaaatggtgatgtcaagcaagaggaagagacatctatccttaatacttttgatagatcggggtatccgcagaattcaaagcaaagctatttgtgacttcaaagtactttaaggaaggggaaatgataaatcccatccaattgcatccaaggaggtatgccgatccataaatagcttcgagaacctttgggatttaccaaatggcaaggttgcttctatatgaatcttatttgtatattttggagacgagatccattacgtaaggtgggttaaggagcttgataaggtacatgcacgataagcatgggccttacgacagacaccaacaggacaaaacctacttgcgcccatggtgttcaggcgatcaatatgtcatgaaaccatcgtacttcatctcatctaggcaattttcacggccagcaataagttgaaaccaaatttaggacaacaggtgattcttaatgtcgatgtttcagctgctggctcctgcttctctcttgagagctggaagccacgtaccaccctcgacgcgaaggaccgcggcaacctccccatgtagtaccctccccaaatcttttgtaaactcctgcacttatactctgccacaccccatactacccctcagctacttcatg

SEQ ID NO: 5096 - DNA, 700 bp, Nannochloropsis_gaditana
gtctcctcgaaggaaaaaaatatcgaacaagctactatttaagtggagtaatcgagcacggtgcagcgaggccgccacagcgtttgagactatggccactcccattaaaagtccaacacaaaaaaatatgagccccgattctgaagtggagagtcacaactttgaaccacatcacagtgaggtatggagaatacatgagcggaaacggaggcaggttgaatttatcgacccgcagagcggccgacaacgtgccttcattcgatggatgcttaccgcccttttggcaattttaagcgagattttgtgcgtcgtaatcattgcatgcaccgtcgagttgcaggctctaaaatttgacacaacgctcaaaatcgcatctcatcgcaagtggtataccagcgtggcagctttctttctttttcttacattttctctgctatttgcggtggttgctggggtcgtgacgcttttgcagccagctgtaggaggttcagggatggcagaggtaaagagttacttaaatggcgtgaatcttcctcacgtaatgcacttcaacactttatatggcaaggctgttggggtaatatttgcgcaagcttcaggattgcctttgggattcgaaggtcccattgtctcttgttgcgcgattttaggttctttgttttcgcaaggcaaaatttggggccttgagcgtcgactttct

SEQ ID NO: 5097 - DNA, 700 bp, Nannochloropsis_gaditana
attcccgtggggaagtggttttgccggctctgtgagtacggtatggactgtcataaggtccgctgctccctctgcgggcacggggggggtgccctgaagcccaccacctcgggggactgggcccatatacagtgcgcgctttggctccccgacgtcactttcacacagcccgacaagctggagctgattgactactcccgcatggcccctgcgcgtcgcaccctcaagtgcatgatctgtcaggagaagaaggcgggcccttgcgtccagtgccccgtaggcaagtgccacatctcctttcacccctggtgcctcctctacaaggagcacccagacatctacgtaccgcccggggagtacgaggcctactgcaagaagcattccccgcctgtgacagtaaggaagccgcaggtggtcatgcgggtctttgagttttcgcacgggaagggaggaaggggggcccgagcgccgacagcggactcggtgcaagcaggaccagggggcagaggaggggtgggtcgatgtggcggtggggggcgagggggccgcggagggagagggggacggggcggatggcgtgggggcggccgcgacgcacctacggggctttcttcctggctgacgaagggcagtgcggcgagaagaggcggcagcggtcgagccagcccccgggagtggggagcaaagagcgtggcatccg

SEQ ID NO: 5098 - DNA, 700 bp, Nannochloropsis_gaditana
cccatcttctcagatagggcaaggaaatgcgtgatatcccagaacgtggacgctaacggactgatttcagcagcgttatgaagcactttgttttgaactatttggcctttgtcttaaaaacagaaatcatgagaagccctgcaacccctgatcaccaagacgagtcgcacaattttcggaccggaaaaaaggagggattggtgagaaacgtgacaagccctactgtacgtcttcgctgcccgtctcctcgaaggaaaaaaatatcgaacaagctactatttaagtggagtaatcgagcacggtgcagcgaggccgccacagcgtttgagactatggccactcccattaaaagtccaacacaaaaaaatatgagccccgattctgaagtggagagtcacaactttgaaccacatcacagtgaggtatggagaatacatgagcggaaacggaggcaggttgaatttatcgacccgcagagcggccgacaacgtgccttcattcgatggatgcttaccgcccttttggcaattttaagcgagattttgtgcgtcgtaatcattgcatgcaccgtcgagttgcaggctctaaaatttgacacaacgctcaaaatcgcatctcatcgcaagtggtataccagcgtggcagctttctttctttttcttacattttctctgctatttgcggtggttgctggggtcgt

SEQ ID NO: 5099 - DNA, 700 bp, Nannochloropsis_gaditana
gaaatgcatatcacacacccacgtgtaaagacagaaatggcacctctatctgtgcggcttctctgatttggaagagggcaggaaccttggtgcccgatagactccatttgcgccggccagcggcccggcgcagcagacggaaagtctttggcgattactttctcagccccattggactaaaataaaatggctatgaccgaccatgtaatcgatcctgtgagcccagtgcaggaactttccgagaatagcgtcaaggagtcatcggaagaggtatgtgaaacatccgtgccattggtcttcctcagccagctccttttccctgaagagcgtaccagtacgctctcttgttcagacaagaggtatatcatgacctttccctgtcctcattcgtttttcaaaacgtgaaataaaattttgagtacggtaaaggcatagaacggtggatatatgatgttcagtcattgtacgcggcatcatctttcccttaggacatactctgcacggtgtgcggggagggccacagcgaggtcgagaaccaaatcgtactctgcgaccactgcgatctgagcgtgcatcaaggctgctatggtgtagaagctattcccgtggggaagtggttttgccggctctgtgagtacggtatggactgtcataaggtccgctgctccctctgcgggcacggggggggtgccctgaagcc

SEQ ID NO: 5100 - DNA, 700 bp, Nannochloropsis_gaditana
agaattattatgttagatcttttacaccccatacctactacattttctcattttaatattggaagcaatacgtgccggggggtagagttattacccagtgaatacaaatgaaaataagatccagtcataggataaagctatccactcctcatacgcggggcaaaaagagaccgcaatcgtagatcgcgaacgtcgcttagtacgccaagcttcggcctccttacgggagcttcgtgcccctctacttctcgccgccgcctcgccgaccagggaggaaagacgaagggcgaggaggcggtttctctgcgccctccactctgcaccacatccccgacgagcggaggggatggacaagacagtcgtgcaagcgtgactgagtatacgcgatcctttttccaaacgggcgggaggtcgtggcacctttttatggaggaagtgcattggtcttttgagcggtgctgcttttccttcttcctcgcttacgggtgtttgcgattactcaataagactcgaaatgcatatcacacacccacgtgtaaagacagaaatggcacctctatctgtgcggcttctctgatttggaagagggcaggaaccttggtgcccgatagactccatttgcgccggccagcggcccggcgcagcagacggaaagtctttggcgattactttctcagccccattggactaaaataaaatg

SEQ ID NO: 5101 - DNA, 700 bp, Nannochloropsis_gaditana
caataaggtagagagcaatggagagctagtggtgaagatgcgtcctggacctttgagcctacacaaagctttgtggcggaatcaagttgctcatcgcacccgagacaggtacttgttggacatccgctgaatcaccgcatgtgaacctgtgtgtgaaacgtattttctaaaatgtgggaagcctcgaatcaaaaacttcacccggcttgaacaggagcaagctttgggcgtggatgtttctgcgaaacccgagttgccattatagacatccagcgtctgtgtcactagcctagcctgagagcttgtcgtcggagcacttcccccgccactacaagactatatacagcgacgatataaagagagccgcctaaagtctcaaaacatccaagtgatacattttgagggtaaggaaagccagacgggagcaaggacacgcagtcaagaagcaagccctcccagcggggcgcatgcggcgggggaaatgcagcgagggatgaagataaagaaggcgcatgagcacacagctgccaccactgtccgctcccgtcggtaatattcttgtttttttgttttacaatgtcgcaaatggggcggtggatgtttttgatctgtacattgtccctgtgtctacgggcgccaatttctatcacaggcgcatcgctcaatcgacggctattttgttcctctgccccgcagcatg

SEQ ID NO: 5102 - DNA, 700 bp, Nannochloropsis_gaditana
tgtgataataaatgcagtatacataaatttcttccatttagaaacctggtaatgtaacggccagtcacgcacctttgctgtctttatgagctgccccatggattccacgcatttcactggatatgagggtcaataaaatggatatttttcacctctttatgtttcacgtgcgtcctgccacttccttatcctctacataacttacaaatgttggcgtctaccagccgtcggaactcacagcgggggtccgacctcgcagttgcagcgtctacggctgaagatgacataaaggcccgtactactggactagaagtgacctaatctagtgtgacgtgagattcttatgccttgacttgaaactcttccgccgtcgttgacgttgacctcgtgcccttgtccccctcctctgcctcctccctccggccactgttggtcggggtcgccggcgctcgccaaaaaagttggaagagggcctgtctttccccccccccccaacggcagtttgttgagccacaacgatcatgaagctcactcgatgatgaagctcaataccactaccgctcaggctataagagatcgatttctcgaggggatcggctagcggctcgtactcccgtcattcccagggctcaactgagaggagtagcccctgtcaaccttgtgcgtagtgccgtccctactgctcgactcgacaaccatg

SEQ ID NO: 5103 - DNA, 700 bp, Nannochloropsis_gaditana
attgatcactcgttccttaatgtttcggcccttcacgcaacagagtcatttacctgaatgacgacaaaagtgaagcgcttattgactggaaagatccaatttcaacgagagctttaacaaaaacacttcttcgccatgattttggtctcgagtgggatattccgcttgagcgactatgtccaccggttccaaaccgtctgaattacgtctgctgggtgaaggatctcctctccttgggtggctccgatacatctcaatcaagaactggtattcgaggtttagatgtgggtactggtgcctccgcaatatacccgctgcttgggtgcaagcttcatgattggtcgtttctgggaacggatattgacccggaggctttagaagcagcctcggcaaatgttcgcgaaaaccatatggaagatcgcatctccctacagcttgtatcgcgcgtggattacagcgagctatcttcattctctttcacagctctccaaacaggagctgggagtgtccgcggacccatccaaactgccctagacgccgctggaatgggatccgaatacgagctggacttcgtcatgtgtaatccgcctttttttgcatctttggatgaaattcattcgggtttttcgcttaaaagtgggaggaaaacaagcaagagaatttccacagatccgcatggctgcgcggacgagatgatcac

SEQ ID NO: 5104 - DNA, 700 bp, Nannochloropsis_gaditana
aagcgaaaaacaggtctgtttgaagaaaagcctgacaaagcaccacgcaccactgcaacggatgcacatgtactgacactctttgtcagagagaatagaaatttcgatgcagagctcagggggctgactgcatcctgtgcgcgtgcaatatgatgtcaagtcaaccactgtgaaaaaacctcttctcgaaaagccctccactaaatttacaaggccatgcctgcctcgccgttgtccttgggaggattttcaaacccccgaggcgatgtccttagaaagtgcaggcctcttccgccctcgaacagatgttctctattgtgacaaattgcgtgactcgcatcatatgtgctgtatcttcattgagtacgtagcatggaagatgagtggaagataggcgcgtaccaaagctacttgtggagggcgcagagaggaccactccagtcccgcgatcttccagccacatcactcaacgtgtccgacgtaccgtgaacgatcgtgtgagatgttaggcactacaaagcacggactacagggtatcatttatattcgcacacaatggagaaggactcactcattccattctcttaacagaacctggaaggatcaagtaatcggctggtagcctctagtcacgcacgaacacgcaatcgtgggcaatcttcttcccaccagcacttacacgcgcggtacaaaaaatatg

SEQ ID NO: 5105 - DNA, 700 bp, Nannochloropsis_gaditana
acatcatcatggcaataatacttggctacaaatttgatgaatggggcaacatcaaccttgaagacgtgcatgaacgctttcgagagcttgctttcccacctgactttcggggaaacgaggaaatgcgagccatgttagacgctatccttcgggaggatgaagatgaagataaaatgaaggggctggaggaatttctcgaagttatggtaggtaaagcttactaccatcaatcggacaaaggtgataacgaagattttgcctgtcgcgcgacacttataaagtggatctacgaatatgattttgtgaatgactggcctagactccccaccgtccaggcattgcttgaggtgaaagcccgcattgatgccaagcaggaggagaacaagccacctcaacgtttcctgtattgagcgaacactggtggtgaggaggttaaactttccgggggggcagtgcattgtacagctttatgtaggcgcgcggtccaaagttgagcaataacaaggcgccgttgcataaatttgtgctctgcctttttgcgaaagaattaatttaatctatgaggagctttcgtaattctgtcctttccgatccttcggaagctagcaaccgagaaagactggagaggatgtggttattaacctgtgtacccgggttcatttcaccttcgattcacaaacataaatgtctcaggtagatg

SEQ ID NO: 5106 - DNA, 700 bp, Nannochloropsis_gaditana
accctcgatgtactgaaacggggatctcctaggggctccttgtacgcctgggaggcttccatctttttgcaaataaaagaccacatcaactgaaacgttgccaggggcctcaggcacacacgtaggtatgtctgagaccatcgcaccattgttggccgcgaaaaaagcggtcattgtcagtccgccgtctccctcccccaaagagcatcagattgggactgctgcgctggcggccttgattttcttctcagtttcagggggaccttttggcatggaagaagcagtccaatcggcaggcccgctcgtcacaattgttgggttattggtcctgccaatgctatggtctgtcccggaagcactcatcacggcagagtgtgcaccagcgtttgctgagccatctggatctgtggcctgggtcgagtccgcatttggtcccttttggggatggatgaagggttacctatcctggttgagtggcgtgacggacaacgccctttatccagtgctcatcgcagactatctcacctccttctttcacaaagaagcggaaactattggggtcgtggacggtctccaccgagtcctacttctcctgggtctgaccctggtccttacgtatctgaactggcggggcctggacgtggtgggaacggctgccatcgtcctgatgacgctgtgcatgctcccgttcgtaatcatg

SEQ ID NO: 5107 - DNA, 700 bp, Nannochloropsis_gaditana
cggtgacgttatttaaggcggacctgtatggttaaaaagaagtcacacaaaggaatataagacgcgaagacatgcttatttgccattggctccattgtgctgtgcatcacactgcgtgcctaagaagatggtcgtcgcggggcgaatgctgcgcatcaattggaagatcggtggggaatactccatgagaagagtacgacactaaacgggaagacagagacaacatgataggcagagaaagatctctgcctggggccgtggtgagaggcaacgtggcacaatttgtctcatgcatcatgagcggttcatagggcacgacgtgaaagaggcatgggtacatgaaacagtgctcggaagagaagccagcgagtccatccgcgccaatgccacaaaacgtgctctcaaacactgatggacgtcaaaagagcgcgtgtgatgcttttcaatgtgtcgcccgacatattgtgctgcacgcccgttgctcaataccctctacgagaaaggggccgacgcctgccttttccgtgcaggatgcgtcactctttttccagccacatgcctgggtggcgctagtgttcgctgtggccggggcgaggatagaacaaagcctcccgttccgtcatcctcccgccctgccccctgctgcacttgcaagacttgcaccaaatcacgctcttatactcgctcccttgtgccaggt

SEQ ID NO: 5108 - DNA, 700 bp, Nannochloropsis_gaditana
cttatccacccctagtcgaattcgtcgtccgacattgtccccgacatctcgcctggcggcgtgacgatgaggctgacaacgacctgaagggggaaagcagatcggagcgtaatcagtcggagttccttcccacctcgccgcgacagtcagggctatcaaacccaaagcattgagcactccctcaattacagtgccccttctcactctgttacccctctacaaacctgcagcgacgtcaaggcatagccctcggcgccgagcagagccccagtgtcgcaggtctggtcgatgaaggccaaatgggcgggcaaggcaggtatccgcgccgaccgcacaacacccgccaaggccggtaggagatcatccgcgctcgtgaccacgcgcccctctcccagagccaaacagctctgcagcactcgcgcaaccttcttacggcctgtcacctcctggctcatccccacgagctcctgaaccgcccggtggaacggatcctcattttgggcccccgcaccatccattcctcgctcctcccgcgcgtctggctcccgcaggtaccagccttcgagggcgctgctccgagaccgggcctgctcctggcactctcccagcacggaggggtagagcgtggtcattatctccgtctccacggccacaaaggcgtcctcgcaggcttccatagacggacccaggagtccgggca

SEQ ID NO: 5109 - DNA, 700 bp, Nannochloropsis_gaditana
aaaacatggggaacacgttttctcattgagtcatgtatcaaatgctgatgcacggagagtgtcggacgctgtcgatacagttctagggttacaacgcagtacacaaaccatcgcaccacgaaagatttccactcaacgtcaaactattcctggacgcgtgtgtggccaacgagagaagaaacaaagccccgttggacaagacacgcgtcccgcctgccatcgtcgactttcctagtcagaatgccctgcttgctgtgtgcgagtcctcactgtcgctcaaggtggaccatttttgcgcgaaataggggccctcacaaggctgtcatcaccaggagccgtgaaccacccattgggcgtgatttcgcttccgtattagctatatcgatactcatgtgagagctagagccgatggttctgccaaagtaacggaactttgggatcggaagcgcaacagcggggaaaagggacaggaggaggacgaggaggacagtcatcacgctcagtgagcgtcgctgagtccgtttgggcgcgacagacacgcccagcgcggagtcggactccgaccttgccgtcaactcgggttcaatgtcacctcttagcaagccttggaattgggttttgcacaacataatgtcaaaaaatcataggtggatgtttcactgcctactaaaatttgctcatatttctggaacgaaaaaga

SEQ ID NO: 5110 - DNA, 700 bp, Nannochloropsis_gaditana
tggatcgctactgaacacagtacagtcgtctcgagtcatggtcgaggatgagacgctttctttcaagtattgagcacggatgaattaaaagaaaaacgagaacgtgagggataagatcataaactttatggctcgcctcgccatatcacgcatccgggactgctcttcggattaatctctccgtgtctgagttttaaatgtagatagaaatgctttggcgtacagagatggaggacggacaacatgcgaacaagcatgtgcccggtgtgtctgacagtgcaagtgaccggcctgagcatgtagagacggtgatcttgacgcccccggggaaatggaaggaggttatatgctcgaggctgccatagccttttaagaaatcttatgctctcactatcaattggttgccatcaggtcaacacctacatttacaggctacttttcattttttgaggctccacgtacgtaattatctccttcttttgctgtctgcttctatcaatcctaattggagccgtggtaagtgcctcatgtcgtgggactgtcatcgcggtaagctaatttatagaatcaggagggaaaagcggcgagctgcgatactgctggccactttgtacatgaatgactgaatgacaaatcctgcaacacgcaggtttaaatgcttcgtcggcttctacgtccctttgtaaagcagatccatcca

SEQ ID NO: 5111 - DNA, 700 bp, Nannochloropsis_gaditana
tcctgctttaaggcgtaggtattgagtcctgtacgtacttgatggtttccttgagacccgggcccaggtctttcggctccagcatgaagtctttctccagtgttttctgtacagaggttggtgagatgggagattaatggtggcgccccgattcagtaagagaaacaaggtgaagatccttaccaggtaaaacatggtattggcggaatggagggacaagctggcggtgggagtgttcaatgacacgaagccagttcccagccttgtaccagacgacaatggagcacttcctgatccgtcccttcctgcctggaaaaaaataaaataaaaatgaccctacctatggtgatgaggatagaattacggcctagctggtgaagttggtgaggtcgtgttggatggtttgtgcgatatggaatgtcgctgttacggaaggcgaggaggcagcaaggagagcttcagggggagaaatgcgtcccaccagcgcttagacgtgcggcttgatgaaacacgcatagagaaacaaccaaaagaaatgagtgtgttcttagatttccgtttatgagataattgaggtgatatttgaggaatctggacaaattttgacgcatctcttgtccataaccatgttctacaggctagtggacagacgcgcggcttatgctccgacgccgatcacctgaagacttgtcgtcaaatg

SEQ ID NO: 5112 - DNA, 700 bp, Nannochloropsis_gaditana
gattaaatataatatggaagcatggaaataattgcgggtagcttacgcagcgttactgtttctttcctataccggttgttcgcttctgttatgagagctggaacggcagccttctggaatctgcacacaaaacagtagctcgtcgaggccaatttcatggcaatttgaggccggaagaatttgccgccagaggcatccgtatttcctgtgattacaatggggcctcgggagcctaagaaaataatccagatattgcttacaacatgatttggtcctcactgattttggccttgcatgtaggtactaaagatttcgtatgtgcgacttctccgcatgctactggattgatgatgccgaaggcgataccgaggcgtcgggaaaagttgccaatgcttccttgaacgcagtcatgttggtcagataatctgttcgccgccaccgcccgccgaaaaaggaggggtatgcagtatgaattctactcagctcgcgctcgttcgctgactcttcgccgctttctcccgtcgcagcttctgcttctcgatcctccaggtggagggagcttgggttaggcgacccggaggagagcgtgacgggtgcaacgcattccgaggggctcaaacactcggttgaagagcggggaattaatgttaaagggtccaacacatttacagagaggtcgacattggccttcggctctatg

SEQ ID NO: 5113 - DNA, 700 bp, Nannochloropsis_gaditana
aggcaccgggcagggtgtagtatctagaccgggtttgcggcctgggcgaggccttgaagagcgcaaggcgttgttctttttccggcgcaaggaaggccggaagcagggtggtgcacgcgcttttgcacgctcaggtggcctggagacacgaaaaagtgctccacactaaatgcaaactattttctgacatcgatttgtgcccttgtacgggcgtgcatttcttaaaacctttagcaaacttgcttgaaccacgcgctcatcagattctcgcttagaattttcttaccatgtggtgttatgtgccttgcaaaacttcagtgaaaatgcatgtatttcttcttcacgcgtgtacaagcaccacttatactaatggccatgggtcggagactcaggtaccgcctgcgctcgcctggaataacttagaacttgcatgtcttgcgccttctcgttcctgctgcctcctccttttcggacccttatacttttcactcgcaatagaaagctttcattcggtcagacttgctaattgatgcatccaagtcgtattaccctttctagggagaagaaaaagttgggtgctatttgaacagaagcgttatctgcatcgtttcccatttctgacttgtcccgtttcctctaactcgcaacttcacgtttaaacagcagggcagatccaattccggaatccattcgacagatg

SEQ ID NO: 5114 - DNA, 700 bp, Nannochloropsis_gaditana
accgtctctgggataggggggggaaggggtgcttgctacccgaaggatgttctcgtccatgtgctgttgtcggcccatcacgtcccgagcgcctcctcgacacgatccgatccgttcgttgccgatccgatccgctccgcccccctcgggcattgctgaggtagcaacgaggaaggagggcagaagatgaacgcgctcatcacaaaactcggcagcggagagaatttgaaaatgctgcgcacttatcatctaaatataaaaatatgttataaaaccatcgaaccaatgacgagcgggcaaaaagtccgcgaggggggaagctattattatattatcgtgacgagttatcagctcaccgactcaccgcttcttgagcgacctgcttgtctgatattcttgttctaccaagcgtgtatcggcccttttctctctttctcatgttcaacatctcatgactgccgcctagtcacacaaagcgggagtagccttagtccaacattttagccattgggccatgacctcgctagccccactcaagctgaagcttaccctttcttctctcgagcccactatctgatggtccattttgttaaagggggggcaatgcgccatgacattttttccttcttcgcaatccttacctcttattttacgtgggacttagtgctacccgtataacggcggtcgaacaggagcaatg

SEQ ID NO: 5115 - DNA, 366 bp, Nannochloropsis_gaditana
aagaaaagccgcaagcgtgttcttttcttagtctttgtcacgtgcacgatgtctctttcacataaaataatcgatggctacacaaccggatcattgtaccacagggccagggtgtgtatacccgcttgaacggaagagcggtcatcattacggtttcagtatcttttcgcttggtcagggccttgagatcttcaagtggggtggcccacacatctggaccgcaggcacaggaaaaattaaaatgccgccgcaaacgtggaatattgggccacgcccacagctcatacatgctacagagaaaaggctacggcccatagtcggcggattggtcttctcacgttctggcgcaggaaccgcaggaaaatg

SEQ ID NO: 5116 - DNA, 700 bp, Nannochloropsis_gaditana
ccggcatcacaccgtcgttgcgtctcactcaaaatactttgtgtccctccagctagcgaggtggaagtgtagaagcagcgagacgacgcacgcgcggcctgaaatccggcggcatgcgctcaaaaaatatccttgtgaagaatagcagactgtaaaaccatttatcgccccatctctattgcgggactatgcgtagcccatcttctccaagtatttattttgccgaaaccttgtgacaacatttgcgtagcttcgttcttgccctccccgcgggcctgcatgcaaaaatcgctccgacggcgacgcgcaacgcttgacttgatactatcaggtaacccttggccagcctccacgcttcgcttcatgcacgcacactcgtgttaatgagctacatggcataagtgtgggtggtggaataattttccacgtcgctcatcgtaggttttaaacaacacagagcattgttgggccatgtgaagatcgggggtcgcccgttgcccgggccttctacgtgtgtcaaatactcaaaacaacctccaccacatttattaggctttgttttattgctcaagaccgtactgaaaaggaattaaagtctctttggcccggaacaacctcctcgcgcgtctccgcggctgctggtgaagttctattgaaatctacgcctcggctttcaagtctcagcccacttatcacaatg

SEQ ID NO: 5117 - DNA, 700 bp, Nannochloropsis_gaditana
ttgcgactgccgcaggcacgagtactgccgctctcctcgcggcgaataccaccagaaatgcatcaaattccccctccccgtcgacaggaaaatcaaatgtgacatatcaagcttctgacacacaccgggaaacacttaaacttttgtcgcagctcagtcctgcgggtgctaaagctccaagtgctgtggacgtgcggaaagcatttcgtgccctgtatccccctttccagacaaacggagccaatgagggtgtcaagagcaacgccaagtctagcacatccatggtagcgacgatcgaaaaacgtgaatgcccgtgcgtcgcacagctcgatgtgatacaggaagagttggaggtgcatttggatgcggtggatttgttcgacctcagagacgtcattaaggaggagatagatgcctggcaggcgggaaaacggaaggccctggcggagatggcaggatatggaaaatctgagaaggcaacgtgtgaagaagccgaacaattcactggcgacctggacaggaagggaggtacgtcgaaggggtcagagaagcacgtgggagaggacgtagaagagcccgaggggcccgtgtcccaagcgtccctcctcgacgggggggctcaagcttcgcaggcgtctcaagatacggcgaacggcgagctcaaaagcggtgacgtcttgaaaaaacgaaagcgcggctc

SEQ ID NO: 5118 - DNA, 700 bp, Nannochloropsis_gaditana
tcatgcaacagtcggattcaccgcctcaccacataaatcagtagaccaattataatgctttcccaaacagatccttctttttcgctttgatgaccttgtaaagtcaaacccaggagtctgcgcttgcccctgcctgtctgtgtccttcagccctgcagaaattgaataaatctgattttttgaggaaagaaacatgccccatcgcaacaaatgattacgatctgaggatcgacagaccaggaaaattactcaaagggatgttccggatcaatcccaaaagtatgcctccttttcttgaggtcaggagtaaaatccagcacaatcatatcaccaaggggggctaagctacagcgccgctctccgttcattgctcaatttccaagaagtaatgaatgccaggaggtacagaaagctcgcgacacggacgtcggctccttctctggagcatgtcgccctaggcgtgccccgtgtgcggcatgcaagcgccgagaaagtgagacatatcaaggagataaggcgagacgggcgagctcgcgccggctgccaagcgttctacccccatcctcctactttacttctctccgctaggacaacagaatcacacagctgtggggggacatcatcaacacaccaagtgcccaccgaagtacaaacaggtgaaagggcgacagaagctgccgcgcgcgcagtgtccgcgatg

SEQ ID NO: 5119 - DNA, 700 bp, Nannochloropsis_gaditana
aggggcaaaaactagtcgacaagccagtgcctcacaatacccggccactcaaatgagcatgggtgtggatgctgtccgacttgcaaactgtggtggggagccgtggtcacgtttgtgggaatcttatggatacacaagtgcattggggcgcatgttctacacgtgcagcggacgagcgaggcaaggggaatgacagattctcccctttgaaattccttagagggaagatcccaccacccaaaaccatcaccacgcgacaccatcgccatcccatgttgcggcaagtgttgcatccacaggatcctcgcgccaagacccgtcgtgcgcaagccgtgcggggggtgcgagggaatgccgggtgcaggtgacgacaagggcggagcgagagggagtccacggccccggttcaaggaggctttggggcatacgcggtcacgcccacgccgctttttttccccgtcggggcaattttcagccacggtcgtcccgaaatccaccttgaaaggagctttgtgtttgcatccttgacatgcgtacagcatgttggcgttggaatattttcaccgcaccacgtagtacttctctcgcgattaggcttgtccagaagactggacccgtttctaccaggcaccaagtttctcctataaacatacaagagcgcaagtttcaccattttcatttgtacatttttattcttaaa

SEQ ID NO: 5120 - DNA, 700 bp, Nannochloropsis_gaditana
ttcattaatgcatctcgcccgtgatccttgcaccgttcttcttcagcccttcgccttcccccctcgtcaattccattcaagccgtgatacaggatggatttcagcgtggacgcatgtggtcgcgacatctcgtgactgttttcttcccttttgcacacttttcccgttacatctggagtgtagcctactttttgtttctcacgtgtcgattgcatccccagatagcttgcgagtgttttggtatatcctagagaaaattaaagctaagacaatgtcatagctttgatctgagatatgttgggcggatgggctaaaccttgctctgtgtgtttaagtagctacttgaaggtggggtcaggttgagaaccgtgatgtagcaagtacttgttaagatgttataatttgccacaccaatgcacgatcagctcttcttgccgctacacgtccatgcttggaatctcctattgcatttatgcgtgaggcgcgagaggagagggtattactgtcattgacactccctcgggttttggccgctaggcaggcaggaggcgcgaggcgggcttccgcgaagttcaagcgcggcctggggacatacgggcggcattctttttccttttctcacccgtcaaaaggtttattccgcccgaacatcttcacacgactcagacagtgtgacaagtatcgtacaatcctcttaatg

SEQ ID NO: 5121 - DNA, 700 bp, Nannochloropsis_gaditana
gctccaatactcccgcctacgcccaacatggtcagttgccagaagcccagctgccgcttcagatgctgaaaatggacatggccatcgtccccctcggtgtcaggatccgctcctgcaattaacggcagtcgtatgccttgatcgtatgagttaaagcccatttatgatcgagatggtcgagacaatcgtccatttgagccaacactttgagtaccgtgctagaaaagatcgacgactcacctgcctcacttttcaaatgaagtgcacggtcatgtatgtgtctccaaaacgacgccggccgcccgttcaatcccattgctacctgtgagtgagacgagggacgcgaccatggcaacgcgtgtgattattttgcggactctttatcgaagggagcggtcgctcagagcaagcctccgcgagagcgagtgagcggcctgggagcgacgccgtggtctctgtccatgctagtcgtggcttgcagcggtgtacagtggtttacatgatacacgagaagaattcaggcttttccaacgtcagggtgcgactgttgagtgtaaatataacgcgtggatgtggccaggggccaagtctcatgattgaacctcctccatccccagggcataccagtttcggaattatgaactctttccagaaaccaaaggcaaggtcacattctgaagtgaaacctccccatcacacc

SEQ ID NO: 5122 - DNA, 700 bp, Nannochloropsis_gaditana
aaaccaggactgatgtccaccgtcggaggcacacttgggaaagagtcatgagtgcagccaagtttccaggccttacctcgagcatgcctctatgcgtgtgggggagcttgggattcgctgcttctccgggaaagggatgcactatgatgccaagcaacgctgatatcagcgccagccttgtgcgtggcaacatttggccctctttcgactcggtgagatgacgggtaataacgcctccctcgcctgtgcccgacgggagtcttaagtgaggaaggagaaataaaaacaacggaggccgtgaaagagatcaagcgcttctgcgctgttgctcgtggtcaaaaattacgcacggagctgtccggcgcgcaaaacacctgtagcagctgcctggcaaacgtaagacgcttccatgatgatgtctctttcgcaggaggccatcacctttttttcatgcgttgcagcggcgacgcgtttggtccgcgcatcctcgcctcaggagtagctataagtactatgcacacattccccaaacaacgggttttttttaatggatttggttacatacatgggtttcaatatttagaaattgattatttgctggtcttacaaggcaggggcccgcgaatgccccaggcaagttcagcacgcttatggtctatgcaaccctttcattccacacgcaggccgccagggcaccatg

SEQ ID NO: 5123 - DNA, 700 bp, Nannochloropsis_gaditana
tcgcttgcaacttcacggacaactcgcggggctaccttcctgtccactagaaacacacttgtgcgatctggtcgcgctgccgctacccatgatgaccctccagcttgcatcatcgcctccaatttgaaggagtgggcgttgtctaacccgcttcagccaagcggaaagcgaaaggcgaaaagggcgagtagtaccgcatagaaatgagattaaacttagaccttcgaggtcagcgtacgctaggagggggcgcttgagcaaccccggcaagccgccttgcttgtctgcaagcctcttgaaaagtagccatcaggccgcctcctaagtgatgaaaggggaagaaaagaaggccgtgggtgagtatagcgtcctttaatgatactttggttgtttcccctgagtgatagcttccaattctcttgcttgcaccgttggtctgtgtgtgatgttgcggcttgcttgaccgggctcgcgcctcgatgtggctcgagacgcttgggacgggcggcttgagaacccccggcgctccttatccccatcatgaccattttctggcatatttccgcaaatgaatgcctcatgagcgtcatgccttctcctaaacatgttcctcgtgctgtgtgcagaagaggcatcattaactgtgtaagggatcacgcagaacaagcgttgccccgcccatggctcactttgaaaaatg

SEQ ID NO: 5124 - DNA, 700 bp, Nannochloropsis_gaditana
gagaggcgaagccagaggccacagtggaacagcctgtacctagacggaaaaagtgcctacgtaaatttgccagaaacagttgaggcgcacccaaatccagcaataacatagaacgagttggcaggaaggtgaaatgccaccatggcgcctcgagtttgttcgccgtgacaggcaggcagaacgcggcagcatcatgacgggggggtctggggagggctcgccttttgctgccccggggtcatgtctttgccgtcatattggccctcctttgggtgccttaaggctttgctgcgtcagaatggatgagaagagagcgtgacatgctgcgcttcgtcgcggcaggtggcgccggacagtcttgcgtcttttacgcgtttctgtgctccttcccccttcgagtggcggagatcctcggacaagtcagcttgaagcccggtcccgcgccagcctgagggggccctccacccttttgggcaattttcacgcacgtttccgtattcaaagtgcttatgtacgctcttgtatgatgtaggataataattggtggagatatcaactttttgaagacttactccaccactcatcctctttccttcacacgtacggcagtgagttaggggatccatcgtgaaaacttatccagacaccgaagaaaaggaaaatagacagtaattatggtaggattcactacatcaacatg

SEQ ID NO: 5125 - DNA, 700 bp, Nannochloropsis_gaditana
gagattgaacggagtaatgacggagcagatgacttgagagaacaagatgagccctctctcaaggtcagcttcgcgttgtcgctcgtacctgccggtctcttatgattgccatcgatcatgcatgattcctctgctcccggataggacttcgtctagattggagagctttgtcaatggcaagcccatgcatcgcagttaaaatatgtccatcaaagactcgacctagtacaagtagaaagtgccatgcatccattccacttgcaactcaattgtggcccatatccgattggtgtagccaagagttttggaagatgattttctgtgccacaatatacccatgtaagcccaaagaatatgaaagcatttcatacggaagtcataattaggtggttgatggaagaggccgggcaaagtttttcatattcgtattttaagtctgatgtcggaaaaaccgtgcacactgtgacagctgctcaaccccctgatccgcggttgaagacctccctgcgcattgatccgactcattttcctgacgcaaacgtccgcgcagtcgcgcttaaatcctgtctttcgtcctggtctttacttcatttgcatctatatttcagttgtatgcagacaatcatcatcacagttgtggcagcctcggcacgtatccgatccacatcgatcccccctctcctccctccttccagtcatg

SEQ ID NO: 5126 - DNA, 700 bp, Nannochloropsis_gaditana
atggcatgggcgtattggtcttggttgttgtcgcggggcatattgctgttacgtcacaacggtacctttgacttgagcgatcgagccgctgccctggaaaacgcttctgaagggcacttctagcacaggacatgtatttggcaaggcaaagtgcaagcttcctagcttggcatattctgacactctactttatgcaacagggtgggacgggtctgcggaattctcgcgatggaacaaaaagaggctttaaaggaaacaaaggaagaagactctcaatcgtcatcagttgctgcccctacaggctccccggcgccggtacctatacaatctgcagagacgtgcagccctcctagtaatctgaaagatggcgccaacccgctgccaagctcctcccctacgccccaaggcccggctgcggcccactctcgtatcatctatgggaaggatgtgcccagtgaaaacgacgaaatccagtacaaatggggtgccatcttctataattataccccggatcaacgagccctactggctctagatgaggtatccatgtatagtattacagacacacggtcggcgaacaacacttcacgcattttgcagcagcttgttggtgaacgggccgttgtgacagatggctgtgcggcagcaggggggaatgttttatctttcgcacagcattttcggcgggtccaagccgtgg

SEQ ID NO: 5127 - DNA, 700 bp, Nannochloropsis_gaditana
tttttcgttgagccccgtcatgatcacagacttcctcctcttggttccattaaatccataagagctccgttccttcctcccgcatcgctcccgccgacaatagcctcatcttcctcccccggcggtactggtcgctgctgcggccgccgttggcaaccccgaccctgggggggaggagaagagggccgcaaaggtctgtggtggcaagtactgctgcaaggaatgccgaggggcgttgcggagaatccagggatgcgtgggtattttctccaagggcaaccggtgcgtcggctccttgactagcaattttgcgatcaggtcttgggcctcaggggatacctctgaagggaaacggagatccactcggctgatcctccggtaggtagcttgatggccctccgcctcgaaaggagggttgccgaccaaaaactcgtacatcaagaccccaaggctccagacgtcgacccacttgtcgtgctttttcccttcaatcatttcggggggcaggtagtccagcgtcccgcagagtgtctctcggcgcgaagacggggcgtggacggaccagccgaaatcagcaatcttcaactctcgccgcggcccaagcagcaaattctccggcttaatgtcccggtgaataacgtgctttttgtggcaatacccgagggcagaagacatttccagaatgaactgcgccgattgc

SEQ ID NO: 5128 - DNA, 700 bp, Nannochloropsis_gaditana
ctttttttccttttggcgtcgggagtcgtctgccaacatcttaccgcctgtgggagtgcacacgttccaggcttgtgtagcccacacagcgaaagcgttcgatttatgcgcttcttttattttgctccttggccgctgtttgttccgtcccccatccattcatgtttttcgttgagccccgtcatgatcacagacttcctcctcttggttccattaaatccataagagctccgttccttcctcccgcatcgctcccgccgacaatagcctcatcttcctcccccggcggtactggtcgctgctgcggccgccgttggcaaccccgaccctgggggggaggagaagagggccgcaaaggtctgtggtggcaagtactgctgcaaggaatgccgaggggcgttgcggagaatccagggatgcgtgggtattttctccaagggcaaccggtgcgtcggctccttgactagcaattttgcgatcaggtcttgggcctcaggggatacctctgaagggaaacggagatccactcggctgatcctccggtaggtagcttgatggccctccgcctcgaaaggagggttgccgaccaaaaactcgtacatcaagaccccaaggctccagacgtcgacccacttgtcgtgctttttcccttcaatcatttcggggggcaggtagtccagcgtcccgcagagtgtctctc

SEQ ID NO: 5129 - DNA, 700 bp, Nannochloropsis_gaditana
gtggaggcctgcactggagtcatttgcgtaaaattcagagcggcaacggcagcaagggtcctttcatgaagtgaggggatcatagcctggtgtataggggattcgatgggccgtgtcagaacacataagtggctacggtaacatcatattgcataaaggggggtccatcaggatactacctcgtacaggagcggctctgcgcgcactgggcagacgtacctgaaaagccaagcgatgagggctgttgtcgccgtccggactactcgcagtcatggccaagcctctaattaaaaaccgttttgtgcgtgtaaaaattgagtgtccattacaagcggcgttagtcatccgtcggccctgggtggtactactgcccttcgccgagaggaacatgtttttttgtctcctaccgccattgacaaagaagtaaagaaaaaaatattgcgaccaacccgtcacgaacttcaaagtcatacaggtggtcagaatgagccattcaaccagctttttcacgcggccacgctttatgctgcggcgaaaatggggccatcacgatgaaagggaagctcgatatggaactaaaccaagcgcggaaagcaatagcagcgaaacaccaaactcctttttcaggggttcatggcgaaccagcacgagctgggctccattttctcaagtgtataatggggccagcacctcatcgatg

SEQ ID NO: 5130 - DNA, 700 bp, Nannochloropsis_gaditana
cttctagagtcacacctcttgtcccctcgtcatccctcttgccctgtctgcaggtttcaaatatcactttgccgaacgctctctggtcaccgtctggtccgcacctaattactgctaccggtgtgggaatgtggcggccgtgctcgcgtttgacgagaacttgaacagggagttcaagatgtttaaaggtgaggtggtgggagcaaaaagaagaggaaaaggcgagggtgccgcaaatgagcatgtgagaggtttgccgtgtgtgtccatggccgcctgtttctatggctctctaagctctttccttttccatgcccgtactgtacagaggttcccgaaagcaatcaggcggaagaacgacgaaatctcgtgccctacttcttgtaacttgcgccgaaggatacggacgaggggggggggatgaaaggcaaaagacgtcctcaagcatagaggtcgaaaattttgatgacaatttagaggcggagtgatcgggcgtgcaagctgtataaataagacacatgatctcgtcgaggattgcctggaagtgtaagtctaggtcgcctgagcgagggcctacgatctcgtcttgtctacataagtccttatcctgcaacagcgaagaatgggagtcttcgaagccgtaaaagaaaagtgcgggctgacaatgggatcgcacttttatcgtctgtgcgtgtcgtgc

SEQ ID NO: 5131 - DNA, 700 bp, Nannochloropsis_gaditana
agttgaccaaccatgaacctcgaggtgcgagggaggcaagcggtgaacgcttgccaggaatcaggaggaaatgccgcccggattgaagacgtacgtcggacgaggtgacggagcatataacgctgtcaaagagcattgcgtgtgatgtgagctgtccgggttgagtgtttttggtggccatcgggagcttttctcgggcaggcggtcaggaaagtgaagtgcttgcgtcctcgccatttttcgctgttaaactttcttgctgacgcaacataggaaaataaaataccttctcttccttgtccaccaccacctgtctcccttcgcttaccacacagagcaactttcattgaaggcggatgcgacagctgccaaggcacgtctagagtcattttatattcgacatgctcggggcaacagctgtggcagcagacggctgagagggggatgactgggagatactagcttctcgcagggccctttcacaagtatgctctccggcaaacgttgtcttgtcgttggtctcgccaatcatcgttccttggcgtgggcttgcgcacaggcatggcgtgcagcgggggctgaggtcatggtcagctcccttcctcgatttgagtcctccgttcagaagcttcttgcatcatcgtggccagaagcaggaggtcaggaaagtgaaaaatatagcgtgacatgcgacatcatg

SEQ ID NO: 5132 - DNA, 700 bp, Nannochloropsis_gaditana
gttcttcttcaccgacaacatctgatgcccacagaaggcaggtgggctccactccatcccccgacttggcgccttaccgccgtatgcacttcatagatagggctatgcttgcccgtgggatatagatatgaccgaccggaattcatgcgtcgaaattttggttgcttcttgtgcgcaagtcacggctcaggacagcctcgatctcatcttctttctgtctcaccccacgtgacctctccttcacatttcacgctacattgacagccacatccagcctacgtttgattggggacaaaactggagaatcaggcaaagttgagatcagtgtcaggtgtccttgtcaccgctggtgagtcattggtcggcagattttcggaattgattgcaaaaacagaagacgtgaggatgtcagatgctgactcgggcgcggatcattccttgacttcgacaaatgttttaacccctgtgaaagcctctttacatgtatggcacctcttaaatgttggtgtgtctttttcgtctgaagatctttttttgttatgtaatggaaggagcgaaatcatgaaaaggagggcgctccccccttccttgttttgtgctttccggagggaatgattttcatcttgaacatctccgtctgcaaatgttgtacacagatctgaagtcatcgaatagcgccacatcgatctctccctgaatg

SEQ ID NO: 5133 - DNA, 700 bp, Nannochloropsis_gaditana
gaaggcgacctgctagtcgaagaaggacttgtagctgctcaggggacaaggcattgccccgccgaaggaccgccttccccgcgtcgtgtaggatcgggtgggacaccgcgcggaaggtaaggggaaataagggtgcatgcgtccttgccttgtccacagcgacgcggtgcgcacgcataatttgggcccagattgccatataggacggtatgcacatcgggaggagtgtcctgaccaggtcgaaacccgttcgaagaggcaagcacgctgtcgtaggccacgtctcacaaattgtgcggacatgaacggactccctgtacggttcaagtgtccatgtgctggtatcaatgcgtgaacatgtggtcaggaatgtatacattcccgtgaaagcaaaagcgggcttttgagcggggggcgagttgcttcttcggcgaggtcacgcatgcccttgctactgattgcactcatatgccagaccttgatgtggcggcgtgcgagcggagcccattttctacgaacattactctgaccctgctccaagactcctctccgcgcgtgcacggtgatcgaaaaaggcattggagcaaggatttattgtacgaatcgagtcacgaagccactgaccccccccaaaaaaaaatcctatatcagtacatataccagcagactgtctatcacacaacgaggaggtacagatatg

SEQ ID NO: 5134 - DNA, 700 bp, Nannochloropsis_gaditana
taatcctttttttaaaacaaaaaaaatgatttatcagtacctaagcgtcacaaacaatcaaatgttcaattgtttgtgcgggagggggaaagagcagaggaggttattgtgggccgactaccgtcaggcctgatctggcacatgtgagacgacaaaacgtttattcatgtcctctcgcgcacgaacacaattcctacaagcagcagtgtcgtccaggatcttacggcacaatttccatgtccatgtttccaagcaaggacttgcatgcctccccgctgtaacgcccactgtttcctcgctcctttcttcagcgacgcccgccgtccctccccccggtgagaaagggagacataaaagccattgcttttgcccctttgtagccccagttggcatgaaaaaggttgaaaagggatttgagagactttctggtccgataatcggctttgctgctccctccagtctcagctgaaggcttcaagtgggtataaatttgcgcttcccccattattttatgctcacaattcttgcttaccagatccccccacttccctgcctggttcaacactttctcgagtccgcaggtacacctggtatctctgcttttgaacatatgatagatcagattgaatctcatgcatatgtctcgtctcattcacaaatctagggagacagagccgaattcgcaagtggtggcggcatg

SEQ ID NO: 5135 - DNA, 700 bp, Nannochloropsis_gaditana
gaggaagaaggggtgagaccccaggcaacaggagcagtagtaagctaagagttgctctgtaagatgtgggatgaagcatatgagaaaaaagtggacagggaggaaggaatccagcatacttgagactaggcaccccatgtgctctcatatctcaagatgatcatgcttcatccgcgggttgtgtgaatggcggggctgtgtgttgtgcatgtaaaacaaactactcgtgtcttcaatggaaggagggccgttgcttttgacgaaggccatgggtcagcttcatcaaagcaagaaaccatcacaggacagccagatctttggcccccctgcacaaggcgtcaaaggatgacatctcttcgtcactgtgcagagaccgggaaagggtggctgggaccttccgtggagttcgaggcagcatgtttcggtgcctatgaccagagggcggggaggcctctgtagtggcgtacgttgcctagggtaggggagtgccacgcccgagcccgtccttgtcccaggccacacagagtagcaccgggactttttttcttctaaaattcatcgcaacctcttcctttttaaatgcctgtcgatacaggtggggggcgacagggcgcgcggtggctttgcagcggaaggcaggtagtcaggaaggagctgcctgacaagagctgttcttactcccgcagcacacatcatcatg

SEQ ID NO: 5136 - DNA, 700 bp, Nannochloropsis_gaditana
ggatctctcgaacgacgttcattagagctgatgtacaggcagtgcctgtcagtccacaatgtttttagcaacccattcacagaatcgaaggaaagaacagatggaaacgtaagatcagtttcatgacgcggtccatgaaatggaaaataaaaagcattttacttggattacaagcctttttacgccattttaaccatacccaattgaaaaatcttacatcaatgacacgctgggccctcaacttgtaaaatcccgtgtgcatataggcttttgatacatacgggaggttgggacgctaataacattatcatagagagagctgagcccccaaaaacgtttctttatgcgcgaacgtatcaaccacgacctctgaggcgctccaaatgtcttttttgtcgtgtcaaccattgtgctatctacttctagcgctacccagctcacaattagctctaccttggtgcggaggcgtaccaccatgactgcgctcgctgacttccttgaagctagccttccccccctgttgccctttgacgaaatacaacccaacccaagcttcaacgcccgggctcagcgtgcaaatcttgaaggccttctctcgctgcgtggtgacattgtaccaagcctgacgcccctcagcgtgcacgaacaaccctctttatgcacaggcaacccccccgtcgcaggcctctctgtcgccatg

SEQ ID NO: 5137 - DNA, 700 bp, Nannochloropsis_gaditana
ctcctacagccgggaggttaaccatggcctggtgttggtaagtcccgtttacgtttgtaacattacctcaccgaagaccagtaaaattggtagcatattgaaatgaaattgatatcaaatttaagcgtagccagcgctataaagatgaaactcgatctgaggcttgcttgcgattgtctcaacttcaaagccaagcttgcctatacgcgccatgtggttatgtccaggctgttaatcgttagtatttcggttcccactgctacagataatgagacaaagaacgataatcattccaacgactttgtggactttggttatgcaattggtggtcggaaactgtgcagcaacacgttgttcctcttcgtgcttcctttcttcaagtgcattgttttcctccgtccatggcggaagaaaggtacctttgcatcaacaattccgacttcatagtcgtaatatgatggcttatagcaacaagcatggctccaccggaagacgtcgagtgaaggatgtgctacggcctccgttacctccacaaaccgcggtccaagggaacaaatgggcggaggaaatcagccctgcgagcttgaaacaaaagtttacgcagcaacctttccaacgagtgataccacttatcacgctagtgaccttcgtgggatatgtctttgtctctccctatgcccctgggtcagtccccaacatg

SEQ ID NO: 5138 - DNA, 700 bp, Nannochloropsis_gaditana
agtgagactcttcactcaaacttcaggactccagaggcttaattcatttgttctgtaagcaaagacgcatttctttgccttctctaggcatacagacggccagatgttccacataagcacgaaattgagcgaaagggtgtactttcgcaattagagtctcacgccttgcctttttcttaggccctgtctgccgacctcaattctcaccttgtgccaacgcgtcgatccatggctaggaccgcacatttttttccagccagtgccaaggcacttccaccttgtaactttacggcattcacacactgaggtctccacagcaatatgcaaaggatgcatattctcgaaaagacaaccgaaaggcgagcaagggggtaggagggccgggcgctcgagggaggaggtctgaatttcatggccttagttttttgtgtgttaaaggtaaatgagtcacaaccccttttcgttaaaaatctgacttacagttcaagtgtgagaggctacgtgtgtgcccctgcctcgggtcgaacactcatggaacaacaactaagtttacctaaagcgtgagcgactgacgccctgtgctactccgagtcggtctcgacagacccatactagtacaaaaccaagacgatgtgactttcattactcacggaaaacgacgatacgacacacacttccaacgcacaccagcgcacaaatg

SEQ ID NO: 5139 - DNA, 700 bp, Nannochloropsis_gaditana
cgcgttgttgatggagagggaaaaaccgggaatatggcgcgacattgcggaaggcggcaccgagggcagcatgcaaggcgcacagggctcgatccaggggtttatgcaggttgtacgagtcaccagcgcctacatgcaacctcgacgagagcatcgcttgtgtttcctcgccgcgatgctggcgccctgggagaagcactgcatgaccgaggatagaaaacctgtggagaaaaagataggggtcgtccaatggttcgtccgggaggccttgaagcaccgagccaaggacgcggaggacctgaccgcgttgttcggcgcgctcgatcgctgtcagtctttgacggaaaccatgggggcatggtcagggcgggcgacggggcaagaaggccgcaaggtacagaagatgaggcccggggacgcttgcgggacccgggacgtagagaggcgccgttccgaggagcaggacaatcgatggagggcggcaagattggaagcgggaaggttgctaagagatctgaagggcttgtggaggaccgggcttgatgtggcttgtgcgcgggagtgtgcgtcgttaaaaggaggggagaatccgaccacagagtctccctcgaagcgggcatgcgacatctcggtcaccttgaaagctctttatgaagtgcaaaaccgttatcagcataccatcgacgctgtgcaaggcatg

SEQ ID NO: 5140 - DNA, 700 bp, Nannochloropsis_gaditana
aagacctgatgactcctgacacgggtatatgggcgaaagacataataggaggtaagaaatggattgtaaaggagacatactcatggctttgatgcctggtattcgagcacggggcaacttatatggcacataggtcttaggctcgcgagagggcccatatccgattgtccttcacaatgcgtggatgctgataggaatttatgtacgacacacagcagttaactttgaaattgttgtccttccagccggatcagaactatcaacaacatcgagtttggccatcaaagatgttgctgtttggcttcaactcctttctaggtttatcttgctgcagttggagtgcgctgttggcgaggagcgacgtcgcgagcccagccacacggagcgagaaaacctttttcttctgtgacgtagcaaaaatcctaaccctatcaggggagtccttatacatggttttaatctcaacacagtaacccgtcaagtatcaggacggacagggacaggcatgccggtctcatgcgtcctgaggcggctcggaggcacccggcggactgccactaccacatccgcattcagccatgtcccattttggccgtgcatccggcgtcgaccaaggccgcaaacaaggccgcctccatcaaaatcatggagcctcttctctaccttcacgcctgcagtattgactcgactagaccagatg

SEQ ID NO: 5141 - DNA, 700 bp, Nannochloropsis_gaditana
ccaaactacatgccaaggaggctcccacgataccgccacctaaaatgatgacatcataatcccatgaatcggtcgaggtgccgtgaggcgctgtggaggaaaaaagacgacctatgcatctctgcgagaggggccggaagctcgaaaccgccgcgagaaggcgaatcatgccacctgtttgtcagcatgtgaccaaaatgcccaacagacatcattagcgtgagacgtgcgtgtcggatgatcaggcttcagcaggaatgaatgacgtcacgaagaagccgcttcctgggcaaacaagcaataggagtttggctcccactcttccacgctttgaacagtacaaaattctgagcatactctgtgctcgtgtacaatatgctgcttacgtctgaccatgcccactcagtctgtgttgtggttgagcccttttgaagattacgcggccgtgctacagctgtcgaaggccgacgtgaagtcgaatgaaaccttatttcaaagcggcagacgacgctgatagacatactatcacatgacagatgggttgacaatgtcagtgatgtggacgatactgaccataagtttgtcggcggcggcagaaatacgagcggcaacctcctagctactacaggcagtaacccgtccattccacttcttcaataccgcagaatctcgtttgctgaccgaagctacgctcgttatg

SEQ ID NO: 5142 - DNA, 700 bp, Nannochloropsis_gaditana
gaccaatagagttactttgttagctctttcaaaacgtaaataccgcatcgtattttagattgtgaaacaatcataatataagggcctgggaacagaagcttttactgcgttccatggcgcgcccatacttaatcggatcggtctgtgaaaaattttgtacatgaacgcacgtagcgtatccgacaattttttttacgtcccacatcaaatgcaattcatagtactattattctattttgcatatactgtcaagtatgacagagagcattgaggtacgggtcgtggccactgtcgtcggatctgacagcttgccccaagagggagaggaggtattctccaccaggcgacaaaagacaagcatgatgtctacagtatggttccacttttctaacacgatcaatcattactcgtttcacgcctcttcatgttgaaaaaggcaagaaggtgctcagttttttatttttcattcctggaacaagctcatggccgagtgacggaaaagagcaggacggccacccttcttgttgaccgagaaatttctcatcacgctcatgacatccacacgattctactgaaaacgtgttcaaactccctctacgacgttgctagtggggtcacgcgtctccaagaggctatctttttcgcaaattccacaaagcaaaatctcacccccccgcatacgctcgccggaaagatactc

SEQ ID NO: 5143 - DNA, 700 bp, Nannochloropsis_gaditana
tgcgattttgatttgaaatagatgagcagcttttggtgaccgcgttgtgcgcgacatccacgtcaacggcgaggacagagttcatttttccctcaatgtgatgggccgagtggtattcttgattgaagcgtgatgggttcagtaagctagatatagcaaggcctgctgagctagaagcaaatacttcgtttgctgtgtatgatagtgagttgagggggccgacactattctatgctgttcgtttgatatgaatcattagacatacctgttgaaggggccagacaaaggcaagcgatgaaaaggatgacaatggcgtcaaataaaaagccgcgcgacaataccatcgaagatcagccacgcgatgaaacaaggcccttttattttacagtatctgtgttaataggattggattatggaatgagaagagcgcttccgatcccagagggtagcgccaagagcaacccccccaaaatgatgtaaaaggtcccttcgattgccacagtgagaccattgcgaattggtccactcttgatcatgaaagtacatcaaaaagtggtcttttatattctgcagtctgatgcatgtacggactctctacaaaaccctgcgtttgtagagtagctgaccgttcatacctctcatcgcaacctcctcccctttccctctcccacttattatgtggcgttaggcaaacatcatg

SEQ ID NO: 5144 - DNA, 700 bp, Nannochloropsis_gaditana
agggatggttggactttcctgccggtattacgatgtctcgctcgccttcgtcactgctcactttgcaagtgactcgaagggccgaaaccgcgtctcaaaaaggaaccagcacgcgcggactaccctgcaggctttatcgctccacaatgactcggatgatttcgaggttcaccaccagcatcaccatcaaatctgtttgggggactttaactaccgtctctctccggccacaccgacggaagtagtgcagctcgtggcccgctctgcacaaatatcgcaagaaatcgtcgcgaatgaggcgtccgaatcaaatgcaaaccccacttcagaaaactggcgaaaactcagctataaacacttctttgagcggcccacgggtttaacattcagccttggcagcattcccgagttgcctccatgtttgggcacacgatattcgtccaactcctcgcaaaatgttagtcaaccctcatacggtaccagcggacttggtttgcccaattcgacctccagcaaaagctacctgggcgggaaattgccgcacctctttcttgctagaagtggcagcaatgcagccaaagatgagttgaatcggccgcctgaggcgcatgggataggtgctggtttcagcaacgttttgaggcgccgtccatccatggaattggacatgtcctctccacactcgcgctttgggcggcag

SEQ ID NO: 5145 - DNA, 700 bp, Nannochloropsis_gaditana
ctcaaggatccacccgtccaaggctgtcgcaccgatccgaaggcaatgaagattcgcgcgcacagggaatgcaacgtagaaaatcttctttccacttttcatcctggtggccttcaatcaatggaccttccggatgtaaggagagtcagagccgaagccatgtcgtcagtggagacagtgggaacgtaagtcagacctttcgacccccacgagccgattcgctttcgccaccttcgaactttgcggatggacaaacgatctcgcgtgcacccatggaagtggagcctgtcccgactgcgactttacatgagatgggggccacgcgacgggagcgagtacggaacagcagcaccatccgccgactgcttcgcatctctttgaccgttgcctgcctctggacttgtatcgccgtggtggatattctcatctgggtacgtttctacttaggtgagaatacgattcggatgaagactcctttcttgatccgcatggtgctcatgcgggctgtgggagccgtggacgccgtcatcctcggggacctcttcattctctgcctcccctgtgcccgcattctgtcgcgcgtggtcaacagactccgccggtccgatctttcttatgtgccaggaggtagagccagtgttggcaacgtcgcgggtcctagttccgtcatgtccgtctccaaaatgcgcgccagcatggt

SEQ ID NO: 5146 - DNA, 700 bp, Nannochloropsis_gaditana
tgtgtggccttacttgaggagctatttccaaaagccaaagcatcgacagcaacggacgagattctgggagatgaagggttggtgttgaaaggcgagagagcggtggaagacagcaaggcacttatccttccggcagtagcccgggcccggggtgcgtgtaagctaagacatctcgtaggagcagctcccgtcgcgtatggcttgccaagtgagcttgtagattagtcaatgcacataaatacagacgattgaggaaaattagcgagtgaaaaaaacatgtttcaatcaacgaagttcaaagttatacgacacgcacttctttaaaactgatgtaaaggaagcagagcagaaccacaattttctcattccttctataggcaaatgcggacagtgccacattcaagaaacagacacaaatcattttcggaaaattactcgagcctagcagagaggggtgtggggaggttcacatgaaacgttttaaatcccacgggcattggcttgtgacgtaatcactcttttaaggtttagcgacgggagcagagaccaaagttaagcttacactattctagcctttccgcacactcatccactgtcattttatggtatccaggaggcctcccctttctccaccacacacggcttccccttttctcctacaaacctcccctctcgagcttcagccgtaccctccgccatg

SEQ ID NO: 5147 - DNA, 700 bp, Nannochloropsis_gaditana
cttccctcccgttccctctttacgcatgagaagacgggcagtaatcactcgcgaccggttcaggacaagaagggatttggccggcaaaaaggacgggagctctcgaaatatcccgtcaaagacccatgtgtctacagtgtctgctgttgaagatagagacgaagcatctgacaccaaaagcaacgaggcatcccggggctccgcaggccgcttggcaatgcaagtctctggcaatgggtaatctaggtcatttgcaggggggagttcaaaaggacatacgtttatttcatcgtagacagggggaaaagctggttgtggtggtcgcagtgccaccataccccccacctgtgtcatgaatagagatggtttaagcttcagctcccaggatgatagtatgctcgttttgtggctgcagcgacaagcgacatgaaaaagcgatcagtgagtataacaacgcagattcggaaaactagatgctcgcaatgtcctacttgtcggctttatcacgctggaaagacatttatcttcacaattgcgaagcatttaaagtatgttaactccaatattgagcgctgacgtacgcgtgaccgcctcctgcctttctggagacacacaagctatccccctgggatgaagggcaatatttccacacgatcacccatccacccgcagaacggcaaagagacttatggcacacatg

SEQ ID NO: 5148 - DNA, 700 bp, Nannochloropsis_gaditana
ccgcgctggcgccactgactcccaccgcccccacaaccttcccttcccttgctctgatgacaacaccaccggggaaaggagccatctggcgcaaataggaaaagcagaaggtcgaagcatggcacaaaggaggagagagaaaagtaagcctcaaatgtgcacagaaatcgagaataattcactaaacatcgaaacttacctggccaccagtcacatctatcatgcccagcatttgacaatacttagttgggtccttggcaatcgtgtatttgtcccgaaaagcacgcgtggatacacccagcgaaatacaagtaaaagctttagcatgcgcaaatttggggaaagctgcgggggcacaatcgtccatacgctgcattgctataggatgtccggtcggatccatcactactatcgtgataggggcgaagccctttgtaaggcatgcagcgactgcattttcgcaaatttggaccgcttgtgccagcgacaacataattgttaatggctgtttttccttccactggaaagaaagagccgtgaggatggatggtgcctacatgttagatgtttgcgttttggatgttcaacagatcgggtcgtttcgtagccgagcatcgttcgtccaaaagagaaatgagaggaaaacagcgagggctcacttttttttccatgataaaacgacgcatgctttcacactttc

SEQ ID NO: 5149 - DNA, 700 bp, Nannochloropsis_gaditana
ggggctcttatattatgccttctgagcctgtcgggtggcagcttggtatgagtggagtgtcgcattgcgttcaaggcggaaggtcatcaagaaagaaagccagtatccaggcgagagccatggcgttgatccagagcacttgcctccgcgacccaccatgcatcgcatagataggagagctacagcacagctatgcctaaaataactaagcgtgcttcctcctggaaagcttgccattatcataacatcgctggcggaagcacaaaactgctctagtttggccgctgcacatgtctgtgatggtctgtctcctctctccatttcattccctctcctccccccccacccacttgtggtgtacagacgcgttctcttgacccggatgggagagctgtaggttcatttgcttctcgcaataggctttggttgacgaaggctcatggaaccattctatggatgtgattgaggtctaagagccaagttcagcggcaaccgccgactggcgagatgaccactgcttgctgcaggctggtgctatcatttgagacatgtaatctttttctccacttccaacataccattgaccttcaacagcactgcgcatagcgagcttgctggtgggggagctttgtggcgcgtgggctgacgcgttcccgacgaagtcttggtgtacagggctgcgggtccggtcagcatcatg

SEQ ID NO: 5150 - DNA, 700 bp, Nannochloropsis_gaditana
acgtaaacaaaaaaagttgaaatatcggtcgaggccatcatgaaatgcctgcatggttcctacgagtgcacagacaatgtcctgatgtgcggccgcgtgtacagacgtagtcaatgtttgcattgtgactgatagtttacactcaatttataccgtgcgttgagtgactttatttcctgtaagctaaaaaggtttggcgacacacagagcgagcgagactcgccggatcttgcaaggagaaaaagggggaaagacggacacaaaggtgtctacaacatccacatacctgccgtcgtgagggggaaaaatgagatttgacgggctctgtgaggtccatgcacttgtgaaggaacgcgtgtcaaacgtgctttggcttttatcttctcctccctctccgctttatctgcttgtcaacctctgcgcgattcaattccctgtgttgtgccctgtgggaggtagaacgggcagccgtagcatcgcaggaaagttagcttgaccaagcattggccagaccaatagtctggtcgtttctttttgctttgccggtccattgcttcaagcgctttggaagaagcgactgttcgtacgcatgatatcgagggcacaagtactcactccatagcgagacctttcgcattattttcctcccaacgtcatcactttgctccacacgcagcacaagccgctcaaacgcactatg

SEQ ID NO: 5151 - DNA, 700 bp, Nannochloropsis_gaditana
aattattctttccactctttctacggccgcctcaagccaacttgctgaggccgtgacatcaacatcgcgagggtttggcaccgtcgttatcgatgaggcaggacaggctgtcgagccctcaactctcattcccttgcggtacggctgccgtaacctgattcttgtaggtgacccacgccagctccctgccacagtcatgtcaccagtgctgcagaaatacaagtatgaccgcagcttattcgagcgcctggaaaaaggtggccatcctgttcaccttttgcgtgtccaatatcgcatgcgaccacccatttgtcggtttccctcccaagcattttatcataataagctttcaaacgcacccgcgttggaggcggctgaagaggatgcggatggtgatcttaaaaggtacgatcgggtaccttattttggagcttatcgagtttttaatgtttcctcggcccgtgagataaagcgaggaaatgcaatcagtaacatagaagaggcaatatttgcggttcagctcattgctaggttgcgcgtggaatttccagacctggtggcgtttaagcacatggcagtcataacaccctatcgggcccaagttcgtttagtggaagagcatctgcgtgtaagattcggagaagaagggtcgtccttagcggaagttagcacgatcgacggctttcaagggcgagagaag

SEQ ID NO: 5152 - DNA, 700 bp, Nannochloropsis_gaditana
gagatgcccgagagattgctttagatgccagaaaatgtaggctagaccatggcctacatgggcgaaatgaaggggaggtcgaggaaagcgaatggctgcgcaaagctgaacagcgacaaaggataagtcgcagcgagctgtatagggccaaaagacggcgatgggagtgtttgaaggctctggaggcagagaaaagccgtattcgcaacaatctgattcgggatgcaaaaattattctttccactctttctacggccgcctcaagccaacttgctgaggccgtgacatcaacatcgcgagggtttggcaccgtcgttatcgatgaggcaggacaggctgtcgagccctcaactctcattcccttgcggtacggctgccgtaacctgattcttgtaggtgacccacgccagctccctgccacagtcatgtcaccagtgctgcagaaatacaagtatgaccgcagcttattcgagcgcctggaaaaaggtggccatcctgttcaccttttgcgtgtccaatatcgcatgcgaccacccatttgtcggtttccctcccaagcattttatcataataagctttcaaacgcacccgcgttggaggcggctgaagaggatgcggatggtgatcttaaaaggtacgatcgggtaccttattttggagcttatcgagtttttaatgtttcctcggcccgtgagataaa

SEQ ID NO: 5153 - DNA, 700 bp, Nannochloropsis_gaditana
acgacagcagcgcgcgagtttgctgcgcttcgagaggtacttggctttcggctcgctccccgtttgctccaagggggaaaagagtgtgaaaaagggaccaaggaagctagcggtgctgccaaacggaagaatttaatgagactgactgtagtaagcgaggtgggcctcaggcaaatctggagggatatcgaaaaacggtacgaagctgcgtcgaacccaagcgcatcacccttggaagttgaggaattatcggagaggattcgttccctgcgaaaaattcgtgtctcgcgaagactcttgagcgctacagatatagggcggaaagtgaagtttttgaagaaaaatcataaagggtctgacctggtccgagctgcgtgcgggcaagtcttgaaagaatggcgggcacaagtgaggttggaatgtgcgtgctacgacggagaagtcactcaatcagtaaatgcggtaggcttatcacaacaagaaagtagctctcaaacttatgaggcaggtaccggcgacagggatcagcagaaagagaacgttggtgctggtagccctagagatgttgagagagatgttagtcaaattggaccttccaaaccgccacacgtctctcgaacttcgctagctactgagacaattcactgccccagtcatgtgccgctaaaactatggaagtcccttcaacaacaatttaatg

SEQ ID NO: 5154 - DNA, 700 bp, Nannochloropsis_gaditana
cccagctcacgagcctccgaagaccttcccgaggggcgaaaacggacgcggcaacgaaaaatcaaaattccctgcagccgagggaccggggagggagggagggagggagcggggggaggcggggaaggggaagtttctcgctacctgctggaatttgaacaactcgaaacgatcggcgccgggcgtttcagtctggtccacaaagtgcggaaacgcctggatgggtgggtgtacgcgatcaaacgctcccgacactccctggtctcggagggggagaaggagggtgcgatgcgggaggtctacgccctggctgccctccaaggctgcccgcacctggtccggtacatgagcgcctggatggaggcgtcgtacctgttcattcagaccgagtactgcccggggggctgcctcgaacgggcggtgttcgattcggtgcgtgcgcggggtcagggggcgggggaggggccagggggagggagggggggaaagaggaccaggaggcgggaggagggggaggcgagaggcaggcaagcccgtgggaggggcgggcacggccgcgggcgtggtggacggggagatgaatgggggaaagagaggggagggcgggggctacgacgggagcgaggcatgcttgctgcgcgtggctcgagacgtggggggggccctggatttcatgcattcgcggggcatcgtgcacatg

SEQ ID NO: 5155 - DNA, 700 bp, Nannochloropsis_gaditana
gtcgcaccttgccgtaaagtgggtatttgattggaccatccaaagacgcgcctaattgtaacaagcgcactattgtggtatccatgtctaccacatcgaagcacagcaaaggggagtaacccgtgctgcacatggcttccccgtccgcgaccttcaacactaggggggtgcctcccgtgtcaaattcagccgtcatatcacttcgacgcgttaatgcaagacctagaccctctttcccatagaatgtcacggctgaaggaagatctcttagcatcaggacgacattcctgtcggatggtgtaccacgcgtgaatacggtacatgtctgccagggggtggggaggtcggctacgactcatattaagagaaacgcaacttacctgaagttggctagacgactggccattgattacaaagcgttcttctcgctcgtctgcttcagtgtgttttccctgtctatgcccatgtatgggaggctttcttagtgtgctgcctctctcgcgtgcgtgtcgctgaggaagcggaaaaagcagagagcgaggaggtaacttggtcacagctccacgcttttcaatggttgacggacctgagaaatacgaaaatacacacattttcacgtcataatgacacattattcccgccaggtagcatgagttgtatactaccgacggcagcttagattggaaagctctttaacatg

SEQ ID NO: 5156 - DNA, 700 bp, Nannochloropsis_gaditana
ttgcgagtactagctatggccgggaaatccctgacagttgctcgccgaatttcaatctggctgagggtcctgggtagggagaggttaggtgcagaggaggtaacggcggcgggaaaaatgttcaggctgccactcttgatgctggtgctactactagccctgcagcccctactgctggcgctataaatcgcggtgagagaggagcggagacatgtcgaatgttgtagttggagggatgcgacaagagggagtagctgcagcaccgggagtaggagtatcagggagggcagcttgaaatcgacagcgccatttcttcttctttgtcgtttgctgccattctcttcacttttccatcccatctcccctgtaattctgcaagacgagtcacaactgtgattgcggaacatgacttcttattagcggtcaagatacgcgtgggcgatgttttctggaagcgagaacaggcatgtagtacctggcgagttccaaggtgatctcttttttaatcctttaccagttttggttggtcgtaccattgcacgcgacaacaatatggtcctcgcagcaatacgtcgtgtcgttctctacattttcacgcagttccatgcttagtacgtgaccggaggccattgctcgctcattcccacttcaaccgacacggcgagattgtttctcaggacgaactggaatagtaatcatg

SEQ ID NO: 5157 - DNA, 700 bp, Nannochloropsis_gaditana
gcaacccagtcagaatacctttgtaatatgggctccgcagaaaaaacataatcatccatggtttcaaggacattgagcacgggcctcaatttgtaaattaaggcaaaaagcatgaaaggatgaagtgtgaggttctcatacccccaaaaaattcttcgtttgtcctttttaagtcgaccgtgcttcttcacggtaaagcccttccacgctagtttatttaatcttgttgggtgctgcattatggcgtccagagtggaaccgcgaatcaccgacagatagaacggtgcctgtgagcgatgatagagtattgttttgacatgaagtctattgtgtatcaatatatttagtaagcctgtgaatgtggtgaaagggatggttcttagattgtcatgaattacatatgtggtcaagcattattcatatgtgcgtgtgataaaatatgcacatggcatttgagcttctactaggtatccataatggatttgagttaccatacccgtttgagatcaatgtggacgccaaaatgtcccgcacacgggtgaaaaggccaatataaaaatacctgtcccagggtcgtaaggtgtcgcaggaaagaaaaaatatcggcgagagcgcgtgcaattttgccgccagcagggtgaccctcgtgacacgtcaatgccattgggtcattcacgttccttgaactcaccttctcatg

SEQ ID NO: 5158 - DNA, 700 bp, Nannochloropsis_gaditana
tcaagtcttttttgcttaaggaggctctctcttcaattggtgtcgtgttttttttaatcaagtagtaaagaaaaggatgtaaaggtgaaaaggagaagagcgacatgacacaactatgccatatgcacaaaacgtgcctcaggtgcataaatcctgcacatcacttaagcatacgcaaaaaagcgccttaaaaggtggctaatacgatttctagatcaatttacaagaacaacatacgggctccgagagaagtaacttggcgaatgatcgagtccaggcatatgggccaagagggtcacctcgatgcccagcgcgcagtcatcagccctacacaggacaatgatggcgccgtccgcactgacatgggtgcggcaggggttcatgaatcttaattaaaacattctgcatttttttcctcatagatgacgaagagttgtgatcacatctcatccgtgcgcatgcaaacccgacacagaacacagaagcaggttgtacagcttccccgcgtcccgatcacttttcctgccgtgacaattcatatcttggtgtgtgcatcactcaagagacgaatttcacaagcgcagagaccatgcccgtgccaacagatggcaatttagcggcgatgcaatcccggtggcctgaggtcgatctacgagtgctgtcgtcgcacttgagacttgctaaagatgacttggatgat

SEQ ID NO: 5159 - DNA, 700 bp, Nannochloropsis_gaditana
ctgttctagctttgttgctgttcgggggcataatcttgggtactcaacatttggggtggcgaaaaacttggcatgggtttctgaaagtcttgcgtggaatgcataggatagagaaggaatgaagaaaagaaaagttgttcgcgtatgtcgatggcgaatttttattcgaccgctattgaagaagtacaaagaaatattgaacagaaagtgcaccacgcatggcgttgattgactgcgccctccatatagtcattactgtcgtactcgatcgcgaagtagattatgaatgatgggaaagagctgtgaagattatcgccgcagcaacctgatgcccatgttgttatggtcccctgaacaaaaatgcacgttccaacgtcaagaataagtaaaatgtggtctaaatttgattctatctttacccaaaaagtacgtggaacaaagtgattacacctgtacagaaggcttaatgcctttcacttaaatgagatcattatgacagcaaaatagagttgattttttgaatatttgaattcaaacctgaggttaaaacttcaaagaagcatcgcgtgcttcccaatccctaggcgctcctgcagcctgctcttcataaattctgtcaaatgttcattttttccaagtaattggtgagattaagatatgctttacacctgtgtaagccacattttcgacataggtgatg

SEQ ID NO: 5160 - DNA, 700 bp, Nannochloropsis_gaditana
gtgagagagtcctaagttagcggaaggcagggaggaggtaaaagaagcgaagtgagacgctaggataccaccagaaagccacaaatatgtagcgataaaccggtcgttgttagattatcacgtgcaatttacatggttttaagccacgctcggtcatctaacgcggacgtgcgcttactttcttcttttgggggcggacagaaaggggagggcgtggtggtcgccagaccggggcggtagaaatgagcgagtccgtttgctaagcaccttaccgtgccaatttcactgatattattccggccttcctctcgaacacatgcagggtcactccagaggatttctcaatttacgggatttgggagaaatactcgctttttcggacgagtataattattttacctccagccccagcattgacattgagaacgtcgcggacttgtgtgccctacggtacctgcttttttctgttccgggaggcggggagggcagaaatacgtggagagtaccgtaacaagcctgaaacacgggcgtggcaacactggtggtcaaagatagattgaaggtgtggaaactatggagttcaactccctccccgggtcacctgctcgacaaacgaataacgggggggggggaggcagacgaggcagaggcggagggacggttcggcaacaccagtcttactcctggttttcagcgcatg

SEQ ID NO: 5161 - DNA, 700 bp, Nannochloropsis_gaditana
ggtgatgcaccatgtcccatcataacaagtgaacgcaggacccgcggggatgcacgtaccattttgcaagcaggcaagcacaacgggttctcctctaattgctgttggttgccttttgtcgattgtagtgcaagaaagctggatgcgtgagttatgtgcgctgagaattcgcccttgacgagcgctctcgcctgtgccgtagcaagcgacacccatcgaaacgaatgccccgtagaaaataaatttaaactaagggccagcaagtagggaacataacacacttcgcgcaggatgcaagagcagattacacgccactggagagcaaaggacctgcgtggacgcgtaagccggggctagacccatgaggcttcgatttgaattcttttccttagcgagcaccccctcgaacgtgccagtcctgaacataaaacctttgccggtgccgccttaatctttggggtcattctggttgtagacataccacgaacgcctgtgtggctttggtctcaccgtgtttcttcttatcgcggcagatcgagattcattgaggaccaagacacgctgagcgcgctctcggacacacaaggcgccttacccctcttgaaccagttcacgtccgagtctctttacctgccctcacgcctcgtttctacgaaattaattgaccaagacgctgcacaaaagagaagacccaacaatg

SEQ ID NO: 5162 - DNA, 700 bp, Nannochloropsis_gaditana
ttacaatgctaatttcgtttgctcgagaaacgcatcgagtatcaggagtgttcgtgctgcaggcacgctatgacaaactccccagaccgcagtcactaacttatttctaatcatgtagaagaccaggcaaagccaaaatacggggctgaatcctacacttaacaaaatctgatacccaccagggattatctaaatctctgcgcgacttactcacattttggtgtagtttgtgctgtgatgttatcccttcgcggagaagtatcttgctccgcaaaaacaagaaactccaggctaggacgccactacaaacagtaaaaaggtcgctagctttgccagtgtagaaagtcaaggaatatctaaccttctgttgctttggaaaggaatgtatcgggggtcatgagatcggaaattgactcgagcagtgacccgtttgcctgcttcggtgatgatgtttctgtcttggctggaggccaacgcccctgctacccgatgaagcgacattatcatgcgtcgaaaacttcgcgcaaggatgcggactgatactttatcctcctaagacgcgacataaacccattgggtgccttttgttggaaaaggattttgacccaagtcttgctgtcgcgcgagtcatacgatacctcgcctctaatcaccatttcctcctacggcagacactattacaggagcatcggcattcatg

SEQ ID NO: 5163 - DNA, 700 bp, Nannochloropsis_gaditana
gcctctcccatgcacctccaacatggaattgttgtgaccccggtccgcaatttgtgacgacaaacgatgacatctttgtgatgcggacatggcagcttttttgtggtgggattaaatgctttgtgaggccgtgtaggtgcagaattcagtttggccatggcagctgaagtatcgcaatgcacatcctccgcctctcctttcgtccactttcccgttccttgatcaggtgacatatttctatcatgctgctcctggaggtagggatcacttggctgtggctctgacatggagcgctggtgcgctgaacaagaaaagacggggaggtaaagtggcaaggcgtgagatcattcgtgctgcttaaaggaagagcgtcagcttcttgctgcacttcggggttctctttccgatgttataaggtcagagcgcttgccgtctcctcttcccgctcactattccacctacagactcttgacaacaaatgatgactgcttagcgccatcttgcttgcacttccgggaaagcacccttggcagtgcggagcgtgaaaaggaaagcgaggcgtatcttccactttgtttgggtccatcgtttttcacaagttgtttacgcagcttactctttcacgtttgcctggcactgtgtaacatctttccttgggcattatttgagagggagggctttgttttatcaataagctatg

SEQ ID NO: 5164 - DNA, 700 bp, Nannochloropsis_gaditana
acgtacagtttcttcagaggtagaatgtgtggtgaaatccctttgcataaccgcatccgttgaaattctggatatttatgccttagtaggacctatggacacatttgattatcgacacgtcaccaaagtccaaggtcgtccagttgagggtctacttggcctgtacagcttttccgtcgatgccaataccattccgcgtgaacaagtgtggcagatccagcttaaattgtcgtctaatgcacaacaaatcacgtctgtggatatacatgacttcagcgtaattattgacacactaccaggatctggctccgtgggtattggggggctgccgctgtcaaatacaacgacgcgtctcggggacttgaatatgaacaagagcaacagaggggcaacaagtacctcgatggacttgtccgactccgcgagaagccaggcaagcaatttttatacgtcgacccggtcgatgagtgctagtacgcgcacagccgccactaccaaagtgggtcgaggcctgagcactgcagacagggacgccactcgcagtgcgagtcacgtcaatactggtgcccccggaggtagtgctgccacctccttgtcgtcatcttcctctgcgttatccgcatcctcgcttgttccacgggctcatggcaacaaggcaagcaagctctctcgatctacagaattgtcatcctccgcaatg

SEQ ID NO: 5165 - DNA, 700 bp, Nannochloropsis_gaditana
ggatcaagtctagctcacccttacacaagcaacctgagtcttttatctgtttgcccaaatctcaaaaaaaagaagattagaatcgagcgcgtgttcctaccgtcaaggcgttctgtgaacgtcgtagccactttattgggcctgggacacagacacgcctgcaatgaaaggatcggatcggcgcattcggaggatcgcgaagcgccctagcctcccatgggtgcaagggacagctaagcgcccgccagagtttcgtgtgtctatgtatgggcatggaaattatggcgtatattcattgctgaacgttaacggctgggtagctcgttcttgaaggtaggcgtgtcgtgtctggtgcctttgaagtgaaatgggcgagggaggcgatcagattctttgtcatcgttggggcgagtgctcgtgttcctgccatattgcgtgaagagtgttacaaaaacacatttgtcttgaatccgctttagttctttaagtaaaatatccttgtttgagtgggagctatgaagctggttgcgctttcgctctagtccttgtgtcaagaaattaatttgaaaaaggcgtttcctgcactcaactcttgctgcgaaaccagcaatgcaccggcctttgataccgtcaccgtgttcaccggccctaacatgacactaaacagccagtgactacaggaaagcacgcccaagacatg

SEQ ID NO: 5166 - DNA, 700 bp, Nannochloropsis_gaditana; identical to SEQ ID NO: 5163

SEQ ID NO: 5167 - DNA, 700 bp, Nannochloropsis_gaditana
tgatttcgggacgctttccccaaagagctacgatatgctgctaattacatgtacgacttaccacgggtacagatcacggcaggaagagctcacaaagcacgggcggtgcctgcaatttttccgtcttccctttcacctcggatcagatcatctgtgcacgttggatgctgatgcgggtctctgtcaaaagcttgaccttgggtataggcagttacttaggcattctcggtggggggtattattgggcattgagccaacgggaagcagcagcaaaaaaagcgcttgcagagaaagcggaggatgcagcgggcaagccgaagcgtttctcggagacagatcgattggccatttttggggagggggcttcgaagtacgataaagaaatcgggacggatgagatcgtgatgggcctgaacttgttgcggtggtggttgttgcggcaggctcgggggaagattttggaggtggcgggaggcaccggacgaaacctggactacttccccaagggggccaatctcacaattatcgatttgtgtgataggatgatggccgaaacagagcggaagctaagaaaaaggtaaggaaaaggtgatgcgggagttattgcttgaagaatgatcagctgcctctgcagcgctctcatattcttcctttggtctctatccttagtcgccggggcgatgtgcttttcgggaaaatg

SEQ ID NO: 5168 - DNA, 700 bp, Nannochloropsis_gaditana
ccatgcaaacatatgcgaagcagccgcaccccaatgcagcgatcagcataaacagtacaaacgccaacaatgaaatgttacatgtctgccattgttgtggtgcgcgtgtttaccgtcttgactttagcaaaacgtgacaggaaagggtggctcgggggccgctcaaggcttcgcgccaaaatctcgcggacagagcctaggacaataaatttcttgcatagaaagaaacagacagacatttacgtgcatggtagtcataacatcatagatttttttaattttcatggatgctagagttgttttaatgcgcgccggagtcgtgtgagcatcttttcgggctctggcgccatgaacatcccgtccacaccaggcgcagtgctccggtcgctgaattctttttcactgagttgacgcctccaggtcaaaaatcttgccgtatttcccgggctgcagtgaataattcgatggaaaatgttttgtttgttttggatttcaatttttgtccgcttgtgatgtttcaaactttagcgctcggatgatctgcattgatggaatgcggagagagtacatgatccactgcctccacctgtacaacttcacatgaaattgaagctcaacctacagcggcacatattcaggacgcgataggtttttaagcttctcaggatctccctttactattttgaagacgcgtatcatg

SEQ ID NO: 5169 - DNA, 700 bp, Nannochloropsis_gaditana
tcatgacatgttcaaagcgatgtatcacaattttcatgagtaccgttcatgcctaccatccaaatgttgcgcgccatgattgtctgatgtcaacgaagtgccccaaatctcacattctcgagctttcgaatctgccttcgcatgaggagtgtaccgtgacaatgttcccggatgtggcatctcctgtatgggccgggtctacgtggcctcaggctaggtcgagtaacggctttttgaatgtgcggcaataaaagacaacgaccgggagttcgcggtccaggcgccgagtccacccgatggcctgaagagaggtgatcaggcaaatcatctgtttttcgacaacaaggcgtttgaggacatcagctgtttatacggatgcattcattctaaggctttctctatggtgaagcgacgcgtctatacgtatagtcgcctccatattaatagccgctgaggaggaggccatgtgctttgacggctgtagcaaaactctgccttactcttcttgaacagtgcttaattgatacggcacattttatcaatattcactcttcttttcggtttaatctacgatttcgcaggcgtgcaaggtattgccgacattcttcactcgcagtgaagatctacatgtatcttgatccgcctggactgcagtcataaccttttcgctggattatccatatcttgatgcttccacatg

SEQ ID NO: 5170 - DNA, 700 bp, Nannochloropsis_gaditana
ctaaaatcccgctaccttttagacgggcgaaaaaggacacatttcatcacacgtgccccaccaacaggcagtccttttgagaaaatactgtttcaatgatcaactggttgaggcggacgtgtcgtgtgattgtggccgtagatgaaaatggatttatgccccattgcccttgtattaagagctgcgggggtggggaggttggcggaaggggcagcgagatcgtcagtccgagtcattttgctgttcattacacggtgagaattctacgtcaagacttcaaaaggatataatgagaagaagtgatttttcttcaacagctttcagtttgcactttctgggaatctttgctcactatcccgtgtgttgcatggacctcgacctcccgcctctgttttaagaacagcaacgtctcctctttttactgtcacatctctgcctagcgcaatccgagcatacagacagtggacaggagagcttgcattcaactatacacacgatctgttttcgtcttgttttgaattgcgatgcgctattattccacggcacacataaattgtggcagggctgttaggcctgcgctaatatgctctttccgcaaccccgtaaccctctctcgcctgctctctcgccctctgacagatatctatagacattctctagtgtgggagcggcagtcacttcattataaacctgaaatatg

SEQ ID NO: 5171 - DNA, 700 bp, Nannochloropsis_gaditana
ttccccatcggaaagctttttatttatttcttctccgacgacggggaggtgataatatttgcacgatctttcaaaaatgcacatacttgacctgcaaccttgcgtcctgaaggacacatgtggctgcatggcttcttatgcatctcacacagctagcattgttgtgccttttttcttttgaatgcctgtgccccttttaattcttgcgcgtgtccaattcttgcagccttcaaattgaggcacgcttcggagcgagagggagcatgcgaagggagttatgtgcaaaaactaagcagcgtagttggaacgattgcgttaatgacgtccatactcctcttttcttaatgatttcaaagtgacatattttacaaccgaaggatgtgacttttgatttcctggaggaacatcttgagaggttttttatatcttgcgatcgacttggaggaaacaatgcgatatgttgatgattttgccgtggagttgttgttggccatgtccatgtatgtcgtatgacttaccactcgatatatttgtggttatacctaagcacagtttcggaggcgcttggttggaaggcctcactgctagagctgccttgaagactggaagtgcctgttgacgcctttattgcaataattcgcgaaccagtggtggggaggagaggtcacaagccaagcgaagctaagcattgcatccaatg

SEQ ID NO: 5172 - DNA, 700 bp, Nannochloropsis_gaditana
gttgcagagagggtcggtgccaggcgtgcccaaggtgcctgcgaggccacagccttgtgtccagcggaaggttcccggcgtgggcagcaaggtcctgacttatgggcttagcgccttcgacttcaccgggctggggaatcccacggtcaagcgtttcgtggaggggttgcagggggcggcggtgacagcattgcacaggaaaaagaacctgggggcagagagggcgggcgcgggggacagtgacggggaagaggaggcataccagttttgttatacccttcctgacaagaccgcggtcaaaagagccttgtgtgtgatcgagaaagtccgtagaagatacctgacggaggatgctcgctgtgcgagagaggacaacaagcaggtgtacgcagaagttgcagcccgcatggcgcgcgcaaacagggtacgaatcgcagaggaggtcgagtacgaggtgggagggcctggtagcgcgcctgaaggcggcgggaaagcgcaaaggaaaggggagggtggagtcgaaggaaatcagggagagggggtgcagggagggccgagcataaatgccgacaaccgaagcatcagccagctctaccgtgagctaaaagcggtgcccttttcccagcgactgctggtcaagcgcagtcggattcatgggtggggcttgtttgcgaaggaacccatcaagaaagacacgatg

SEQ ID NO: 5173 - DNA, 700 bp, Nannochloropsis_gaditana
cctgggagaatctgcgcattccgcgcagtctcaacaacagtccgatgcggatgtagagaaaaaaagcgagctcagcacagggaaaataatgatcatacaagaccgacagcagcttgagaatgcctattacaatcagcaacagaaagaatacttggcgcgccaacgcatcaagcaagagcgaaaggcgaggaaggcggcagcggcagcagcagccgcagcaacaggagcagccgtggcagtgtcaggcgtgaggcataatcgccctccccagcaaaactattcagatcaacattcctgcacacgcgaatcatcccgtccccctcaacaccccgagactgtgcgtttcgttctgcctgacgttttccccggtcaacatgatctaaagctgaaaaaagagcagagggttgggaagcttcgagaggtagtggccctgcacaagacaaatgtggaggatttggccgacgggaaagataaagagaatgcgcgagatgtaagtgaaataagtcgagtgtccagtgtctcggaaacagatattggtgtgcctcctcgacagccatcatcggcctcggtgaaagctggacaattgtgcaacgttatcataccgctgaaaggctggaacgaaggtgcagtgtcctccgaggtggaaactgaattgggtggcctgtgggaagatccacgacggtgctgtctgtgcaaaatg

SEQ ID NO: 5174 - DNA, 700 bp, Nannochloropsis_gaditana
aaagtgagccagcggcacagtcaaaagaccgacgcacgcatctcctcgctcaaatagccatctcgcaacgattgaaccacgcacacgtggctttaaaggcgtgtgtctcacatgacattgcccatcaaaagtcctaagttaggtatcagggtcctcgctcaatttcctttggcgatggcccaaaaaggcggcaaaagcctcccccccccttgggattgaggtgagaatgctccgctgcacacttatacgtgccttcttacgcagcaagtacacatacatctgacacattcaggctctgagggtatagatgccggcatttggctcttcttcccccgtccgaaggcaacggcgcagggtggttggcaaacctgcgggaaacaaaagtctccattcgacctcatccccacgctctgcttcttccattccgattcgacccgctacagctgcacattgttcgcgtgacaatggatcatggaatcccgcggctgtgattagatccgcttacttcccccaggacgaggaggaagatgaatttgagacatcgtcttgttggaatgaggagggagaaagcgatactccgggcctcaggcatgacacaccattaaaagcgatggaagaggctgaacacgaaatgaaaaggaaaatattggcacaaattagacttccaaaggcgcatcatttcggaaacgtctcgaggatg

SEQ ID NO: 5175 - DNA, 700 bp, Nannochloropsis_gaditana
cgctagaacaagcagggggcggggcgatcgcactcgtttcttcccgatggtactactacgggcttgtatcatttcacgacaaatgcttcacacactcaactggcaggacgtctgggttgctatgacgcgcttcgtgacgatcgtcagtattctacttgtccttttggaaagctcgacggccttccacttgcctcgattccagtctgtctcctcgtcctccgttcggaatttacagcgactgaagcaagtacggagacaagtttccacgaagcagggatcgtatacgaaaacatcacctgttttgaagacggctgtggggcttctgaccggtggcctgaataatttggtaaataaaaatatcaatgtctaactgagatgtagcgttcgaaaaatgcgcatatgagccccacggttcattcacacctgtaattttcaacttgcttactcggaccgttcgaacatgttaatacatacatctaatactgcgtcaggcaaggcaagatgccaaacctcttccttccaacacagtcgcgcgtcgcctgtccccggctgtgctcagacagaaaattgagaaggactacaaggctgcctattttctgacaggagacatcagtactgatgcatacgatgaaaattgtcttttcacgggtgcgtgttgcaattggccgggaattccttatttttggaggctcaatcgatg

SEQ ID NO: 5176 - DNA, 700 bp, Nannochloropsis_gaditana
gtggttgctgttcgcctcacgattactgcacccaaccccaacgccaccactgctcttgctgcaatgggcggcaagtttgagacgatcaagggaaggagaggcatgtggcaacgcttctcgggcagctcgacgcaggggactaccaaagttgcctacgggggccggattggacctcgctgagaaactactggcgccgcggttcgtcccaggacggggagaggaaacgcggactcgctgcacaagatgctgcaggtcctgatgaagctcacggaggaggcgggcaagacgggcgttgtcctccagcagcttctctaccaagtgcttccctccaccactcctgcaatcggctatatctggcccctggcactgtgcattccacgatttgagctcctccagcatctgctttgtgctagttaccaaggccgcaacttcaaagccgtaacgctgaagctcgtcggcacgtcgcagaagctcgccagtctcccacccttgcgaggcgcctaccgtcatcaagtgcgccgcagcatgctccattccctccttgatgagcgacaccacccgctgtcccccgcgtccacactcctttctgccctctccgtccaccttggacatgtgcctttcaagtaaggcaagctgggcagtgatctgccgcgactctcccaagccgtggctgtccaacgcctctttcaggacggcgatg

SEQ ID NO: 5177 - DNA, 700 bp, Nannochloropsis_gaditana
cgcggatccatcataagccctttgcaaaaatcgccctcttatggcatgaaagatggcaagtcataaggaacactcctcccaaaaacgtgccacggggaaaacgaaggctcccaaaaagggacgatatgggccgttttcgtggcttgagcgagggctcacgcgcgctctccttcacgctcccgcccgcgccaagacatgtccgcgttgctttccacaggaagtgacctaatacccaccgacggtgatttcgacgatgttaggcattattttagttgatagtgtacagaaataattgaatggtgtcctcatttctggaatgcaggcattttcacggctcttcctatccgattaccatggtagttctcgttgcagactatcggcagataaggctgtccctgccttgttgaggttatcggtcgccttccaaaccatgcacttgtatacaattttattgaaacaaaatttctgcaggtaggaacgcgactgccggttgtggaaggagaaaagctgacgcgtccctgctttcggtcggtcacctcccctcaatttgctggaggaacactcataccgccgagacgaatcaagtgtgacgtacagaaacgatagcaccgacctctccagatagccttgcgctcgatcgaaagtgtggcgctcctgaaggccgggaggtcaacgaatacctacaggtatttatttcatg

SEQ ID NO: 5178 - DNA, 700 bp, Nannochloropsis_gaditana
ggtttctgcgtatgtacactggtaactaacattgattgaccgatcgagagactcgtaatcctacggagcatttcggagactacacggcgatcttgcttttggcaaaagtacttctgggtaacagacatttgctgtgatttgtgtgacttttgcttctttttcaaacgtttgcttccacggggttcaagtgatcgcctttttcccctcttcgtacaaagcttgggcagcgcggtcggagaaacgaaccatgttcatcagcgaagtggatcactcacaaaatcattacgacagcattgaaaaatgcgaaaattcgattctcagttcgaaatacttcggtgatgaagcctgaaagaaccaaaacatataacatttccataacacctggcccatcgccctctcgcggtaagcatcgctcacactggcaggcgatggctgcgatgatgttgagcttcaaatatggagacggacagcatagccctttcctattttttacaagcacgccgcgcatacttgtcaggacgttggtacacatacatctctttaaagcgccccgtcttttaccacgaggcacagggaagtgcttggtcccgtcagggaaagcttgcagatgaagaacaagatggttaagtccgcctgccgcattgtggctgctgcagtggccctttcccctgctttaagaagaagtttcgcctttcaaatg

SEQ ID NO: 5179 - DNA, 700 bp, Nannochloropsis_gaditana
gccaggagagtggagagacgctgcctctgcgcatcgcttcagtcttcgtcatcatggtggtatcagccttgggctgcatgttccccctcctcgtacttgatttggacggacgagccaagtttggaggtaatctgcctctgactccttcttctcggaacaaaactgacggggagcgtgttttccacggggcccatgccatgcacctgctaaaaagcttcagtgccggcatcattttatgcgttggttttgtccatgtcctggcagaagcgaacgagaccctggaggagcttgtggatttccccctggccttctttgttgccatgatgggctccatcgtggtccttgccctctcccaggtcgtggacggcgtggtctcgagcatggggcggaagagccgcccccccggcccctccagcacgggcggcgtcgacatggtcagtatgggccgagacccgtccttgaacatgagcaaagtcgtcatctccgcccccgatacctccccttccgcccgggcacccagcattcacctggaagaggccgctgtgcaagaggggctgacggcctcccagaagcaatttttgcaggctgcccgacaaggggcagacggcgccagtgggaacgagcatcagcatgcacccatcacaccagtaggggccgctcttaccggtcgaaagaagcccacagacttgcagatcgtccc

SEQ ID NO: 5180 - DNA, 700 bp, Nannochloropsis_gaditana
ttccaacaacgatacagtcgagggcgccgcagctttcattttcaaccagattgaatagatggctgaccatctccgccgtgctgatcgttctaaacagacgaaaaacttctatacggtaagcaaaaacagattcgatgcttgtgtttgtagtggcacgcgactgacatgtaagtgacctcattcagactcttatggggcagcaggaatatcctcagagccgatagccacgaacggcgatcaaaaagcatatatgcgcttccttttggagacttgacttcccctaatctcgccatccatccatgtcttcaggtactaggggtcgagaaaggcgcgtcaataaatcaaatcactaaagcatatcggatcctggccttgcgctatcatcccgatcgcaacctaaaggatgccccgacgggcgaaaagtttaaggaaatttctacagcgtatgcaattttatcggatccaaataaacggcgacgctacgatttgagcggaggagacacgtcagaaatgtttgacgacagcacagagagtctggatttggaaaatttaaacagcctgcaaaaggttgtgtttgccattattaccagatttggtccaaattttcagacgcaagtcaatgcggagacattgatcaaggctaaggatttatgcaacgatgtgcgggccaagaaccggggcaaggagaagggaaagcggg

SEQ ID NO: 5181 - DNA, 700 bp, Nannochloropsis_gaditana
acgagatcggttaaggcctgaccgttactggcggatggccgtttaggcttaatccgcaggccaaatcactgtgtttgtggagacgcgcacgtgtgttttatgcgttccttaactttatgggtagaggctcgagttgtgttcgtggataatttatttgaaagagtaggtatgtcctctagtattctttgaggaggacagggaggaattaggtaggcccatgcatagttaagcttcgttcctattgatgagaaacactgtgtctggctacgatgcggcatcgtaaaagtatgcaatcaaatcaagatgaatcacgaatttttaatacgtacacgttttcaacggggatcgacataaagtcccgatctacgttgaaggactcaccctcagatgcgcttttccaacaacgatacagtcgagggcgccgcagctttcattttcaaccagattgaatagatggctgaccatctccgccgtgctgatcgttctaaacagacgaaaaacttctatacggtaagcaaaaacagattcgatgcttgtgtttgtagtggcacgcgactgacatgtaagtgacctcattcagactcttatggggcagcaggaatatcctcagagccgatagccacgaacggcgatcaaaaagcatatatgcgcttccttttggagacttgacttcccctaatctcgccatccatccatgtct

SEQ ID NO: 5182 - DNA, 700 bp, Nannochloropsis_gaditana
cgttaaaaggggaaggcagggccgacgcggacgaggaggacgatgcaggagcagaggacatgaggatggacgtacaatccctcgctgggcactccctatatggctgcaaagagccaaagtgttcttgatataagaagaaatgcgagcccaagtgaatagaagaaggcaatggcgtatcgccggatgcttcaagcgcgtgctcccagaggtacttgcgccatcacatcggcgcatctggacagccttgagactcacacaaatatcagccaatgttaaaccacgtatcgatatttttctctttatgccacagggatcatttgctcggaatggtagacgagtaaatgatggcttccacgacgagcggcgccctactagcgacctatccaacgcctcgattgctccgaccatccaaagtacaaattaccacgttgcagacacctatcagtaggcaaacagaagaattcaatggcgacgagaatgagtaagtttgggatcgggctgcgagaccaataaatgtatcttttaaggaatgtatccgagtttggtggtcgggaggtcagtgaagtccaaactcaacgacgctcgccacgtccgttccgacgcaaaacccgtctaggtacgtccttcattgtgtacacactgttgacggtagtactttggctgctgcgctgtcaaactatcaaatcaaaatctacgatcg

SEQ ID NO: 5183 - DNA, 700 bp, Nannochloropsis_gaditana
ctgggccccgtcctcaacacgcacgatcgtgtgcaaggcagggctcaggaagtcgaagagctccgctgcaaaggcagcatcatgcaccgaaagacggtcattgtttcgaaaagcatgtcctttgagcggaggtaggttccgagggttggtgggagtcatgccccgggcctctgcggcctccaccatacggcggcactgcgcagtggtgaagacatcggagattgtcaagagccccgggcccagttcttgaacttcaaaagatggaggaggacgatgatgcttcgcgcgggcactcgatgaggcggaggggcgcttgtgttgtgcttcggacacagccctttgcaaagagggccagccgttaaaaggggaaggcagggccgacgcggacgaggaggacgatgcaggagcagaggacatgaggatggacgtacaatccctcgctgggcactccctatatggctgcaaagagccaaagtgttcttgatataagaagaaatgcgagcccaagtgaatagaagaaggcaatggcgtatcgccggatgcttcaagcgcgtgctcccagaggtacttgcgccatcacatcggcgcatctggacagccttgagactcacacaaatatcagccaatgttaaaccacgtatcgatatttttctctttatgccacagggatcatttgctcggaatggtagacgagtaaatg

SEQ ID NO: 5184 - DNA, 700 bp, Nannochloropsis_gaditana
tatccaattttgtcattttcacctgcctttcggagagcagattgtgtaagtcctcgttgcctcagagatggcacctaccctgctttccgaaaacttgaacggaaaatgttgaaaatgttaagccctgaaagtttatgcgtgttcatcttagattggggaagaggcgaaatagagtttgagagagaagcataccttcaagcaagacctcagatggccttgtatcccaacgcaacaagcccgcaggtaatcgaaaaataaggaaccataacgttgccatcgtttcaatatatgctctcgtttggctttgtgtttacgcgactaccacgaatcaaaattcccgctcacgccaagtcccaggtcctccacatgtgagcagatcggatcggttccgtcgctgactcgcggaagaaatcgatgcctcagagggctcaaaggccgtcgcatgtttgcgcaaggcgctcgtgtccccaacacaccttcaccgcgtgttcgacttatttgattgtattgattttgtctttttattgtcacatactttggctgcttgtgaactcagcacggtctctgtggtcaatcagcgtcatgctatcgtctaggactgcactgcccaacctagggttggcagcctttaactcacacaacgaatgtttctaaaataaacgcatgctaacaggttggtaagcggaagggagagaggatg

SEQ ID NO: 5185 - DNA, 700 bp, Nannochloropsis_gaditana
tttcagctttcaaaaggagaagtagattgagaagcccgcgcttcggcaaattgaaacggtagtttttcaatgttatcacgactttaacatggaacaatatcattgagccccttggccgcaagaaatatttggcaaaaagactaccgggaggcaatccggtggtcctttgttcttctaccaaaggagaatttttcagccctttccattaaacaaaaatctcaggcagtccaacgacatctatgcggtgaaaggacgacgctttaaatttactcacttcaaccaaaatactgtagaaagaggcatttttccaagcaagcctaggaacgtacggcctggccatcattccatgggcccttctgccacttccacgatttcggccctctctccgtcgagaggtagactcgtggcacttggcgcgcctttcatgggtcaacacgccacggtttctgtgcattagcattatttaccagtactacgaagatagtgtacaattatgccggatgccggtgcctggaactggctgtggtacttgctgtcgtgcacccgtgcctttcagagagagagatgttggcagccaggctggtttgaaattcgtcgcctcctctcgttttgttacgctgccatacccacaagcttttaaaaatacgcgttacgtcatgcattgacagaacacggcgatttcgggaaccagattgtcatg

SEQ ID NO: 5186 - DNA, 700 bp, Nannochloropsis_gaditana
cgccattgcacaagaaatcggagcgaaagtaggccgacgtccctcccaccttgatcaggtgcacatccaagggcgcggcccctggtctggcaatgcagtagcctttcccttccgtcacacaagcccatcccccaacggagccgcccgtggctgccaggagcggcgcgatgtcacccgagcgcacgtacacgtctgatcccgacaaagccccctcctcgtcctccccctccaccgcactggcatagctacccgctctcctctccccgccaaacccgtcacgacccgcgtccaaggtacttgccagcccgtccatctccacaccatccccccctgcgcccacaacactgcccactttctcctttcgtcctccttccccgcccccgtcgctgcttctggagcgcacgcggctcgggcgagcacccggcgagtgaccagggaagacagatccatggaggccgctgctgctcatcccagcctcggtcgcgctcagcctgtctgtgtcttcctctcccagccccgcttcgccgccagccgccaccagctcgcagtgatagaaataccgcttgtcgcaccgccgatgcgcgccccccggactggccgccacggaattgtgcaggtcgtagacgacaatgtggaccgaggcgtccccgaagtacccgcccaggtcgatggacttctgccccgcgatgttgaccagctg

SEQ ID NO: 5187 - DNA, 700 bp, Nannochloropsis_gaditana
tttttactccaccttccgccccttgagcactctcgtatctcccccagatttgccttaccttgacgtaggctagatactccgcttcccagcgcttttgtcgattcaaacgctcagcttcgccttcttgtggaggtggctctccatagcgcagattgaattgtggtgttgacgaggtcccagtagcacgcagtacttgctgttcaagtgcagtcgtggaaggtggcaaggaagctctcggaagcagaaaagcgtgagcggtgtgaactgccaacaaaacgatgcaaaccttctgtaccagcgccatcatgctcttgttgatctacattggtaaatgatggtgtacacgtaagttgatgcgctttaaggctataaaatgcccctaagaggcaggaatcgcctccccctccgctcaatcgacgtcgcgcacttcaacaagcaatgcgcatcgaggtaggggaaaagttccaagaccttagacgatcattacgatagctcacagcttctacggcacctacacacaggaaaggagattagaggactgttgctactccagcgcacgagtttcccgcgcattgaacgaaaatgccatgcggaccaagtcttgtggtggggctgagtcgccatgagcctccccgccgcctgatgccttggtctatctcgattatcatctgcttggtcgcccttatgaaaattgttcatg

SEQ ID NO: 5188 - DNA, 700 bp, Nannochloropsis_gaditana
atgcgctttgctgctccatatttttgctcacccagtgtctaatttgctatccccaccttcctgagctccgcttcggccccaatctttccgccatcttaccttggccgttgtcctgtagtcgacgtacttccgtgtcaaatcccgcgtcgccatacgtgctgcgtggttccgtcgtgacaacggaggaggaggccgtgctttgttgaagaggaaaggagagggaaagcggtgccaaggaaggtggaacaagaccggaggtagccgtcacgccctcctaagctgcgtctcgccttttcctcgtgatattcctccgccacgcccgcggcccacaggccagcttgattgcaaaaggctccctctcttagtgctgggcatgagcaaaggcagagggtattgaggggttccaggaacatggtgacataatcgaacgcgagacttcgcgcgaggcagcgagagggagagcacgaggcagcaagtcaggcagccccccattcttggttcgcaaattcaacgcgggtcatttttgactcttcgtaatcgaggacgaaatttaaaggggaaaattggtttccatacctgtgacgagtgtttcctttcctcaaattgtatcatcgttctgtacatgcatcacaggcaacatcaccccacacatgcgtcgcttataaatcgcagcacatgggatgacaaaaaacaggaaatg

SEQ ID NO: 5189 - DNA, 700 bp, Nannochloropsis_gaditana
ctcctccatggccattgcaggtcaacgccagagcagctgtgataccctatagcctttttggaacgaagagaagtattcaacgtgggcaatgtacgtaaatctgcaggaaaccaggtcgaaccccaaaaacatggcacgcgtttctgcgctcgctcatgaattacggcgatgcggaatttgaccaaagcgacaaactggtcaccctctttccacgggctttcaaggaagcattcctgtcatcaggtcacggctcaatggtagaacggtcgttgcaggggagtggtgggcgcgatgagacaaccagggactgtttatgttgatgtggactgcggttggcttgtgccagccgtagatggtgaggagtgtttttacgacaacgcgcatcttcaactgtgtactttggttcagcattggtccgtcgtcttaatctgagaaaaaaattcctcaacattgagtttctttgccatgtctcaatgccattttgcatttgtccttaatgtggggataaaggatcatatgcatgcggctagccttctctgtacggcccatacacagacaagccggtgtcgcagactgagatgcattcacacgtgttctgcttaagtctagagcgtatgtatgcgcataaatattgccttatgtcattacatcgtgtttttgaaacagaccgaatcggaacgtcttcgcctcgtccgccatg

SEQ ID NO: 5190 - DNA, 700 bp, Nannochloropsis_gaditana
tgaaagagagccgtctcttccgtgaccatgcattcacatggtgttcgcttgaaactcacctctttacgctcccactgcttggtcgcgggtgcaaagacataaatgacaacatgtgtcgctgttgcaagtatctcggacacggcatcgtcgcttctttgaagaatcaagaggttagccgcctggacctgttgcggagtcctcttcactaggcccccgctctcggtcgccatgatctctcctgtgcaaggtcaataacaagaaaatcagggatggatgcacatcgataagttagtgctggtgcactcgtgcagagatgatacatgcatctgctagttagagggcagaatcatactctgttcagattgttgtgtttcttgtagatcgagagggcaacagcagccatatttcaccccctttaaaagtcttgcacatagagtcatttctattgatttcgtgcggaacgtcaattctaggtcgagaaggcaagacgtgaagtatcagatagtgcgctttttgtgggcggcagctgcaagaaatggagtgaaagtgtgttgagccacccctcactgcatcgcgtgcatggaacaaatggcgaggctcgggatacaccttttttgcttcctcatctcaagtctttcacttctcggtcgcgtacattccacccatgcacagacacacatacgtggaaaagaaaactatg

SEQ ID NO: 5191 - DNA, 700 bp, Nannochloropsis_gaditana
cgctagcagatgaacctcttgacaatgacgtcataccttgatggatccgttgaacagcttgaaacaagagggcggtcacccactaagatggccggtagtacagactttttcatggttttggaggtgcgtctatttttgtaaaattttgtaatgacgaaataggaagcttagctctctcgccaagactttgttgcttttcgtgcctgcggtgcccgtgaaggaaaagcgtagaagaacatcgacggcgcgattacgcgtggttcggtcaacgtttcttattcgaaagacttgcagtgaatttttggtgccacttgtaatcagccacaaagtaaacttactatttgtccatttttcgaattggtggcgggtggtatatgcttacctgaatgttatgtcgtaaaatggcaaaagagtccccttccttcaacctcccgtccatactagtacaccgcaatattaatacccttatctcgaactaataccatcgaacaggaaaagccaagtaaacgcctgtctcgctccgatctcgccataattacttgtccatgctcagggctagtaaaaagcctccaatttcacttgagtcctccctcgttcaggacgatctaccgtgtaaagttattcacgggatatacattggctctgttcacagtgctttcaactccgatgccttagggaaatgtgacattacgcacatcct

SEQ ID NO: 5192 - DNA, 700 bp, Nannochloropsis_gaditana
ggcgactttggaaagcgtcattcttcaaaataggcgtaaagctatgctaccacgtctctgtagtgagcagaatatggtgcgaaatgagtgcaagcatgaatttcagccatgtgaggattactaccttgacaatgtcgtaccaggtcagatagatcacgaagagaaagagcgacatacgtgaagatggcgggtgagccagaaaggacataccaaacaacctccctagcttggagacttcattgtaaagcaagcaaaagattgccggtgatattcacgagctagccaacaatatctctctcgttggtcccacaccatgctgtaccgagaaacaaaaacgtgagcatcgcaggagggccatgtcagaaagtctctttactttccgacgcctgttcgcgagtcgcctgtaggctgacatttggggatatttcgtttgcgtggaacggatcaagtggaagggattgcgcgagtgggagaggaaagcgaggcaggatttggagcccgaaaggtaaacgtttgcactcgcacatcctctgttttactttcgcactgcgaaaatcctaacaatcttttgctgaatttttcgtgagactgactctactgccactcatctgttgtaggtgggcctggagcggagccttcatttctggcgcggccggtatcatatcaacggttgctgctcctccacccctcatcacctatg

SEQ ID NO: 5193 - DNA, 700 bp, Nannochloropsis_gaditana
gaggctgtggtggcggggcacggagaggattcgaactcaccgctttcgccacaggaccagtgtgtgttgagggatcgcgccgaagcgactcgactacgttcccgaaacagcctcgtaaggactatggtactttctatgaagtcgaaatcaagactgtaccaccggtgcatttccatactgaggaggtcgaggaggaaaaagtaggagtgccattttaaattgaaaccgctggaaatatcacgcatctgcattttgtctggcaatatctgaaactgcgcggcatcaatcagtatgaaaagccttccgtgttgaccgcacgatgacacgggtgtaagctgtacgcacgttggactgcgaggcttcagactgacatccgcctgcgggtcaagaagtgaatgaccatgcgaaacctcgtcttttctgctttgtctttgagcgactaagacacactacaagctgtcgtatggtgatgcatctttttaatcacagccatgaaaatttttaacttgtttatgatccttcgcttctaggggcaacagagaatttcatctgtacactagtttattgtaccttacggtcttaccgttttcctgaagaccgagtattgttgcgggagaaatgctctcatacaacggttgtgtggtataatttgccgtttgccgacattcattctactcacagcctaggaactagcaccatg

SEQ ID NO: 5194 - DNA, 700 bp, Nannochloropsis_gaditana
gctgtgaatgttcgaaaactaaaaatgaaatgaatgtcttggagcagactgtttgtcacgcggcgcgtggcctccatggggaggcacgcatcacttcacgctcaggaacacaaatcggaggcggaagcgcgaaggtggaatggtttcccgtcgagaccgcctctgagtccataaaggtggcaaatttccgatggcgcatttgtctgtgggtgcccacgggtgtgtgatgcgggttttcacgtatcgaccggcacattttgcgaaacggaaatgtttttggtgagtcttgcgggaaccgagagcttgtgtcgtcactaccagctaggccgcccgcccctcaacaccatgcgcagctcgctgtgcactcgaaagcaaggatctgaaactccacggaagagggatgatggacgccagtgcatcatgctgggattttgtacgcgcggtttaatggtgtacacgtcctttagactttcgaagtttgaagcacggtttacgatctgctaggactgagaaggtggctgatgtttgccgcgttgaatcactcatttctgatggtgtaggaaactcataatgttcccatcgataccgtacaggtgggctacatttacaataagcataccgccttgcggttcccaccctcacctcgcggttaggcccgcaccccgtaggcctttgatatcctttcctcccaggaacgatg

SEQ ID NO: 5195 - DNA, 700 bp, Nannochloropsis_gaditana
aagatggaacagatggacccagagacgcgcacacgcacgacaagcattcttgaaggtatgggccacagtgccgtaatgcgtacaatgtctctatcttcctagttgataggaagtggaacataatgcagggaacggaagcgagacaaaattttacatatgcatacgcaaactagcaggtaaattgtctctcgccctatccttttgccgatccggagaaagttgtaagtttaggatgcctgactgctgtgcattttttgggatgacgaagaccgagacattcatgtccgtccgcttttctcttaagaatcgggtattttttattgtaatgcaaaagcaaaatccaaaagttactttgtcaagtgcttcagttgccacaaaaaacgtaaatgcgtccacatcgagaacttttcccgtggctggggtcggtggatcctccgagcccagttgaaccgacggcgaggaattactagcccgcccgacctgcaaagtcgcccagctcgtgtgtcgcacggcgcattaaataagcatcacattaatgaatgaagcatctaagttcttgtgtgtcaaatgttttttcgggaaattcaatgtcctgtacgtctcaaacgggccacatttcttgcgtcgggaccgaggccggagggaaagaggcgagcgttcctgcagggacggacatcggcttaccacgtcgcacacgaat

SEQ ID NO: 5196 - DNA, 700 bp, Nannochloropsis_gaditana
aggtgaggggtaagctcccaagatgcggagcctcaagtcaatgtggggggcgtatcttctcatcctttcaaccgctcgaccgtttaaaacttcaacctgagcgctaccactcgacgcggagaggggaagacaggagtgtggtgcatcctggtggccgcattctcattccactttctatccatgcagtattatgacagatgaagaggaaaatgatgccgttagcaatgacaagccacgtaattcgctgccctcggattctattcgtgtcgcaccagacgttccgggcgtctcgcctttaaaacatagtcatcactcacttttacatgatactggtatcggcgaccaatgggtcgaatataatcgcaatttgggaagtaattgcgactttcgtgccagcaccaccagcaaaaggccttttcttgaacctttgaatgacatcagtacctcaccatcacgtcatacgtatggagaagcatcaccctcgtctgcctctgtgaggacgcccaggaaggacaacatgggcatatacctcacgcgtgtcgcgacaggactacgaagtacggtcaagcatgcctttcggtggagaaaacgtccaccaggtccccgagacgtaagaccgagtgtaagagcgttttattacaagctcctgaacgcgtcccggccggcactggcttgtttcttggcaacgggggtgtccatg

SEQ ID NO: 5197 - DNA, 700 bp, Nannochloropsis_gaditana
ctaggtcaccaaagacaccaggacagatgctccgacatgttccacaacccgagcaactgcggtcaacgtacaagttcgcgtccactgcattacccaggctttcttccttcgcccgcgcgcgcatgagcgtgcggcggcgcgtttccttcacgggtcggtgcatggatgggagcatggtgtggaaggccgaggtgacggagaagtttgcaagaaaaaggaatgaaaaaaagaagtgactgcattttcttctcttcctccgtgcgtgcgataagtccgacgccataattcctgagacgtatgtagtggacgtggaatgtggggggtaagttgtctaaagttgaagatgactgttccttatgccgtgaggtccaggcgagaggaggggctcagggttggaaggagggcccgaggaatggatagctccggtcacatagtttgtcacggggccatatccagcctgtcccatctttttcaatccactacagcgcgcttctcggttcttgtgggtgtggtgtttgctttgcaggcacgcgcctgcggtcagtggggctgtgtggttctcccagacgggcgggggcagtagcttttgcacgcaaccaaggaagcatctacgagaacctattttttcccatttaatcttagttaaactctcttgtgcacatgacaggcttaccagcgcaacattcaaatctgcaccatg

SEQ ID NO: 5198 - DNA, 700 bp, Nannochloropsis_gaditana
gacaggcttacatgaacaaaggccgcgcagcgcacgaaataaaatgtggcccgcgagaaaatggtggaaacagctgcagctggtagacgatgtgaaatttctacatagcaggtatggaattctactcaaggcacgattacgacgagtgcaatctggagacgcgtgtccgactactttgtcgcaataaggactagagttaagcgatgattatacgacaggcgagatcggaagattcttggaatctcactggaatgaaaaagtttcctatatgtacattgtcggagcaagggaatgatccgtcatccagctttttgatttaaactactttcttttttgcttaacaaagggaggaaggagaagtggcaatatctaagtttggtgccatgactgtagtgatgacaaattagtcgatgtggtggttgaacggcatagatacatcatatttgtgtcataacctagaatttaagcagttaaaaggcatggtgccttagacggcatgatcctaccggctccgtaattaccgccgttccacatctcgacaacagaaaaaaggtgaaaatcgagaagaacctgaaggacatgcgtctttcaaagcaaggggcgtatgtaaggcctttcatgacatgaaaacagcattataagtcctatccttccttcccgtgccttcccctgtcccccctcgccaaactttcttagcgag

SEQ ID NO: 5199 - DNA, 700 bp, Nannochloropsis_gaditana
aatgacatggtaccccacttcagccaacagatcggaaatggccagacccagaccgcgattgccacccgtgactacggcggtaatgcgcggtgtgaatccatgaaatagtggaaagagaagcacaaagagcaagacaggaaacaccattacctccccttttttgaggtctccacccgggggacgaatcaccgccacaaaagcggtggtccacttttacgtcattgagagcctgtgcgatagttcacatgtgtagacatcggcgtaagtgagtctcaaagtgaaacaacaaccaatgtaatcgttggaaataggctccacacatcgctgggaccgagggcattccatcgcctctggctgttgccagtgaggttgcagcttgcgctcttgtgtgacaccaataattctccggatccccggacccgtgagatttcattcacgattgagtgaaatggtcagacaccgagtctcaaatttcataaaaccctgagatgtaatgcttgcagcacgggttccagagtcgcggagtcaacaagccagcgcaagcacaagtatccacgcgtgctatcaagcctcgccttctgtcttggctgctcccacgctctcagtgatgccacacgcacctttcttacgcctctttgaaacccttcaggcacgaatctcctcgctgttatttgcattgccatcagaggtcgtgaatatg

SEQ ID NO: 5200 - DNA, 700 bp, Nannochloropsis_gaditana
acccgttggtgaagttgtcgggagaaaatcgactcggaagttcatttgcaaggccgtgtgtgacaagtgcagtagaaggcagcccactatgaagacggcgaacaagtaatagcatttcttggtagaccatccccggaagcgcgacgcaagtgataagaagcaattgttatctgtccgtctaccacactcaagaccatcgaagggcttccagcctgctacgcgatgattagggcggcgcatcgatgggcgggaccaggaggtgtgaggttttgcgtcactggatgatcaccatagaggcctgcctttctggtcgcagcggcgtctccgagaccgtggcattaaagccatctgtctgatatcgctgcgaagaaagtatgtaaatggcaagaggagtgaaataacgctggtcgtggttagactgggtacggcgtcacggtctaccgaggcctgccacacgaggaggaggttggttgatactgccttaacctctcctctagcgctacgtttgtttgtttccagcgacatttttactgattgtgtgtaatcaggtaaagtgccattgaagacaagcattttgacattagtctgtaatgccttcaagcccaacaggccaggtcacagggtacaccgctacaatcctagtgctactcgaggagtgagggcccctggatcgagcatcttccggtgcttggcaaccatg

SEQ ID NO: 5201 - DNA, 700 bp, Nannochloropsis_gaditana
agccttccacctgttggcagtgagtggaaatagatggatgactggtattcgacaaggtttgtcctgtcccgtgactcggcagcttcacgtctctacgcggaagaagcaaccataccaccaccaaaaaccgcctagactgtacttggagccatagccatgacattacctagtgtgtcagagttgggatccgcaagaacgcagacccagatcaaaaatgcgatgagggtgatgtagacaacaagaatggtgactacactcatttatcttgaactttgcttcgacctatcgaaattttagtagataaattgtgccggatgctgaatacatatcttcttccttgttttctatttcctggtctggtgtcggagctttttgacttgtgtacaaagttcagcacaagcttgcggaagtgctggtatccctgtatgccataaattttataggctgcccctccccttcttttttcctccaagccaatgcaagcggcgctggcacacctgcgtgtgggacgagcctctgatgaattgagtggccgtgccgaagaaatataggttgtcctttttttgggggggtccgtgtaagcattgtcacggggggcctcgcttacttttcgagcgtcgcctcggcgagcgttcttctaagttgcaaaatttgacgtttcggtcccatcgacattcacaacacaggttgaaggatcatg

SEQ ID NO: 5202 - DNA, 700 bp, Nannochloropsis_gaditana
gcccggcgaccagcgatatggcaaataaaccagctcccaaagctatcagattggtcagaagaaaaagaaaatgtattcagaagtgtgtgtcaacatcctcggccagaagagaatagttaaggaacatacgccttacatatttgtcatggcaagcttcacacagcttaccttgccagcttccgggccccgttatcttacttttaagcatttttccgctttgtaagatcttcgcaatttagtcctgatctgtgatgtacgcacatgataatttcaatctggaaaacggacaggaggttacggagtcgccccggggaggcgagcagcgaggggggtgttcctggatatcaattcttcacgcccaacaaacctccgcgaccgaatgaggacgagtctgtaaatgagaaaaatgtcacattattcgcttgtgtctcgtgcgatacccgtttcgatcagctcacgtattcgcgcatcacccctctcctacacctcaagcccaggcttctcgttgcagcatcaaaggacgcagcggcctcaatatcttccaatgcttcgttcaacgacgacatcgctctttctcgtactaggggcaatgttgtgtgcagttaccaaaagtttcatccctgtgccggcacgcgcgtcccgctctgcaacttacttccctgcaaagcccaccgccatctccctcgtgggctctacaatg

SEQ ID NO: 5203 - DNA, 700 bp, Nannochloropsis_gaditana
aaggcaactgctggtaaaagagctagaagaaagagttgtcgggcagccattgctatgagaggcggagacgactggtggtgcccattttacgggaaaggaagcaagagaaagggtgaggattttgtgcgagcaaccacggagagcttcccgcaatgcgaggaaggcgtcttgcacgggagtgccccgagtaattgttggtgaggacgcatcgctttcgaagtgggtggtagtgaattaaagagaaaaaggacacggtgccataacgcacacaggaggaggaagagaggaggcaaggccacaagagaaaagaggccaccaacgagtgacgggaggcggaaagcatcctctcctcctcttcgcctactgcggattaattttgccaccagcgccttttcctcaagcgtatcttgccctctgcaacagcttcaaccacacactgccttggccacgcggtcgaccccgcacaggcattggggcacgtgcacacggcgcccagtacacccaacgtgtctagaggaagcggaacaaaggttcagctactatatgtgtggccttctccctctcgttttggatccacttctaccacttctgccctcgcgtcttccctcatcctaccaggggcaaggaacacggggatcaagtgcaccccctgccctcgctcactcctggttcacaactaattaaaataacatccatcatg

SEQ ID NO: 5204 - DNA, 700 bp, Nannochloropsis_gaditana
tcttcagatgacctttggttgctgatttgagcagaaaggcttgcctttaagctatgtaggatagtatcgggagcattttgcaacaccatatattgaccactcaagacggaaaataccgtgcataaaagaactagcccaacgagcagtgatattagcagacgccttccccaccgacgctgccgaagccttcgaggaaaacgatccggcatgtttaccgtctatgcagaggggagacgaccctccgcactttgttgagcttcaactgtttgaggaaatcacaggtcgatttattattcttatcaagttatttcgaaaactttgttgagcttcaactgtttgaggaaatcacaggtcgatttattattcttatcaagttatttcgaaaagtctttctgaagcgtagattctgatagctgattgaaaattactttatgggccatcaaggaaaacgataatttccggtcacgtcgcagtatgttgcgattgtgacaccgaaatacgttgcgaccggatatcctccatggactgtctttgtcgccgtctgaagaattgggtgcctgagcttggtcgagagattataaattcgaataacgaggttgaagttttgtgatgaaaagtgccccttcgttcgcggcggcaacccgccacggcagcatatgcgctctttacggcaacaatgaaaagtacttacacttacaaa

SEQ ID NO: 5205 - DNA, 700 bp, Nannochloropsis_gaditana
ctaccttgtgatgatcctcctcgattttggcaagctgaacgagtgcctgtttttgaacgtgctgttcatggtcaccgatgccacggaggtcttcgttgtcatgacgtgtttgcgtgcagtgctagggatcgctcccgtcagtatcattcggacgggggtgggaataaatgccatcctgcttttccccctggttctggcccccttgaaagcgggcctgaatgctttgcttatctatatgtgctacggcgcactgaaccttcccttgtctgaaaccctcgtgatttggctgattggggacctgtttaccgacttcttcgtcgtatactcggtgctggtggtgcgctactacctccagctctacctgatcaaggtgaaggagatgaaaatgtgtgagagggagggcagaaaggagccggaagacgcgggccgggccgagacggcgaatgcaatcggcatgggaggcagtctcagggtgccgcatggagggccgggcgaaagctcaatgggcggggcagggcgcacgaccccggctctgaccaacggggagagtatttatcactttacgcaaacacgttacgagaacggggggtggggccaagaagagggtgacgaggaggaatcggagaaggagtggggcagcgacgacagtgaatacgaggacgaggaggaggatgaggaggaagacgaggaagacgaggag

SEQ ID NO: 5206 - DNA, 700 bp, Nannochloropsis_gaditana
tccaacagctgtgcaccacaggtacgacgggggcaggcttactaggcggagcctccagtcagtcattatgtacccgtccatcatgagctcctcctccacgccgtccgtttccattcctgtcaaatcagctccaacgtctactatgctgcactccaaacgacggacaggaaaagacaaacccactccaatggcttttacgtaggcctctttcatggcccagacgcggtagaaggcacggtactggcttgcctcgccatcccgtcccacgctcctcaaaccctgccactccgcgggagttaggtgccgcttaaaatgctctaggtactctaaggcagtcatcgcctcgaaaggcctgtccccgacgtccacgaggtcggtcccgacggcgtgaaacggctcgctggccagcaccacccaatctccatgatgcgatacattatagttccactgggggagtcgggagtcctttgcgttaacatatggtttattgtaagttctagtgcgttcgatgtttatgtcactgaaccgcttgccgagcacccagctcgtggctgcccgttgaagtagaatgctgcctagagccagtcggcgatctttatcgtgatagtagcgctgaactttccccccctctgactcagacagaagccgaataagcaggttccattggtcgggcgacagtggctctgccacaatcctcatg

SEQ ID NO: 5207 - DNA, 700 bp, Nannochloropsis_gaditana
acccaagacgtcgtaatgctacccttgtggctgctttacctgtgagatggacatacttctaatgcatcaatctgcaaagtacgatgcaacttgttgcactcaaaagtttaagttggcgcgatcatttaaccacctagctcatggctagtgctaggttgataacaaaatcgcactggcaatcacatagtacccttaaaaacgtaccccagcgtgcaatcgcaagcgctacgacccgcgacagaacacggaacgtggagtgggagcagaagtggcgcgttgagacgctcgccagggtagactgtcaggggggcatgtggcgccgggagcacgtttgggtggagagcaccggaggctctctgccacacagcccagcctgcttcctcgccctgggtctggaggaaactgggttgattcattgtttgacgagctacaaatggaagcggatgtcatctatgcgctcaaatactgcattgggcactgattgacttgcacgaaatgctctaaatgtgctgagcttcctcgagaggcgtcggcaaccacccgcccccattgcttctccctcaatctcccatgacttcatgctgttcactgtatcctgccctacttttctttggtaacgcacatcacgggctcttttcatttatacaggataacaagacttccttaaagggcgcctttgcttgttgcgaggagtccaatg

SEQ ID NO: 5208 - DNA, 700 bp, Nannochloropsis_gaditana
caaccttcacgcctctgcacgaatttgctgaaaccatggctgacttgagcgagggattatcaggtgccgatatccaggggttgtgccaggaagcagccttattggctttacgcgaggacttggaccgctcgtatctccttccgagacacgtgatggaggcattggatgtaaaaagacgcaatacatagtaactctctttaatattgaggaggaaaatatgctatcaaaaattataagaattattttttatttggaattgattgggtgtttgtgacaagagacgaaagtgtaagaaatctcatgaatcggagcacacaagttactgcctgcagtgataactcacgatacccggatttaaaaagatgcagaatgtgctctcacgttgtgggcgcgttcgactctctctgtcatctcagtccacacgtaagttttattgcaaagtgatttcgaatcgcaccaagcctttcatgactagcaaacactgatctggagatcataatgtctacattgcttgccgtttccgatgggtagtcggtcttcaccaaaaccatcttggcgagcgagacgtggggttcttggcatgacaaggtggttcgtgaaaagccctttgagtgaggaagtcaccatgtcagcttacgtcgcatgtactgtagtgcttgcagatttcaaagtaacggtctaccgcgttcatatctaaaac

SEQ ID NO: 5209 - DNA, 700 bp, Nannochloropsis_gaditana
acctcacgtctcaaactcctaccaaagggacaacatatgatagagtaattaataaaatttattttgaatactaaagcatgatattccgcaggcaaatcgttgactgaccccggcttttcatatgccgtttgcgtgagacagtgctggacagtgctgagcatcgctgagccgcaaatatgcttgacgcgtcttcgtcgtcggggaaaagggcgattgagccgaaatcccgcctctaccctcgcacgtccagtacatggctttcatttgttttatataggaaatataaagacgatgccgtgttttttttcagttggcgctgtcaatcaatacgttcccatctcataacttttgaccggcgcgctataaaatggacatggcggtgacatggcagaaaccaagaaaacccatattcatgaccacaatcgctacaagaaaacgcatgttcatgaccacaatcgctaggaagctgcgatgctgcataggcgagctcagaacgagttgaccattcgagggcatggatagcttgctccgcgcaagcgaaagacccttggcatgttctacaccattcctcgcctgtaaagtatccactgcatttttctccagccagcacatttccgcaattatggcgattgttgtccctcagtcacacgtcccttatgatctgtattgcagaattgtataatgtcttcactcataaatg

SEQ ID NO: 5210 - DNA, 700 bp, Nannochloropsis_gaditana
ggaagaaagaattatgcgtaaattaaatttcaagcggtatatatagctagtttagacatctagtggcaacgcgtggcgtttaccagttaatcgtccttccaagcatggcattagagggtaggggaggttctactttctgtagccctgtggacaactcttgatcgaatcttacagaccgttcaacatccgcaaggcatgccggtagggaaacaccaagacctttcacaggatcaatatgggtttagggcagtttcctcctcattcagataaaaaatgccaacaccgccgcagcgcaattgaggcggatcttccgggattagaagaggacattgatctgcttctccgccttattgatggatttagtcggaatggtggtggcagtagagatcaatcattttgtcaagctgttcgcggtgcccttttggagggcggtcccggtgcaggcaagacggcattggccaagtcattggctagacacggaggcctcccttcgtactattgctcgtgccccagcttattcagcagggacagaggagacgcagagagaggattacaggaaatttttcagacttgcatccaaaaggcggcttgtagcgagaaggaatcttgcctcctggttctggacgatttggattgcattggaaaggtaagagcgaatggcggtgtcatgccccggttaagtcgtcacgtctcatctcgt

SEQ ID NO: 5211 - DNA, 700 bp, Nannochloropsis_gaditana
tggatatttaggctgatgtgggcgatcatttccccctttttggacgagaagactagaagaaaggtccatgtcctagccaggacagaagaccttctcgaacatttttcattcgatgcactgccacccgagcttagggccaaattgaacgccacagcacacagagattcaaagtagtcgttgccccttggaacgcactagggctagccgacagaagatcgctgctggttcaaccggaacacccggaaatgtcgagtttcattgttaaaataactaatttactgtgagtcgatagacagagacatcacatctctgcatccgatgtttattatactagaatgttacgcaatcattttttgacaggcgaaggcttgagatcttcaacgatgttgggtgtgggcgtgcctggggtggtgaggaggttaaaccaggaaccgtcacgggagcatggtggaaacacccaatggaagaaagaattatgcgtaaattaaatttcaagcggtatatatagctagtttagacatctagtggcaacgcgtggcgtttaccagttaatcgtccttccaagcatggcattagagggtaggggaggttctactttctgtagccctgtggacaactcttgatcgaatcttacagaccgttcaacatccgcaaggcatgccggtagggaaacaccaagacctttcacaggatcaatatg

SEQ ID NO: 5212 - DNA, 700 bp, Nannochloropsis_gaditana
ttggacggaacgaacgtcttttttctggaccaagcagaacgaccagggttcgatgaaatatgcaacaatctggctgggcttcggaaagagctcttcagcttggccttttatttcgggcggaatgtccccccacttgttgtagacgacacagggccaaagaggatggccagtgacccgcgcgtaggcaaagcgctcactctcaaactcaacgtcttcaattcccacacccatcgctgctgtccaattgttcttttcgacaactgagctcgactgccctctcctcttcttaactttggtgcacgtgtttgcaaactacgagcatcattctgaagccaggcagtgggccgggggggtatatctgtcaaaaaaagcgggatgtggcagtagttgacatttgatgagattggaatggctgcgatgcgttgaatggaaaaatgtgcaacattaggggagggactcaagacgcgaatgaaaattgtgcgttcttcaacgacttgtttccgcaggccagcccccgggtcgcccttcgccgggtcgtgaggacgccgcccctgtcaggcccttttctggcattcccccctgaaagtcaccacgaccccttgttgggttgcatccgtggtactcgagcatagcgaagcttctatctcaacgtcttttcaactactttattccacgcctcagcccgcacgctctggatatg

SEQ ID NO: 5213 - DNA, 700 bp, Nannochloropsis_gaditana
ctccccatctccgatacgaggatgggctgcaaaagcctcgaggtaatcgggtctcgacagagaccaccacgccctatccattgctgtcaggatcgaggcagccgaggtgtgagggaaggttttgatgactgactccacccaagatactgagccacatatccgcagtaactcggtgcgcaagtcggctacaggcatggcgttcagtttggctattccatcttgcatctgttgctgacagagaccaacaagaggtgatgtgagctccggcgcacgagtggtacttatggaacctaggcaggagcccgttcacactggaatgttacctgatcctccgctcgcatgtccatggcctatgttgctttggagtgtgtatatttgagggttcatcactcacggacggtaattgtcgagcccttgcgcttgggggggtaacttctcgcctcttcttgcttgcatctcctcgctcccgtcgctcgctcgtcgagatactacctctcgaattctcgtgtcatggattctaaagagaaaccataaatttacgtcacaacaacttcatccggtgggatcatgtgctcttgtctccatccgggacgactcgtgttgtcataccaaaaaatatcctcttaccagccaaataatctttgctctttgctgacctcaacagtcgctgtgccaactaccagtacgcccgaaaaatatg

SEQ ID NO: 5214 - DNA, 700 bp, Nannochloropsis_gaditana
tgctcaggaagggatggcacagacaccagccgaccacacacatggagcagtatcgatgaaagggatgcaggatggtggtgattcatcgatagctccatcaaccaatgtctttggaggctcgcaacagcccgtactagacgaggaccacgacgaagaggagtgccgcgtttgccgggagagcaatggaattttgttccgtccctgtaagtgcgcgggtagtatccgctccacacatcaagagtgtcttcttcagtggctccaacatagcggaaaggacagctgcgagctctgtaagcacaagttccattttcagccggtttacgccgatgacgcgcccacccatattcctgcgcggcaagtgttgggccgatgcttgcgcaaagccgtctgtgattatcttccctttgtggtacgactcgtcattgtagcagtgctgtggttgggtgttgtgccctgcactacaagctggatctaccgcatctggatacaccgcgccagcttgctggtcccagacctcattcggcgccgtttgcatggggaggggagcggtatgctttggaatgacgcggtctctggaataattattgtcggtttcataatattctcttttttaagtctcatgtctttcgcagacttttttgcggtttcactgggaggtgagggatgtcaagtggggggggggggggctgaggaggagatg

SEQ ID NO: 5215 - DNA, 700 bp, Nannochloropsis_gaditana
ggcctagtgtgaaaagccaatccaactatggagtggggaaaatggggcctgagacacgctcgctccgggaagttgaactcaaaagctgcctcagtgtttgcttcagaccatatccacgacccttcctgagcaaattagtccctctgagatgtctgaaatcatcatgctctttaacacgtacaaaaagtcgcatcgcaacgcggagattctacccccttgccgcctcctgatggaggccacaagaccgttaagagaaacgtacgctccccaatctctttacaaacaatgtgccatgcgcatttatggagtttaggcacacgtggcacgacagagcacacaataagaccgtcgcacaccgctttttgtcccgttcatcccagttttcccgtacctgagaagaggacgagtgtcaggacaacagcatagcccttcataccgacttccacctggactgaaagcgaatcgcctgtatatgtgggagtgacatgaaaggagatggcagtgtactaaatcacacacaagggtgtgtcctttgcgcgtggctgctgtgtgacacgaggtcctgaggatggggcggcaggccccgtgcccacgggctcgccttccaggggccgtctcgggggcgagctcgggcgacgacgaggtgaagcgagcgccgcgccatggtctaacttcttgaatccacaaacatgactttcag

SEQ ID NO: 5216 - DNA, 700 bp, Nannochloropsis_gaditana
gctacgatgaacgtagtaatgtgtaaggctttgaaatgagcacggtagcaaatcggcatttgaaattcgaagaaagaaaaaatcttgagtaaacaaattatacttctgttttcgcgtgttttgcgttactcttgaaatgggccgaaggttttagtcgcgtcatggggaaatgcggcaagtcgcttctcattgctgcgctgggtcctgcgtatagtgaagagccaatgtccatatgttcttgggaatatgctgctgacgctttggtgatgtaaatgagaaattatggccccgcatcttgaaggacgtcgccatttcccctggcttagaggccgcagccggcgagcccgcgcaggtcgccgggagcacagagctctcttcctttccaagcaacgccgaactatctcccgtgccaggttgacactcttccctgctaggctttggagtcttactcaaccatagaagaatgtcatttttttggaaggtggaagtggtggacagtaattttgttccaggggatcgacgctccaccagaacacccatccctcctgcttgctttggcgtctcactttacaccgctccttcaccaccgttttgcgtctgattttttcattctggcacttacagaacgtgaggaacgtgtataagctgttagaagaagggtgtgctggagtaggcggcccagagcaggacgcaacttatg

SEQ ID NO: 5217 - DNA, 700 bp, Nannochloropsis_gaditana
agacacctggagggcctcggtgtatttaccttctttgtacaaatcctgaacctcccttaaagccagacctacatctttttccgtctccatactgggctgtcgaacatcgagattcctaatcttatccacatcttccaaatctgcctcacactctgtctcttttctaaatgatctgtgacagcttgagagaaaaaggcggtgttggacgtggctggcccgtggtgaattgagcagtatggaggctgacgtacacgaaccaatcataagggcgaagacaggcattctcgtcgaccacaaacttccagaagcgaccaaccgcgtcccctggcattgcgtattgtgcccctggaggacggaaataggtggatggtggattgaatgtgatgaggggagggccaaccgaacccctgaagaggactcccacccaccttgaggaggctacaaatcagactcctcatggaccctttgagacgctcaactgcctgcttatgacctgcttagattgtgttgtcaagaacatgacgtatgatgacgacaggcgcggtgttgtcataatttacaagtagggcgaaccaaaatttcctctccacaacgtcaacatcaaccagcccacgacgagaaaaagctcagatcgccgcacccgtcagattgaggcaattccgattttaaaaatccgacggtttttcatcaacattcaaca

SEQ ID NO: 5218 - DNA, 700 bp, Nannochloropsis_gaditana
cctccagagggatgagatctagagggggtcgcatttcttaaaagcagtattacggtacgggcgtttatgcggatctgcttccgggccatattgtacttgcacaacagatagggtgcatacatacaagcatcgatgtaggacgaatgatcggcgtcccctttgaagaaatctcagttgctcctgctaatgaggtgaagctcgaaataacgagtacgaagaagggatcgagatgatttgaaaacgtatcacgtcctattttttccttcgagcgttatgcttatgtgctgcaagagaaagtaccattgtaaaattatttttcattaggggggaggtgttttatttgttcacaagttgcgcgatgccggcggcatgccagagatgttagtacagttcacgttcattaatgagagcgtgagtaaattgaccatttgacttataatgtacgtatttctatacagacatatacatacgtatatatatttatgcgtattatttatttttagcagtattataatggttggcttcatcgcaagacagctgcaaagtagaaattgactaggggatgagaggaagccggggttaatgtcgccacgggaaagctacccggccggctcagtaacttttagagggctggacctcttatgcgtgcgaagcagggtacacgctctgatttattggtgtacactgatgtaatcgcata

SEQ ID NO: 5219 - DNA, 700 bp, Nannochloropsis_gaditana
ctcactgccctgatgaacgtgtagggtagggctatcgtgtcttggccgtgtgagagtcacggcacgacaggcgaaatctggcacaagagctggtagatgtctcctcagaacgcggctgatccctgtttctacgcctctccttcctgacaaaagatgatttccgcgcgctgtaaaagcgaatgcaggaaccactgcctctatggaaagcagtcccaaaaggcccagtacgctcagcactattcttgccatgttgccgtacttgctgcctctcgtgacagcagctcttgtgcacgcagggtacaaaccggcctttttgagaaataggttgcaacaagtatcctcaagtctttcgcatcgctggcgttaatatgcagtggagtcaactgtgaaatgaagaacacgtgaggatgccccgggcatgagtgaaaatgttgccaagcttcaggagtaggacgtcaagatctgtcgaaaaatgatcgcggaatggggggagtgcaaaatgcgcactgttctggatgatctagcctacttttttcgcttgtctcaacaactcctcgctacatttacctttttttttgaaaatgctggtcgcacagttgtatatggttctttccggcctaagctccgccaggcagcacacaaacagcaccatcaaacccttctcctccagtagcgaacagccttgcctacaggtcttatg

SEQ ID NO: 5220 - DNA, 700 bp, Nannochloropsis_gaditana
aaatgattgtttccagtttcgatgatttgacagatggacatcctttgtgcattatcaagacgatctatgtgttttggggggtaattgtgacattcttagcatggtctctgaaggagcgggattccatgtgataatatgtacataacatagacgtcatggtattgttgcgggtgacaagattcagattgatatctgttcgtcagaaatatagagaagggaaaaaaggactctagattttttttgtgtttcttacatcgaatttgaagatggacacatgtgtgaactaatagaaaacaagtgctctatggttttacacgaagaacaagagaatgaggtggcaaacatcgaaaatatgcgcgttccacaccgaccagcggtagatctctaggcctccaaagacactctattattcaaccaatagatgaggaatgggcgcgaagctgctcaaaaactatcaaggcgcggcggagcgcaggaccatggtcgattgacgaagaactctggcgtcatctgccctggggacagcgaacttgaaggtccgggagggtacatgtacttacacacgctcacgccctccattgtcccatccgcacagcgccttgctaccaagttatttcactgtcaatcttgtggagtttgacagttgctgtctttggcttctcctccccttctctttccaagtgtgttccttcttctgatg

SEQ ID NO: 5221 - DNA, 700 bp, Nannochloropsis_gaditana
aaaaaggggggaaatgcaaaaatcgctcagtaagagtaccaaattcaccgtttgattacgtcatggggttacaaatctttgaagcatctacttattggctggaatcattcgttgtcgacgaaaaatacacaactattttttttcccactaaagctgtgtttttccagagtgatggaaggccttttgctgaccgctccatatcatctgatccatcaattgttttaaagtacgcgagactcccttttgtgggcatctctgactttttttgtgtctcggtcacagagaatgattgtgcaagcctgattcttctggctggagtcatctcttgcttcggcggtttctcttgttctttctccccagagacccttcccagtcctcccttccctcgcccctttagcagctgagactttctcatccggtacgtctacaatcttcaggacgctgtttttactccaacattacggtcgcaattctcttgctcgtgcacggacgggcgcggtatcaagcacgcaccctctctatcgcccactgcaccaccggtcgctcgccccgcttcaagtgccccaagtagactccactacctagccctctgtcggctcaccaggcagctatgcaagacgcacaagctgatagcagcgacttgaaccgacgctctttacggagcagtggcaatccgctggaactaatagagcttataatg

SEQ ID NO: 5222 - DNA, 700 bp, Nannochloropsis_gaditana
aaatatggaaagaaaggaaaagacaaggctatagagcgcacgacacatcagaacgtccctctggtggggccggatggaaaaacgttagaaacgctgggaccttcaaagtccacatcaacatgggcgttgagatcatccaacaacccgttaaaaacgtacaattgtacctgtacatccttatccaggttctcctcaacttgtttttctttatcctggcatggaggaagtaaggaggggaggttaactcctcggcctactactttactactacttttttctattggaaaagaaaacacaaaaaagtttttgagtcggccgccaccaaatattcttggtggtgaaagtgtcacacctttgatttgaaaaggagagagatcatggggaggatggccgtacattgcagaagtggcgaaaagctccatgccggaaacagctaagggtgacacgtcccccttgctcctcttcacataggttcccgggccctatgctctctcacactaaaatcgcatccgtcacggcgcttttgcttgcatttcgcaagcacatattttgtttactactacgtgaccgagaagaaaacttaatcatgtatctcttcttatgtctcgaatttattacaggcaaaacggggcacctgaggggcacgggccctgatgctcgcttcgacggcctcgggagaggaactaagattgaggcaatg

SEQ ID NO: 5223 - DNA, 700 bp, Nannochloropsis_gaditana
gctaacgtgtccattgttaaatgaatagacggcggcaggtatcgctttaggggacttcgaagctgacagcaggctcgacaattttttgcagatagaaccgcgcggaccactgaaaaatgcagcagcaggagtagacgcatcgacgcatgccgggctcactaggattagcagcagaggagagagggcgtggatcggctgagggcatctcattctagtcccgtctcccctttgttgaaggtcctcttcaagttcgtgtttccacaccttggcacgctgggtgcattgagaaggtgcccttttcaatatcttcgccaaagcatgaatcagggcatgcagtagatgagtgaatgtgagcctgcgatatgctatgcatgctacagcggaaccgcagccccgggaggtggtcaggtcgctgcgtcaatcatagatgatctcgcaccgaatgggcgagcctcctggggctcgtacactggcaggtgggactcgagcgtttcatggcgtggaggcgaaaaagcactgttctacatcataatggctccctgactcataacttttaactccatgcaggtcatcgctgcccgcatctgctcttcacgggctttcaaagtgcaactaaaccaggcagacggcatctgagaggggctgctgctcatccattttccaacggagatccatcatctgtatttgaaaagcctctatg

SEQ ID NO: 5224 - DNA, 700 bp, Nannochloropsis_gaditana
gtgattgaaaaagtactgctttctctcatgttttacgaatattcatgcgaactgctggtattcggtttataagtaggcctgtaaggcttgctttgaaccatgataattatctttgggttgccaagaaatgggccgccgaagccgttgtagcgcgctcacggaggcatcgctttttacgaaggacaggttccaccgcgtaacaaaaccagtaatgtcttcggacgctcgtagctttcaaactggcttgtcacattcgaaaagccgaggacatggtgaaggatgatattcgaaattgttgggtggcttactacttgatgcagaggtgtcagaggttgatgcgatcgagcagcatgtcacattgtgtcgatgcacgaggcttcgtcggggcgccgacctcgacactttctgagaaatgaaaaccatacctgattaagctgcggaatgcctcactgtcaaaggttttcatgtcaaagaacaaaagcaagaggaatgggacacagcaacatacacgtacctggctttgttcagatatcagatatggcagattggaggctaagaaagcttcaggtcttgggcgcgaccgtgcgtgcaataatgcccgcttacactaatacgaagcttgtctcctcacatcagcaggcaaaaatctctaacttcagatccaaaagagcaggcatttccaactcgttgcttgcctatg

SEQ ID NO: 5225 - DNA, 700 bp, Nannochloropsis_gaditana
ggaaagagcggcggggcgaagccgcggcagcgtgccttgccgccctggccgcggggggagcaagctcccttcccctgcgcaaggaggcagtagacgcctgcctcgccatgggagcggtccgtgacgacgaatatcagttcgcggtgggacaggccctggcggccttggccttgggaggggacgtatgtgtatttgcgtcggtgtgggagggtgttgtggaggggaaggtgagagacaacagcccgcacgttcgggccgctgccaccctgtggttgctggtgctgctctgggaggcggccgcggcctcggatagggaaggcgacatggcgcgcgaggtacaggtggaagagagccacgacgcgacgggggcccagagcggggcggtgcaggcgtccgacgcatcgattcccgcggcgcagaccgagaccgacacggccgctcttctgtccctcccgcgcctcttggaggcacagcaggtcctcgtcacgctcctgcgggacaagtcggagctgggacaggaggcaagcgggaaggccttgggtgtgctttgctgcctcgtcgggcacggcccccaggtctcctcctccaccatcccctccactgcccccatcccgagcacggctcttcaagagctgaccaatgccctcgtcctcctcctccgcggtccctccgccaccgccaaccccacccacctggagct

SEQ ID NO: 5226 - DNA, 700 bp, Nannochloropsis_gaditana
acgtgggcgtagttaagagagccgagactagaagatggccgggcgctaccatggggctgtgaaacttgacgatggctattcgacagcatcgacaaaggccgcagcacacctccactgccgcattttggtctccttacggcctgcctcaccgcaaaagacagtaaagctacgccaccggccatcataagatgaactgtagtgcgtttagaaagagcgttgcagaaatgcaagaaaaaggcggtctgagggattgaggttgaggtcgagcgggtcggggcgctgccgtactatcagtaattccgagttttctgtgctcctatccccacgccctctttacaaggggcgagacgaatcgcgcagtatagtgatgaggtcgatgtacatttaccggaaacgcctgaaggagcgtggcagtcaagtgggcgggcctcgaagagcctcccaggcccgtctccctcccgctatgccgggcggtggtgccagaccgcgttgctgactgagccgcccggcatttggggaaaaccttctcagatttcgatgttttcttttaaaacgcatgcagacagacggctagcagcttactttggccacctttgactccacgtgacacgagcagcggcacttcatctctcctctgcttttcgaccagcctccccacatcgtcactctcacgctgatcagggaatcggttttgaagatg

SEQ ID NO: 5227 - DNA, 700 bp, Nannochloropsis_gaditana
ggctgaggctagggaggagtaggacactgacaggggcgcagggaggaaagctcgggccggggctgccagcaggacgacaactcccacgaaggcgaggaccaagcacataggaacagaataacaagagtgatctattcttctccgtgtccaacccatggccttgctgaagctgtaagggtttgaaaaagacgcgtccagggtacatgaggttacttgaaccacttttggtgggtataacgcgtgccatgcaccgcccaggcaagacgaaaattgagaagattagaccgtcagaactctcatgttaaatttcattttcttgtgcaatatatttttgacgttatgaaccggttatcttgcaatgtgttaccgtatacacgtaaaaagggtggcagcacaagagagatccagccaccacgccggcttggtcatcgctgctcgccaggacagccacgctactcaattttacttgccgtcgaacaccagtttgcatccatccactccctttcggcacaggctggcagtccatacgagccctgcgatgagggcatcctcgtcgggaccccctgaggcctccacctaccacgaaaccaaggtaccacgtgttctacctccccacccccccacgccggcggacccccttctgagctaccccctccctgtcttacgttctatcaggagattaacggcgtcctcacagatg

SEQ ID NO: 5228 - DNA, 700 bp, Nannochloropsis_gaditana
tttatttttgcgtctcgcgtcagcaccagctggttgagatcgtcaacctgttcctctaggcgcgccttctcctcctcaagagcatgcaaggctcgagacctcagatctagaattctacgaaagccacgcaatttttttagcttagaggccaggtcaatatttaatgcctcttcctcgtcgagggaatctgccgaagggggtgcactgcgggacgaatcatttttcggctggtccatgagaggtctgaagacttgcaggaataagacgactcggagttgcgcggcagccgcctctccgccagaatcctagtcccgccaagtattttacacgatcttactttcgacactgacttcacctgtggataatcgggtttatcaagctggtgacgggtttatgtatgtgagccaatatgcggactcaccgcaagctgccgcttcaggagggtgtcgccgtttccgttgagagattctagcgacggactccgaaatagatatgagaccagagacagaaatgaatgctgccatctaggcagcaatggtgttgtccattgcggggctgagtcttcaatgggcttgtttccaccctttgcaccaactgggggccattggaggatattatgccggattagaggctcgcgagcgacgttgtcggacccaggaggtggactgaaggtgactcactgcactctaccaacccgaac

SEQ ID NO: 5229 - DNA, 700 bp, Nannochloropsis_gaditana
gagggcccgtgtggaaaaatcatcctcggcagaatgtcaagggatgatctgtagtgggagaaggaacgttttcaccttgaacaaaagtaaacatagaggatgtgaatttgctttttccgatattttgttgttattgttcgttagatctcaaggttacttcacgggaaaacgttctactggcaaagtaactatgctcctacagcatggtctctcaaaacattcagctgacacgatcgatgaaacacactccgatatgtatgagctgtcaacagaaaattgtggaaatcgtttccgagctggaatcgattagaaaggcgtccgacacgaatgaaagttgggtgcacttttgtatgtcgagtagctatctcacccatttccaggtagtctcattgatcgcccgctcgcccactcggaaaaattctaaatgcatgcataggatggaggcgttcagaaccattttaaccacagggatctaagttggtagccttccacattttgccattatgcatgtgcggtctttgtattactagaatagatttgttcacggatatcggccaataaagggtaacctccccgtactaagcgccgtcttcgtactgtggacacccacgggtgttccattcccaaaataacctcgcaacctttgtcgtcgaatcgctggttgccaaaagctccaagacagggcgactctggaacgatg

SEQ ID NO: 5230 - DNA, 700 bp, Nannochloropsis_gaditana
gtgctgaagtggaggaaccaatatgcgagagccgatggatcagatagaaagctccgaatgagccgaccatcaggagaggccagtgtctccagatccatgtcttaaatggtgcgtgggagcggccacggcctcgaaaatgagcagatccgatcccagagctactgtgagatgcatatccaaagccgctcaccatgggtttgcgctcgtcgatggaggctcccattgcggaatcggccgtgtgttctggttcttgggatggcggcgccacgttctctcttttcgaaggattaaagaaccctgtaaagccctgcaaagaaaatttaacgttgagtcaaatacatgtgtgagcatgggtgagtgcccatgtttgcaaccgcggtgtctgcacaggccgtggttatgggtgtgggccatgttgccctcccggctcgagcgatgagcacggccacccagccggtcaggcggtagccctttcctgccgcgcttggtgtctcgggatgtaatgcgctctcccacgaatgaggatttttccttttcttctcgacttgacgacgctcgcagctatgaaggaaaccgctagttccagatttctaccgctagttccagatttctttttttattttgctcgggagatacctaatcttacgatatatgctcccatcgcgacctgcttggacgcactcctagggtgacgataatg

SEQ ID NO: 5231 - DNA, 700 bp, Nannochloropsis_gaditana
aatgtaccacatctgcttgagcgcccccttgcggcgttcttcatcgcggcactcacgggatgtagcctctgcgaagcgaaaacgggttaacatttcccgtacagtagccatagctattgaccgccagttttgaaggccccccaagaaatttttctgaaatattccacaacgtcgtaatatgatactacctccgaaggacaatttgccattgcgtttggaagaaataggatgtcaaaatgttgtaacagcactatagatttaaatgtttgatatacaaatcgacgataatggtgcctgagcatgcacgaaaaaaaggttatgggccaggcatggacgaagacgccggatctgctgcatctcgggagccgtcactggctttattgacggacaaagcccatgacgcgcctaggtgcttaatcgcattgcaggcgatcgcctcaccacaagccacatcaacatctgccagacatggaaagctcgcattcattagctgtggcaggcattgccgatggtgacgggtgttgctcgcccacgtctcctttcacctcgtgttcttgttcttcaccccctgcccccgcacgcctcccgccctactgctccccttcttttgccccttatgctcgtgactcaccgcgcacgtgtcgcatgctgcaccacttgatacaggagagcaccgctttccctcccttcgagcgcgatg

SEQ ID NO: 5232 - DNA, 700 bp, Nannochloropsis_gaditana
tttgaattcgccgtcttcgagtgaggtcaggacgcgccaccgcctaatttaattggacgatagggcgacggaaaacggtttgagcgcattagaagttggaggtttgtgagcacgcgaatggcttcgatagtctcctggttggtcgtacgggcatagtccccgaagcacgtgtagaggaggcggggctcacttcttcgcgtgctcgccggaggagaacgggagccggcgcaagcctgctttatgtcgtcgctaggattactgccccagagcgatataccacgccgagactctttgtatcgagggcgtttggtttttataagatgctccgtgacatttccaagagcgctcataatacttcgtgccccttctcggacgttcaggtgccatcctccgccctccggctggagacctcttagctagacttgcatcctctcctccacatgtccaaagatacctgcgattgtcgttctcacaggcatcattgatctaatcaacatactgtgaactgcacgataggatgcttcgctatggcttacttcgcaaggtaggagcagcctcggcagcgtgggtacaaaggtgcagcgtgggtgagcgggcaacgctgcgtcggggcttgcgaacaggaagagcattgcaccgccactctgcctcgttttactcttcaggggtgatcgagagagctcgtattccaataaccatg

SEQ ID NO: 5233 - DNA, 700 bp, Nannochloropsis_gaditana
aaaaatacttcccccatccatatattctgagaaaatcaattttaccttctaatcgtgttaacgaggaagcccttgttgatgccgggcttcctatgctcggccttactctcgaactagtgcattattcaggggcagtaaattcattagcgatgcgtgggtgtgacacagagaggagacgacaagcgagtcaacaagggggcagcttaccgctgattcccctgtggaaagctgtcctctgccgcccgctgctgcctacttgaaggtacgaatatgcatgagaagtccccatccaggccagcttttttgagagtgcacggacctcgagggcggccaggcgcgcaagcctgtcgtccaaaggcctcgccagccccgagacgcgggccatggcattgctgacaagggagtaagcgccatcaacgcctcgtgtggcgtttggagggcatcgggagcgcttcgccatccttgtgtgctcactgtgctgtcaatggcgtccgtttcgaagaagtaatagtgaagacattgctcttgttcctcagcgtcaaatgaacctccctcctcgtcgtcgtcgacgatcgctccacacctctagaggctgcattacattattgtttttgcttttttgacatcaggaatttattctccccctccacatcacggaaaacaccgtcatatttcttctagctacttacacaggtgaatg

SEQ ID NO: 5234 - DNA, 700 bp, Nannochloropsis_gaditana
ccttcgagacagacgttcgcctctgctcgctgcttgaagctggacagtcaaacaacgtcaccgccgcgaagtgataaacacttaccactcatacaattagttacaggtaagctggtgctgacaaagcgctttttgtgaaacaaaaaaacaatgacatggtcatgcgcgcgctttaaataatttgcacgagctgtttgtgatggggctctcggctctatcatgcgctgcaggaaggaaacgagggcgggcatccgagagggatgaactgagtagggcggaggccgctctctgcggagccgcggcaggaggtgcctcacgcattctgacggcacccttcgacgtgctcaagattcgatttcagcttcaagttggttccatcgcgacggctcttgatcggcaacgactggcatatcgatccgtgctcagctccctccgaaaagtaattacggaggagggagtcatcgggctctggcgtggaaacttggcggcaacctatctgtggattggttacggagcagtgcattttcccgtttacgaagcactgaaggtggagctcgcaggcctgccagccttggcaccagtcgcctccttcctggcaggcgggctcgcaggcctggctgccactgtggcgacttatcctttcgacgtgatcaggacgcaatttgcggcacagggcttgcctcgcgcgcatgagacgatg

SEQ ID NO: 5235 - DNA, 700 bp, Nannochloropsis_gaditana
gctgcacttctgcctataccagcattacctccggcaatcagcacgactcgtcctctcaaattaacatccaagtcttccttgtcgaaacaaagggaacgtgccttgaaccccaacgaggtatgagatgggtctagaaagtagaaaagcatccctaagcataattgagaatcgaaaagatataagaagggaatgcttcagctcaaaattcacttcatgctccctttatgtatgatctaattataattgatcaatgcgattctgcccagggaacagaggcagccacaaagcattctgttgtcttcatccacctacccggcacggaatatgtataatccggcagatgcttgccgataaacttggagatcattatgtcaatcctgaaagcagtaacagcaggaatgaatgaggtgatgattgccagcaacagtaagaccagatactggactaggcgcatgcgacggcagcatccactggaggcacctcagggtatatctttgcttgcaatcgcacgcagatgctcgaccttgccctcctgtgattaaaccccagctttaatattggtgtgttagaatccatgaggtgtcacactgtttaggtggctttgaaaagactcccatctcgtaattgaacaggaggtccacaaaaagttccttcgagacagacgttcgcctctgctcgctgcttgaagctggacagtcaa

SEQ ID NO: 5236 - DNA, 700 bp, Nannochloropsis_gaditana
aatttcagtattttctccaaaggtttgggcgcaaaaatatcatacccaagtatatagcagcatcatttttcatcaataagtaagttttacgaaagcatttcaacttttgggtgggctacgccattacccccccccgcacgggtgaatgcccacgattgaccttagttgaaagacgaagattgtgaggggcacgagcaaattataccattatctaagctatatattacgagaatcgatgctctccctacgccgactcgcacatacatacggtaacagagcgctctgcaccactatcctgcaggtagtgtacgaagccaggaggttacaccgcacgctcctctgtcgccgtcccgtcgctcacgtcgacggcctcaatcgtcatatacatgtctgaaggcgtgacaaacggggtaccatcatcttttattgtatgagtctgccacctaatcgataagatgagttgcattgtttgctcttggtcgcaaccaaagtttatctcgttcgtcttggtgttcataacaagcaagtcagaagtaagccaggcaggcctcgatgatactgactgcccgaagcattttcccacttttcttttccaaatatcgcctcgctcaggaatattttgcgcatcgacatcaggataaatcacagcccgctgaagtggattggataagggctgcaagtgtagggttccggtgatatg

SEQ ID NO: 5237 - DNA, 700 bp, Nannochloropsis_gaditana
ttacgaaactggaaaacagaggcaagcggtgaggcgaggtcgaagatacgccttggaccggaccggcttttttagacgctctgtatcacgaacggatgaaaaaaatatttaccagtattagctgtatgcaacatgctgtggcgaatgccaacgtcaatgttgagctcgcggtagacgtcagataacgagcaaggcagtggcagtgggtgaagtcgctgattcccctccgcttgtccgggctcgcctcgagctctcccaggcccatggcgacaacttcatccttacgatggcgtcgtctcggcacggacgggcgttctgcaagatcaatgcttcttcctgaaatttttgctcgcgaccgtgccatgtccaggggcctgacacgcaccgcaaatctttattgccgtgcagtcagaggcgtggcagtgtgactgcgggtttcgaccgcgtcctcctagtccaacaccgtccctcccggctcagcctccagccatgttctgatccccaatttttcgcacgcgtacccatggaccacaggttgctcttggataagagatgccttcacgcgcattgcttatgcgcagctccatattatgtattaatgccgcgattgcctgcctagtgacctcaatttatgcccagctagagcctcagtacgtccccgccgcttcaagcgaaagtgtaacatgctatccggccgatg

SEQ ID NO: 5238 - DNA, 700 bp, Nannochloropsis_gaditana
agagtggagatcgcgaaagtggtgaacacttttgtaaaccaagctgctaaaaaaattttgattgggttcgattgctgcttcggagaggtggcagacggagtgaaggaccgcctgcgaactgacttcctgtcgggggacgaagcatccgcagaggacaggacctgcgtagaaggggcctgcgctttcattgatgcggtgcgtggtgctcagactggagaggggggggcgcgaggcaatgggaatgggctcagacagcctgccacgcccgatgtctcgggtgctggccgggctccctctgtgcgaggagccactggttcctttctcctgactcctatcccacgcaccctctctcccaccttctgcacctccctgactcaccatccgtccttctttctccaggtggtggccctctccccgtgctcggacctggaggtgaacgccaccaagggggccctcgttcccccctacacccaggcctacgcccgcgtactcgacacgctcctaagcaacgactgcgagcttcggcactcggactccagcgccctttctaccactgcttctaccgaccctccttccccccccctcaaacgttcgcccgcgcgaccgggacatatgcctgtccctgtacgacaccatcaccggcgccccgaccaagaccaaggtgcttaacaccatctccaaccgggtctctcgcaccatg

SEQ ID NO: 5239 - DNA, 700 bp, Nannochloropsis_gaditana
catctgaagggttttatgtgatatcatggcgggagagttcgaaaaagtgaactcatacaggaagtgacgcatagctgtacaacattgaaaagtagacgtgattcgaccactctgaggacagaatcttattatgcatcgatccaattggaaaaaaacatctgcacggcttttcttcaggctggtagcgcttcatggaccattcgacattgacattaacacacgcgaataacttgccgtatgaatgtctgacgcatggcgcgctccaaggacagacccgactccggaaatcgctgggaaaccgccccgaggcgtgtattatttatgcggtgacggtccaagcgccgccgccgtccggttaagctgtcgccagggcccttcactcatcctgcagggagcacggcggtcacacgtgccgcgtacacgcccggtggaaggtcgggttttgtgtctgttcgtgcccggggcccttggcctatttggtcgacggcaacgacgttttgcgttgttgcgtgcatctcagggctggaggcgcgatgaaatcccaatcgacacaagaagagccctcgccaggctgagagaaagccgaacattcatccgcggacaaaacggatgccttttcacgcgttctaccaaccattctccgcacaaggcgcagcagggtggcgactaagtcgaggagaagctgctagatctgaatatg

SEQ ID NO: 5240 - DNA, 700 bp, Nannochloropsis_gaditana
gaaggggtcagacaaggggaagctgggcgagggaggcgaaggcggagggctcatcgagacgggcccggcccccatcatcgaatgtaacggcagtggcgtgcacccgctcgaagggacacgaccggcgtcgcactgtagtagcggtgcgggcggcgtgggaggcttcctgggcattgtccagaagaccctgggactgagctggcaatgtgccgccctccctcccactcacacctctgccatcaacacgatggcgagctccaccagctcgcccttggagccgctgcctcctttggaccccgcggacacatacccgatgtccgacagcgatgaggagggaagaccgctgggggaggatgtggtcggcagtgacgaggaggcctgggacaggcgacgaaggtcggccaagaaggtaaggaggcgtcgggggcgggggcggcgggggcggcggttgcgcgtcaagggggggggggaagtggctgacaagcgcaatctctcggtttcacgaaagcatcattttgcgacatcgttctcgcgattcatgtcgtgtccatgctcagacacgtggtcatggtcgtgtaaagcagtaggcccaaccatcctatccctccatgtaacgcacccgctcctccttccaatgcacgcagatccccgattgggcccgcggcaccacgctagccgctgccttggataggcaattcac

SEQ ID NO: 5241 - DNA, 700 bp, Nannochloropsis_gaditana
atgaagtaggaggaggccacgttagttgtgcgaaaaaacggacgcgtcagaggagaaaaggaaagcctgtcctagagaaggagtgaatgtgcttgaatcagaattcttgatgactacgaagtacaaatgtaacacgaaatcgcgcgccttggtcttgtgagaagttctagtttgtttggttcgggcaaagagtgcctgtccatcggtgaggttaaatgtccaagtgcggatcaatttaaaattgagcttcgtcatcgcttgaccgtcgtgatttactcttctctcccaacagggatctcatcgtagccctggatcggatcttgagatcatggcggaggaagaggaccaggtaggcgtcgcaggcagctgcagtcagagaacgcagatcggcatagctacaagtcccagtcattcgctccacgactggcatgcactcccgcttgcagatcggccccgactggtcgatgttcgctcagaggaagcttttcaggcgcggcgtctggtctcaagcatcaatttacctatcgatgaccttgtaaacctactttttgaacttccagagccaagtgtaggtctggcgatagttgcgactaatttggaagagggggaaaatgctgtaaagttgcttgatagccggtattggcattgcatacctttcattttcgtagaggatgagagtgaagaaaatagtgtgttgtgg

SEQ ID NO: 5242 - DNA, 700 bp, Nannochloropsis_gaditana
ttttccccgccacgcctctttgtggtcaatgtgatgaaaaacttcatttcaaaagtgcaataactcttttaatgtggtgtcatacgtggatacgctgtcttgcaaaacgggatatcataaagaaggtcatagtaccatcgaaatcggggaagatatcatctcattgttttgcttgcatgttgcacactattattgcgttcaaatcaatttttacgttggaggctagaagcgcatgcaatggatatgatagaaagtcaaacaactatcggatgtgagttcggagcgagtaatgtggagtgtggcaagcaaaccgaaacatacctcccgcccccctcagcttcccaccaagcgctccgtacaccacaaaagtgcacttacacagttcttccttgctccatgctcgtggttttcaatcgtgggcttgttgagtatagctctcagctttttcttcccgatcccactacgttggtaagcaatgcgaataaaccgggcaaagcaaatgcggaaatggctgcgattttatcgcatcgtgtacggcatcactccgccatataaggtatttattgaatactattatcaatttcgtggccattttggaggacttcgctccctctaaccctaatatgtgacaatgtcactaggctaactgggttttgaaaacgtcagacttgccttaggccttcttttgtctttacctaga

SEQ ID NO: 5243 - DNA, 700 bp, Nannochloropsis_gaditana
gcgctcccttaaccctcatcagagcaagtcaaatatcaacgattcagagtacacatgcctttatcgacaaattttcaagtacaagaagtcattgagagaataatttgatagttaaaagtggcttgtgctgattcgtaacaatgttgtcacgcgtggtggggttacttttatttgcacgtgtagagcttccgggacgcgagtctgggatgcacagggacatctttttccccgccacgcctctttgtggtcaatgtgatgaaaaacttcatttcaaaagtgcaataactcttttaatgtggtgtcatacgtggatacgctgtcttgcaaaacgggatatcataaagaaggtcatagtaccatcgaaatcggggaagatatcatctcattgttttgcttgcatgttgcacactattattgcgttcaaatcaatttttacgttggaggctagaagcgcatgcaatggatatgatagaaagtcaaacaactatcggatgtgagttcggagcgagtaatgtggagtgtggcaagcaaaccgaaacatacctcccgcccccctcagcttcccaccaagcgctccgtacaccacaaaagtgcacttacacagttcttccttgctccatgctcgtggttttcaatcgtgggcttgttgagtatagctctcagctttttcttcccgatcccactacgttggtaagcaatg

SEQ ID NO: 5244 - DNA, 700 bp, Nannochloropsis_gaditana
tgcatgagttgcatgaatgcggccggcagtcctcgtgtgaggggagtgatatctttgaccctcactcggtagttctgcctaagcgcatccccaatcgcacccacagatatctcccccgatcacgacatacatacctcgtgaagtgaaatcaagcaacccctttttggccattttgcgggtggccttattcccggttttggccatcctaagctgctggccccgcggggaggtcgtccgatggcctggggtccgcaacaaaggagggggcacgagaatgatggagagtaaggttgataatgtgagacaatcttctggtagaggccgaaagcgatatgtctccccgctttgaccactgcaatgaaaatgtcgtagaggctgtgggcggctactgcagcgtccccccccctcttctcgcctccgaggtgtcctcgctctctgctcacgctgcccctctcgatttcactctcatgcccgcatttctcacgccttaccactttctctcacgaccaatgtcaacatggttcatctccaaagtcacagagagacgtagtgtccgcgaatccaagtgtagtgcttgccagacttctagggccaaggagtctcgtaccaccctggagccgcgcccctggaagcaacaaccccacccgctcacttagtcaactagcgtcgccttccagccatacaagtcaatcaaatcatg

SEQ ID NO: 5245 - DNA, 700 bp, Nannochloropsis_gaditana
ccctgggcaccttatccatacataggattgatcccgacacatgtgctggaagaatggtgtctattgatgctaggaaagccccgaggttgccttcctttttcctacgctcccgcctcgatcggggggtacgtctcacaccggggcgtgttttgaaagcaaagtgaagtcgcaagacttgccaccattttgatgttgatttattgacttgctttaagagtaaatctcggcccaaaggagctcgatggctccacgacaagggggggggctatttaagggacctgagagcttcttggcgagatcctccctcttatctcgacgccgatccacccggcccgcgtccctgggggcttctcaacatctcgcaagcaaattactacaaccctccatggattcctgctgtccccgctcatgcttaacattggctttagaatgtggcattggtcatagttgggtgccctccgaatgtgtgatgtgcggtacgggctcaggctttcccggcaagggccctcgctggatagcttctggcctttcttgcagctgctcttcgaaaagtatctgtgcgcaccgctactgcatcgtgcatatcatttacattgataatcagagttgatgtagaatcgattatatcagtacgactatatcagtaaagcccgatggtttatatgttgatgacaagcctatttttacggtctccgcgatg

SEQ ID NO: 5246 - DNA, 700 bp, Nannochloropsis_gaditana
cgacgtccttcttgctcttatcaagcgcccagaaatggaagtacatgtgagccttatgccgcattccgaccgaattatgagtgcgcttgaaaaagtcgtccatgaccagaacccggaggttgtgcggctggctatggaggctagagccttgttgcacagggttggggggtaggaggtcaacagatcagtgtcgctatccatcagtcacgacaaaacaggaaaaagcaagtcacaatgtcgctgtaaaagttgccagccctacagaactaaacactttcttgataaaaagatcgatgttgccaaaatagataagatcgatatcgcctgtcgtacctgctttggagcgaagttcgggaggattcgttccagggattcatttttcccccttagacccttctgtccgctcatcctcttattgagaatgagaggcatcgcgccttcatcgttggcgcttagacgaaacagtggatgaccccgatgtcactccgctctgtcgaaatggtctgtttttgtaacctcctccgccgaatgaatggcagcgaacgggcggcaggcgaggcagtcgacgaccaacaaaggcgtccttggtcaggcctcgtcctcgcacgggcaacaattcacgtttactgacttcacctgggacaaaatatacgtaggtgtgtcaagtcgctcggcatcgacaaagtagatccatatcatg

SEQ ID NO: 5247 - DNA, 700 bp, Nannochloropsis_gaditana
cctctttcgatcacgttttctttcatcccgacactcttttactcatgcttcggcggcgaatgagggactgggcgatgagtcttcgatgcagatcgacattaacgccgttcgaaggaatcttggccctggggaagtcagcaaagctaagaatgacggcttcaatcctcctccccaacctcaagtcctacaagatcgtggacggggcatcagtgtcagtaacgcggaattggaaccgaaaatccgcggagggcccgatggaagcagcgtaactcgcggcactgctcctttacctggaggagcggaagaacgctacagcgtacgcgaccttttccccgactttcccgagcaattcgtgcccgagatgcaggactatcaacgggttgtgattttgaacacgtctgagcccgtcgacagcgacaccatgaccgcctgccgccagctgcggaaggccatgaatcttcggagcaagtggatgggggaacccttggatcccgaggccccatctggcgagccacacgcgcaaaccagtaccttggacagtgtcggtgccatgagctaccctgagtcgccactgtatgcctcgaccacgcccccgacattttcagccacccatctgacggaggggaacgaccccaaaatgccttttccaccccatcaaaggtctcccgactctccccgcacgtcggcatacaagcggatg

SEQ ID NO: 5248 - DNA, 700 bp, Nannochloropsis_gaditana
actttttgacgacaccttgctccatgcttccatggagcagattatgcgagaaataaaaagagataagaatctaagtcagggactgcactacatcagaggttccagtgaaatgtacaagggcaaaagtcgcgtcgtacgcttcgcaagatcgaacgggcatcgacatgctgagttcaacttgctagtgtcgtagcaggttaagcccgccaaacaaacgcaaccatgacccttacaagtccaaggttgcagaaactacaactttaattataacgcccaaattccattcaaaggtttttcagacgtcgtcacacagagtgctcttaatacctttttgaaaagggaaatgacgtctgtcgtggaattttcaatttttgaaaatttgaatgatcggccggtacctcctccctctcccttctctgcctgtcactccctcccaattcatcgctctttctgcatacttcggtcagctatgcacaaaacatatttcttgctattttaagattcgtctgtctattggcattctgtgttcgtcttgcaaccttttttccgagcagacatgttatccgctggcgggaccatcagtgcaaaccttacaacccggcatccccgacaatcaacatcattcggctgtactgctggtacaaggtatttggaatacctgaactttactggacggggactttcattacataaaaatatg

SEQ ID NO: 5249 - DNA, 23 bp, Nannochloropsis_gaditana
ggcactaatggaacgcagaatgg

SEQ ID NO: 5250 - DNA, 700 bp, Nannochloropsis_gaditana
tcgtccacaatgcggtaagggcaaggctcccggccctccattgcgcgactgctactgctctcctgatctagcgcggtcgcccaccgcccggacggctggcaaagcacctaggaatgctgatgagctaccgataaccttgtacaagatgtatttggaacgtgtcacaaatgtatgagcggtcttgacaagttcaaagaagtgcattaaataaggccctgcagcaagcccctcaaaagaaagtactggtagtatcctgatacggcgccaagagaatgtgccgcgaaaaagctgtgtccagaaggcagactcggcacaatgcttcatctacaaccatacacacgtatattcacttgcctgatagagacgccaggcctctctccacgacaaaagtgcaccatgcgtcaggggaaaaggggcggtcgcggaggagcctcgtttgagaagcccctctcagcgatggtaccacattcctccccttgtgcctccagcccacctgtcggcaagcgttgctgccctctagcccaaagagggagtctgtgagccattaaagcaccagttgcgtacatcatggcaggctttttctggcgaggcacaactcaccttggtgcacctcatgagccatttagagcacatatcagcagggaattgtaggctactcagatttttactatggctaaatggctttgatactgcacagatg

SEQ ID NO: 5251 - DNA, 700 bp, Nannochloropsis_gaditana
gtgacggagaccttagcggaatgccacgcatgccagtccctcctatcgctgtgaatcaagatagaaacgagtcgggcgtgccccaccacacatgtggtgcgaaagtactggccggtgccggcatcgtgcagtgcaaattatcacgcgactgcaccacatcgagattctcgtgccggcgttgaactgccccgctgccggtgataaggagccgcgcgggcgcgtcagtctcgcccccttctccctctccgcgtcgccgctctcgcctccctcacgcccttgactcgctttgagcaggccttcggtcacccacccctcggcgtagcaggcggtcggggggtggaaaccttcgctttcgcgtactttgtcgttcggatggaaaccatctccaactacattgttgcgtcttttcgattgctccactcagctagcctctcatccgcacaaaaagggacagaagtatcaccagtggcccgtccgtcatctacgatgcatactcgcccctgcgcagcaaggaaaaggcctcgatccttctctctcccatttcgtcagcttttgctcgttgccgtggccgcaactacagggatagttagaacagcgcaggcatttattctgcccagcagtagcgtcaatcaggcactgcgtagtgcgcaagtaattcgcatgggcaagggggggggccgggggggatggcaaaaagagg

SEQ ID NO: 5252 - DNA, 700 bp, Nannochloropsis_gaditana
tgatgaacaaaggaagaaggtcaatgagaaacgattactttctgttttcctcccgtgctaaaccggagtccagcttaaatttgattcgaatttcaatttcaaagcggaaatatcacttgggccgtcaaagctccaactaccgacaaatatacagacttgagccatttaaggacaaacaacaagtccctgctaggttatggagagatgcgcgcgctaatttcacgctaaatgccgccggggagtatttttgaaggccgtagtgtccgcaagggacgtgcttccccatgtcgccatcgggcgggagagcatcgtcgcccgcaatatttcgacggcccgggtctcaccccgaccccgaggcacaattttctccctttacccatgctttcatcaaagcgtgaagggattcgtttgatcactgcaatacatattccgtggggcgtagaacggctggaccatggtgtattaatttgtccctggtatgcgcacctgtctcccgtacgtcgctcgtcgcaaaggaacaagtgcaagggacgctgcagggaggaggatactttgcggcgggactttgttgtagaagaccccaggttctttacgttcatgccatccatccctataattattttccccagcgaaaggcaaaagagcggcgacacatctatctctgcttcagggtctacgtgcggggccgcaacgaagcatg

SEQ ID NO: 5253 - DNA, 700 bp, Nannochloropsis_gaditana
aggctctcctcgcctcggcgtttgccccccccggttgctgcggaggcgactcgggaaagccaggcctgcattgagattgggctggtgtgcgttgtctagctttgacagagacactcagtctttgtggaataatccatgatttcactcgcagtgatgttcaatggtggtgttcctgtacgtctctgtttgtgtgtgtcgtgtatgggcgagggaaacgtactaaggcatcgtggtgggttgggcctcctctaataaaccgatgaacgaaggccatgcaggcgcaacgacaaaaattgaaagtctttccattcacgccgtgaagcgggcaatgttaacacgaaaagacttcctgttcggcgctccggacatgagggctaccgccgttcccctttcccaagttgagcaccttgagcgaggccccgatatttgatttttgaagaacatgctggagacagcggacagaaccccttgaccatcaagacaggtgcacgcaaagacatggcacgtctcaagccgtgtcgcacaaatcacgttgccgcacatgtgtgcgtgcgatagctctgcctaccttgatctcaccgttctccttgtttttcaggacgctcgcggggactgggctttcaggcggtgtgttgaccaagcatttcccaggccctagatactcttgatcaaggggcctttgccgttcaggggagacatg

SEQ ID NO: 5254 - DNA, 700 bp, Nannochloropsis_gaditana
ccagcattggccatcgtgatggccacccataaatttcaaacgcacacagccgtcgctcaagctcgctttaagatggcgtgcgcgggaaaggcttcgcgtctttatgcgccttcaagatacaagagcgatgagtgaggaaaaaaataatgtcaagcatggaaaagaattaataaaaacaaaaaaaacaacgtcggctgcatggaaaaacacaatgtaaacacattcacgataaatggcaaattcggcttctcaaacgtctaagacagatgtgtcaacactaggcgacccggatgtgtgtggggcgacccagactggatagccaaagttggtgaccctggacgcggactttcccttcccccgtgagccctccgggaacttcaaccgtgaaaattgcgcgaaaaggaacgcgaatcgacaacaacacgaggcacctaggccgaggccccgcgcgcctaaaacatgcccgtgaagtctacctgatataattggacgtttattgctcatggtcttcgttggattgaggaacgaagtcgacttgacatgagggtgcacatgcaactcttcactttcagcacttttcacaggactagcgcatgaaaaaagggaacggggtacttactcaggaggaaacgtggtccgcatctccaacgcctctctatacatattaatttttctccttcttttgtgttcaaaagtcatg

SEQ ID NO: 5255 - DNA, 700 bp, Nannochloropsis_gaditana
agagtagggatcgaggcagaccctcattcttcacagaaaagaggaacgcggccaggggtttttgtccactggacatggaagaatggctactggagcttttcttcgactctctttgcttcctgcatgccaccttccggtaaagaaaaacactggctatccatcacatccacgagttcaaggcctgaatctcctttatgcaaagcccacggcatagcacatgagacgggccagcaaagacggtcctctaagatgcaagcccctgtcttcgcccacgctcgctttcccaggagggaaagtcacggccctccaaatcgtgtgcatattttgtcggcgccgatgcaagtggagggacgctatggcattgagaaggctggacaatgcttgtcgtcttctagacaggaggtgtgggcatttttttcctcttacgttgaaattttgaagctgatatatttagcagaaagccccttcctttccccgcctaattgtggccgctgtctagcacccccttgctcctatctacatgcaagcagagagcatttcctttatgtggccgactaatacgtgccattttatttttcgtttcacttgtaggggacagcgtcttttgtgaaggccctaaaattcgacatggagcagtttgcccgatacctctaaccccgacccggctgctcgcacgacccgtcactattatataatcatg

SEQ ID NO: 5256 - DNA, 700 bp, Nannochloropsis_gaditana
cctcgttttactgccgcgtaccgttgtcgattttctatggatacatgcatatggctcttaaacatttaaatcagcgcgaagtgaaggtggatagtctaatttccttgtaagaatggctttgactgaagattactcagcatttctcggccttgacaggatggacatcgcaggcaatgcaccgcacgacttcctgcatcaattacacatgcgaggcgccgagcatgaaaagcgtatcagcgaggtttctttgtcaccaatacttccctccttggctacgaagagcacaatttgttgcgtgcgaagaagaagaagaagagcaatgagcagcgtacctccccgtggccaggtcttggtcgcagctcacctcgtatttttctgccttgtcagttgcgcctcctcgatcgcattgatatttccatttcatgcagccagctcctcctttacgcgtcagcacgtaatgttccggcctcataattgtcattccaatccctctgtcaatcactttgtgaaccacattggctgtcgacgtgcaaagtcccacgttacggccctcctcgatccgccccaacggtataaatcgtcagactgggcggagaacttacgttccctcttcgactcccgcattgtgaaacggatctctgggcacttactctttaacactgcctgggcaactggagtaacgggagtctacgagagcatg

SEQ ID NO: 5257 - DNA, 700 bp, Nannochloropsis_gaditana
cgctgcaacaggtcgacgacgggcaccataataagcacggtacgatccgtgggcatgtcgttgccagcggaaagatgaggaaagagacctcaataacgagctagaggggctatcggtggagtgcaaagtacaggagggcgatggcaagtgacccatacggattctatcgtcgcgctttaaaaagcttctgcatggcccactttccgcacttcggttttgcaacgccaggacacgtggtcgaaatatccttgtattggtgcgcggtgactgacgtgaagataaaagtggtaggtccggttgtcttgcagcaatttctacagacacagcaggctggggagggagtgaggaggttaccatctttccataaaacgataatgcttttccagctcctgaaagtgtgggttttcaagaaagctgggcttcgttatgtctttaactagatctttgcgtggaatatctcgaccctgtgtagtttggcgggagagcacaattgcgcacacggcgtgatacatgaaatgaaggaacgtgtttcggggtcatatatacggcgaggggtatcaaacaaagtctaaacctcagctcacgttgtcatcatgaaatccagatattgataaagccctacacttccatttggtgaatgggattgctggaacgctaccatgcctcgcctcatcgacaaaaaatcaacaacgttctgatg

SEQ ID NO: 5258 - DNA, 700 bp, Nannochloropsis_gaditana
ggtggatggaggtaagaggatcagagctgcttccttttgttttatggcttctttttcttctgtcctggtgagactcgcgggcttcaatttgcgaaacagcgcccctggcacaaaatttcccgcgtatagccgtattgtgttcccttaatttttcgtctgcatttttgggtcgtccagcacgcacaccgctcttccaaaactctttttttgcttttagcatgtagacaagtcccctcgcgaataattagccgagtaaagtatgttagctgattgaagcactggaaattgtctatcgcggcgaaacctattgaaatggccagagagagatagtgaattaatatagatacatgtgataattgaaattttcgcacgctgcgaaccaaaagggaaagtataatatgtttgaaattagaggaggagtgagttgaggcgtcgagaaaaggaacatgccagcctgtctctttcgtagaatccgacacttatattatctttgcctggcgaagcaaacttccaacacggtctttctcttcccctgtgtcacaactttctgcctctctttgcctttatccaggcattgttactcttcgcacgaatccctcgggtgcgataagtctcgcccactcgcctgcgcctcgccaggtgtgcctcaacttctcactttaaatgccttttccataatcagggaccgggtgttagcatg

SEQ ID NO: 5259 - DNA, 700 bp, Nannochloropsis_gaditana
tttgaatttaatttaccattccgtggtatcctgccaggttatttggtgacaggcacctggagaaagcttcaaaaaaggccaccatacaagtatcgggcttttttcgacggggaaatttttgagcgactcaacgtctccaccgcttagatattcaacatagaatatgtattccccttttggtgcttggcaatacaaaaataccttcccaaagattgcgtcggcctttcgacttgcttgtatggcaatcagtctgtctgggggtatggataaagtgcatgttaaagtctgccgacgcgtccctgcttcctgctgagtcaggcatgttcacgtgcttgtgggtgcgacgatacctgaacagtgcaatcaggcatgagattaatagatgcgtcccctacatgtcaagtcaacgaagcatatgcatcctatgtaagggttacgtacgtgaacggaagggcaccagatgatgtcgacgctcaggagaattctcctgctgcaaaatctccgtttctacggataaatatggcgtctcagggctggaagcacttggtaattgtaactcaataagcatcaactcatcctcctctgcatcatctcgcagcatgtcggcaaactctgaagagcaatctcaagtttttccgcatacgttcacagggcacttgtgtcccctgcaatcggatatttgtcctgagaagaccctatg

SEQ ID NO: 5260 - DNA, 700 bp, Nannochloropsis_gaditana
atcgacgacaagaaccgcaagcaagaccggaaaagaatatcagcacacctttccgtctgctgcagatgattatgccctccattgtcatgccccgccgtctagcttgtttacgacgacagaggtcgatgcgggcgcgttcacaatgaggcgacggcatgcaaacgaggctcttttttgtgatttgagcaccctggccttggaagctgacggagaggagctcacggcctgtgccacagcagaggactcattttctagaggcaccgtcctggtcacgcctcccccccagctcgccccaaaggaaagaggggaaataggagaaaatctttgcgaaaacgagatggccatgcagacaggtaatggcgacattgtctgttgcgcacatttctttcaccctcgtttggaatacgggcgctggcagcatgtctactggaacactgaggctctggcagagtccgcgggagggacagggggcaacggagaacggaaaagaagggaaaggggagttttctgccttagcggactaccacacgaggaggtggcaattggtaatagggatgcccccggcttgtctcctttacctcggccccagcagcttgaccgtcttgtctccaagggtcgctctacttcctctcctggtgcgtcgccctcgccgcatccgcgtcacctggtggcccgctttcatggacacgaccggggcatg

SEQ ID NO: 5261 - DNA, 700 bp, Nannochloropsis_gaditana
gtgtgcctccgatttttttgccgggcgcggggggcacggcacgggtggtgcaagaggaggaggacttttcagacgacgaggcatatgctcagaggcaacaagagctcttggaagggaaagagacagaagagggggagggagaggagacggagagcggagaaggggaggagtgggaaatggaggagggagcagaggaggacgaggaggaggaggtggtacgccggggacgggggcggtctcgaaaatctgtgggtaaggaggagacacccgtggacgtcgggtcactgacttcctcccctccgtccgcattgccgaccagcacagtcaccgcgacgccgacgataggggaaaaggaggaagaaaaggagacagggccgggcgctgggggcaggaaacggcagccattgaaaggaaaaggggagaaagaggctgtcaggccccgggaaccaggcattttgatgggcttgcccctctttacgaaggggggtggagatctgttgctggtgggaaaacagccattgcgggcacgggaatatttgtgttttgaagagggcgtaaaggaagagacgcgaagggcgttggggaaggagggattgaagttgctcgagagattgagcaaagaaggacaatgggaggggaaggaaggagggaaagaggagggaggagaggaaggggaggagggagaggaagaggaggagga

SEQ ID NO: 5262 - DNA, 700 bp, Nannochloropsis_gaditana
ggtgggtaagagcacaggcgctgcccatgcgatggtggcgtcccgtccgtaaggtgagacagtgggcatggtcgagggaaggactttattaggattttgagccataaaccctacagctgtatggagtccacatgctgataccagtagcaagcccaatttttttcttaatggcatgatttctttgcctacggatgatgttggtgtgggacatcgtcagtgttcctcttcgacctcccccccctttagccatcagagatccacgcatagaggctatcgcgcacacgcacgccttcaaacgagcgatatgagcgtactctcaagattcgttccctcctgcgccctccttcttgcccgaagcccgcaggagcagagacgcaggcgccacgcgagactcccgtgctaacccccggctatcgtcatcgccagaggctgacgtgcggcgagagggaaaggcagtggcgggatagtgggttcatgttatatggagccgcgacgcgggacatgatggcatcgaatgcacgcgttgactattgcgcacgccatgttgacaccttttcaatgccttccatggacacagtaactcgggaagggcgaacagcttgagccacgaaaagtgttgggtaagagagcagcagttgacgcgaggattgagtggtaatttgcttcgatcgtaaaccccacaaagccattaaataggatg

SEQ ID NO: 5263 - DNA, 700 bp, Nannochloropsis_gaditana
cggtacctctctatgactgagtcccaatgattggcaacgtaccgccgtcgacgcatgtttccttccaactccgcaacaaggcgagcctcttcttcaattgttatgacgtcgggtagaacacgaatggaagaagagtccaacgtattgtctctgcaattcgaaaagtctatgaacggagactcccctgatgcagacagagctatcatacgatatgccgggccggatcgtagtctcccgcatttcaataccagagtatacatccaccgcccagcgcctgagcgaaaagcaaagtaagagagtttaaagaccattctgtggatatacagtactaagcaagacgcatgacaaggtatttgccacgacgtgggccataccattttttgaagatggggaggtttgggcgattgtgatgttgccgcccgcaccgtaggcaggagtgacgatgttcttttacacaccacccctgctactcttttatatgtctgttcgtcttcgttatgaaggttaacttgcagtcaagtgctgctcaagtttcgttgcggaaaacaaaaaacaatccgtagtatattacgcatggcgccgccacatacgtcaaggccccgtacttcctgacacgtgaaaaggagtggttaaacgttttatgcactaaaccataaggatcacctaacgcacctgcaggtacattgctatatatttcatg

SEQ ID NO: 5264 - DNA, 700 bp, Nannochloropsis_gaditana
ggagtctcttcttgtgactctgttggaacgtttggttgtagtggttgaccatctacggcaggcgcagcaggagcgggtggcacagcatgcattctcgcgccagtgatcctggactcttttcctcctgagtcaacgtctggttgatgtaagaaagttatcagtacgtctcgccaaagcaaaggtttaagtagatgccttagagagaaaaataaatacgagtagtaaaacgcgacaagagatatcgtggatagtgtagacccgctatctataggtgtagcatgcctgtgcactgaatctctttttgcaatttgtatttctaaacggagtactgtctgtgccagcccgccctgggaggagcctctgtgggcgatgccgtaggcgccgacaagaacttggcgaggacactcgattctttgcaccaggacttccgagccctctccgggttcagagtgggccgtgggccggcacgatttgcgttcatgggtaaacatgtttccgttcgtaatctgcggtcgcgcttcttatggtagcgctctctgcagttgacacagggaggccgactctggtggatgatcgctgtgtgataccgcccttttctgtctgctgcgaacaaggggtcacttgacgttcatgcacccatctgaacaggaagtaaaaggataaaactttaattagtggcatcccagaggagaacgggatg

SEQ ID NO: 5265 - DNA, 700 bp, Nannochloropsis_gaditana
ctagtcaggctactagtcttactcctattccgcagcgtctccccaaataatgcagcacttaactgatgcgtcaccccagcagcgtccgtaccctaagagtaaactcatatcaagttcctcgtcgcgagacaaacggaggtcgtcggtccttcagcgccaacgtgcggccagaagagagctgacagatagtttacgagctctacatagggacaccatcgcagaggatgacgtggactcgatgacgagaagtgggaatggtagtcagttgtatgaaagcgatgtcattcaagaggacgatggaatgatggtggatggtcaaggacaagtacaggctgagaaaatcgcgctcaggcggaagagagcgcgcgctagacaggcaacaatttacgcaaatcgattcgcgattcctgagtggatgatcgagatacctcacgatctacatcctacgggagggggtggtggctggttggtcatgcctcaacctatgggcaaaaggtgcttgatggcggccacgggcgggttaaccttaacacgcatgacaagcggagaggtgctacataggcttgcttcgccgctaccaaatggttctgcatgggctaaaggtcccaaaaacggctggaccttgctggattgcgtgtatcaggaatcaagtcggacgtattatgtccttgacctcctctgctggcggaagatggagttg

SEQ ID NO: 5266 - DNA, 700 bp, Nannochloropsis_gaditana
tacgaaagaaccggcgatcgatacgaagcaaacaaccacccgtccccacggcaccctgaaggaccgtaaaatgccgcaatacacttgagtagtttaagagcttcgtggcgtgcacgggacccgataggcagccccaggacgtagttcggtcgtgggggccaaaatcataagcctgggcacatacaatcatggaccggcgatcgattcgaagcaaaggaccacccatcactgaccataaaatgcagcaatgcaggagcatgtgttattcaaacgcttcgtggcgtgcatgcggtccgataggcagcaccagggcgttgatcggccatgggggcctaaagtaaacaagccgtggccctgaaccctgtcgtgatgtggaagttggcgatgatcggaaccatgtgcagaagtctcttcgctcatcctacgcctcgcctcccccgaccccccgctccccttatgccgctgcccctccgctgctccatgctcacatccacgcgtatcaatatcttgtggctttttccattccatatgtaggcatcggtccgaggacttggagtctgtaatttgcacaaggaagggaaaggctgggagtaacaacatttgccctctcgctcaacgtgcgactctgccttcgactcagaccttctagttaggctcccaatttaaaggcagcagcctctgttgtacgaccacaaatatg

SEQ ID NO: 5267 - DNA, 700 bp, Nannochloropsis_gaditana
aatgagggaggctggttacgcggagacaatacttgcggtcttacttttgtggctttcaaccaagcaccggatgaaataccacgtcggctacttctgcctacacttgatggtagcataccaaacacgtgctttggcaccagaccaatgacgcaggatgactgagagtacactagacgaacgacacggggggaagtaaacgtcactggattggggcccgacacggctaaagcggtcaggcgatgtcaagctaagctttccagacacctggtgctgcttccaacgcgattggtcggatgtaggcagtcctgtccagagacgaggtgtgaaacgtgattgagattgtggaacgagttgagccgcaagatggcaaatgcaacgactttctgctcgccgagtcttcctcgcctgttccagtcgctgcttgctcgacctcctcagctacacttccttcaagccccgagacccactgcaaacatttcatgcgctattctagcagccacgatcacctttatgccctctcaaactatcaatggcaactcgttgaactgttatccgcagttttaaaacgaaagcaggcctatttgcccttcgctcccatagccggaggattatgttgccaacacgtctcgccggcatagcggcccgccgcgcttttttaatgcagcgacatatcccaagcaatgcaaatacaacggctatg

SEQ ID NO: 5268 - DNA, 700 bp, Nannochloropsis_gaditana
cggcccaaggacgctgaaggcggctgctgtgatgctacttttacagctgcaggagattccagtcgccgctgctagcacgagagtcttggaccaggttggcattattgcgaccctctttgctcgcatgaaactcgcccgacaacacttcccgccctgtgccattcaattggtgagcaaatattggttagaacgccatcaggaggaggatactcagggcaatctgccctcaagtggaagaaactcagggccacccgcgcttgtgaactgcaacagcccctgtgatcatctaatcgtcaaactcctcgatatcgaccgtctcaatgcaaaaacttagcaagagctattctacaacaaactcttcaaccacttggaacctcttaatcatggctctactgctacattactctatttacggtccatattcaagcctctcacgtgatcgctgctgcgagaagctcaacccccccctcgccatgcgtcagttagagtatccttcagctcatctccttactgcctcttacatccccaaacgcacagattgaacagttctcaaaggtcgtcctcctttattaaggaagctcaaatttgtgctatttaccaagtgccactgggctggtaaatcacactgggaattcgataatttagctcccgtcgctccttggtagaagtagcacctgtgcagacgagcctcttggaaatg

SEQ ID NO: 5269 - DNA, 700 bp, Nannochloropsis_gaditana
gcacacactcacgttgaagacattgagaagggggtcatcagggacaaaacacatgtggcaccgatgttgttttattttggcttcgaaggccgcaaattttgtccaattcaaccttcttatttttcacgttgtaaagtagtcccgtttggcatctaagcacacaaaaaataagtcgactggttcgcagggaacatgacgactctgaaacgcgcggcgcacactgaagttccgtggacgcaagtaagcgcctttcactccatcttccatcggtaccttatattctagccgtgtatccaagctcatcgtccagatatggcttcgggttgattatattgtcgcacacgcatccgcacaggggcgggcttagtgtaggagggcaatgaaacggcgatcttggggcgagcagcaaagaatgcacatgctatgcgagcacccatgcattgcaatgcgtaggaactcgtctgtcagcttccgtgaagcatgatcatcaattaatcttcaggtatgcttgtcttttatctcgcaggccaggggcgcggggagatctatggccatctagcggtgtatttttccctttccatatttcatttctcgtggaagggaagggccggaacaacgagcttcttagctaagcgacgaaaaccggaatacccggcactgctgaccactagctgttcttagatcctggcactggagcatg

SEQ ID NO: 5270 - DNA, 700 bp, Nannochloropsis_gaditana
cggtcctttgtgtcgaagacgggatctttttcgatgaaagccagcgcccgaaggcgacgggaaagagcctcctggccgccaaaaatgaacgtggccatggcctccggtcgaacggaggatgtagcacgttccttttgaagcaacatcgccccctcctcgtcctccaggtgtctcttcaggattaaaggattctcgttgaccataatcctgtctctggacgagggcccctctgtggctgtgcactgaccctggacgggcccgagtagtaggaggggagagtggggaggtcggttcaacgaggcctaagacaacccgtaaaaagacatgaggccgtgcagagaaaactcagtcaagccgcgatgatagatatggggtgaggatctcgctcgaccggtgaagggcggggggatggtagcgcatgtaccaatcgtcccgccctggctcgaggggactggccgtagcgtccgtgccgatgcgcgtcgaaatacggcgagttgcagcgagcccccgtcccggtcctacagccacggtgtctctgtgccactaggggtttgtcggcctcatgcaccatactctcaatacaatgacataggcctgtctagcaagttgccttgtttcccgagcgcgggaagactttgaatcatcttaccgcccattccgcaacgatcgacgctgcgtcctctttcaaggcaccagtatg

SEQ ID NO: 5271 - DNA, 700 bp, Nannochloropsis_gaditana
cctccacatcaacttcgtcttccaaaaagctgccacgatatacttgataaagtgatgtcaccgcctgtgttggcacatgcaatacacgtaagcaccccccactgtccgccaaagctaagtgattactgtcctccaccgggcgcgcgagcttgatggtggcttcacgccttgctgaggccaccggcaaggcacaaaggcggtaacacgtctctgagccttggtcaaatgacagcaaattatgactcatgctgtaataaagagtaaaaatatttatttagatgtcactgggctagatttgcatgtgcatacctgcaggcagggtggacaaacggcaagaaaatcgaacgaactgaggaggcgcgaagagcgaggtcgccttgggcctgtacgtccgcgtcaaatagatctctatttttcttggctaaattttgcgacaggccatgtgctacacagggatcagagattgcgctgcatgactgggatccattcgcatcactttgtgcgttttttccacagttccacagggcgccggctaagttgaatcggcttcagcgatagaactaaccccagggctttccgttccaggaatcacgccatggtagcgcccttcattaccctttccgtcggattggtcgtcgtggccatcgtctattatggccttgtcctacctttgtaccgcggaatatcccgtcgacgaatg

SEQ ID NO: 5272 - DNA, 700 bp, Nannochloropsis_gaditana
ttcttcctctcccaattccttctcgaatgaatggctgagcattccctcggcccccctcccttcctcgcccagcacctcgaaacgcacggccgcctctatcttctcgacggggaccattgcgatgatgcctgtctcccggcgcctcatcctctggagtgatcaaatcatccaggtctttactcagcttttcttgaatctcctctggtgtcgctggcatcgtcgagatctgcgataattttataattgtgtgcggaaaggacaacgaaataaaaagatgctcatcgtctgctttggggaaaggggcattggtacactcatgcttctcgcgggacaacatgttgccgcacgctcaaatgcacatacgtagccatatcgaaaacgtcttatcgagaacccgcgacacggtgtgactggtcgcgcgggtctcacactcgcaaaccgtggacggggtggctgaccgggggcgggaggtcggcttgctctttctcgccatgccgtcacgcgcatgaccttggccttccgtaaggctttaagtcccagcagccggccaaccagtggtgcccacgccgagcggtggcgagtagaccaattattgcggtgtgcaggttacggtgactttgttcgaaacagtgctcacatcacagcacccactccagagacacggtagaaggagcggcgacggcacgctagtagcataatg

SEQ ID NO: 5273 - DNA, 700 bp, Nannochloropsis_gaditana
atgcagatacaagcgatgagtctcaacaatactcattttcacatccagtgttaagtgaggatgttggcgagacctgtgtgtggttttggcgggattctcgaggtgtatatccaggtcccttagtttctgcgaacgtgacagttcacgcctcgacagtgttcatgacgctccgagacagcactctcagtccaccttatcgcatagagaaccgttctagctgggcatatttgcgatgtaagcagtcgggcacgtccgatgacacttttgctgttggtcccatggcgtataaatcattttcatggcaagaacgagatcaactgcaccgtcttaatgtgtcggtggaggacattccaaataaagatgggggaggaccagcatccagtgtcgccaccgctgaatattcgctggacgaagtgggacctaaagaaaccatgctcatcgccagcagggctttctatagtggaagtggagttgggggcttcggagttggtggagtgagcggcagcagccttgcaaggagtcttaccatcaaagcacgtcctccgcagcagaaactatacgtgcacgtctctacggctggtcggacgcgagttattactttttcggatttaccccgtgacgatttccgcaaccggctaaatgagatggccctgctgagctggacatggagccttttccaagaactctataattctctcga

SEQ ID NO: 5274 - DNA, 700 bp, Nannochloropsis_gaditana
accgctctgcgtcggagcggagcaactccaggtagctggtgcccctgataactaccacctcttgcgccttgggcgagctgaaattccctgacgcagcagcatggatgtagcccggtcgttgcatagtcaagttgagcaggttcaaaggcggggcgatattgggagacgccatggtcccgtcgagctataactctaaagtttccgcgtgacgatggcgcaggtcttagagcgaagcggccgttcgccagggccggcggggcactgtccttctggtgcacctaacgtattgttacggccctccttcgctggattccaatatcgcgaatatacggatcaatgactatatgtgagcgcaggttagagcgagacctgggtgcggtacgaaaaagaaaatcatccgaacggggactccagggtggggaggtcgctcatcgctcgcgtgaatggcagccatagccaggaggtaaaacgctttttgttcatgtgcctttctcttcctccgagatcgaaacgacggtggtacatgcgccttttcgcctggagatggttgcttatcgcagtgcaatggaaacgtgagctgacgcttcgcgcaaaacgcagtccgatcggtgggcccacgccacccttgatggatattaagaacacagcccctctcttgaacatcaaaacagccggtctacttttttggggttcgtcgatg

SEQ ID NO: 5275 - DNA, 700 bp, Nannochloropsis_gaditana
tggattttgcttaggagtaaagcacaactaagaaaatatgctgcctggcaggcatcctgagacatgaggcaagcgacgtagcaattgaatcctaatttaagccagggcatctgtatgactctgttagttaattgatgaaccaatgagctttaaaaaaaaatcgttgcgcgtaatgtagttttaattctccgccttgaggtgcggggccatttcggacaaggttctttggacggagatggcagcatgtgtcccttctccaaattggtccgtgtggtagttgaaatgctgccttaaaattctgctcggtcatcctgccttcgcattcactcctttcgagctgtcgggttcctcacgaggcctccgggagcggattgcgcagaaaggcgacccggagacacagagaccatacaccgactaaattgcactggacgatacggcatggcgacgacgatggccaagcattgctacgtgattattcgccttgtcattcagggagaaatgatgacacatgtgggacggtctttacatgggaagagggcatgaaaacaacatggcctggcgggatggagcgtcacacctgtgtatgcgttcgatccacaagcaactcaccatttgcgtcggggcctgtctccaatctgctttaggctacttttctctaatttagcctattctatacagacagagacacacagggatcatg

SEQ ID NO: 5276 - DNA, 700 bp, Nannochloropsis_gaditana
cctctgtgggcactccgcccgtatgccattctcacctcggcgcaaccaacaatatcgcctctccgagagagagcgcgatgagaggagcccctcttgacacagctcgagcagcagcatcactttgaggcaattgacccttggcatcaaagcgtgttagaggactgatagggctgaagctttcggcgaaagttccagatgaccatattaagttgacgaggacaaggaggaggaccttggggaggttaatcgaggtgccgtagatctcgagcctcgtgagcatccccgacgccggcgtcagaacttccgaagaggttgctatcgttgtcatatttgtgtgcagaggaattcaataccacatgtgaagcgaaggatcaaggaaaagtcggacagactttgaaaaaaagggaggcaacggacagcgagagctcccgtgggagccgtgggagccgacctggcgagctgaggcgagcacttcttaagcacccaaatacactagtaccctccagaactacacggcgtcacgagcttttcatcgtttcgcgcgtattcttacagaattttttatatctacatggagactgacgtcttcctcggataggaagtccgggcagtcacatgaagtcactgatcttcagtttttacgcgctgccatctccataattccaggggggcagccttcccgtcggtcgttgaattcatg

SEQ ID NO: 5277 - DNA, 700 bp, Nannochloropsis_gaditana
ttgtaagtaagagtcaatacgatgaatatggtgccgagtttattcaagaaaggatgtttgacggactctggtaaacgtgtattttcctgggtggaggaacaatgaaaagaaatatagacacctctggttcacggacctctctctcgttgcaaatatctttattcaaatctgaaagagtcgtttgtcaacatttgcttgtgaaagaatgaaatctttatttagaagtggagacgctctgtggtataggagcagggggggggcaggagtttgagcgccggcgcacagattaattgcttgcaagctttaagaaagacagaaacaaaagagggggctgtgaacttcatgacataaacttgaggacgagatagtcatgttttaaagagcaactcgttcctcactgtccaaaatttacggaaagatgagttgtggtgaagacggaggaggttacgatcggtgttgtaggaaggcggctgtgaggtggcggcagcaaactctgtgtgcaacaaaaaggatccatgactgatcgctaggtagaaaaagatgctctctgagtctcgcatgatcacttatgagcatgatacataatagtttaatcttgaaaattaaattgtagggagcgttccttctccttttcgatccactgctgcaccattttttacgcatttatatctgattctcgacgtacatttgcacaggtatg

SEQ ID NO: 5278 - DNA, 700 bp, Nannochloropsis_gaditana
ctccatgtctccttgtcggaaatacatacccgtgccgtacttctcgtccaacaccagctctcccggtacgtattttaaggactcggggttaggcgtgctttccgtctggatgaacatgctccgcctttgaatgtgccctgggacagctaatcctgaagtgcgcgacgcggaagatggccacatataatttgcggccaagtggctagaggacttccgcagatttgacgcctggcgccgtgtagtccggtgcaggactctaagcgagttcagagagcgtcggcatgcgaatgcagccgactcccaagtcaccgcattgagcggtttggcaaaagcaggccaaatgcgccgcatgctgcctgtccaaggaataatttgttcagttagtgcatgaacaccggaggtcgatgccgtgtggggaagcactttgtgttacgcagcaacttgcgacaacctcgcagaaatttctcggccgcctcgccgcttgatctccctccttattccacttgtactgcttcccgcaagtcctttcttcgatgcaaccggcatactttaacgcacacttctctactcaaagcattgaatcccacttcagggccactcgttgctgcctcttacgccttagtcgagggctcaaaagcaacgtcggtagtatcgttgcctcctccccggccttcgtcccgcaatcacccatgttgtgatg

SEQ ID NO: 5279 - DNA, 700 bp, Nannochloropsis_gaditana
gccaaactcctgagcgtcgcgcacacccgttccctcgcgcgcccagtaaacgtccaactagtgaagatggctcgtgtcgcaccagaagtcgtctcgataccaaagtccccctcatggtgtcggccgcgtagtttaggcagggtctggccctcgacgtgagaggtctgcggcctgtccctccgacgctcatcggtagcacacgtcttgtgcaaggtcctgcagcctttgacatcacggtgacgaggctggtcattgcgcttgtgtcgctaattctgtacttgagcagaaagggaggtgtgagcatccaaggtaaaagtgctggtgcttccttgttcatcttccagtacggaaagaggaaatacaggacgcctgtcataacatgtgaagggggctatgacgtctacacacgagaacgaagtcaaaaagacgcggcgcggtcaaggagcagtccaccgcaagcattcatgtccctacggagctagggagaaccagcccttgctgcggctctgactactccgttgctttatgccagcgaaatgaagacgggtttcgtgtagcttataagtcctgtccctgtctcaatttctttcctgttttcccctctctagctttcaaatgcgtcctacttcctaggtggtgcggggctcacagggcgcagggactcacacaggatcccggggggccggcactctgagcgatg

SEQ ID NO: 5280 - DNA, 700 bp, Nannochloropsis_gaditana
gtcacaggcagagtcaggagggacggggcggggctgagaggttgatgcaactccgccggccatgtcaatttcaatttcgattggggggctgctgctgaccctattcagggttggcagcttggtggggataataatattctgctggtattggcgagaaaaaagcaagaagaagaaatggctgtacttggacgtgtcgctgtggccggaaatcagcctggggctttggaataccaagtggagcacctcctcgcttttgctgcgtacaatcaacggtgccatgcgacaggggcctttacctctacaaatagaagctataacattgcatgtaatttgtgtgtcgcttccatggagggaagcttttaaaatacgcaactggcgcgtgcagcttcaagggatcagcgcggtcgggcgcatgacccatgtcgaggaatgggatgaagcggacatgttacgcaaagctgtggcttttaaacgacaagaagctgatctaagctcttttttggtggaaaattattgcttgcaacgtccgggtgtgtcttctcgaccagtcccgacacctatctcccaaaagttacgatggctcgaccatcttctatcaggcctccgcttggaccttgacaacgtacatttacgtgtgaacgactcccgctcagtcagctgcatgggtctgcgcgtcttacgtctgtcttgtcggcccatg

SEQ ID NO: 5281 - DNA, 700 bp, Nannochloropsis_gaditana
tcaagcgctaccacgaatgatggagggctaggtttcctagcgtattaaaatcagacgaaaggcagaaaggatgatggagttatcgaccctatgacagcaagagcaaggacgcggcgcaggcgtgggcagggacgggtatgtgccgtggttgtggaccgggagcctcgctcgcacgggcgcctgggaaagcggattccttttcgcgaaatatgtgtgctctctccctccaggcgtgcccagcccccccctttcccgggcaggttgaatggaaaggcggtgagatgagttgtatttgggagggctcgcctgttccatcgcgtgtccgcgttgttttaccggcgggcactggaatgggaggaaacaaccgcccgagaagctcgagcgcctcttcgtctacagaagtcacgccatcgctgtgcggcggaccagtaaatttctcttttgcgtcggctcgttcggtatttcatgtaccctacatggatttgaaaaggccgtggaggtgctgggcatgagtgattgtgtgaagcctgtccttttactcatactgggtcgaaggcctcacgaggacgaaggagcaccctccttttcccacacgatgcatgttatgatcttctcaccaggtcacttcaatttgtactaacacgtgcatgttttcatgtaacagaaacaccaactcgaatatatctgcacgccaaccatg

SEQ ID NO: 5282 - DNA, 700 bp, Nannochloropsis_gaditana
ttctcgaaagcgagcgtagcatttcggccctcgatggctgaaggctcaatatttgtcgcggctccaaggctgtgcagtgtgacacatgtatgagctgtatttctggcacaaagagaaagctgtgcgtcgctctgaaatattaagaaagatgtacctggtgggtgacaggggtcctgtcatagcggctgactgaattgcaaaagaagggccacatgcacccctcggcttgacagtggaaggagcctcagaacgaaaacagtcgcgaacagccctgctacgcttggtcaagaactccatcacacctacataagaatttaataatgatatttataaaatttaatctgtcatgcccccaactatatgcgcaaatgtaggagtttgtgaacagatcgaggataaagggtatgaaccgttgaaagtttgaaattgatatttaaaatcaatccgctccttccgataagacggcgagtatcgaatacccaacctgggtcggctaagctggaattacatgaaagagagagattttgatgtccacgactgggcccagaacttaacccattagccattatgacattttacctttttgtccataatcgcgtgcgcttgtcgtagcttcactaattgagctcgggctactgcaacacacagagagcgacacgcctggatgacacttctcgtaatgtgagagagcgagtggatg

SEQ ID NO: 5283 - DNA, 700 bp, Nannochloropsis_gaditana
taccggcgcgcaatccattggggaagaggcacaagtgaacgacccggcgactcttgcccagccaagtcatgttcagagggatgcctgttgccgaggagtggtgtaatgagggtgtgtaccggcattaaacgaagatcatcatcgccttgccaaacgcgagagacaagtagactaggaaaggcctgcaaaggccggaagtcgcatgataatccaacacatatggcccgccgtccatctcttcccgtcagaatcgtgacatggttgcgaatcagacagaatcagccaaattgaatgtataaaaagatggcttgagggggaggagataacatcgctagacgggttcgtctctagccacagccaggctcgccatgcgcccgccactacaaaagcatgacagcataagctctttcgtcgcgggttatgtgggaacgagaagttgcatactgacttcatgtcatgccttgctcttcgattatgtccggttggtcatctcgcgtcaactttccaatggagtactgcgacatcccaatggtggggatgcaggggaagaggccttcggtcagctatttcttgcacccacacgatctcacactcttcattggaatacgtaaaatacaggaccaaaaataataataataggactcccggatgcggatctaggagcttcaggggccagaggaggggtatagcagcggtcatg

SEQ ID NO: 5284 - DNA, 700 bp, Nannochloropsis_gaditana
ggtatttatcaggctcaaagatctttcgaacttgaattcctctattggatccaacatccaggtagatatatctgcagtcatggagccattctcgcatgccctccttgtcgtgctcaaaagcggtgaaccaggcgtctggcttattcgccggagtggaaacacgaatgctccgattgatagctaccatcataactaccatcataaacatggccagcgcaaagccacacagcttggaagacaatgctccaatagacccattgcggcctgtattgggcaccaaagcccaacaccatcgctgtgcataggcatgggcctttccggatttcattcagccgtacctgcgaaaggaaaagggcattaaaaacaaaataagaatgcgggatttaaatattacaactgtctactgccacatatcttacattgccttcctctatggtaattagtaacagacaacaaaactgcaagtagctctaggcgaggaggcggtagatgggccgcgagcgagctgagcgggtttcgaccgtcatgccaggtggttgagaatgtcgtcttcctttttggcgtggttttcggggaattgatgtgtcaatcacgtccacctctagctttatatggtactgaattaagggaaaataatctttcatctacaggcagcaatagagtgcaggtattcagtttttccggagcattgagacagatg

SEQ ID NO: 5285 - DNA, 700 bp, Nannochloropsis_gaditana
catttgcgcccaaagtagtgtcattgttgtgactgctgctaccgattgcactgctctcatcggccgaggcacctctcactcccccggtgtacccgtccttggtagcacttctcgatgcgtgccgggcctcgtcctcaccacttccagacttggctcctctaccgaccccacgccttctctgtcctcgggtctctgcaggcatgatacagcctgtatttattggtgattgatggatggaggatttcgcaattcagagtgcttgtgcgcggaaatgtacacgggaaatatgccgggagcaagcttggaagagtgtctttccaaggcagaacatagtgacgagaatgccgcccttcaccttttgcagcgggatcgaataaaaatacacgcgtgattcaaggaaaaggaagatagagctatgcggagatggtgtcattactggtgttgcaaccaagttgtcacgggggcaacatctttgtgaccggggtgtcgcatcgatcctctccatcgttgttctttcgctgaccaacaccacttaatcatgtgcaaaccgctcaagatcgtcacccaacgcgcactgcgcctctgttgaggacattgcattgagcacattgcgaccatgtttctcaactcacgcatggcaaagcgctctatcccccgtggcgcactcacaggaaccgtggactaattagttggagacatg

SEQ ID NO: 5286 - DNA, 700 bp, Nannochloropsis_gaditana
acggattgtgctgtgagtttgacaggatagtaacactcaacacacgtctgcgtgcggtggcacgatttcttcttacgagccccgcaagctttgccaaggcccgcttgtcacattggagcattggacgggcagcgcgtttctccatcgcttaatcctcttccttgtttacgtaatttccactttccctcgcccgtcggctcgcgagttcgaggacgccaaatgaatattggatgcgaggagaaatcatcgggcaattaatattcatgaccattgaagttcgcaaattctcggaaaatatttggtggtgcttctgcgacggtcgcacaacgtacgaatgcatggcacgcttgtgcgtgagtacgttgtgcgggctgtggggtttttggttaactttccacggggtatcgctctcggaagcattctgcattcccgagcgcgatgcaaccctcgcacagcaagaaacactgtgccttttgcctcactttgtatgttgaactgacggggaattaacaaaatcatcacacgtttatggcaacgaatgcattgcacgcggaagatcgacagggaaggctcgtcgacgtcgttttttgggttgacacgtactctgtcgcggtcttacctgtcttctcactgcttcactcaaacttcactttcgatcccatgtcagtcgacgagctgggcgtttgtggggaggacgatg

SEQ ID NO: 5287 - DNA, 700 bp, Nannochloropsis_gaditana
aaggatgaggtgcataagtttttcgggatttgtcttttttttccccagtcatgtgtttctgggtatgcctgtaatttcctacctcaaagacctcttcctattaaacaaacctacccgagcagaaagctttgttgacgaatgtgtaagggcgacgtaagaaggagtgaccacaaagggagccttcctgtgaaagcaaaaaatcagaggggtggagggcattctgggtgaacggagaagtgatcgaacagcacgcaaagttgggtatgaaaggaccacacagcgtccttgcgcccttaaaacattacatgcatttctttgcatcaacgaagacacccatgcacccagaccagaacgagcaacctttacttgttggtacagtgctttatggaaggtctcaagctcgaggtccatccacaccggccctggcgagccgtaggtgaacaacacatggaagagtgccatcacctcctttttgttgaagactattttggaaactttgatagaccctgtgagatattctcgagccaatgcagttcgcacacttgactgtcccattgatagtggatgtgcgaatgacttctcgggcccccagtttgtgtgcgtgcggctctccttctcaccctggactggtacaaccttttggcatctctcattcgatcatacccgtacgacatgaaatataaataggacaaccttcatg

SEQ ID NO: 5288 - DNA, 700 bp, Nannochloropsis_gaditana
cacggctttcacaggagagtacgactttctaagcacgctttcgaaatctcgtgttgtacttccaggagaaggcgtgatggaaggggagggttttcaggcttacccgaccgtcgagcatgcgcttcaagcgtcaaagagctcggaccctacgtaccggcaatcgatcctgtcctccaaagacgccctggaagcgaagcgtcgcggcgcaaaggcaccgaacgtggacaagcaggcgtggaagcttaagtccttggtggtcatggaagccttgctgcgcgacaagttccgcaggcacaaggggcttcggcagcagttgatgaacacgggtaccaagcagctcgtgtacgagaacgagcacaacgaccagttctggggaacatgcaagggcaagggccacaatcacctggggcagctcctcgagcgagtgcgcgcggatgagaaagaggggcttctgggtatattgctgtgggccaagcaggtcttcaacgccacgtccgactccaaggtgcgccttgacgtgagcgtgacacgggaggggcaccctctgcccgaagcagatttaacgctggagcgtaaagccatcgtcacttttgggaagcttgcggaaaacgatgttcctgtcgcgcacccgagcacgagccgtttccacgccatggtggtcgtctcccagccgtacggtcccttgctcgtggacctggaa

SEQ ID NO: 5289 - DNA, 700 bp, Nannochloropsis_gaditana
aagacgacgcactgatgcaccttcattagccagcagcaccagcaatatgagggtgggaatgatcgtcataacgcgcctaataaccaagccctaggggtttcttgtgaaggaattaacaatgaacacccgagcccttagcaccactcagcttccatgcagatgtgttcgtcaactgttggtatggttataacttataaatgaggattgcgggtgaattactagcatttttggtcgtgcggatgttgttgagggtcccaggtgggagtcgaggagaaacaaacacgggcccacaagaaaagacgcaaggctttgaaacctctcactgaatggttcagcatggcacacttgtttccaaatgctcacgccgctacgctgtgatgccgtcaaggcacgtctgggcccaacggatcgaaaggtcggaatgcaagatcaattgccacgtttgcgggtccatgaattaaattgctcgccttttggcccgtttcacccccttcgccgtgctgctgccagcggcccggcttgaataccacccaaagacattgaaacacggggaaattcatcctcacgcttttatttctcgcacttttacgcataccacgccagatcttgtgcggtttctcgaaaattggtcagggaaccggcttccttctggtccactgttcacgctccaaggggcctcgacagctagccgtgtgagatg

SEQ ID NO: 5290 - DNA, 700 bp, Nannochloropsis_gaditana
ctagagcttcactgctctcatgcgtccgtttactgtcttggaaggcgacgaagcgtctggttgtcatcgcgctcctccacaaagagtttcggggaaaagagacacatgcagtcgaggtcgtacacgaaggtagggggggaaggacaaaggcgtcgactacttgaagaaacacgaaagccacaatcagctgtgtcgtttgtgcggcaggcatgctgacgatggagttgtactatgaacgacggatagttgaaggccttgatttttggacgatgtaccggttcaataagcaggctagcaatcaggacccgcccctcggcgtttctgccgccaacaaattccagccggactaaagcggaaaaggaggggcgcctgtatcgcagttggatgcgtaaatgaatatgtgcatgcttccaaaagacgggcgcggtaatggtaagaggattggctttagcgattccatcgtgctgcgaccggtctcgccaagtcggaaaaaagcattcgtacgacaaacctgctggcagaagaaatggcttaagtcacgtcctgttttcaaatccatcggcacaacataacaataacttttatccttcgtaaactggcgtgctgctcttcaagttgcaacacaggacgggacatgaacacgtagcaagtctcccagcaggctttcttccttctcgttttcattccaagcgtcgaacga

SEQ ID NO: 5291 - DNA, 700 bp, Nannochloropsis_gaditana
atatatgctccattctctgttaaaataagtgccttcggttggggtggtgggggaagccacgcgtttccattcggaacgtggactggcatccgcagtgtagatgtcgataccctcagatgatgtgtacttgctctaacaattcagcatcacagtttcttactcctgtcatcattacccgtggtgaccatgcgatgcgcatgtagaacatggaaatgagcatcaaaagaacacctggaaataaattttctagtccaaaattctgagtgattttcgtcctttcactaatgtcaaaaatagccctttctcgtagtatgtttcctaagaacttgaaatctcacgttgctacgcgtaaaattcagcttgtcattctctccgtgctcgagaatttagtggaacccttctcaatagtgcaatactggtctagttgaaatagctcttaaaccacctggtagcctacaataagcatatgattttcatataatttatttaattctcatcagtaaaggccaagaaaaccgtaaacaaagcaacaactttatcagtttaacctccccagtgagcaccctgcctggcagtgccttctccgtcgcacatgactagccgagaacgccgccaagcgcctgtagagatgagtcgaaggaattttcagatctcgtgctattcacaaaaaaagacgcatcatatccccgtcacgcacagg

SEQ ID NO: 5292 - DNA, 700 bp, Nannochloropsis_gaditana
gtgctagtttggggacccgacgcatccgcgacaggttcatcccttggcatggctcctaaattcgcgtgtgtggcgcgggtgagaataattatgcggcatgagtagacccacagacgcccgtaaaaatgtcaaaacggattgacgaggtcgaaagcacgcggtcgtatgtggctcggttatttctcgttttcttgagcgatacataaataatttgctggagtcgagcagttgcttcaagccactttctggcctcccctagcagacacccccccgccgtccatggcgttttccgatgcatcttcctgtcatgagattggctttaagggcagcagcactcgtttttatgttttccgtgtcaagcatcaaagtacgtggggtatcgcgtggtgcctgcgtccaatacgtttctcccaccgtgcgctggcatgtgaagaagcacactgtcaacacgcattgatatcatctagcccttattcgatgccttcgtctccatttctaaccaactctcaaaggggagcccgtcaacctcttactctcatgtcaatttgctttgctcacgcttcgttctcatctgtccagaagacgtcgtgacacaggctgggcctactccatcggttctgacctctcctccgctgagggtacgtgcaggacataactcggacaggcagacatcgagcagtgccacaccttctaaagcatg

SEQ ID NO: 5293 - DNA, 700 bp, Nannochloropsis_gaditana
taatctaatccttcaaggtcgcacctgtgcaaattctagtttggcgtgcggctgtcgattgaagagaatatgccgccacgcaggcaacctgtggagggctaaatccagtccgacgagcacgagctcatactcgatcagtcggtctgcaactgcgccacaaaattcctggaaggacagtaaagttcccgtaggcgaattgttttgataaggatagagtaaggcttcgcgttggagagtatgcgtgctctagctacatgcaaaaagcgggtggttgggtttcaggatgcgatcatgcacttacacatctcgatagacggatattatccttcgaatattccctgtaaaggccctctgtgacgggcttgccgcattcgatgcataagctgcaaccgtcgtcgccgtggattgtgacaagggccggggcagctccggcgtcggccttgggagaaggaatgttttctttcaatggtctgatcaagtgtgaagaaggcgacataaatgcagttaccgccataatcaccttgttaccacgtctggatggagtgcaaccctgtggaggacaagagggatgtgtgacacgtccgagatggaatcaggctgctttacctttttagcgacctcaggccctcgccgggtgagcacttcctcagctgcctctcccccccaaacgccacctcagtactcctttctctcaccgatg

SEQ ID NO: 5294 - DNA, 700 bp, Nannochloropsis_gaditana
acagggtcaaccagaagctcacgcttgcaacctcggagctcgctaactagctgtgatggaaaaggtaccttcgacttccgattccccatccttagttctgtcttaacccaccattcgaacccatcggggaaaacacagggcgtcttgcgtcatgcaaggggcacgattgttaccgacgtttgccagggggcatcgtcggtgtgcgacgctggtccgtcttttttctgcgtccactcaagagccacagacgagagttctgactcgtcgggactgtcgcccgcctgtggtcagagcgttcaaggcattttctaccgccggccatttcgatcgctcaaaaacagaagaagaaagctcaaatgcagcctcttcagcgtccacacccacatttcaagacccacgtcaggagatcttggccgctgccctgcctctggtgccgacgcacgggtggactgaagaggccttggctgcgggtgcggcctccttaggcttccctgcagtggcgcatggcatgtttgcgcgtgggggtatcgagctagtggaacatgtgctagcccaaattgattccgcatggctagcagagcttgaagcccgcaaggaggaacttgccgccttcccctcgtcacgagagcgcttggaaaaggcgatacaatgccgcttacgcttgatcgcaccacacctcgcccaatggccacaagcgatg

SEQ ID NO: 5295 - DNA, 700 bp, Nannochloropsis_gaditana
aacaactgtgagattgccacgtcaaaaccagccgaaagaaacatgaacgcggcgaactttagacttcattttttttccgttgatgtacgccttgccagtgctctataagataaccagctgcgcaagggggggggatttgcatcgtgaagggtacaggaggggaggtaataaataagcgcgaaggaactaggcatctctcgaaggtggacgaacagcctggttgtaggaaaacctgagaaaacacctttcgaggaaagagaatgcgaaatgcatgcggtgctgtatctaagtcagttgcaacgtcgttacgctgccatcctgtgcacgtccctccgcattcaaggccgtcgccaatgggccatacaggccaggatgtaagcatatgtttgctatcgttgcccccgaggaatgttaaaaatgcttgtgtggacgtgtccaatgtgtgctatatattttgtcggtgcggagcgcaagcatgcactgggctgcatggagattttgtctttttaggaagccatcgctcgtgatacttgccgagtgacgggcagtaagaagtacttgttcttactgtgtaccatgttccttcccacgcgctgcttgttaaatgcttcaacctcataatgcagaaacacaggcaaggtatagaagaaggccatcaatcaagtacgctggggtacatcacctccattcattgaagatg

SEQ ID NO: 5296 - DNA, 700 bp, Nannochloropsis_gaditana
aataccggagtccttaaggcggcgttcgaaagagaatacagcttctttctcatcctcggtaaaccccgcctgacactgataaagatctggagaagccgacgatttaggctcgaccgtgacggcaaatctccttgtcacagggagcgatgatgatgaaagcctcccactttttaccagaaaaccctgagtcatcctcgaggccgacaacaccatcatggctatggtcggcagcgtagggcaggtcacccgcatactcttgataaacaactttccctcttctgcccccttgtctaatgatgtagattaaaaatgggtcagacaacttgccttttccagcaggagaggttgagaagaggcggaaaaagccagcttcgtgacactttaagaccaaggagaagccaatgagaaacatgataaatccacaaacaagcgaaaaaaagggtcgaacccacatggtgtgcgtgtgccgctttttttgtctctgtgggcagacctgccggtgcttgtgcctgtatatgtctacctgaggtcaagatacttccctcggcactcgccatatcttgcacctgaccatcacacttttttacccccccacaggacaactatgccaccttttccgtttctggccaccacacttttcgtccttttcttttgcacgtttgggcgacctcagcatgtagctatcgttggcgcagggatg

SEQ ID NO: 5297 - DNA, 700 bp, Nannochloropsis_gaditana
aacacggggaaatacagttggtatatgtcattaccatggggaagagaagagatggacatacaagcgacggtcgaaaactcacgtgcaacgtccgattaggaagtcaacctagcagcctttgcccgagacacatcaggcagcaagagcgagggcccgcgcagggagggagaggagaggggtaagcgagcgcaggcggcgacccccccaaaaacacttcccgactggactggtctcgttttgagatggtttcagtcgcttcgtgcaaaactgaggagtattgtagctctcgtcgtcgcgagcattgtctcggttggctttctaactcagcaagcatcacgtacaggaaggctgaagcgacacgtcatcgtcatccgtcatggtcatattaccccaccatgtgccacattcaagctccctgacaatcttacttctcattacgatcagccattcgcgggcattttatattttggcgcctctcgttgagagatcacgcgcagttttatcggccgtctcctccgacgcgcctcctgctccgtcttccaatagaccagtcgtgatttacgaaggcttttggcatgaagccaaggccatgatggacgctcgtcaaagctctttgccttggaaatcacaaacaattccttttgacttacagcgcaaggtatgtacaacaccagccaagggcaagcgtctcgaaacagtc

SEQ ID NO: 5298 - DNA, 700 bp, Nannochloropsis_gaditana
atgttgtccgttcaggtctgggatcctcgaaggcggctccgtttattgggtcacatctaccgcgcaattcatcggaggccggaaagctatcagtacaatttgttggatacccacaagcacacgcgcacggacgacaattctttttcacatgttctccgcattgatggaatagcgccctaatcgtcgaggacttctgctcccggcgccgaccgtcctatcgccgaaagttcaaattctggggagggctgtgggccgtgagccgcgcataacgcacgctcaaatttggtgcccggcgtgtctgtctgcatttgccgcccaaagcttgtaagtgatgcttaaaatcgttgaaaatggcggaggtgcacggatagtcaacctgtattcgcgccaggactacgacgaagagcttttgtcacggctcctgtggagcgaacctttgtgatgtccgtcatgtgctaaatttccgtgcgggacaattgtaggcgccgtgcaaatatatgtatcatcttgccatgatgagtcttatcttgtgcacgggatccttatatggtcatatgcacctgctctttttctcaatggatgagcgaagacccatcctatccccatttttttcggcattctctttttgctgagacccattctttaacactgcaaccatagctcaatcacaaatatctacttgacaggaggactcaagatg

SEQ ID NO: 5299 - DNA, 700 bp, Nannochloropsis_gaditana
atggcttaaaatttggaggggggtggggaggttagtaaccgtgggctgcaggaaccgttgaacgccggaacgtggctaggcgctctcgtcctgcctcaactgagtgttgttattggcactttttatttagggacgatcgtcttaccgcacattatcactattaggggtaccatcgagtgtaaggttctactggcctcaccgctgggcttctcctctacctgcgttttgagtccacagcctccatcgccgcattccaagagttgggcaacatgcacgtcaagggttataaagtaataaccgtacctctgaataataatacgtcgagccctttctcaagatttgtttacgttcgtcaacataacaataaagggtaagacatagttcatgtgttttattctaatgtggctatcgagtgagtatcttctttctgacttcgcctccccacccaaatatttctgtcatttctttactcagagaagaagagctgcctcatggacgcacgctctttttggccaatgttcccgcgcagataggtgttgatgttcacatgtacctgaaagaggctttcgcaaagtttggagaagtagagctcgttcgcgtgaaggagtcatcggacaacgacgccacgagctcgtatacggttaagagtgcgatcgcgttcgtgatttttcgtagtagtaaaggggttaaatctgtgatg

SEQ ID NO: 5300 - DNA, 700 bp, Nannochloropsis_gaditana
aggtccggcatccgcggagacagaggaagcgctcatggcgtgtgctacgataatggtgaaatgtaccgtcgatatccctgagaagatggtgccaaaggcaaagtcgaaggagatctgtgtcattcagacttccccgaactagcgatgcggcatggcccctcaaccaacactggttaactgggatctgatgcgagacaaaggagggtggcgggaacattcagaaacacgtctcgtttgacttccagctactgtgtgtagaggaatcgaatgacaaggacgtgctgactgttctttaattcgtgggcgggctgtctagagagagtttcttgtatactctctactataccgtgccgacagaccgatccttatcctccctctcgttaccctacgttgcaggcaacgtgcacggcaatacacaacgtccggctaaaccagaaaacaaaatattctccataggatgcaaaagatctatattgtcacccttggattgagttttgtcatttcatctgtctccatggtggtcccggtgaagagcaaacgaccatcaccgcctaggcctcaacccccccctagaccagacaatgctgtggaacgtctcctaatccgtgcaatggctacgaaattggcaagtataactccacatgacgctcctccgcccccttcgtccccaacatacgaggagatggcccgctccacgatg

SEQ ID NO: 5301 - DNA, 700 bp, Nannochloropsis_gaditana
ttgccgattgtctaaactctgcatggctacgaggggacgttcccggagaatgacctgaagttcatagcctcatgagttttgcggttattcgaaagaacgcatcaacatggtatttgccttatcttacgtccatggtacacaaaggccacacacatgcatattttagaaagaactcacgtcaatatgttgaagcttttcagagacttgcacgcacacgctaaccggtctctcgacaattcagtcgaattcggtgcgatgtttcgattgattcaacaccaaatgcaacctcacaccaaacaatgagggctagagcgttcaaaatgctcttcgaacctccccgtcctctcctttcaccttacctcgccaggcaaaaagtccctggtagcgaacaagccccgaccgtggtacttgctcggcaaaacactcacgttggttttgttgttgtccatttgcgtcgaagttgtccacatgtgcctgggaggaaaaaaatgtcagtgcgcatatcccaagtagatgccgcaaggagccgatgcgttgatactccgatcgtatcgttgatacccatcgattgtctaatgagcgagatcgacaggaacagagggtcttcgcctgcaagttgacggccaaagttgatgacagaagcaaccatcttctgctgtcaagtaccgctttgactcacgacatgcttgcgttttccaca

SEQ ID NO: 5302 - DNA, 700 bp, Nannochloropsis_gaditana
agctcaaaaaaaatacagtcaggggaacaagacgccgtgatccacccccacgctcaccacttcacaccatcctagtcagaaacaaccggcgtcccagcctttcaacccgtcccaaagcccgcgaggcaggatgaccccgccaacaaagaaaacgacggccgtgctggcttcgcttggccgagggctccgagccgcagctggcatttgagtggcttagcaagtatcttgcctaggacgggggcttgcgccgcaagtatgcattttgtaggcgaccccacgcgtcttgacagaggaaagaggcaattgtgcgcttaccaagggggatcatgaagtcatggtcattttttggggcttaaaagtgtcttttgggtggagatcgggcgttttgttcaggccgtacacgatgatcgcgtggatggcgacaggcatcatttgcgttactgccatgcatgcacgacgagaccaaaaaccgtgtaggcgaaaattatgaatgctcagtcattggctgtcctcatggctgctgtccatttcatttcgtaacaacattttatgtcacataggccgttccagaggaggggttgcccggcgtgaggtacacagacagggggagaccgccaccagcacctttcgtctacttaagccctatcttctgatcttccgcccgagaactttctacgatctttgttgagcaaggaggatg

SEQ ID NO: 5303 - DNA, 700 bp, Nannochloropsis_gaditana
ttttgcaccttatgcgagaagttttcctgccctttaaatgttgacttttagtctcctttcaagcatgtgtcgtctcgcgcaattttgtgcatccgtctttcccctcccgatttgctgcaaaactcatctataatgcccaatggcatcctctagaacgcgtatacatgaaaaaaatgccgatcaggaattttcacgtcacagacgctgtatctgaaagttgtgttcgaggcttgcccaagagtacaactatcagtggaatttagcgcgattcactcccccttcgctagataaaactcgccgtcagatatcaagttggcatggatggagttgtaatagttttaactggtacgcaccttatgaaccgaagcaagtagtaatttttgtggcaaaaagtgaagtgccgtaaacatgtgcaaaatttcgctgcgacagcgtcttatatgacaatctggcactccctccactttctaacgatgatgtacttattacatatcaggtcacctgcctgcaaacaccctgatcaagccgcttagaagacctcttcctcttcttcttgaacctgatgcatggatacatgtctattaccattttcttaacggttatgatggcaaactcttcttttcgggctgttgctcgtacaaatttacatgtgcatgtcgtaagatcgacagcttggcttgcgcatcgtccatcttcaatg

SEQ ID NO: 5304 - DNA, 700 bp, Nannochloropsis_gaditana
ggaaaggaaggaggaaacaagcaagtgaggacaactagcctggtcatctgctcagaaggtaatgatgggggggggcgagaggttgacgcttgccatttgcagagaatgagccatacatgatcctacagcattcccaggacaatgtactgcccgcgtgagtcatggtcgtgaacaagttgttgaagcacaagaaagctcttttgttgagcagagggtgtcggggagagggaggagcaagaaacttcggaggcggtaagaggatgtgatagaggggagtgtgaggccccggtcttcacgctgcgaatcaaataataaaccacgcgcattgaaaattggctcccatgaaaacacgtgagatacgctgtcacgagttgagcaatcaacacaaattaaaccccagcttttcaacatcgagatcagggacgacaattgacctcgcgtctgtttcaagtcactttacagtccccggcacgcccgtcctcctggcaggacgctgtggctttgcatgttccagatgcacgatacttttatatgatgtcgcatgtcgcatcatgggaagaaagtatgttggcatttcgcgtccactcgcatgactggaaagctgcatcgatcgctcgtctgcagttttgtcgcctaaattgcttgttcctttctcaccatttttacatcaacagtgcaaagactttactggagcaaaatg

SEQ ID NO: 5305 - DNA, 700 bp, Nannochloropsis_gaditana
ttaccagtagtcgctcatttcatgcacaaccgtcaaatataggtccagaggacttggcaaggtacacttgtcaagttttctgaagcgctacttggaagtgcttttagactagcagctcgacggaaagccgtacctttcatttcagggagtttaagtggcttgcaactttttgaagcttcctccctgagcttgtgaattctgtctatgcgcttagggttgctggcctgtactagattaaacgtcctcacctacagtatctgttgttttctggctcgtaagttgaaaatatttccatctcctcccccgattccccttcatgtcacgctattttccctgttcatgtgttttcctactataaagaaagcctcgctaagtcctacacctcactttacatttgtccttggttatcccctgaataggatcgccttgcgcaaaagcggttcccatcatctgtaatacagtgaaccaccgtcttttgcacagcagcctgcgcatcagtagctggcgcgacggttccttcttcagaagaagtgttggattagctttcactgtatcgtctcttaaccattcatcttacctctatcgtcgccattccgtatttgtcgcagccctcctcgcttcttcaccgactcgaagcactgccacacccattcgcgtgaaaccccctcttcctcttaacctgctcgcttcggataaaatg

SEQ ID NO: 5306 - DNA, 700 bp, Nannochloropsis_gaditana
ccgcgaaaggcgcttcaagctcacccatgcggacctttgcgtccggaattagactgaacgcctccaaggcacgacgcaaccggtgaggtgggggagatgtaggcgtgcttgatgtgcaagccacaagaaatcccgcaagaaaactgccggcaatcagaacgtacaaacgacccatgactctgaaagggaagagaggacgaagccagtgaaggagggagccagaattatttcgttgacagacaatcaaatggaagggaaactgtaaagacaattggcggtatcctgtattcattatgttttatggggaaaagatgcttcgacagtggcctcgatatcaaaggtccaagacgtttatgtaatgaatgtactaggacgggggggtagggcgtaatatgggccaacgtaaactagtaagaaaaaaaaggtcaaagcactcaaaagacagttgaagttttcaggtaccacgctgttcattccatgcctgcaaaataacgtgtatgccatcacaaccacgcttggtactgactattgggaggaaggaggaagacccatggcgggttgatgcgctttccttcaagccggcttagaccactggagtcagaggagagtcacgcgcacgccagccaccttgtccatttacttccttggccatcctaactaacgccaggacgactgtgacgggcacatttcaattgatatg

SEQ ID NO: 5307 - DNA, 700 bp, Nannochloropsis_gaditana
cggcttggttttgggactgccttatgtacatggcatgatctgccgcgctcgcttctccgaaagtcaattttacctgcaccgattgacctgtccgatcaaagcggcagataaaattgtctgggattccggtgcgatcctacgagaagaatcaagaaagcatactttgaaaacgtgatggcaaagcattcagttgcccccatctcattgtcgcctactcaaacctcctgccattgccatgcaatgccctacaagctgtagacatctttagggaaaaaataccatcgccttccccgcacgtttaataagattgtcaacccaaaaaatcagccacattcgatttttctacgtccttcgtctcgcgtggcattgggagatgttttttcctttctgacggcttgtgtgaccgagagcaatcagacgccgccgccgggctgcggctggaaagagcttggaagcccctctttcatgcaaccatctctcgttgcatctgtctttacagcagtgacttcgaggttgctagacacccaaaacctgattacatgtgaatttggctgtgtacgagattggagagggttgttttttagtattagactggtaaaggatagagacttccgtccaaaaaatgcatcatgtattccactcctgtgctcatcctgtcaaaactttgctcccaccaacagtacattcaagaaaagtcatg

SEQ ID NO: 5308 - DNA, 700 bp, Nannochloropsis_gaditana
tgttgcgtcttggacgatgcaagtaaatgagaaacaaaatctgccgaaataggatttctccccctatcgggtagtattttttcgattatttattacggtagagtctcacatgccaaaaatttcagatgccgagaaaagtgtgtttttactttttgtacttatcttgtggcctgcaggcaagagtacagatcaaaaattgtcccctttttgacttgtgctccacttatctcatacataattgcacaccttttcgctttgtatttcacgttgatataaagatgtagattacgcaaaaggtttttttacgccagcctccgtattgattattttgttcgacctccatactcgctggataagcgcttgggccgtcggtaggaaaggcgagggcgccagccacccaaagatacttcacaacgcacgttccgtcttgagttgccttaaacgcagccctgcttgtgaggaggctacaaggtgtaatctgcattttgaaactactgtttgtaaattgcgtttatttttctttttttacgtcatgtgtcaacagggcatcagctcgcagggctgaggcttgtcaagtatgggcaaaaaaaaaaatcatgtaggagccgccctgcgagagctcgaggagtcaaaggatgcaggaaccttaaaattaggggaagaggaggactttgaaaacgagaatagcagtgaaaatatg

SEQ ID NO: 5309 - DNA, 700 bp, Nannochloropsis_gaditana
tctcatcgctggcatcacgaatggtttgtgcacaggtagcttccttcatgatagccctctttcatcgtcaatgtcggtgaattcgcgaatcagcgcagatgtaacctacctgaagtcatagcatatttccagaaaatcattaatttttttaaatggcaatgctttctacgccgttactttgcgctttcggagatgaaaatttaggacgaccttagaatcaaatttgacgatgtcaaatagctttcgatagcgaatagattttcgaaaacgcacccagtattaagtaggcttgcagaaattggagaggggaggtttttgaaaccagccagttcgagtcttgcggtctttatggcttctttgtgtcgatttagaacatgaatggtgtccatagccgtaagtcaaggtcacagaattcttttcattgctctagcaagggatggtgttatcatctatttcctgaaaggtatcaaagcgatggaatgaataagccaagagcaacgggagactcgctcggcgaacatagggcagtaggcccaatacatgcagcgggtccttggggaccatggatgggctctcacgctcaacctctatctatcttctacgcaaattttaatgaaggatactcagaaggaagaggaagcggcgcaagaaagggaaaaggcggacacatcagatcagcatcaggagtcaaagcagtatg

SEQ ID NO: 5310 - DNA, 700 bp, Nannochloropsis_gaditana
ctgcatgcagtgaaaaggtttgtgacggctttgccacgggtcaaaagcgaggcagcaggtatcctccacgcacaagtcgaagttgatggataatagaaaagaacgacagggaacatgctcagtcccaaaatacggtggaaccgatcctttcgtcttgatcgaggtcgtctcattgtactgtgttatgtagagagacgcattacgacaacaatggatgcgaacgtagctaaattaacgtctggtcaggcaacaattccatgatttcctccaaaatgtcctgctaccttctttgaattacacccagatgtgctttctgaacattgccccctaaaaatatccggaaagtcctccaattacttgtgttgaatgaggcccccgatagcgcaattcagacctctggcatgcggaatcggatctccatttactggataatcatggcacccacactctccgaacacatttgcgaaattaccgacctttattccacgcgtcgcactcaaagcatcgatatgatttcatccatgtgtcccgttgcggaaatctattcaatcactgcccttatgcggacacagagcggtcggacgtgccacagtgttttgtgacatcagcttcagattcagcgaggcagcaacacgcttttggtgtttagccaccattgacacattcctcgcgccgtcactcacaactttgtggaagaatg

SEQ ID NO: 5311 - DNA, 700 bp, Nannochloropsis_gaditana
aaggggctcggaaatcttcccgagctttgttctatccccttcacacctacatcgtctcaagttgttgatttacggcttgcacgtcctcgtagtctcgaatcagctgcatgaccatggccccgtatgtgagattaaataattcggcattctggcggggagtcgagttcacgtgtcagatctagagaatgcaacttcattaagaaagacaaaacgtaccattttgctcatcttggtccaggcttgatcccctgcgcgagtggcagcagagcggctgcttgatgatgacatacctgctgaccagaaacgagcacttcaatgatgcagctgtgttcatttgattcgtatgtgagctcacactatcgaatggagcacgggcaagctgacctcggaccgtgagtctgggtgttcgggtctctgatgcggggcgcattgggccttcgcctgcgggcgtgagcgagtcgagggaggacttcggagactttcccttgtgctctcttccaacgcgcgctgaaggtgctttacgcacccagccgcagggagatggtgaagaagagaagcaacgtcgaactgaaatttgatcgttgaagcatttgtggccctggtatatgggttttcactctctttgagctcactttacgccttgaacgcccctcacctctcccccttttaacacacatggaattgtactgccagagcaatg

SEQ ID NO: 5312 - DNA, 700 bp, Nannochloropsis_gaditana
gaacacggggaaaaggacagcagaggggaactggatccatagatttgattacgaggcatctgttcaatgatttcgatatccaacattgagaataggaacgaaaaattatcgcacaggaaacagccgatagccagaggggggtcctaaacactaggcgttgtggatatgttgcctgaatccattgttgacggggcgcatcaagagtttccttaaaaaaccaataacattgatcgaaacagtgtatccattacggatttttttgcgtgtgacgcggattacatgtggcaggagcgcgacctaagggtatttgcagcgcgctgtgccggagtaagatcgaaggcttgaggaacacagacgtacctgtcaggaccagccatgtcgcgcctaggactagacgcagcggcatatttgtctcggatgctttgaatcaaccgtcctgcgtaaaatcggtgaaatggccacgtcaaaccatagtgtgggagagatgttgcacctgaaggcctgatttttcgtgcttccgtcggggaaatcgcttgggcgcaaatatctcctcgccgtgtgccgctgggaacaaaacttcaacaggtttctaccctaccacggtgccacaaatgcctgagaccggtacatgataaatgtattcgcttgttggctcacataaccattatacctgtctagtagtaggcgcaagtccaagatg

SEQ ID NO: 5313 - DNA, 700 bp, Nannochloropsis_gaditana
tttcctgccaagttgtacaatcatccagctcgactcagactatcatcttacgcaccataatagatccttccgcaagtgaccattcacagcccatacttaccatgatcttcagacgtctgtttgtttggaaggtctttatcggtcataacttggagagccggcgaataaaaaacttcatgtagaatgtgtccgcagcagatactagcagtgcgccggaaactccacctggatcatatcatggtgatcattgcagacacatgtcagataccacaggctccgcatttaaaggggttgaatttcccaaaaactggaaatgtcatacggaaatgaagttgttaggggcgttcaagtcaatcgaggatacggcgcgagttacataatcctagcggacacgcctaagccacggccgtagggcggagcagcccgaacaatttctgcatgttttcacaagacatgtagcgaccgagttggcttctgatttctgcctgctcatattgacacattgcatccataaagcgctgggttttaagtgtcttttacatgcagttgtcctgcgtcgcccgaatatatttcgtcatcgccgattggaacagagaaagaagtcatgggccttgctagcaaacatttagaaccacgatacatttcctcgaatcatccctctcatcccatgatacacaggtggggacattctgcggtgatg

SEQ ID NO: 5314 - DNA, 700 bp, Nannochloropsis_gaditana
aggactcgtcccacggggccgcgggcgctgtcatgcttgtccccgatgatgcacgccccggtgggcgagcgagcgagcaaggaggccgccaagcgatgcccgcctgacgacagagacgagaccgtcacccgcggggtcactgccctgccatctccctcgtcacgcctcttcgtgtgaccggagtcggacccacgacggtgcttagggttttgcaaggctttgatgccgttttccttcctgccaaggggcgtatccaaagtagcagccggacgagaggaggaaagaggcggtgatgcttgtgtgcatggaggtgccacagctcaatcgaggcgcagtaatggtcatgatttacatgagagatgtacactcaatcggcatcaaccttggcatgcgcacatcgaggagatggcgtcggtaatctctgagtcaagcagtcagagacctgcttcgtggcagcccctactttgaaaactcatcatacataccactaccacgacaatactggacaggctagaagtttctcacgttgtctatgagctggaggcttcttgccgggggccgcggtcgcttagaatggttgatttgcctgatctgttgctttcagacggcttccaccgcgttggccttcgtgtgtggtcagggaggtcttttgagcggcctcgtgtcgaaacacgataggagatcatcacaggtatgaatg

SEQ ID NO: 5315 - DNA, 700 bp, Nannochloropsis_gaditana
acttatctccaattgtatctatggggtaagcggaatgcatttaagcggcgcacgcctgtgttattgtctcgcactgacaggactctttctcatacacattgtacacgcgagcatcgcgtgcagagcaacagttctcggtcgattgaacgccccataatcgcacaaatcacatcattatcaccgcactctgtctccattacatgtgcaaacgaaaccttatcccgtgtagtctgtaagggcagagtgcaagaagacactgtccatttggggtataaagatgcaaagaaacaccccatttgtcgattttaaaactttttaccacatttatgtttgctctactactcatatcttgcacgtgacattttttcggggccttgccgcttttgtgaaatgggaagacaatttgagacactgaagtagcggagctactagcaccacaaccgaagtacaaaactccagaaacatttttgacagatctgtaggacacaatccagctaccaatattccattaccagtatttttgaggagccctaacgcttgaaattgttgtccctccctattacttatctcttgtggaagttagctactggttttgatcaggaaatggagaggaggttaaatctaccgactactggattgacgcgccaagcataatctgtactgagagcgttcaaaacctccttcatgttctacaggtatg

SEQ ID NO: 5316 - DNA, 700 bp, Nannochloropsis_gaditana
aatactgtgcttgttcacattgaaaaggaaaggtgcgcacacataatcaatttcgtagcaaacgctgatcgaaaacttagcttttaagaaaacagtcttcgcaaagaacgaaggacgaaggcgcgtaggcgctcagatgcatggcatgcgtcgcatgcctgacagcacccgagacaagtccttgcccatttggcctttaggaacacattaggagcctcctgtggctcttacacaccctagaaatgtatgtatttcagtcgcactttatttgaacttttcgcactgcgacgtccccactcacacgtttgactccactttgattttccaagcgcgatcattccctacggatgcgacctgtagttgtgtcggtggagcagtgtcgcgcattcttgttccgttcccttcgcctgtggaggctttcgggaatatacctcttacatttcttggtacggggcatggtgccgtgcttcgttgaagttataatatgtctatgcttgtcatggttatcccccgtctttcatcgatgattggcagtaattgcgagcgtcatccatgtggatgcatcgtggcgatggcgatggctggtcacgctccccgactactcgtgtagcatgtccagattagaaccaaaaacagagccgcgcatcactcacttgtcgctgccctcgtatattacagtgaattgctttgccgaagcatg

SEQ ID NO: 5317 - DNA, 700 bp, Nannochloropsis_gaditana
ctgccccgctgtaatgggcgactacaccttgcctaggcctcacagacgagcagaaacagattggttagtgcacatttacatgctgaagacacaggatttctattgtgagcgacaaaaaggtggacaaaagcggtcgcgctgggatggcggcagcacagggagaccggcggacccgaggcgaggcggggcgtgcgagagggcaccatgcgtggaatgcccttcctctctgttagtgccgcgcaagctcaggggcgcgccgccaatccgccagccaccgcatttacagtcgttgtcggggaagtgaatggattggtgagacggaggtagggagaatgactgaaggcaagatgcgggacatggaggggttgggggcccgaggctggctcatctctcatgtctcccggtgccggtcgaggcaggaacgcggcctttgcctataaccattcttttggttcccagggtgttcggattagcatgtggcatgtgcgcctcgatgcttgagcgatcaacacgaccccgggccccaagtaaggattggcttgtcctaagagactcggcatcttgatgcacagggatctcctgtctcgaagcccatctcttctctcgcacccgtctttgcatgagtgagcaatcactggcaacaatctaatttctcgcaatcatacgtgatttagatagtccgatcaccaagagagccatg

SEQ ID NO: 5318 - DNA, 700 bp, Nannochloropsis_gaditana
tcttcgaaaaatatatggatgcgttaaattatccctctacctacattgcgaagtgctaaacgctcgctaactttttctctatgactcgcgagtcctgcttgcagaagccattcaacactttcgactctctccaaagcatcgccgtgcagaaatcgcgcgggaaaaaaagtgctgcgagtcatgattggtctgcaacacttgttgccgatgacagcaagtcagttgaatgcgaccagtcaccactttgacaatcaccatattttataatcgacgtaaatgggtagctaacgctcagttaagaagcacgggaaaattacggaaaagcaacgatcaatccggggcccccgcgagctcctcttcttccctcatcatctcgtctgtgcctctctcgttccaagcccaaggcaatgagaaaaaaaaatgcaagagcagcttccgtttttattgcgaatttttcaaaggaaaataaactatgcaaagttacacttggtggcatattggagtgatgagattcgcagcaaccgcggtttgcactgtcagggttactgtcccgcgtgcaagcttctctgctggcaactatctcgtttgattcttcatccgatggccctagtaggcccacatccgcgttcttttcatgtcttcatttctctctgtaatcagcaattaggcaaacacagttgtcgttcaagcggccatcatg

SEQ ID NO: 5319 - DNA, 700 bp, Nannochloropsis_gaditana
gatggcagccttttatttgtctgttcaaatgtatatgtgtgagctgcgaatcaactacagcggtgaatccaatgtccgacgagccgcaacgccgggaacatacgatttaatgcctgccgctcgccttcagctggactcgaacgccagcgacaggagcggtctgctcgcgtgctcatcgcccccattcctacccatccctactccgtagcaacacccctggacgacgcttaaggcctaaacgagagccggcacgggtcgagggcagccgagggtgccatgcgcgaaagtgtctgcccgcacaatggagtccagcctccgactgagcggacggggggcggcagcaggtaggacatgaaagtggttgggggttgcgtgttatctgccgtcccccgcgtactggcttcgtagggagggagacagagttggagagactttgttgttgcgggagcggctcgggattcgacccccgaggcgtgtattcatgcacttttgtcacatttcttggtgcacactttggaaacgtaccccaaggtgggttctctcagagctagcattagaaggcgtggccacttacaggtatgtctccgggtcctcgacattcctggatcgtgtgctcaatcacttctggaattgggccgtccaatggctccccctgtgggtcgcgcccaatctggttactctcttgggtctcgccttcatg

SEQ ID NO: 5320 - DNA, 700 bp, Nannochloropsis_gaditana
tggcagtattgtacgtgcgtgtaaaatcacgtagaaatacgaatgaatagggcattgataaaaacgtgcgcggcgaagtgacctttccgtagaaaaaacgtgcgagtgaaggccgggacccagggagcctccccgtcggcgccgtgagcaataatagtcgtgagagaaaggtggcataggtagccgcgacacaagccacgagacgagggggccacagcaccgaacaccccacggagaattaagcggggtcctgtctccctaaattcaaaccggtggggccgctgcgcgtgatgctgcgaggatgaccgctcgcacgccgggtttaagcggggggactggcggagagtccagtgacgcgtaaagtgggccttttggggtcgatgtttcggggtcgctgtcgtcaagtgagacccgaatttcatccaattctcgccttggggtgtaagaggtgaatcgccgtgtccaaggttggaaagcgaactcctgctgggatttatggatggcataactttgtccggggtgtgaatgggtggaggatgctgactcgggagggaaccactgttgaaactcctcgcgctagcagagcaggctcatcacgcctcggcttgtccgtcgtcgacacacgcgcacgtcagtgtgcatttgtgatgtatgctcactcttttgcatgctctacacacttgatgcatcgttctcaggt

SEQ ID NO: 5321 - DNA, 700 bp, Nannochloropsis_gaditana
ccatcacggcaagcatttccatgatgtatgagctcaacgctatgtaattgtgcaaaggtatacatggcatgtacacaacactccgtgctatgtagcggaacgcggacagtggcaaaaaagctcaacgcgcgagcagccttgcaggccctttgaccaacctcccggcctatggcggctcagtggagggatctcttactcctcttttccatgacaaaaatgtaaaatcgttacaataaaaagtagaagatgactgtatatgtttaggcacgatcctcttccttatttctctggacgatcgagtggcagtccaatttctcgctcaacctcctccttcccgaggctctcaaattgatgtaaggacggtgttcacgcacaattttcaagctttttattcgttccatacagcagagtcatcattaatattgtcacttacacattcagacctcttcggaatttgagcacagatgggatggtggcattcagggccagatcgaaatggagacgtgggtggagacgacttcaaagtgatgcagggtctgcagatggtctctcgagcagcgaagcattccaggtatatcgcgacctcatcataacacgcctctgctcacctgaatggcccttaccctcgccgccgcgtcgcttcagtttcctacgggagggcttcgacgagacgcagccagtattcgtgctggctccaatg

SEQ ID NO: 5322 - DNA, 700 bp, Nannochloropsis_gaditana
gaagatacatgatggatcattcgtacaacgttacacttctgctgacgtatcttgtcacaccttatatagctgggagacgccactatctcctcatgtagctgcgaccaaggaaggaaaaaccatatccagtgaggaattgcttgggatgttacggacatgtttacagcaggcgcaggaatctcatacagtagggggggatggagggggagtaaggcaacgtgagggctcgaacgtaggggatttagtggttgtggagactgcgggcggtgtgctgagtcccggtccgtcgcccctgcagacacaggccgatctgtatcgacccctgcggctacctgttttgctagtcggagatgggagattgggaggcatttctagtaccttagcagcgtacgagtccctatactgccgaggatacgaggtgcatgccatagctgtgttggaggtccctcactacattgagaacgcggctgccgtaagcgagtacattactggcacgttagggcatgcggagactcccgttttgtctcttcctcatctgcccgaagtctcatctgtctctttctctactggcgatgtagacaaagacgtcctcttaggcggcttggatcagtggtaccatcaacacgaacatgtcttccatcacttgctcgatacgctgatagatagagaacgagtccgcatccaacgattgcagaaaatg

SEQ ID NO: 5323 - DNA, 201 bp, Nannochloropsis_gaditana
gggggcagggaggaggccacgtgggagggcgtggtccttccagccagggcgacgcagcgattgaaagagttcgtccggcttcaaggaaaaggatgtttctacgctgcaaacaccaccggctactaccgcggggcctggacaaagcaggtggaaccgcctgtggctttagaggccaatcccgggcgccgcctccgcctcatg

SEQ ID NO: 5324 - DNA, 700 bp, Nannochloropsis_gaditana
gtatgccatcgattcctgaaagcttgtcttcagaagtagaaggcgttccgagaaagactatatcttcgacagatttaaagtcagaggatctggcttaaaaacagtagtggctacaattttgaactttatttgttgaatcgtcgcacattaaatgaaagaataatagaaaaacagtatgcagtaactctaagtcacgaataacagatctgcccacactttgtcgtggaggaaaggcataacctcccggcctcccgatgatagtttttagtatgtttttccacgtcctgagaacggaagctagccccaaaatatcatgttggagtctcttattccttactggctgatttagatacagcaaggctgggttaccttgcggcagggcgcgttgccaacaagcacggtgcaccctggcgagacttgaaaattcgaatgcggccttttcccgggctattcccggttcccgccttcccagcccatgttcctgaccgattcccgcccaattcctgccctcagaggcaagcccgagtcatgtttcccttgcgcaaacgacgaccacaaatgcgacaagatgctctcagctaacaatattcatgctatcatgcgtgctcgggtgagcagtaggcaggcatctcaccccccctgctcgttccctcttacattttctacctgcagcgaagtggaggctctgtgaagacgaatg

SEQ ID NO: 5325 - DNA, 700 bp, Nannochloropsis_gaditana
tcagggcccggccccagtacgtcgccgatgtgccgtgcgtcccactctaggagcaatggcaggagcttccgcgccaggttcctccctcccatccctcccttcccgtagacgggctccagcatctccttgagaagcgcaacatccggtcgcctacgccactcaaaatgggctggacactttcccggtgcgcttccgtccgtgccagtcgcctcgtccccggcacttcgaagacttctggtcaaatccatggccgcatcggaggccgctttgtaggcggcgtgtgcctcgtcaaacttccgcagatagccctgcagacctccctggccgtctcttgcccgcttggccagtaattggagtgtcccatcgtctcgccgctggcaagacatacacagacaggggctgtcattcccaacaaacacgcctccaacgcccacggcatcggcctgcgtctgtccccgattgcagcctccctctcctacgccgcccctcaccttgggcagcatcccacacttctggcacccctttgtaccgcgcactttctttcctgcctctacatgcggatgacttcgacaggtcacgcatgcgcctgctgcaggcgccgtcatcggctcatccaccgcttccgatagacaggagcgcagcaagtccaccaagcttctgcttccaagcgcgatgttagcggcactaccctccccctgct

SEQ ID NO: 5326 - DNA, 700 bp, Nannochloropsis_gaditana
tttcttgtacttggcattggtctatcgaatgatgaacaaactctataaccctacagatagcgttggtagggagcgaaaaaatcttcagcagaaaccaaaaaaacgtgtcatcacattcaaggatgttgccggcatcgatgcagccaaattggagttggtggaagtagttaatttcttgagagaccgagcccggtatgacgccattggcgcccgtctgccaaaaggtatactactatcaggagctccaggcactggcaagaccttgttggctcgggctgttgcgaatgaggcgggcgtgtcattcataagttgctctgcaagtgaattctgcgagctcctcgttggtcgaggcgctgcccgcatgcgcgacctcttccagcgtggcttctcaagctctccttgcataattttcattgatgaactggatgcgttggcgaaaacacgcggttccttttcttcaaatgatgagcgggagcagacgttaaatcagcttttatgtgaaatggatggttttgagggtggagaaaattgtgtcctggtcatcgcagctacaaatcgtcccgaggtgcttgatccagcccttatacgaccaggtcgcttcgaccgccatattgcggtgggtctgccagacacacgcggtcgccgggccatcctggacgttcattcacgtcacgtttgcctggcacctggcgtagacatg

SEQ ID NO: 5327 - DNA, 700 bp, Nannochloropsis_gaditana
ctatgtcatacctcaatttcctcctaccccctgcgtaaacatatgagttttaagttagtcgatgccaaaaatggctctctcaggtgtagcttgctgtgtgagtttctcgagatacgggtatcaacttatcaacatttgacgcaagggtgcggcaatggttttctttcggatacaacatttcttcttcttcatgctcaaatgcccgaacacgctaatttttcgtgccttcttttgatgtgtccaatacacatcggctcagcacggcgcgggtggggaggttggcgaggaccaggtgagggagcgaggaagaggaggttggctttctttgtgttgggaacggaacaagtctaaacttcacgctttgttgccgtcacaggaggaatgtggggggaaattcacggtccttattttgggatgtcacttgtagctaagtcctccgaaatgatgcataatccctcctctaactccccttaaatctcttcggcaacaggcgccctccttcccaggcactcacctctctcaacatcctctcgatccgatctaccggacgcttgctgctacgggatgttttcgagtcgacaagttgtcggtcatggcaacgatggtggagttcctgtgagcgcaggcgaggctggtcggctgctttccggcagcacgacgcagactattggtggcacttttaattctgagacacatctgc

SEQ ID NO: 5328 - DNA, 700 bp, Nannochloropsis_gaditana
tggaatcaagaaattgcgagcgtaccctggcttgacagccacctcctcaccagcaaagccacgaaaggcgagatcttcaagtaaaacaacgttgaccatccttttcttggacaagttccggataattgagggcttgaaggacaaaaccgtacctgtcaggctgttataaggggcccacatgaagggaagaaaacgattcaagaaaaactttggcttgcattgacattcataatccctgccattgcataaaaattcggtccaatttctatttggttctgttgtaagacacgaatggagacggacaatcccatcggaggcttctcgaagcttgacagtggccgatgatgcactaagagcagggtcggcaaccacaggatgtttacctgttacgtcccaacatggtcactgacagagaagtggtgcagcacaaaatctaactcccccttcggtgacctgcctgtgcgattgggtagacgctgaggtgattattatggacttaaaagggagcacgcatctgtgtccattcccgggggctttgatgggaattgcgcgaaagtccgggagaccgggcttcgacctcgcctccgagactaaccgtacgtccctctctcgctttctcttttccccagactataaaacaagcctcccaagattgtcatccacttgattcccgtatcctttaataaaaaacagaaggatg

SEQ ID NO: 5329 - DNA, 700 bp, Nannochloropsis_gaditana
gatggaaaatatttgagttcaaggctaccctggagttggtggtggttccggcgggagaaggcgacgaatcactagaccatgagcgtttgacaaacgcctttatctttgaagacgccgtacttctaattcgtggacaaggatgtggccttcgaggtccaaaatgcttactgccccccctgtcctgcgggtagtatgtctacaggaaaggtgcttgctttgcttgctttctcgacacactggcgggggcgcggcggtgcaaatcacagcgtcactagattatgtggcaggagtatgtgggaccccgtgaggcttgagtgttgttgtgacctcttacaaggtgagcacggggctgggggcctgaaacgcccgaagaactcgccagcgtgagcgagggcgtgaccgtggaggaccgcgactttcggacctcaccaggtcgtgcacacgggcaacctcatcccaccatccgcggacgaatggatgaatcgaacatgtggcagcgtgtcagaggcacgggtgtgcgcggcgcgccttagttcaccctgtactcagccaccttgatggttcaccgtcgccgctcgctctttgtaacacgttaaacccacttccaaacaggagggtctgaggccatcttcacggtcgcccttgctggaaagaagcacacggagagtgccgcagagatttgacatcgctggatggcatg

SEQ ID NO: 5330 - DNA, 700 bp, Nannochloropsis_gaditana
aagaatgttacgcattggatgcgtgacaggtcgtaagtgggtacgggaagcttgcgggctagcgctgcctcgcacgcggagaccgtccgtgcccccagggcgcctcaagcctccgttctccgtctcagaagcgagcgacgaggcatcggtgcgctcgttctcatccagcgtcaagcgtactcgcaaaaagagcccggggcaagtccgattgaagaacgaaccattgtgccgcgtggcggccgtggttgactacggcaaccccatgcaaaatttagtcttaggaactggtgtattggcaacgcagtgtgatggcgcggccgtggggcggcagggaggttgtttagttctgggcacagcggtcagtgacagacaggcgccggcaggagctggagatgacttcttacccttggtagtggaatatcgtgagaaggcacatgcattcggacgcatcaacaggagcgttaatcggcgtgagggagctcagtcagaccaagaaatattggcctcacgagttatagatagggtgatacgcccgctcttccccgaaggctttatttatgacacacaagttgtcacgacggttgagtcttcagatcgtcagaatgatctaacagttttgagtgtcaacactgcatcagcggctctggcagtctctaatattccatggaatgggcccgtaggttgcgtccgtgtaggaatg

SEQ ID NO: 5331 - DNA, 700 bp, Nannochloropsis_gaditana
ctcaaaaatcggggcaaaaatacaggtgccgcgcgaacctcaggaattctatgcagggatcaatatttagagaaactcgagctcgtaaagtgcgcgtaaaattgttatcaattgcccgaaccccgtgggccctccccctcaggaggctctctctcgcccccccacgtgcccccccatagcatccagcatctagtttgtgcctcggcatgtgacactcctctcgcccctctttcaacatgattataaccactcaagaggctcctcaatcctttgccttccatgctgcgttctcctgtccctcctccctcattgcccttttgattttcatcacagctacgaaggcatgcaacacgcctgaacgcacgacccgggcactgcctccctttccctttctcgctttgctctctttcttctgaccaatttttcgtcaccatttccctaatatttgctcggcgtcgcaaagaacaaaatgacacgagtatccttgcggcagtcagcacttgtcgtctccctgtacctcctcctcggtacctatgccttcactgtgccgcccttaaatcaagtttcccagtctagtaggtcacacaggcgtcgaatatgcccgtcatacatgattgccaacttcttaggtggcgggggcgagcctcaagggattccaaggtccatcaaagacggtataaatgggctgcgctttgccatg

SEQ ID NO: 5332 - DNA, 700 bp, Nannochloropsis_gaditana
caatgctgagtgtcgctatggttgaaaaagagagggaaaaccgcatgctctgtcatgattcaagaaaatatggcgtggaagaaaattaaatacggatgagacaacagacgaaagtctcacaagtctcattacttgacctgagcacttacaataggccttcatcattagacgtacggattacgatgtagaaggtacagccattcatccatatctacttataaagtcatatcacatgattatcactgcgagatgtcttgcgaataattgtaattttggcaggggggaaattattatgtcgggcatgtacacggaacagttgctgtaggtggactccctggaaatgtcagtacagagctaatactgccaataaagatgacatggcagacaggggtcacttggctgtgggaagtacgtgtcagacgctttgaccccgagggcttaagtcgagaggagcgtcgaggacacctgcaaaccccggtactcaccatgtcttcgagtttctgtactcacatgaaatcctcgtcgtcgtcgtcgttgagtcagtttcatacagcgcacccaagtgaatcgggatgggatgcccgtggcgagtgagcgatcgatctggttagagacctcttccgtgtgcattgcgtgcgtgagaacattgagcgtacaaaggtctgaagtcttaaagaaatgacaacattctgaactgaaa

SEQ ID NO: 5333 - DNA, 700 bp, Nannochloropsis_gaditana
cctgtttgcacggctatcatagtgtggtgtggagactcgcgacgcatcggaaggccgtgatagggtaggcgagtgggggacaggaagaggaatcaagcgaccgttttgttccatgccatacgaaataaaaaaatttccgtcgttgctccctgatcggctttcagaaatcaaggcaacatcggctacatttaccatgctcatgctcgggtctcctttgtgagagggcaagtgacttaagaaagcgtccgtggtggcatccgccgtcattactgccaagatgaccggcagcaaccatgggaatgtgagtcttttgtccatcattcctgttcaatggatgggatgccggtaggcgggctaccatgagatgctagtggacttagacctacttgcgtttgagcgagggaggcgagcggatgagcgggcgattgcgggcacggcaactcaagttgccgctggtggcgaggaaggccagggataggcggggcaagcgagacagtggtgtatgaggaggagcacgcgaatgcaaaccgtcccgtggggcgaataaacagcacgcagtggaagcatttggttacaatgtcgtccttctatgcacatagctcaagctcaatgaagatgaagaatcaaacataacagtatctattgaccggtacttatgacgatattatcaatcaatctatcggcacagcactagacaatg

SEQ ID NO: 5334 - DNA, 700 bp, Nannochloropsis_gaditana
gtcgaccggcgagatggcaatgcaccagcatcttctttagcactgtgacattgtgagtttcgactccgtaagtgcacgaagatgattctacaaataataaaaaaaccttaaaatacattgtgcttgatcctcctggctttcctcgctacccgaaaggcgcacccggctcgaggaacatagaaacagggcggatcacgccaatgctcccctctaccctccgcccccctttgtctaccttgcctttctgccgtccctcctctcggactttcgacgtcaggcatgcatgcaagcccacccctgccttcacctcttcccgcccgtgatgccctttatctccacctcctccttcgggtcccaggcctcgccaaggaaagggcaactcgccgacgccgtgggcccgcccgggaccccgtgcaactgtatggcagattttgccttgcctcccgcatgcgaagtggaaggcacagcgcttgcttgggggagggactggtgtgcgttacattgtgtgtgtgaattccgcggaagggacagctcttaccaacgtggtcaatcgtgtcttcggaggcttcccccaaaattgacgtgacatctcaacaaccatatgaaacagaaacctcgcctttgccgtctttgctcctcaccaggcaagcacttttctatctaccaacgattcaagcaaagcaaaaagggttacaagatg

SEQ ID NO: 5335 - DNA, 700 bp, Nannochloropsis_gaditana
aaattaaatctttgccattggaggacaagaagctcaagttacaaatctgggacactgccggtcaggagcgtttccgcaccatcacaaccgcgtactatcgtggcgcgatgggcattcttttggtatatgacgtaacagacgagcgctcttttgcaaatgtaaaaaattggatgagacaaatcgagcagcacgcttccgaaagcgtcaataaaattttgattggtaacaagtgtgatgtggaccctgctgatcggcgcgtctcattagaacaaggaagaaaactggcagaggagtatcgaattaaatttttcgaaacatcagccaaagaaaatgtgaatgtggacgaggccttctatactgtggctagggatattgcactgaggtaagatcttatcttgctctactacgtggggtcgatgccggaaaccgtagacgatcccttcgatcacgagacgagcccatcaattgttttgcagatatgtactaagagttttagaaatcccataccgagatttaatggccccttacaaaaatcttgcactgcaggattgataatgaagttgatttgaccgccagcggcaagaacgtcaagatcgggcctggagttggtcccgcagggggcaaggagtgttgctaacctgcacaagctgtatattccttcgatgataatgaataaaacatgtcttcttagttcatcatg

SEQ ID NO: 5336 - DNA, 700 bp, Nannochloropsis_gaditana
gacaagctttttctaaattttagctccatcccaacttgcgcgtcgcctcgcgtcccgctcacataaacccgcggccttccctttccccagctcctatctcgcattgccgtaccttaacctcagagacgggtattgtagaaagagaatgtttttgtctcaagcgatgatgtaatagtcatttagtattgtaattccgtgcggacgaatgttgaattgaaggagtcgggcctgaaaaaggagaggaataggtaaagcagccctcctcggggtttctccatctcgtactagcctgaggcattgagggacaggtgtaggagccccacacgcacatctaaacttgaacgaaaaattgtgcacgagtcgagctctagcaagcgaaggatatgagaaaaactggatgttacgtcactcttggctggacaagaggtatttctttgcagaaaatagtgaagagcaaccacaaaagtggaagcaggcaggaggcagcagtacaccaacgtaaaggtctcgatgcatgggacaagcagataattttgttgctgtagaagacggtatgatgttgccctgtatgcttttggggtattttcgctctgctgtactgcagcaacgctatgctttttagatgctggattatacggcaagtattcgccattcaacgacgtgcttcagctctaaaagcccatcacttacacagagaatg

SEQ ID NO: 5337 - DNA, 700 bp, Nannochloropsis_gaditana
ggatcgagtgcggctttctcccgcccaataatatcgtattactgggtcggatgccttcaccgtctttgtcagagtgctcaaaactctcgcgaggactactgtacatcgtcgacagctcaccctgccatattgcatacgtttggcgggcgacttatctggatatgcggcgcccctttgattggcaatagttgctggtcacacaccgagagttgcttggtggtgcggagaccccgagggacgttgtgttgtttcgctttttagtgcatgtctagcaagtttatcagcatccaatacattcatatccacgccctacttctctttttccttattgacaacaggtgcgcatacccaagcgtttctttttgcttatctctcctccaaaactgcagcactactagcagacgaagcatgcagtcgcggtccctgctcacaactttcgcaaagcaggaaagttgagtgatataatgttgtgtcattcgtattaaaaagttcttattgacgtctgtgacgaattgaagtaaagctctcgagcacagtctcgacaaggaggatcccatggcgaacatgatctgcttggctttcgtgtaagctcgccacccaatttttgatcgagcagctcgcatattatttttgagaaaataaggcgataatagaagtaattgatcaaaagtgagtctattgaggaggaactcgcaagatg

SEQ ID NO: 5338 - DNA, 700 bp, Nannochloropsis_gaditana
gtgggtttttcctaacccattctgactgtctgtttcttcctcctctccctcctcatcatcagaaaaatgtgcagtcattatgtcgttcagtttgtcgctagatatacgctctttctcttcgtcctcatcggctccaatcggaagcggcgacgagtcgttttcctctgtttctggcgaggaggcgtccgaaacaaacatgtctttcacctgatctgaattaaaatgggcaggcatacaaaataagatgtaagagagcccaataaatgcgacgtgtagcctgaggtgggactggaccggagcgattcgttccgcttggacgtgaacctaacggacggcaccgcccaacggtcgagggagaagttggcgcgaacgatgcgttaaacggtcaagacttgaccgtcaagtgaaattttggcgcgagcgagcccatcgccgacgcagcacgactcgtataggccaagctccaaccacattgccagcattgcaaagggcgacctgcttaacacgcttcgatttccggtctgtcaatgggtgatttctatgcatgggatagcacacgacacagcatgatttcttcatgcaaattgccaccacgagagatggcatattattgaaggctgtgacacctcatcacctaccttctgccacgacgtacctccgaaatacattttgtaattgtcttcctggtacccattccaaa

SEQ ID NO: 5339 - DNA, 700 bp, Nannochloropsis_gaditana
gtgtttataaagcctttttcgtcggtccgtcggcccttcggcctccgcggccctcgactcgagggcctcgaaaagcaccgacaatagtcaacgaacctccgagacggagacgaccaggaggtcagcgacagcgcgacagcgagcttgtcgtaagcagcgtctatgcttcaccaggaaatatgagtatccatagctaagtcatcctcctcaatgtttccggaaagtgccgagttaaagcaaagatattcagcaagccagacgaaaagatgatggtcttgtagcctgttgaaatggaacttacccgctgcgcccatgcacttggctacagatgttaaaattgccgattgcaaactgtgcgaactcatgtgaatatcgcatgggtgacttgacaaatgacgtgctaactggaatttcttcttttaatcgtgatcactgtcgcaggtggacgacacctacaggagcatctaaccctcgttgcttcgattccgccagactcgctccgaccatgtccagggatgaattggtgcgggaaaccagaatgtacgagcatccacttgttaaacgttacgcaactagagagatgagctatatatggtctccggaaaagaagttttccacctggcggagactgtggatcgcgcttgctaaggctgaacaagagcttggcattcccatcactgacgaacagatagcacaaatg

SEQ ID NO: 5340 - DNA, 700 bp, Nannochloropsis_gaditana
ctactttcatactcatgcaaaggcactgggtcaccacaccttcgaattatatcaagagcaatcgcaagcgcggttcttgtaaggacgtttggatcaaacaattcattattacagactttcagacgagagagaagttggcttccctcgaattgtctttcgcctcgaagtttagtgcgagctattttatggtaaacgttcatatcccagaccatgaagcgtgaaattgtgataatttcgtaggattacgcttttgttggtatgtaggaatggtccatgaaagcactacacttggtgtcttaaccggctgcattgtaatttcacgttgagtatataaccttcccgtcctgttttgggcctcaccgcagggagcatgaacgacgagcagaggataagagggacgaaaaggggagatctacagccaccagacgtggacctaggggcaggaagtcgtttgcgggccggaacgagggttaccatgcggcggcaccttgccgcgctggccctctgctgctcggcctgcgcagtgcagggattcgcggtcctgcccggcagcagcgcttctcgacaccatcgttcaagccacccggcgactccttgtccgggcccaatgtcaactccgtgtttcgtattctctcctgcttgcccccccctggagttgagaccacgtggttcgttgactggcggcagcgagctcttcatg

SEQ ID NO: 5341 - DNA, 700 bp, Nannochloropsis_gaditana
gccatgctcgtgaatacataacagaagaatgcctgcttccttgtccaacagtgaaaaaatggtcgacttgcaacgttatcaagaacggaaaatcgacttttcgcatgtacctggatgaggctcaacccagattcgtcctcagcgccaagcgtgtaggggactcttttttcatatcacagtatgaatcatttcctgaaagtatcaacggcgtgccggaggtttcttcctgtgccgtcctccggacgtgctcggaaggatatttcaagctttttctcaacgggtgcgaagcgtgcgataagaaggcagacaaatatacgtgtggttctggccatagctttgacaatcgacagcttttggcagagatcaatcatgtacgtaccaaaaaacaatgcaaatgtaagacgaaggatgctggacatatatccagtaatatcatcaattcagaggatgcgctcaatttgtgtcaccatctattagtaaggctcggttcgccttacatctactgacttttctgaaatttgttccttttcgcctgcatgcatatacagtctgtcaaaagggtaaaagaggcaaatgcagatatgcgttgtttgtcagtcaaattacccgaggtgcacgaggaccagcagacgagggatgtgtggtggtaagtaatttatgcgaagaagttgaatcatccagtagaaatgtgagcgccaaa

SEQ ID NO: 5342 - DNA, 700 bp, Nannochloropsis_gaditana
tttctggatttggagggcccgatctttgttccatgcattctgatgcataattggtagttgagtatgcgcagacccttaaaatcctataattgaataaagcatagcaaggcagcgctagggtttgggtcgaatgagaaaagttcttactcataacttgtatctcgttagtagttagtccctcgaaaggaagctttgacttcgaacatgattctccaagggcaagtactgatcctccttaccacttatctctttccaaactaatcaaaaagattatctttgtcggcaggttcataaggtaacgcattctgcaaccctcacgggaagcgtaaaatggctacacagcatttagcgtcagcatccggcgaattggaagggcttgtgcagagcacggtaaacctttttggcggggtggcagacaagttatggccggccaaaagtaggaaccaagaaaagcaagcagaaattggaaaagttggagctttgaatagtgaagcgtttgattccaattttaaaaaagatatcaagacattcgaagatcttgatttgctggtaagctgcacaatgagggcttgtcgccgttgcttatatgctcgagtcatttaaatatatagatcatgcatggtttcttcacgtagtatacaacatttcttcatatattgcaggagagtggccatgctcgtgaatacataacagaagaatg

SEQ ID NO: 5343 - DNA, 700 bp, Nannochloropsis_gaditana
acctcgtcgcttgcagacgttcacaatatcctccatgttgtatgtagaaacagtggtatcttcatctggggaggtaaccaagagctcttttgtgggaggcgccctcgaaggcgtgcggaccaagcctcttctttgctcggctgtccgaaagacgcggccaggtatctgacctcctcctcgtcccagaaacccagcattttgtacatttgagaaagcagaagcgataaacgatcctttgtgaaagtaggagaaagatatcccgagaaataatgcaaattaagccagggcagagtcctagcacggggtacgtacgcttaagtagtatccaacccattcccctacgacatccttacgtgttgtactcagcatcaatactgcaaagaccaaggaggttcgtcgttttgggcccaccatctgctgataaaccaggatcttaccaaaggtcacctgtgatcgtgtggtgtaagcaattgaggaccgccatgttgcctctcgcatatcgccttcctcagacgaaatcaggcacggagtaatcaacgggcgatgacgctcgagccttcggggacaatatccgcccgagaatgcctctgaccacctcagttctctcatgaaaggctctcaacttcattcacatgactctgcagacgaggggatcgtcgccttcaagtctatcaactcgcaagccaagccgtagccgatg

SEQ ID NO: 5344 - DNA, 700 bp, Nannochloropsis_gaditana
gaccattcttattccgtattaggacgaagagcatcaaccttgcaggactaatcgaagtgtgtggtcctaaattgcgacgcaacgagcagacaaagggagctgatactaccagtacactgcatgcgcccacacgagagctatcagcaaacttaccatggtctgaaatctatatgaaggagcctgtgaggccctcttgaagtgatttaatgctacaaatcgaaaaacgctgccaatgttactgtttagaccggggatttcacagagttagagaagcgtgatgataagtacggatagttcttcggccccgccttcaatccagcaagcccagcagcctctggacacgtgaacaaacgctttgcacttatcatgtataaattctagtcttctgtcacatagcaatggtcttgcttatgccacaaaggctggcccgagacagacggagcacacagccctggcaggcgggtctaccgcggctggtgggcgggggctggctgcggcttttttcgcgcaattgttcccgttgccttctcccacatgcaagtggcagcttctgaagctataactggcattagatgagcagatttgtaccactttcctcaaatatatacatcataggctgtaaataggcattcgggaatcttctggcaggccctggcgtatcacgagctttcgcagtggcaggaaaatcgtccgaatcatg

SEQ ID NO: 5345 - DNA, 700 bp, Nannochloropsis_gaditana
ataacatgacaggaaacgagacgtacgggataagtgaatgtatataaggggggtcttgcgaatccggaccacttttaatattctgtggactgatttttctaattcaaattcatcaaaattcattgatcttcgacctcttttggaggagcttgaatgtgtgaacggagtaagatgatgtagcaatgtgtacgtgaagtgagtttcgagtatacatggagggtacgagggacgcgcggggtcgcgtaaaagtccatagcttacaggtcactgtcttcacaggcttacacgcattaaaaaatatctatacaacttgctctgcccgcttgtgggatttctggccgcatacatcgtgcgctcaattagttttgaagccgcagggcgagaccgcgacgcagtcggcacgtacgacctaacaccgccctcaacttttaagacacatcgtgaagtctcttccgcgagtctcatcctatgtgttttgaccttctcatcatctttgtgtgcacacaatcacctcttccggatgatcaaaaacagaggtagataatgaccatttgacccgtggagactgaagctcttacctcctctcttgatggtggtgtttacgtagcatctgagcttttcgtcgtctctacttcacgcacgcctcttcttgcttgcctgaagggcacccatctttcttggaataaagggtgtagccatg

SEQ ID NO: 5346 - DNA, 700 bp, Nannochloropsis_gaditana
aagacgaattaaagtactgactagaccagaggcatttctacgcctgtttatcgtgtaaaaggagtcacggggaatgggacatgcccaagtgagtggcagtagccgacgtagtagtagcagtatttactcacgtgttcaggtatgaaatcttcgcctcgattgagaccggtgaaggctcaagggggtgtacatgtaaattttgttcaaatagcttgtcaacactgagagagaaaacataccaagtggcacaatttggtacttgtggccctttgtttttgttgtcttgtgattttgttaaatgactttaatgaagaagtattagagacaacgagcggtgtggatatcgatctcgtggggacgtgttgtattcgagggcggcacgactaggagcgaacagatcggatcgtacaaagccccgaatatcgccgagggggcgggcgcgaattccctgttgtcctcatggccgcctcattgtgaacgatgtctcacgctaacagtaatttcccggatgttttgtgtaccaaccatcattgtcggtgagtaattcatctagttggggatacggcccccaaaaaagagcaaggagaacctacagggacaaggaagcgcctgcgcgatggcaaggagccaccatgaaacctgaaaactagagtcatttttgattactttagctctctcttatcacataaatacaataagt

SEQ ID NO: 5347 - DNA, 700 bp, Nannochloropsis_gaditana
ttgtcgtttttactaccgccaaagccgcgacacggagaggcgaaagcgaggccttttgactagtcgaggcacgcattatcaagagctgcacgagcccttgttacagattaaagagatctttgatcgcgaaaaggatggtgaaaaaaacagtgacaacatcagcagcgccaatcacagcaacaaaatcaaacaaacccagacagcaatatccacgctagggtcgacgaaatcgaccacaacccccctgcggtctgcaaagaggaacagcattagcggggaagaggaaggccctggtgtcgcccgcccaagccttggtggccgttcaagcgtagggcccgtgctgcgggaacggcacaaggtggaccgcatagacctgcagtttcgggatttgactgtggagctacccggcggccggcgcaaagtgctgaatggagtgacgggtggcttccgctctgggcgtgtgacggcggtaatgggcccgtcaggatgcggcaaaaccacgctaatctcagccctttccaatcggctaggactgggcacaagggtaataggccggacctttatcaacggaagtcccgagtcctctacagccctgcatgacgtcatgggttttgtcccgcaagatgatattatgtacgaagatttgactgtcaaggaaaaccttctgtactgctgccaactccgcgcggatcccagcatg

SEQ ID NO: 5348 - DNA, 700 bp, Nannochloropsis_gaditana
agaaatacctcgcttggcgagggtgcggataaaatttattagcttcattgctccgtacaaatctaattgatggctgttcaacagcccaaagaaatcaaggcccattactcggtcagcagctaaagcggcctcaggagagatttcctcggtatcggaaaggagacatcttgtgggaacctcatcagggccctcatctacccagtcgttccattcttcatcgcctcgcgcgcaaacgttgatagagctgtcatcactaacgcttgctatgctagagccatcattctcgtggccatccatcattacacgctgcctggcgtttttaaacctgtacgacgagcgtcgatacacgtgtgagtagacagacggaaatgcaggaagatacaagcgcagagctcatgactttaccgaacgacaaagttttttttcagtcctgcagaacgtattccggataagtgcagattagaaggatctttacgaccagtgagaaatacagcggccaacatcgataccaagcaaatcttgtactcaagcctgaactaacctcccgacccccagcatcgatgcatctggctcatcgctcatgcgccgtggctacgtacacgctcgcaccataatgccgacctgatattactttctgcatgcaaggccctcttaaatatacattctgcgtgcgcattcgctgacagattcaactcttagc

SEQ ID NO: 5349 - DNA, 700 bp, Nannochloropsis_gaditana
ctttccgccatcagcagacatctccacattcctttaacttagcctactaatcccagcgccaaacttgcttccctctcacgacataccttgcggccaaagacctgtaccgatcgcaactcttctgccatgcgttctgtgacgtcgaattaaagggatggggcggtgagcatgagcatatgacggctgtcgaacacggatggccatgcacccaggatgccgtttgaagtgagccaaggcccgtcgaatggggcctacgccgtcctgctcaagcatggcaggccatggccttggcctgatttgctgtgtccagaccaaggaccgggtcgtgggcaaggtgaagaaggggacctcgcaaccactcctccagcacgccacacatctcccccagcgcccagaccctctccgccgcggcggcgccgcccccctccccacgggctagccacctgctcaaaagtggacgggacagtcccacgcccccttgcgaagcacgctcttttctcgacaattgaggacgtcgcctttgataattatgctcggctgggtaaagtgataagagatgtcgcggccatcaccatcctagccatccattcaggaggttgttgtgcctttgttccatgcatctctgatcctcccgtcttctcccacccaataagttggactgacagatgccctttctgaatattatctcatagatacaatg

SEQ ID NO: 5350 - DNA, 700 bp, Nannochloropsis_gaditana
cgacgacctacaagttgttggcgagcagggggccgttaccgtgagctacttgcattagttccacagagtgacgggcatcccggacttgcatcaatgcatgcaccactgtgtaaatggaaagacctagcatgtgaagtgctcgaaatgacctacttgatgttttgccgatccggattgagcaaaacttcaactggtatgcatacgacttacgtgaaacacatgccaagcacccgcaggttcctacttcccaatactttctgatcgaaatgtggtggatgctgaagccgcgtctgcttttcttctgggggattttcctccttgtggggcaattgtacgcccaaactgaggtaagtgggcactgctgtagattctttcttgcgaagtatgttgtaaacctcggtatcgtttactcaaaaacttaatgcttgatcgacttctcacgattttacattaaatcccacggcagggcggaaagaggctaacgagtctccatgccttgagtttcttccgctcccgcgtctgtcagacctgtgatttagtcggatccgtaggagattgtggctgcgattttgatacagtcaatcaggccactatattgcatttttttccgcttctgacagatctagcccaacgtaccttctttcgatatttcaaagtgaatttgaacaaagattgccccttttggcacgaggatatgatg

SEQ ID NO: 5351 - DNA, 700 bp, Nannochloropsis_gaditana; identical to SEQ ID NO: 5321

SEQ ID NO: 5352 - DNA, 700 bp, Nannochloropsis_gaditana
ttcaactgctgggaacaagttcgcatcgggaaatagttctatcttcctaagcatggtagtggacgtacccatggaaagggtaagcggctaccgagtcacgaacctcttccccaccggctctgtgttccgcacaatgcggcgtccactgagcccgctttctttttcaagctgcgagagagaagtgtggtatcttgcgtgattgagaatgtgctctggtttcgctttacgaaacgtgggacgtcaagcacaaaggaatatcaattcatcgatcgtctgcttcgctaaaatgctccaggcacgaactcctcagggccatgcatgctcatccttggggtcctccaacggcacaaaggggggcctggctgatccagatcggaggcgagcatgacatgcgattgagggtctcacaggggggggacagcgcgggggatgacgagaaaatacagcagaccgcccgcgaggtgtggggggcgggaggtcgagtaggagtacgcatgtgcactcaggttcaggtctgctttgctacttctgcttgcgcggaaaaaagttgtggacatcgtgtgaacctgaaaattgtaacacaccactttgctttatgggtcgacattgttgctattacacgatataggtacggttggcttcttcacctcaatctcctttcctaccgctccctccgagcttttaggcaaagcctggtatg

SEQ ID NO: 5353 - DNA, 700 bp, Nannochloropsis_gaditana
agcgcaagcacatagtggttcttggcggtgactgttgtttcgtggaattcatctatgctcgcttaccctgtgactgcttccagagggaacattatcctgctgagtgtcgttactgtcaaatttctagaccaggtaatgaacttaacctcgacgtcacaggctcgcggcgcccggtaagcttcgatcttttgttagatcagggagttcagagcagaacgcggcgcgggtatctaaagcatcacacgctgagggcaggtcgagcggcgcgaggaccgcctcatcgtcatcacccgccacgagcccccaggaggatcgcatcgcccttgcttttgcacgtcgtaaattccgactgctcgtagtgcatctacgcccatgagaatgtgtttctcccaatttgccgactctcctctgacactttccgtcatgttgccatcataagagttgtgtcaagcccctgagccattagaaaatcgtgtgcttcggagcagctagaaggggttcataccaccacgcacctgtttgtcccctttgttctttctgtggatctctgaatagatcccccttccggaaagcgccctcccagcatgcggcttggggacttgtgccctttcgcagatttatatagctaacgtctctaaattttctcgcctacaatttacactaggtcttcctctcactgtcttcagaagcaagcagcatg

SEQ ID NO: 5354 - DNA, 700 bp, Nannochloropsis_gaditana
gcggctaaacctgtgctcgctgttgggaaaaacctagatagtaccgaaatcaacatggggatacagtttgtgatgcgttcatgcatttaattaagcactccttgtcaaggtgacaggtcaagtcacgcgacctatgaagtggaagagtgtctgtttccctctttcgagtgaaataccaactccagccaggataccagttcgcattggccggccagctggcgtaaagcattaacgaaattacaagaaaggagcgggttcgtcttcctccttgcccaagccagcacacacaccacaaggtcgggcgcgtcgagaccgaggcatgccggtgctcgccggccgaagacggcgagggagagcgagggctctgcggcccgaagccgccacgtttgtgtccatgcgagccgtacgccttctcttttcggggaactccggagactattgacagggaaggtgcgcatgtgtatagttttctcattcgccttgaaacggtcgcgcgtgcattatgccgtcatgtacctggccgacctccgggtggtactttctcctgttcatcacatcaaacataacgctaaaatattatgctaaacaatttgaatctgcgttttcactccaagccctcatccagtgggtgcgcaacctctccaattgcactgacgagattggtctctgtaggacttcgaaaaggatttcaaaaaggatg

SEQ ID NO: 5355 - DNA, 700 bp, Nannochloropsis_gaditana
aagctctgaatgctagttcacagcataacattttttgtatcacccgagagtcttgagaggacataaataagggaagcagtaaacgaaatgataacttcgacgaagcaacgggagaatgatagagtgtcgcgaatagttacaccatacacactacaccgcctgctcagaaaaaatgatgagttgcgtatagttacttcgctacagcgtccttcatagccataaccagatctgacaaagtacgtggatctcatcacatataatttgctagccgtgatatataaatgcgattctcgacttgaagtaactctcaatagctactgattacatcaaataagccgttcagaggcggtttcacgtacatgtagtgatgattaggattcattgtcagacgtagtgccccgtttaaggaaacaatcgttacatgaatgtcaaaacgtcaaggcgcgacaagtagtactcaggacgtcgggtagaccccaaattcactctcagacactatcgtggtcatgtggcaggggggaagggtatagaatgcagataggtacatgtattaatcacaatcgcgggaagacacaaaatatacatttttattttatcgatacaaaggaacataggagtggcgtgtctgggacggaagctcctgtgtagccaaagctacccggagggacgagctgaggcttgagcaaaagcctttgcaatg

SEQ ID NO: 5356 - DNA, 700 bp, Nannochloropsis_gaditana
cttggttcgagaaggacttgtgcttttacgcttttgagagataggcaacgcagccacccgggcctctgtccgctgctcaactgcgcggcttccctcctcccgggcaagttgcaaagccgattttttgagcggcattattgcagtgctgtgtgtgtatgttcgaaatataagaagcatgacgcaaaaagacaaacatcaattcatgcgccagcctgagcttaatagcaaaatacctcttcgggtcactaatttcctcattcaatcaacgacatgactaatttgaggggtcgtcttggccagccaaattggtcacgccagtatatcagaacatgaggacgcaccatgcctcaaagtaggcagcacagcaggctctggaacgggaaagtagagggtgactatggtccgtctggcacttccggaggctccccccggcgtccccggcgagggcgagagggacaggcgatacgaggccactgatcgactcacatgtcagggaactgacggggtttccgacatacagcggcgacatacacctttggccttccttattcgcagcagcttcgtgttacatcgacgagcagtgcgagtgagtcgtatcctgcggagtggtccagtcgcccggaggagggcccgcctggccgcgctttgacttgttgtacgtgctcgtcccgcggacaaagctcttcgcacatccacgatg

SEQ ID NO: 5357 - DNA, 700 bp, Nannochloropsis_gaditana
tgggcaaacccgtcttaaatttcatgatagacaggagtccaatgagaaaaggaatgccataattctgcatttgtgtccaatgtactgctaacgtgtgtcagtaacctgcgtctggctaattacatggccacatacctattgcaaaaaaagtgggtgagaaagtttgagaacacagccttcgccgcctgcttttcttgtcctcttaacaatcgccatcacgcatcaagtattgaagcggattgcctaccaccttagtgactgcaattcctccgtcgtagaactgaaaatggtgcagcaagcacacgccgagggcgggaggttggagggcgcccgagaggaagatacgaatactggcgacttcaacagtgacgtcggcgagcccccttggtaacttgtcctgtagccatctcctgcccgtctccaagtagcacaatgtcactcatgtgacagggctttcaaggagggtgagatccatttactgaacgcatatcccctcctgagaaagtcaacaactttgcacgagcacttgtacatatgcctcctgcactcttgttgttttttccaaggactaagcaaattctcctctctcccaatgcgtatgctcatgtgcgtttataaacaatcatctgcatttcgatggttaaattcaactctacaaatctcaaacaggcacgggggcacactcaattttcattcgatg

SEQ ID NO: 5358 - DNA, 700 bp, Nannochloropsis_gaditana
gcggggtccagagctcagggtcggcgcaccccagacccgtatagctctgtcgcccccgcaagaggcgaggtatctgccacacgggctccaggatacatgccacactctgtctgtgtgtcctgtcagcacagagagtcgcttgagagacattgcgaccagtcttgctgttgccaagtgcctggatccgaaataggacctatcgtgaaagggcaggggagtgccttaagggcaacgggctgagaagcactgtgaaaaaggaagaagtaaaattgaatcgtttgtcagcttcgatgccccatgtcactcagactctcattttgagctgatctgaagccatgcatgcatctcaagtcgattcactacaatcagctggacccccatttgttcagtcaacagtccaggtaccacctggcagcggctcgagacgagtgttctatccaatttgtctcatcctgtgtcgcagccgaccacaattgccgtccttgccggctcaacttctttttttcccatcctggatgttcactttacaggtgtaatttttggcttacgtgtgctgtgtataagtaccggctgctattcgcgttttcgtcctgtcctttatagagggaaccatcagctgatttgacaacgacacgcacccccttgcatctatagactattctcaccgcttttctgcctggaagaggcgacatcggctatg

SEQ ID NO: 5359 - DNA, 700 bp, Nannochloropsis_gaditana
agtgcctgctgcgatggcaagtctctcgcatccagacagggtggcagaggcaatgtccgtagtagtccgcgggtaatcggcagaaaattgaaactaattaagatcccccaacttatcctccggcatcgctgtcgttccatacctgtcgctggattgtgagcttcatgagtaggtccacgaagaccccagaaggcatggcttcggacgtagggcggccatctcgccgagatttctcagcgagctccagctaacgaggcgaaacgcctcgaggtctgaatgccagactggtgccgtgaccatcctacccccccgcgtggagcacagtccatatcgtgctcgagacatggcgaaagatcgttaaccatcgtgagggggcgtcagtgggcttccttcgacgtattataaccgttgtgcgctctccaacgaggcttgccatgggtcagaaagccctcgagtcgtgaagtcgaatgaactacgtacccgcagggccacgattttgaccattgtttgagtagttttcataataatatatctagtctcctaagaaactctatactgctccatcctcgtacccatttttgtaggtacgaagtcctgctgccactgaaccgtgctggagaagggaggctcactgtcaaggaaaggacctgcggccgaccgcagacacataaaacgcctccctgcatatttacaatcaatg

SEQ ID NO: 5360 - DNA, 700 bp, Nannochloropsis_gaditana
tcctctgttcgaattacggttgttgccatttgacttatgttggcaactacagtgcacgagcaccttgctcccattgctttttccgtgcggcgacaatcaaggcgattcaagccacacatttacatagcgtgcgaccccaaagacacttgtctgtgactttgtgggcattgaccagtgtgtttgatgtcaaacaggaaagggtggatcggggttggacagtgtcggcatcggccgggcatctgggggcttgccccccctggagatcttgggccacacgcacgttggtttgcttcattcgtgcggtgacgaaggcaggaggattgctcaagtaacctgcgtttcgagttgttgatggtctgggtgcgacgactgcccatgtgtatcggcggtggcctggactgctatgaagcaaggacgtggatgctggcttgggtcgcccacgtcgacccccaccccgatctagtctcaccgacccctctccgtgtagacagacccgcacatgcccaccaaagccacaaactcatacaaacgacagctataactgacatacatatccgtcttgttcgtcctgtccggaccttcaagatggctgtgatgttttccggcttcttcagctttagtcaacattctcttccccccctcccttcccttttcgttcaaaacagaactcccctccaatttaagacattcccagaccatg

SEQ ID NO: 5361 - DNA, 700 bp, Nannochloropsis_gaditana
cacattcatagcagagcgcatcgaagtactactacacataggaaggtgagagatcagtctgcgaaggctctcacgattccggtcaaagacaggctgaacaagcacaagctgcttgaagatcatagtaagggtactcgcatcattgatagaatcgtgagcttgcacgtgaaaggaggaatatctccaagatggaacctgatgagagagcaccgaatccggcgaagcagagactgcttcaagcctgttattctcgaataagcggtccagactgtctgacaagggccttagactcaaaccaaagacgcttccgcctgccaaaacgtcgtcaaaacggtcgcacgggagggctatgatcaccgcgccggtgcgaggagcgagcgtggcagtgagagcatctaatttaatgcacccgctccaccctcgctcaagaaaggcttgaggcagcaacgttccctgtttcctcgggctctgtctcaaggacaacgccagccatacacgtgaacgtgtgcggatccaccgcctgaagtctggacaatgcaaaatgatccagtcgctatgtcataggcttgtctgtggcgtcccttgcactgtgtttttggtcttcgggcatgccttcttgtccctgcgcccatcctcacacgtctgcatctcgtttcggccccttcggccccctccctatcaggcctcccagctaggtatg

SEQ ID NO: 5362 - DNA, 700 bp, Nannochloropsis_gaditana
gcggccggatcccccctcgcgtcgaaggcatccagggtccggtccggaggcgagggggagaggcgcatacatgggaggcaatgcaggtggccattcggcgccggagtcgtcgcgccggccatcgccacgggtcgagcgggaggagcggggggagcgagggcctcgagagataagcggggaggagtaccggcagcagcgacgcttcgagggagggcggcgtcggcctgcacatcgaccgcagggaggacctggacagcggacgccaatgtggaaccggcgggggttgaagagggaacatgggtgggaaggagaggaagggagggagggaggaagggagggatggagggaggatgagatgggggccgacgagggggaaaaagaggtggaaccgacggagtactacgaagaaagctttcgggagggggggctgcggaccgaggctgatgagggtggcttggatgaggagagggccgcgcgtctggcggacaccttcttcttcagccggaagaccttcgaggagatcggcgcctcccccgaggcccgggccgccctggggtccatgggcatcgcccgcccttccaaggtccagaccattgcctacccgcacattctacagggatcctcctgcattatcgccgagcagacgggctcggggaagaccctggcctacctcctccccctcttgcagcgactccggggg

SEQ ID NO: 5363 - DNA, 700 bp, Nannochloropsis_gaditana
cccacctcttccgcgctgcagcaacagccgctgctacttgcctgctgtgggccaatcacgcttccggctttgagatgcccccccacactcaagttcacacgatctcaccattgaggcaaaggagctctgcctcgacggcaacggtcgtcggtggggacaggggaggagcacagaacggtatacagaggcagcgtctgagggaggggacgggtgtccatgtatatggcaacggagggagaaagcggggcggaggcagtaatggaggaggggacaagggcacgtcgaggaaagacgatttcctcgcgccggatttcgacctagaggagttgctgagggaggaggggggagagagttcgtgggagccgcggagggagcggccggatcccccctcgcgtcgaaggcatccagggtccggtccggaggcgagggggagaggcgcatacatgggaggcaatgcaggtggccattcggcgccggagtcgtcgcgccggccatcgccacgggtcgagcgggaggagcggggggagcgagggcctcgagagataagcggggaggagtaccggcagcagcgacgcttcgagggagggcggcgtcggcctgcacatcgaccgcagggaggacctggacagcggacgccaatgtggaaccggcgggggttgaagagggaacatgggtgggaaggagaggaagggagggaggg

SEQ ID NO: 5364 - DNA, 700 bp, Nannochloropsis_gaditana
gaatcccaccccacattatcgcatctcacctctcacctcgggcattgcacattccgcactctctcttgcctttttcatcccggcaggtttttagggcgggcaatctctgtcaggcacattttttaaataaaatggccacatgcgagtgacgcgctatgttcgcgccggggcttcgtggcctagatctaagtccccccaaatatgttgtcgccattaccaaaaagccctttagtccgacctcaaccacacgtggacgggactgcggtcggtcggtcctcgtaactatatcaagccaatttttgagcactgctagcttaaatttgtgccgcaccggtattcaaatgatttaaaatataattattcaccatattatgtccttgaagtattctttgatgctattacaaagtcataatatctgaatagccgacggattgggagggctggaaggtttgctcgaggcggcaaacgccaaaaagcgagaagcgcggtctccgctcccttcgtcccgtcgggggggggcgaggttctttctgccttctggtgcgtccatgccgacacgaaatacgatgggtggaaagcttgatcgtacaatctggcaatctataatgtgattgtcgtcgctcaaacgtaagctctgtatctcaagaatggtccgcgcgccttctttgggtcaccgactctctctctacctctcctcaca

SEQ ID NO: 5365 - DNA, 700 bp, Nannochloropsis_gaditana
tttttgggcccaaagcctgaattgaaacccaagccacccgtctttgttttgtaataagaaattgcacaacgtgaatatcaagagctgaagttgccacgaatggtctgactgaagagagggtgttgttccttaacaacatgcatgtccctaccttgccccgaggtcgtagcttgtccaatgtatcgtgaaggcgctgcatcctgtcgtcctccatggctgtctagtaggaagatcctcgcggccaccaaggaccaaaacctaggccttcaatctgaaaagcgacagaaatgaaacagaatcaatattttcatatgtgacgcgcatgtacatggcgccatatcaacgccagccgcggggaagaagacgacgcgcatgcgatcaaggcaagccaaggtgttcagtggaggggaggaggtcgaaggcgtcgttcttctctttttgtcattgtgctgctttttgccgccgaatcaagcacagacactgaccattttctttttccaatgagttactggttcaccgcgctgtactttaaatttcgttcgtccgtgcatgtggtggacacagttacggggttgcgcggggacggctggcttgatgcttgacgtagcccctcgcttcgcattcttgtttgaccacagttgacgacacctatcgtcattttcctaacgttcaaaccaccccaagggtttgtaaagagatg

SEQ ID NO: 5366 - DNA, 700 bp, Nannochloropsis_gaditana
aaagcaaaagaattttcttccttgcgtccttcttcccccttaaaattggattatttattttttaaaaaatacttaccgctgcctcaatgacattttccttctgacagaaggctgtacttgacatgcggtctcatgtcttgtactcgtaaacgtttacgccacgacatgacgtcttcgtccaactgtcccagtacctaacgacatggtaagaagagtaaaaatcgtccacttaaggatcttgaccaataattgcatggtgatcgctccttatttggcacacaggctcttcaggacaactttaaggatgaagccccctttgtcgcgagtggcgtgtgtcaagtttctgcatcctcgcaatctatagaggacctgaggatacgaagggcaaggcttcggagggtaactcatagcccatccgcataccctgcgaagatgcggcttgtgtcagaggcacatttacacatgccttctcaaatggtttctctgagcaactgccatgtcgtgccgtacagtaccgagtttcatcgtagcacggtacgttttcagctgaatgcacactgtgtgtgaatcattttttcaattctggatatcaatatattgcagtactgaaaatttttcatttattcactttcgcaacgctctcggcgcccacctcctttatcacagacatttacttcatcattcacaggcctctatcatg

SEQ ID NO: 5367 - DNA, 700 bp, Nannochloropsis_gaditana
caaccatctcaccccgcatctctcttttagaaatatgtgcctgatagtggttgccatgctcccactcacattccgaatccccccagatcactccctatgtgatacaccacctcgtctagaagcgcggtgttcacccgccgagaatctttcggaacgtggtcctgcccctgaacgcaaagagagtcaatgaaatgaggactcgcatcgcgcaacgaaggcgcacggctcgtcgaaaactttctgaccttgtcaaagatctagaaccgccatggctatggcatgtcacgtcactctctaatcaaaagcacgcgtgctattgattcccacatgggccgggggtagtacgtggcccttgtcaaggcgcgggcgcgctcgctcagggaggtcaggggcctggactgtcagctgagaggcgacagaatgggtgaacagagacgcccggaagtagttcgtgctgaatcacgctctatagtttgcgcttacttcccacatttcacggtttttggccgctgtacagcaatattgcaaggaagtgggcattgctttggccacgagcagagcatgcacaagcgagaggtggatgaatccccgacactgctcgaccagggccgcaattttcattagtctttgccgctgcacacgcctcttcgcttgtaaatagctcattctagcacttgaaggaaaacaaaagccaagaatg

SEQ ID NO: 5368 - DNA, 700 bp, Nannochloropsis_gaditana
gaaaattttatttttcagttgtttctcccaccgctatctttttaaaaggcacgcgtgaataagtttgtatacagtgcgttgcgacaaatgccccccctctacacgtttaggttccaagaaagcactttgacatggataacccgggggcttttaaaatttcaaataacggtttcctcggtttttgttcgcatcctccggcctccgccctctacctcttccctcactcgagtccctttcaggacgtggattgcgtccccggaatgtcgtcaatggttataatctttttttgagaatgataaatagatgcatcattttatttgttcgtgcggttttcatgaagcagttggtagatttttcttgagaaggcccgctcgactactgactgttccctggtcttcgacgtgacaaaccccgtgaatgatcccttgtgcacaagaccccgaccatggcctccccgaggatgcatgagcactttagttgcaccccccccccttaactcgcacatcatagacactgatttaaagcacgattaagctcaggggaaaagtataaaccgcgcttgaaatatcgtgcagttgtatgggccgcggtctggattcatgccctgttcgcctcatccctctcgaagttctccgctgattgtttttgcgtcagtactcacaaaccatacataccttatgcctacaaatacattcgcagg

SEQ ID NO: 5369 - DNA, 700 bp, Nannochloropsis_gaditana
acttgcgacaaagtcaaagcctagaggcgacggtggagcaaagatagatggatgcggacgagaaagaagttagaccacaacagcctctacgtttcaattttagccgcatgttgctaagacgtcgtccacaacggtgatctggattaagatttagagctgagaaaaggcatcaatatggaacgggcaaatcaagcaacgaatgaagaattggctgctaacatttatgagctctcatcaattgttttctttgtagaaaccgcaaggcaatgaaggaaggaaataggaattgcagtctccgcaaggaattattcgcagcgggtccgagatgcctttcagaagcaagccttaaatagatcaagccgtgttaaatgtcgaatcatatgctccagcttctaaaataaacgcggtgtttaaaatatcaacgcacgtgtgtggggaaaatgtgcctgcgtttgctgatgtgaaggggaaaggagatggtaacggctttttaaattttttcctcgcgtagttctcgtctcactcaacaagcccatctgtgaatgttgtttattcgccaggcctctggcagccagagcccatcagctcgcaccggcaacaaagaaatggtgactgatctcgaacatatttctcgtcaggtgtcgcagccatagtgtctggtggtcgtcgccgtagaaaagaagggcgtccttacttcatg

SEQ ID NO: 5370 - DNA, 700 bp, Nannochloropsis_gaditana
ggcaagcggcaaacgacccgcgcccccacccatcaatgcgcaatttgcgacccgcgcgcgacaatacgaggttctttaactatattttcccgcacgaacagatcatatcgtcgctataagtcttacagtcgggctgtttatgaaccaagggcccaacatcgcgcgttgacgcaaggtgcgtggtatgatgacctccccatccccctcgctctttccaggatagagccattcccaaggctttttgtcaagtccgtgatgcgtcctgatctcacacgcatcgggggccgatgctttggaagatgcaatcatacagtgatgattcgtttcgagacttcccgcgcggacggcgcaaaggtggggaggtttttggcttgccgagacgcaatgttcaattatctcagcactttgtcggtgggaagccccttcggttggatcgtcatacatatacattgcgtcacttcgcacagtattattgcctccctcaaatccccaacctacctttttgaatgcttaatttctctcctttatgttccgggtttgcttctcacgaatggacccgttaaggggcttggtagggacttgctcttatgttgtcggactgcatgatcctcaactaacgtaaagggtatacttgtttgcatacttctcacttctaagccttcccaacaagcacagcgccttggcgcctgtccccaccatg

SEQ ID NO: 5371 - DNA, 700 bp, Nannochloropsis_gaditana
ggattcgagagcggcaaaacatggtggagttgctgctacatccggaagcgatggaagtggtaaccaacgccgggatactcttggggaaagtgggcgacattcagcggatactgacacgaatgcgacgtgcgggttcgacagtaaatgattggttgacgctcgctaatacggcggagcacatcttgttgctacagagctgtctagctgtcctcgcccatctaacggcgcggctttcgagtgcctcggataagggtccaagaacagccggagaagaagagcatagaacgaacgaaggttcctattcatcggccatggcgatacttcaaggctttttggaccgaatatctcgccaggctgtaggaagggtgagcaaagccctcactaaggttcttgacttggaaataacgcgggagagcaagagcatggcggttcgcttgggctgtgatgaggaattagatcgactacgtggggactacgacggtttagaggaatttctgtccgaagaggctcgtggggttcttgctgaacagtcctcgcagttgctctcaaagatttccgtgcaatttttgccgcaggtagattaacttttgggcgatgtatgctatgggctgctcatcgattattttctgcttttccagaatttttcttccgaccactcaaatagacacggcacggtctcctatccatttcctcctgcatg

SEQ ID NO: 5372 - DNA, 700 bp, Nannochloropsis_gaditana
cttcgcgtctaaatttgcagtggatgcgggggccatcaagatcgtccgttcggcccctggagaagggaagatgtggcttaagctggtagaaaacttctcactgacccttatggcgcttgtgtccacacctacgtcgtccaacgtctgcctgatcgccacaccattctcatccgttccctgtagggccaacaatccagtgggcgtgcccaaggcacgagcccaaacgaggtgattcagtgtgacacctcccacgacccgggcgctacagatactttcgtccaaaaagtagcctttcgtcccttccttgggccacctacgaatcggatagaatttgtctactacatttgatccacaccctagcactagcttgctcgtaggcccgcgaggctgcaatgcagcagcggcgcgggacgccgccatgtccaaagtcacgaaatagtttccctgttatgtacagtgagagattcaattcttccgtgctgtcgttttgggcggcaatttgatacacgacatggcaaagatttggccacgaccaacacttatgatgcatgcagggctgtgcgcaaggccaaagccatactcccgggaaaaatgcagcactgtgcaaatatgaagggctttaattaagctgtgctgctctgtagctggtcccgtcttacgagccagccattcctccatttctcccccttttagaaaaatg

SEQ ID NO: 5373 - DNA, 700 bp, Nannochloropsis_gaditana
gcgccacagtcccgccgaaagacaagtggcacgctggcccttacccaagtacaggcgtcgcagaggcactacgtctaccgcgtgaggcacgtccagcatggaggacacgccctctcccggcgccaaatccatccactcgggcagcgggataccgtcaatatggggactgtggctgagatagtgcacctggaaaaacgctactgcgccatccaaccgcaacgcgcaaatttcttgccctccacggctccacatgaccccgggcttgacataaacttcttcgtcttcctgcagcagcacttcctcatctccatcatcaatcgtggtggcccaccctagcaagagttgatggtgccctgcactccatatttggagatcgtgccgtgttaaaatggcaatgtagtggcccgtcgggtcagcagccatgcttaggatgctggtggtacggcgggcgcttgccccttgccgcactgccagcagctgcgggcagcccaccgcaaaccctggcatacccgtcctttccctgtaacgatcgacggtgagtgagttgaagggctctggtaaagcgcccgaggcactttacagaacgcatcgctcagctgtcttggcgacagggacgcgtcagatgatgatggggggacgagcctcggacgccggggcatgccatagtaaccttttttgtgggataaaggtcacaaacatg

SEQ ID NO: 5374 - DNA, 700 bp, Nannochloropsis_gaditana
gagagaggcaaacagggccccttcaggaagggtatacgtcatagcctttcagaggaaaagccaaaaccttgatttctgacgtacacagccaaagctcacctgtaactaatatatggccggcaaaggcctgggactggacaaagaataccagcatgaaagccatgaggcaggcgccgtgtgacctgctcatcctgtgggatgacataacaaggattgaatgacttgaggggtggggaggcttgaatcaagctgaatgggctgtactcagaagaaaaaaaaaggtgcatttacaatggatcttgtctagaaaggagctttttcaaggctaagagcgtctacttccgagcacaagtacgggttgggaggggtgggggttgatgttgacgtgaaagagggacctgttggctcgatggccaccctcaggggggaaggcgaggcttgctgagagaggaagcgaggcacacgccgcgaatgggggccatgtgccaaattttaccattgaaatggcatgctgcgcttgtgggcttctttagaatgaattttggcggtacagtcgctgcatttgtggatttactttctgcccggggcggaatttccgcgcttgttgcccggtcgagccagcactcttcgttctcttccgtctcaccgtcttaacctgccatctcactttcctcgacgttcctccagcaccgcgaacatg

SEQ ID NO: 5375 - DNA, 78 bp, Nannochloropsis_gaditana
ggggaaagggggggggagacgaagggagaggggcccgcctgggagtcggactgcgcccgcttcctggacaaggtgatg

SEQ ID NO: 5376 - DNA, 700 bp, Nannochloropsis_gaditana
ctttcagtcgcttttgcacgaatcggtttacttcctcctttgctttgagcttgcctgcagcgtctatcacttccaagggcccagccgctgaagccatttgcactgcccacgctgacaacaccaaagccaggacttgtgcatatttgtaccgataattcctctctgacgatggcgtcatggtccgtctcgaccaaaaaaagttcgactctgggtgctgctggtgcgctcctccttttgtgccaggcaagatccctcttattctttcactttaatctctttcagggccacgtcgtacctaccgtcacgtagcgatagtatagatataacgaaaagcttgagacactgagcgaacgtaaaaaagatgaaattctcgcttcctgtgggaggtgttgaaggagggacggtaggcaccgctcatctgaggctatctaagcgctctcgccgcctcgccgcgcgataccatcgctgtggacttcagccaaagttccccctgctcacacatgaaaacctccacaatacaacaggtacatcttgtatgcacctggtaacgtccttcctgctgctgattcttgggctttcctctgccgctggtgcgttcgttcctcctgtgagcaccattattttgcgatcaggtcgcctcctgctcagcacctcatcacccctgcgccgagtgtcgaggacgactcgtggtttcaaaatg

SEQ ID NO: 5377 - DNA, 700 bp, Nannochloropsis_gaditana
agtcatagtgcgtaagagcaacaaagcaatcggctccccgttgcgattgcgtcgtcccagcaaatacctttctccctccccttgtctcctcccctaggcattacctgggcactaggtgggatgaacctcacccgcttgaaggccgcagccgctcgagaaaacatcctcactcgcgaagtaagtagccaaaggctgtgcatgcaaagtattgaagcgcatgtgagcatttctcgagagatgctatcaccaaatcgacacgggcgttttcgcctgagggcccccgccctcgagaaggagcgtctgcgtcagagacggcgccctgaagaaacactccaccatttcaggatcaccagtctgcatcccctgcgccacaacatcgacaaatcctcgtcgcagggcgcaagggaaagaatagaggaaaatggaggtgggcgcggcggcagagttggtgtccaagggcatgatgatcgctttcgccttgatatcttccccttcccgccccccactgactggattcttgtcgcgcacctgcatggagcctcagcggctaatgcgggagcgcgtcctccttggcgcgcgtgcgcgacaaaagtttgtgaaggcagcatccgtgtctcttttccaccagactgtggatgaccgttctgtcttatctttttctttttccaaaccgattcaggcatttatcccctaaactatg

SEQ ID NO: 5378 - DNA, 700 bp, Nannochloropsis_gaditana
cgtatattccttgaaaatgtaggcgaacacggagtgcccaattcccttaacggtttctaacggctgccgtgacgtgcgcggctcccttgagctgctccgcgactttgcggcttacacggcgcctccaaaaagaaggaaggaccatgatccattgctttagaatggatctgaaagcgtgctatcctcttgtgtcgcactgcatagacaatttgctcacttacattttccaccgcgcacgtaggagtgaggagacaggacaaggaaagggcggaggctaagtcgggcgtcgaaggtgttatttgtgtggaaccaggcagtctctgtcattggaggcacagcaacatcatattcttaacgctgctatcggctcgctgagtcctggaggcacatctcctgtcccttttctccaatccaggtcagtcgtgggattatactgacacaagaggggtgtcggacctgggtatggtcacatggcaaaaccagctcattcagtgcacgacaatgcgcgactgctgatcatgtagcgctttggtagtaactcgtttaaaaattgtacggatttattttcaggtgtccaacgaactgagattggggcaatctgatgtcatgcgatactttcaagcccgtcccccaccatgtgtttctggcctcgttgacgttgctccgtgtccctattccccataggaaagcaagatccatg

SEQ ID NO: 5379 - DNA, 700 bp, Nannochloropsis_gaditana
gcccgggctctgtcagccgttaagatttgaatttgccccccccctgccctcgcttttatgtcgtgcccgcgtcccgaggaccattcacacgttggtgcgggcctcacgtccttttgaacgagttgccatcttgtaaatacctgcatgggagggcattatcctcgtactgcttgggaaggcgtataaatccatgcgcctgtcgaccttgcgttgcccttcaactgcctctcgcgcagcgacgcttcgtcacatgcaaattccgttgggagctaagttgaaagtaaaatacgcaacgtgtctctatatatttaagaactaacatgagcaagaaatgaatcttttattctgattagaatgtattgggtacagacgtgtgccttttgacgtgccccactgctaattgtcaaaacctttctttctttttaggttcgtcagtgtctcctgagtcgtactgcgacagcgccagggtccagctgtaaaagcgtctgaaccatctgcaggcgcctgtatcctgtgggaccgtaatacacacttgctgtaatcgatatctctcttcgcaagatacctgtgttcagggggcagacggtcgtgccaccacaatctcttcgtacggcgttgaacctttgtcgtcctcttcgcttgcctgtttgagagcgtcgaacttgaactaaaactttgcagaagtcctttcgtataaatg

SEQ ID NO: 5380 - DNA, 700 bp, Nannochloropsis_gaditana
gaacgacgacggggatttggccttcgaagacttcaagctggtggtcgaagacatggctcgtttgcaccagggcaaggacagcgttccgggctggaggtgcgacccacaggtgttggagaaagaggcgaggaaatggcacaaaggagggcgttgctcactggtggacttcgtctctgcagtcgagaccatgaagttccagggcaccggcgttctttttcgcacccctcagtcggtgatccatgtcgataaagcgcgccgacggctgcttctggatggatcccgtaccccttcctctgcctccccctcgtcttcaggcccctcctccggtgggtgtcgcgacggagcgaggacctccacaagctgcagtaccggtaaagaggaggacagtgatggcctttgcgcacacgtcggccaagcgtcgtcgtctgtggtgaaggtcaattctcgtcaaatttgtttcgacgtcagcaagcagcggtactccatgtctcctcatgagaagaccaaccgcaaacttgtccggatacacgaggatcatgcgcccttatcccatcaggaaggaaggagggcaagtggagggagggagggcgacgagagtagttgtgatgaagtggataggcagctggcacgcactgggatgaactcgacttacgactcacacagaaatggagagcaatatgaaaaagatttcaggaccatg

SEQ ID NO: 5381 - DNA, 700 bp, Nannochloropsis_gaditana
agcaagcgcaagcattttattttttcgttcatccgcaccagattgtttctctttcgagtgccggttgccgaagacggatttcaaaagtcctccatcaggttttccacttgcacgctttttcatattttctaattgagaggctgtcaatacaatcggactggttgaagccccctggttactatggctgcaaggattgttttcccgattgcggttcactccgaaaagtgtggggtctacaggctgcgcgagcgggggcttggagcgataaattgcctgcggcataatttcttgaaaaattataaacagtgtgcacattgtcggcgtgagtcgttcgcgcgtgggaattttgtaggaaaagagcacacgggaaatggaggctcgtaacggtttgcggcacccgttaccgttagcgaacaatttgaaggctgaggcgcgaagcacgccgcttagggttcaaacttgcaaaggtcatgcgcgatacctgcaagaatcgtacaggcccatgatgccaaaaagttaaacgggctacaaagcgttgttttccacgaggttcaaaccctcggatgcattttggcacatcggcatatttctttcctccactacgtgtgagaactattaacttcattccatggcttcccacagcttttcttgaagggaatcatcaagtctatgccatgtgggtgtacaattagactttcct

SEQ ID NO: 5382 - DNA, 700 bp, Nannochloropsis_gaditana
caatcgtgtaacgtgttcctgcttgggcaaaacgcaaggcaaaagactcccggaggcctcttcttacaaaaagctttctttcgttagcgtggtgaggcctttggaggcatgtcctcttttcacgcgtccacatgccggaatcgtgtttcaatcgctagccgtcgttagctgtggaaggctggctaactggaaacctctgcgcatgcctacgtctcgaggtcccataagggtaggaaacgtagacgccgcgaaaaatgcggcattcagggttccaccgtgtctaaaagatcttcacttagtgggagataccccacggtgagcctgttgtgagggatcaagggtatgactaactgtggatggcctttccctgcgaagctttcgatccgaccgagagccctctctagcatcctcacgtccggaaaccttgcccgcatgactctatgcccgtccgctccaatgagagcctgtcttatttgttggacgtgtctgtgtcttgcgtcctttgtcccttgacacccattccagccacaatgtcctttgcctttgggcagctgggccgatctgcccacggccttgcccccatttctcacatcccttcacttcttacccctgcatctaacattgtcagcgacagcaacggtggagggaggatcaacgttaggcagcgggagctgagggagcaacagaggcataagacatg

SEQ ID NO: 5383 - DNA, 700 bp, Nannochloropsis_gaditana
gagtatgatatctggcggtgtcaaacatcccctacagtagaagctgaaccaagaaaagccgtggctacaccgctaaaatgttttggaacttattggatgtccatatctatcaatgtcaggtgcggggtcatgcgtatgagacaggttttgttgttatctgagattcttagtgatctaagttcaggacttggtcgagtaaaagctatggcgggcacacagttttctgtgtgtacgtggaacaacgagaaggcatgggccaagtaggaaagtacagcgagcatgcaggaaagagtcattagccaacctgctgcattcgaatgctttactttgttttattttcgctccccccaaaaaagcgctgaaaaggaccccagaatcgtgacgaacaatgtgaaacgaagttggcatccttgcgagtcgaccctgttatctatcattcaaaattttgaaattcgaaattgttgcaaggaggggcagcctcagcaaggttgacatggaggcacttattgcagatggtttttgatttacctagtcaagactcctatgaagtttattacattgatgattttccatatatttatcccgaagggacggcattatgagataatttagaatggctttcagcaaggccaatcccaacgtcccaggagtcaccgcaactaaaaactgagttctcgaagtctaaatattcttatcaatg

SEQ ID NO: 5384 - DNA, 700 bp, Nannochloropsis_gaditana
cgcggtcgagccttgccagggcaaactggtaggacattcacatttgtctaattttacctgtcatcgtcatattcgcttgtcctcttcacctctctacacagccagatgccgtaccttcgtgccggattacgtccagtagctcgcgagaccgcaagagagacgaccgggcttcagtgagacacatgtcgccgtcctgcagcaaggtgagcaggtcctccatgcccaaaaaggaagccagctcctctgctttctctgttttgtaaaaatttgtctcgctgtggcttcgactgcatcagactttgataaggtccaggagtaaaaaagcatgggagaggagtagagggccccggaggcctcttgaagacatgggagctgataaacgagacgaaaaaaatatcagctgcgtgcgccgagcagtaattgccccgacagaataggcttctgcagaaaaattagttgtcgtcatcgtcagtaattcttttttgcggttgttacgtcttgtggagggagcggacgaggccttgtctctgggcacttgagctgtcgccctcgtctcccctccccggtggcacgccgtcggacacggagaacctgtgtcatattctacacgcctcggacatgaaattatccagcgatttgagccgctttgaaacatatattttcttcattgttcaggtcgctgtatttaattttgcccatg

SEQ ID NO: 5385 - DNA, 700 bp, Nannochloropsis_gaditana
aaccggtaggaatgcagccccgcgcgcggtggagcggtatccttgtcgcggacatcgtccaagaacgcttgaaagcgactgaaggattcctgattgacgtctttctgttttgggtaatgtgtgaagaggtctggatgcaccctcaagaaaaatttgcggagtgtttgctgcaggagaggatgcgctccgccgtctccatcggcctgatgccgccaccggggggccaaccctgcacgctttcgcccgccgcgctgccgagcagtggaaatggcctgagaggtcattattgacggctgacatgatactcccacccaagagaaggggaggggcaggcaggggcgggctcggaggcggctagaggaggaaagagaggcgcgaagttgcggcagcgcgtgcatggcccgggcagtcattttgaacgcctcagaacctggggggtggaatgatggagttgagtgaataccgaggtgtgagagtggtgtcaagatgtcagtgtttctgatgccaggccgcaaggtggtgcacgcgcgagtatcttcctgtccgggagctcgcctccgtcatacaggtctcgcgcccattgcacatcactaattcaccatcactcaccggccctttctcctatcatctacaagttcacagtgaaccgactcacagggagacaatgcaagccctaagcgcctcttcccgcggatttatg

SEQ ID NO: 5386 - DNA, 700 bp, Nannochloropsis_gaditana
gccctgagccaggtgtccagtcgatgatatgtccgcggcagtcatctcgaccgtctgggaccctttcgtatactccacacatcccaaaaccaagagaaatacgacgaattgtgacaaaactaggcgaccgaaggcggggatggccgggaatgggccggaggagggcattcccaatatcgtccgcgggccgcggtcctgacgtcctcgctcctcgtggaggctcaggggaaccggcgacagcttaacggctgtcataaataaggagcgagggagtcatgagtggatcgtcatacacgtaaaggttatcgggaggctctctgtccgtcgttaagagtacgaaggctgggacgctaggcaggggcggatccagcggctcgggctctaggaacgggcaacgccggcctgctcgccagagacgacgtgaccgcgggaaaaagcgagggaaaaagttggcacgaatggaaacaacacagtctccggcacgtttccccgtgaaaatggcccgaagcgaaagtggcgcgctatgtgattggcactctttatatcttaactagctgctcgccccgtacgacggggatgagttttccctttctttatttctttcttcttcctccgaacccaaactcttcttagctgcctgatagcaagtcaaagctttgatttatggctgtataaatattttttcaacgatacagcaatg

SEQ ID NO: 5387 - DNA, 700 bp, Nannochloropsis_gaditana
tgttgctccacgaatgtttccaagtgcgcacaggcctacaacgaaggcccgaaggcccttgggagatggaaatgaagggaagagagccaggttacaagccgcggactcatgagggagaggggaggccgagccgcggagagaaggcaaagcaaacattggtatttcctagcacagggtgctatgccctgagaccaccgcaacatattccccgattcatctctcgtgcatcccatgcgtctcacgaatcgagaagacgtggatgctgtggagcagcttggcctctcagggggtgaagaggggcgaggggagtgcgggagagaagggcggggaggggaaggggaaaattgcgcgaagactgaaccgagctgacgtactgctggcgtcaaagcaacggaattttttttctccgatggcgacatgcgcgagacagaggtttatgcacattttttacgtctttgactctgatgcatgcgaccttctatagattcgctttaaagtgttgacgctttgaaatgttgactgtgatctgattttcatattttattatcttgtcgaaagatagcacagctcggaaatggaatgggccgtcagtaaagataggtctttgcgttgcggctgtcacaatggcgtggacacacgatatatgatttacaataaaggccctctcatctcatttttcatttaaaaatagggaatcatg

SEQ ID NO: 5388 - DNA, 700 bp, Nannochloropsis_gaditana
gtatagtatgctacggcgacttcggatcacggataaagaatagtcttgaaaacggacgcttgatccacctattatacgcactgtcctctggttgagatgtggggtagctctccttcccatcccgaggtgcctgggcggagacttgactgccacagggtcagcggcaaccgcgaaatgcatattctgtgtaatatttttgaagtcatcgcatcgtgaaattggctcttctgccacggaagtaaacatgcagggtttgagccgggggtttatatcacctcctctctccgcccgggcgcgatagccacataccccgccaagttgacgagcattcacgcaagcaaaaaaagaaaagaattcatacaaacgttcaagaaggcggcggaaggtttaggctattgccaaaaagttttgccaaaattcggctcctgtgtttgtttagggttttaaggtggtcgccgtgtactagtacaggctgaacgcaaagcaaaggaattgaccgtgttatgtacctgatcatcacaaatttaaccgtggcagaacccgtttccgacaacatttagcttcatccacagactcgctttctgaattatccgccagacacaaaaatcagatgcacgagttaaagagaagtacgcctcgggtgtgcgatttctgacgagcttcgtcttttgaagacacagagagatctcttcgccctatg

SEQ ID NO: 5389 - DNA, 700 bp, Nannochloropsis_gaditana
ggccgcagaaagtgaaataacgcgaaataagaagacacatagagggtatgatttcgtgatcgaaaaccagctcttgcggtgtcctctggagaagtttctgcgcgccaccgggatctccacggagtcgagcgtggatgtggagtatttccgaacgcttcaggcaccagtgcaaggttcttctagcaaatcagaggcggcgtgggtggggtcgctcgtggcttgtgaggggaatgggggggaggacatggttttagctggggctttcgatgggagtctgcgatgtcactcagcgcggggctgcgtcgagctcggggggcgctggctccatgctcatcgtggaccgatcaaagcgatggcagcgttggagcccggagcccaggaacaagagtctggggcatcagagagaggcgtcgtgacggtgggaaaggaccaggtggtcaaggtgtggcaggtgctggtgggagggaggggcgagaggaagggcgggaaggaggcaacggtgcgtcctgtgagcaccctgatcggacacgagaatagcgtggagtgcgtggctgtgcgtgggaaggaacaggtgctgagcggcgacgtggggggggtgctttgcctgtggaagatagacaaagaggagaggaccccggttaccgcaccctccttcaccagcgtccacaaaaggaagaagcgtaaagttgtcgagggaatg

SEQ ID NO: 5390 - DNA, 700 bp, Nannochloropsis_gaditana
gagacaaaaaaaaagcggtgacgaatgatatgatttcgagaaagtcgattcctaccgtgaagacaaaaagcgcctttgcgatcattgtgttgcacaatagtgttgtgagtttccacagcacgcaacatgcacctgctctcattcagagccatgtaatgcgctccaccatggccaccttgtctcgacttgtttttcatacgcaaaacagtcattctttgaaagtcccaagccatggtcagacggtcacctacttatcaaacgcatttctgtgggctttacatatatgcctccacaaaatcgtcccagtcaggacagcaatggtgccagggtccgtctcacccaagaggaaaggagaagatctcttcagggccgtccattagcccttcatagcttagtgttcctcgaaaatggaaatggcgtcaaagttctgtactgtcctttctcgaactcgttcgtccgatacgataggccgcacatcattcccaaaagaagacacagtgaaagtgggcgcgaaggggaatggtgcggaaggggggaaacgagggccaagaggaggcaagagaaggccggtgccggagcatgactgaaaggactcaaatttggcgcgaagggcccagccgccgcttcattttatttttatcttcctctcacgccaacctacatcacaattttgacgtcctcggccgtacggcatatgcag

SEQ ID NO: 5391 - DNA, 700 bp, Nannochloropsis_gaditana
caggactacgccatctcccaccttcctctcctggcaaagcttgtcctctttccctacaaccaccaccgcttgcatcacttgctcccggcggtggacgagtcgcgcttgccgctcttggaaggggccttgctggagacctgtcaggaattcggggaaaactacgtcgtctacgcctggagggacctggcgcgagggacgctcaggaattggtttgacgttggaggcaggaagaggagagcgtgggcattggccggggaggggctgaagagagaatgaagggggagggagaacggaggacgggggagctgacgaaatggcggagggggagggaaggagggggagcagaggggagaggtggggctagagatttgaagagaaagacggaaaagagcagggcgatagagcgtaggtcacgtttgacaggccgacgcaggctgtgcaagttttcgaaagaatatgcaccttggcgggccactttgtgtcagcatggacggtccttggcctacgccgagcggtgatacctgctagcgactttgtcgataatagtgtacatagatgatgtagtggaggaccacctcgttgaaaggtcgattcccgcaattgagaagatgagaagaaattgcttcaatccgggcgtaccccgcgaaccccctgccctcgctttctcactactttttcttccccccgcttcccatgaaac

SEQ ID NO: 5392 - DNA, 700 bp, Nannochloropsis_gaditana
ctcagacgaattgaattagatccatcaggcgactgtttgcaggttgttgtgtgcatgctcgtttgtgaggtctttgaccgcagcatccccgaaaagatgaaatatgaggtgtagacatcatttatccgatgttgtgtcaacatacaccacactatttttgaggtctggcttcttcatccagtcttgggatcaaagctactggtgtccgcgaacaatcccctccaaaaatacctgcgccggagtaagctctggagagggtggaggcttgctgtgtgcggacgatgacagggtgcgggtatcgaaaaaagccgtgacaacagcattccggaggccatatatgcttcgacgtgccgctgacgagaaaaggaggcccgcgcaaggtggcgccatgttgcggaacctgcgaaatacacgatcgctagacgaccgatagtttgtgatgtagacctgtggacgcggaaatgcgtgcgagaggcgcatgaaacgtgaccaggagacgctgacgcagggttcgcgtggaaagcgggggttacacgggcagtcacgtgggccgactggcggcgactggaacatgaaaaagcaagaaaaagaccggaaggggtggtattgaaggctgagtggaagcgacgagcattgcccaccgccaatgtcatatgtccttctcagcacttggacttattcatgctcttctcgtcgtaga

SEQ ID NO: 5393 - DNA, 700 bp, Nannochloropsis_gaditana
cttgcgcggccgcccggtcaccaccgccatgcccagggggcatcgacgtgcgatctcggccaaaaggcccgtgggcacgatcagtctctccttcgtccacagaccctcactcgtgcttgtgccctggtacaattcctcgaacttggccgtcacctcttcgaggctcacgtctacctggtgactggccagcaggcgttgcgtcaggacccagtcgttgttggcatcccctttggccttttgcctcgcgatatcatcctgtgtcaccgtcacctggtagaaggcggctgtttccacaatagctgcccggtaggactgcgctacgtccgccaggatcccgtccatgtcgaagagcactgcctggacttcacgcatcttttgcgcacgtggggacttgcggccacggcgtacttcctccttagggaggggaggctagcgaaggcctcgatcggtcggcagcctatggaggaaagttcaagagacggacgaaagcatgcatcatgtaagtaatccacgaatgtgtaatccaagaactctcatgtccgtcgaagagggacacctcggccgatttgaaacgaggaattccttccaccagggcgagcgtcgagcaatgaggcccctcccttcctcttcacttggctacttgaacacctccctttttttgaatagttgctaagtttctcacttcacgtcaaaaaccaca

SEQ ID NO: 5394 - DNA, 700 bp, Nannochloropsis_gaditana
gctccgagtgttcctgcttgaggggaggtggcggggggtggtttgctgggtatccccttttcatgcagtttcagctgctggtgctgctggtgctgctgctgccgctgctgctgctgctttcgtttccctctctgctgctgcacaggccgccgtaatttgttcatctcgtcggtttggccatggctttgaggacgacctgctcgggccatggaggtcaggggaggctaaacaggagcgcccctaagcctgcgcgccagaaacggagatgaaacacagatgcgtgacgtaagttagatcataataatattttaaagccaatacggcatgcggcaggtgttagtttgatggagccacatcaatatcttggtctcgcgcctgccagtaaaaggggcggcgaggggcaggaattgctcgcagggggaaaggatcgagatgggcggagtgtcaacttttatctcgcatttcttgtatggaaatcatcgcgttttacgcccatcgaatatgatcatacgtattaaatacatcaatactctataggtgcaggcttgggggtcgcttggagggcgtgctggtccgattttaggctggtatttgagcacggacagagcctggccaaaggacgcttcaactcccctcctcaaagcaccaggtcccttaacttcccgagagtgtccgggtcatcagccaattgggggtcatg

SEQ ID NO: 5395 - DNA, 700 bp, Nannochloropsis_gaditana
agtacattgttcgcccttgtcatgggatctgagtttgaagctccagcagtgctgctttatcttggatgttcttctttagaggaacgaaatatgggcgggcgaaaccagtgttaatacagacgtcgctgcaccacagtgacctagaaaagatcctgttggtccatgatttatgtttgtttcgggccgataaaaaggaccattgctgtggcgtttcggaaagtccgagtggggcctcattccatcacaagcaggagcattccccgaagctcggaaacgttcacagagccgttacagccatgtagcacctcaagtctcaagcctggaggcatgcacccgaggccacgccggcgctttaccttccacacaaaaacagccgtttgggccaatctgtggcactctcctcttgaagatttctcactgaaggggtacttctcgtttcaactttcttcttcacaaacctctttcatcctcatccggcccatccctgctcaagaccacggcctagggcagatcataaacacatggcgcatgaatttctcctcagtttctatctcattattgcattttgggtcgaaatatgagatattctaatcttatcccgtactatccacccatttaataccacacggcctccaggttctgagtccgatattgaaagcaagtccctcaaagtgttgacttagtcctctaaaccgccatg

SEQ ID NO: 5396 - DNA, 700 bp, Nannochloropsis_gaditana
tgggtctattccacaacatgtgtttacctcgatgggaaacgttttgttacatgcaaaaaagatagcaacgctattacgactgctacgtaaaatcccagtttggaccccacaaaccttttctttgcttgttttcacccacttggccgccgcctggcccggcatgagacatattggcaatgctcctcgaggtcttggttcggtcgccattgaggaccgtgtgtgcggacacaaaatgaagggaaaaacaggcgttcgaagaaaaaggataataaaggagcaccttgcaccagcgtgccataaaaaagttgttgtacccgcccaccgccccattccggctcgaggaactgaggatgtcaggatgtaagaaaaaagtgaggccggaacacactgcgtgcagcgcgtccttatcgactttaatgcccgcgggaaatgcatacgtgaaatgcacaggcaaggcttggaagcttttagagtagccgggtggtctgacagtaaaaagggtggccggctcgtgtgtcacaaggaaaacaacctcctccctccttaacctccccccttgcttggtttctgtgcattgacgcctcactttcaccctcgaacgtctgaattccacgtatacaggctcttgcacgttaaatctcacgttaaacctgggatataggaagcaagcagcatggttttgttcgtcgtaggcctaggt

SEQ ID NO: 5397 - DNA, 700 bp, Nannochloropsis_gaditana
gggcataagtgtccccatggcaggcgaatgtttgagtggcataaacgtgcttgttgaacaatggaaaagcttgcgtactcgctcgtggcgcgcatgcaagagagggaaaggcgatgacctggatgctcttcctttcactccctgccccggtgattgcaggcccggcacagcacgattcgtgcccagtgagatggtttggaacgtgcatgcgcacctcctcaacctcatacgtcgagtacgctcgtatgtgtttggtttatggcgctaagtgacctcgtaaaaagtatcttcgccctgccccgggccacacgagcctcgagcaggaggtcgatgatctacaacagacagtatttgcacttttcatcacccgcccatgatccaacattctgtgaagccacgtaaaaacatgttgtgaggtgttacaaaaccttttgtacaaccactatgcaaaaaaggcgatggtggacatcctttttggaggctcggtttgcgccggcgtttttttggtttcttttctgttctgttgcccgaaaatttggccataaacccacttgcaaccatctccgcgaggaaatctttcgggtatacttttaagtatgagcgtatgttgcacatgtgatgctcaattttacagccatgtacctatcctattgcgagtttaagtcatacccatttttgccctcccacatgcagcatcatg

SEQ ID NO: 5398 - DNA, 700 bp, Nannochloropsis_gaditana
gtggtcacgggctacctgccgccagagttcgaagagccaactccgcgtccgcatgtcttccggataaaagtctcgtgtacctcgcggagggtttaaatctaacttgccctgtctctccttttgcgtctccctgctatcaaaaagggcccaaaaacaattaattgtgggaaacatgatgccctgcgcactctgcgaaggctttcccctgtcctttcttgcgcaattattttcaccatgatttttcattcagtaatctcttcacctgttctttaaatcttgtgcgactgccgcgctaccccggctaccttcagcggcggcgtttgcggttatggaaatgtgttgccttgactttgttgacgtggcaggatgtatgatgaaggatttgcggcgtaacaagggaccaatgcctgagagcatctgcctacttgtcgcaattctaccagaataatgccaggctctacacgtcgtgaccttcattaatacacaaaagactgccaacaacgtggtgaagtcctgagtgcgggtgcttgagccaagcctttttgcaccgatggaacgcatttaaagccttcaaacagcgcgtcacaagaggaagaccgccagatcacactgcgagtcctaatcctatcaaaaagaaatatttgagcgtgagaaagtaattcttttgccccgatagcatcaggacaaagtagggagactc

SEQ ID NO: 5399 - DNA, 700 bp, Nannochloropsis_gaditana
cagaacaagaaggggctgtctgggggggagcggaaacgcctgacgatcgctacggagctcttgctttgcccgcaagcgatctttcttgacgagccaacgacctcgcttgactctgtgatggcggggcacgtggtggcccttctccgtcagctggcgctctcccggcggatcctggtaatggcgacgatccacgccccctcctcccagatcttcagcctcttctcgcacgtcttgctcctgaccaacgacggccgcctcgctttccatgggacgatctcaaatgctctgctttatgccagcagctgtctgaagcggcccttgcccgacgcctacaatcctgccgaccatctggtgcggctggtcgtctcgaagccggggggaggggcctcggcgagggaggagcggaggaaagagaacgactggctcgtccagtcgttcgcggcatcggcttacggggaccctgagctgccagagcgcgggagtcatcgagacaaagcctgtgaggagaacagccatcggagtttgcggggggtccagggacagcacgcctcggcgtggaccctcttccgcctcaacctccggcgcggcctcctgcagacgtccaggaacagcctgagcttctggctgtacgggatggtcatgggcgtgatagggctttgtttcggcaccctctacttccagcaggccgcctccagctggc

SEQ ID NO: 5400 - DNA, 700 bp, Nannochloropsis_gaditana
gtaaagaccgctttgcgcacggaaaaaaagtgaaaaagctttaaactgaatacatgaatacaatagggagtcgtgtaaagtaccacataatagaaagcagaaggagaagacagagaaggtctaggaacgagatgagagcggtggaaggagaaagaggaggaggaggaggaggaggaggaggaggaggaagcggaggaggagggaaggtacagtaatgaagaattgaatatgtgattataggactaaatatagacaaatccttatttattaaatttattccatacgaaaaatcgtatgagcccttctttttgtacatttaacatgaaagtcgctttcatcgtcgtgttggcttcaggggagccagcgatgaaggattgaggcggtaagatttttaccagccacgtccatggattttccgtacaaattcgaccaaatgctcagtaaaacgtttttttatgaggatatgtttatgaataaatgaaaatcgcccctcgaactctggaatgaagcgccttttgcgaggttacggtatacctacgtcaaagaacagccgtgacgacacggcggggtcttggccgagagaatgcgagggtacaggacttgcgggggttctaacggcgcagacgcaagatgcgggcaatagcaaagctacagggtacaaggatgagtgctatattagttttacatgtttgctatcaca

SEQ ID NO: 5401 - DNA, 700 bp, Nannochloropsis_gaditana
aagtacccgtaaagcatgctcgtctccaaagcgcagatggcgtcgaaaataggtgcagggtccccaaggttcacaatcctatgttgtagagtaccttcagctgtccgtaaaacgcttcaggtatgcctatcaaccaatatcagaaagtgtccgatttacattccgagtcaaattgctttatttgggaacgccaagggcaagcgagcaatcaatcaggtagtcgtgctccgcccatcgcgccatcaccatgtttaagatacccggtcctaccccgactcctccccacgacagtgtgtttttaatagaactcctgggctaactagtacttttcacataataacaagaaaaacacagcgctagtgatgggctctttccccagttttacggatgaggacggctcagctccagtgaaagcgcaagattagccttctcagcggccgagttgcacatggcccggcaaagcagaatacgctcccctaaccataccatctccgcgcttacactccgccacgttgccgtccttctgtttcttctaagtagacaaataaatgctttcttgccgggccatgtccttttccgcccgccctccagcttccatattcctgtcgtgtcttctcgtccaagcacccctgtagagacccccgcccaacgtgttcagcatgctctcgcacctgaagacatcctctccaatgctgtgatg

SEQ ID NO: 5402 - DNA, 700 bp, Nannochloropsis_gaditana
gcccggatggcgatgacggtctgggcgtcgtagcaggggagctttcccaggtcctcctgggtcacgtacatgaggcctgtgttctgctcgccctcctgctgcagcagcgcggtcatgctttggatgtggcccttcacgtcgcgctcctcctgtttgagatcctccatctcctgctttaattgccgcatgtcctcggaatgcacgctaccttccccgtggcgactcacactggtgctcagggcagacgcagccgcgcccctccaagcaatgttgttcttactcttcttttcaatcaacccgatgccttccaggacgttcgtgatgtcgtagatgcgtctcttttgcaccgacagcgtcactgcggcctggttgaggtccagggagtccccgcgcgcctgctgtccttggagcagctccacgaatttcttggtcagtagcccgagagagctgtcgtagcggctgctcggagaggcccgtgccttggacacgcttacaggagacgtcatcttgccggcggagctatccattccaccgggagtggcgccagcagaggcggcggacggcaggttcgaggaagctgatggaagggcccccctcctccccccccctcccgaggtagcggttcccgtcgctgctgtgccgttgaccagacccccattactgtgtgcaccgccacgcttcttcgacatgtgcgacgatg

SEQ ID NO: 5403 - DNA, 700 bp, Nannochloropsis_gaditana
ttgtcatggacccctcaggaaccaccagattcggtccccactgtggggcgagacgaggcaaccaagtcgacacggtgaaagcaggcgtacaacaagagaattttgggtgtgctggggctctatacgccccacggtgtttgcaaaaggaacggttcaatggcagcccaaagttcgatcctgcctcgtttcgctcggccacgtcgccgcctctgttgcctcggtggaatgccccgcttgcagatttgatagcacgcctgagccctttctgtggtcgatgaaaccgcgaatggagcctcagtaaaaagaatgatggtatattgcaggtgacctactggttgtgtggtcggtgcgtgcaggaatttccgcggcaggaaatctgtgccttgatggcccctcggggactagatcgtgccttgtggttgatgttgtcgtccttgaggcaagcgcacttccactactagggcaagatttggtcgagcattgaaaccttttcacttctatttgtcgtcttgctatgtgttccagacatgccgtggccctattcttaaccttgcgttgatgtctcacgcaggccttttttcaaaacctggaccttggcaggcagcaaacaaggcgatctttctcttcttcgacgcgtcgaagtttgagcgcgatcccggaggggaaaacgccggagtgcaagaagcaaacttaactaatg

SEQ ID NO: 5404 - DNA, 700 bp, Nannochloropsis_gaditana
cccccctcccttcacactcaagcagcgaccactgcttcttcaatggtcctcttatcttctgctcccctcccttctgctctcccttccagaagaatacaccccaggctttgccatgcctagggtctccttgcttgaggacaacgcgcttcacatcccagtatgttcccggctccccgtgccatatcgagcgggtcaaccgcgctcctacgccatagtgtcgcaaaccattgacgatctggaagaagctttgaccggagggtgccatgcccggcgccgccttccctgtcgcaatgtaaagggagataggcggcagggcatgagggcgctatagtacatgtcccttgaatgcaagacaaataaaatcgtcctgacacttttccacatactttaattgtcaacccattgcaaccatcaattttgacacgataattggtcggtggtatccgttccttggcgcggcacagatgccgaccaggcacattctcatcgctagcaccagcatcatgcacgcaagctccccccccccaatttcgtagacacagcaacaaaaatgctcttgcgcgtaaaaatttgatcaattctaattcgtccatgttcttgacttatcgtaacatcaataggcctcccctggcttgcgcttgctcatttgccaggggtccgtccaatgccaagacccggcagaccttcgaccgctgccttc

SEQ ID NO: 5405 - DNA, 700 bp, Nannochloropsis_gaditana
tcaatttgaattcggatgaaaaaatgatgaagaggaggtcaaagccaaaattgtttgttaaacgtgccgatgcgtcttttaaacaactaggtaaatgagaaaaggttacgagcaaggatgccaaatttgaagcttcatagaatcaccacaaaataagtctcaatataacccattgacatacgggatgcaaaagtcggtttccccatacacttcctcaaaagtaagaattgaacaaattgcttaataggatcagggaaaaaagggggaggttgcgacctggtgcatgtcgtcattcctcgccgaggccgatgaacggctccgcgacgtcccatgcgcctgacctttcatttgctttcactgttggattacgcctccctggtcacgtcatgaatgagtttgcgaatgggtagatgagcccactgcgtaggggaaggcgtagctgatgtatctttgaggtcaagataagggcagtgtggtctgtaagcccctcaaccatccgcacgcaattcctcccgcccccccattattcccgtgccccgttttcttcgtcccgggggagggcattttttgatagtcgaagtaacttcgcgcaggacatgtttatcggccagctttcttgatgtagtttccatacctggttttcatgtccataccacaaactcggttctctgcctggttcccttctctatcagatattatg

SEQ ID NO: 5406 - DNA, 700 bp, Nannochloropsis_gaditana
acgaagagacgaaaattaacttcgtataatttttaatttcaacagtattcaatcaagctcaacacgtttattcttatgtggtcgacaccaaatttaactaccatagcgacaaaaaataatctccgtcattatttatttatttttgtattcggccatcggggcagtacgcctcggggggaggttaagagttgaagtttctcctccttcccccggccgctcgcccccccctcccgacgcgcctcactcttcgttttcttggtccacgagttgacattgaagcgaggccttaaacgggaggaatagaggactgagacttttgtgttgccattcttgcttctacgagtccgcgtgtttggagtggctttgagcgtgggatctccacatagaatgcccaccaaaaaacgtcgtcgctcatcctctgaggagtccatcacgttggcatcgagggcaggcatgaggagagtatcacatttttacagtggttggtactcgcattttatcgatacctaaatgcagttctatctgcgttgcttaaggtgtgaggatgtctgtatgctattgatgtcggggacatagcctttaaaggcatgcaagtcagctcggactttcgtcgtagaaaaatcgttgagaaatagacgcggacccttgctcttaatacctcttaaacctgcaacaatatgtacgaaattaggaaatcatg

SEQ ID NO: 5407 - DNA, 700 bp, Nannochloropsis_gaditana
ccagcgtctgtcgctttactagagcggacggtgctgagagtatcggatccacgcgattccctcctgtacggacgatatttgagcattgcagatctcacggcattgattggcgcggatgtcactcatgtcgaagctgtcatggatctatttctctcttacggcgtcaggcggaagcacatccaggtgaataaaaatcgggacatcatcaccgtcagactcgccgcgcctctggctgaggagatccttcagacaacgctacacaggttccgacacgtgaagagggtcgaagccaccattattcgagcaatttcaccctatagtttaccggaatctatcgctcctttggtgtcgttcgtcagtgagctgctccgttttcctgccattcgtgctttacccttcgtgccctctgcttcccgagagggcgcatttactccggaccgcaccgccttcaatgcctctgctccaccctctgacgcggcttttcaaacgtgtggccaagattgtgcgggttacgtcaccccacaggtgcttgcggaccgctacaaccttcccacctccttggcggaggcccgtgccaacacgaactccatagccctggcagaattccaattccagcactacgaccgaagggatttatatatgtttggaagagcctgtggcgtggaccgggtttccgttgaaaagaaataccaccacaatg

SEQ ID NO: 5408 - DNA, 700 bp, Nannochloropsis_gaditana
ctgtaactgtcgccccctgcgagcgggaggggcgacgctggctacgtgaggatattctggggttgagtccttcgattgagtacaaagtgatggtggttttgcccggacagcgcgctgacaacgtcgagctccttttgaaagctcttcaagagggatctccctccgcagccattgttgggggcatctttgcgcgaaatctcttttgctggaaggacggcgccttgcgaaggccgggaggggagggagggaacgctgaggacggtatcgtgggcatggctctctggggcaacgtgcccctgcaagccgtcgtttcacgaggagttgtgccatgctcgccgtccttcaccgtctccagctgggagtacgagggagaagctgtcgtggtgaagagcctttcacgtccagcgtccggtgacgcgcgcttggactccgcccccgacgtggtggtcaatcccttggtggcctttgagcacgctcagcgcaacggagatatctacgtaggattacaaatcgaggattccgcggtgccagtgaatggtggagtcgatggagggggggcggggcacgactcaggggtaccagggtcggcgtttaagtcccgcccccccccctacgaactgctctcgttcgttttcgcagtggacgagggcgcccctgtcctccttttgtctttcgtgaacaaactgcagggtggaccacc

SEQ ID NO: 5409 - DNA, 700 bp, Nannochloropsis_gaditana
cggtccttgagtgggcaaaattgacaatgaaggcccgctttcgtctcgcaccgcttccattgtcctctcttatccgtaagaaatcgcgcacagcatggttttgggtcactgtccacgatgatgatggcgctcgcgggccatgcaagaaggcgatggcgggatgagccattgatgcagcagtagccaaaagtgttatccatcccccaccgcaggccgcgactctaagtggcctttgtactgtcatcttgttaacgccgttgatgtccttcctgcgcatgcatgtatttgacaagtggatgagcaaggaatgctacaggtgtgttcctatccgtccagcccccacgcaggcttcaacaagccgccttcctctgtacctcgattcccccgagacttcagcctctcccagcgcttcagattcttccaggtgattgcctcgctcccgcgtgccctgcacctgtgcatagtggcaggccacggtcgttacggtttgatagtctaaatgaaagacgcagagaggcttgcttcccccgcccatctcccgcagactccccgccgcttgcctctcgaaatcgcaagagacgacgcgcattttctggcagacattttcctgaccagctcgatgattgtccctcaaaactatcacagaaaatttaagaaatggttagcattttattgctttgcccacacataatgcctaatg

SEQ ID NO: 5410 - DNA, 700 bp, Nannochloropsis_gaditana
acgatccctgccagggacaaggctttcaacaattcaacccgtggcctacgtttactgcgcgctgtgctggcaagtgcggaagacgccgcacgtgggaacaatgctgaagccgttttgtgtaacaatcggattagattagatagcataaagagttagaacgtcctggaaaaggggcccgactcggggaagaagtacctttgtccaaagtgcttgattgtgcatacatgaaaaaaagccattgaaaatttcggcaaattgcaggaaaaaggaagccttacgtaacattattagtgtctcgaattgttaatcatgctttttctttctcccctcttcttcgttgtggagtcgtaccttggatggaagcagcgcgtccccgttgactgaaaacgaacagcagtagctcgtgtagctccttgattgtagtgcaacgtgtctgcagaaaattcttgcggacttcgaacagcaaggcatcaaaccacatagtgtagcgaccaacccccttgtccggtcacaatgtgaccaaatttccatctttctttcaccaccgatcctccctgcggcgacgtctccctcccagcgaggcagtgacctggcactgcccctgaagatctgcccctttttcgtgacacagccgccaccccgttccccttgcattacaccacattggcaggaaaaggcttgacaaggatctgcagccatg

SEQ ID NO: 5411 - DNA, 700 bp, Nannochloropsis_gaditana
tacgtcggcgtggtaatgtgcatgagccaaaaatgctgccggggaataaacatcggaatcagctacagtccataagtagaggcagttgatgtatgtaatggataatcttgtcttgcacaaagtatcacgaacctcaaagtgaattcaaggtaataggaaagacaagaaatgacgtatctaactgtgaggtagggagcgagagggagaggtgggcgttccaattctcaaaagattaatgtgtactatataagctgacaaaagaatatataaaacatgaatctcgctttccgttctcatttttcgcttttcgcccgcacatacacaaactatttacactgtcgtacacaacccagcaaggattacacctcctcttgaaatctctggtaatcaacaaaagcaaaatgcccagtcatcttaaatgaagaagtcaaatcaagttgcaccgctttgataaaagcactgcaaatacatcagtcacgcgcagcaaacgaccaaaaatggaaagctccttggcccatgcacggttccacgctgacgcctcggagtcgaccctgtgggatgcaatacgatagcgccgacggtcatctcattcgctcacttggaaacctcacaatcctccatacaatgaacaagtctacctgcgtttccagcggtctttttgacaggaatgcctccgacacggaaagaagaagtggaaatg

SEQ ID NO: 5412 - DNA, 700 bp, Nannochloropsis_gaditana
tttcacgccgcctgcggcaatctcgccgtccatggcgccactggcgacgtccgttgggagcatctccacgcactttcctgccgccaaatttgtgagaaatgctgtcgggcagcttgccgcggggggatacgtgccatgtggggtcccttacaagatgttaagggccctttcatgcatcgcttaaggttgtagtgatctgttttcctttgttgctatcccgggtggcgagatcgggtcgctcgggtactccggcgtcacgcttgcagacgtttgtcgaaatctctctcttccagaacctcgaagctttatcattcggttggacttatcatccactcatatcttgatcatgtcgcatgcatgatctgtcggaataatcattggaatatgctgttttgtgttgtcaaagctgcaggttgtccaaagaaggatgcgacatgggccactttgcttgacattcaacccaaacaaagcgggcatgcaatatgtcgtcacacaccccgcgaacaagcatggtgctcgggatgagacccaatatccttcttttccacaacatggtcaagcgatacttgcaaggcatgcacctctcagacgccatcacggaaatatatgttctagagcagcgaagactaactatgcacccctcttgacggtacatgctcaggtccaagggcaagatctacgcgtttagtacttacgcatg

SEQ ID NO: 5413 - DNA, 700 bp, Nannochloropsis_gaditana
gggtggctgaagccgaacgtaagcgcagacttcctggctggcgggcgacggaagactcgagggcggacgccggaggcaatgcatgttcacctgctcgcggaagaattcgtgcccacttgggcaaatatagggcggggagtccactgtcaagcaagcagctgaaactgtaatgcatgtgatcgatatgagacgatcaccctttcacattgttctgcgtgtcatttttagggctttggtcagggctgatatagccgtggggtcagagttgcccgattgccctttgtcgcgcgttctagcctcattttggcaggctatatgtgcatcccattcgttcgaaggcctaagagaacactctgcgcctctcgaagagactattaatcgctcgtaggactgtcaaatcttggcacgtgctcttttagccttggtagagcaggtccgctcttcggaactatttcatgaaaattgcgaggactgagcatcatcctgctttctcgttcaaaaccctgtctggaagggccgcacgaagtcgttcaaaagctattctctcacaagtatcctcccacactctcggagacaggaccctccccgccctgcttaggaagaccccggaacgcggcctaccctgccccgtcccccaccttctttcacgccctcggtcgtcttggacgctgtgtcatcacgagctgggtgtgcaaagatg

SEQ ID NO: 5414 - DNA, 700 bp, Nannochloropsis_gaditana
ttgtcacatggatgctggattccaagggatttgagggccttgatgaggaagcttccgtggaggtttccatcaacgcgctgccattttcatcatctatcttagccgaaacggagacaagacgtcgtcttcgagcacttgtggcggaaataaatgtcgatgcaccgattgccttcgccgccctcgtggcaatggggggcattttcctgttattcattttcccacaggaggttgttaccagtgtcacatggagaaggaggagagctgacaggaaaaaatgcaaaacggcccccgttccagtagggtagacggtcctcgttgtcgagtactgcagcacacagtccctgttgtaatttaaatatatattggaagggtgtggacaggtgagggagcataacatctaggtcgaaatgcgcccgggagggaggcagatacatgacttgctgaagcggcggctgggaaacaaccctttatctgtggcccacaaatctacaacttccctgtcccttcgctcacaaacgcttcacttttgaaattttatacctttctacagccaggaagctgtcgactggcatatgttgggcggtgcctgatggagcacggcagatacaattcacggtctctgctttgccggttgatgccctgtccccgccaccttgcatatcgaccaattcctggcaccgctttggcattggccgttatg

SEQ ID NO: 5415 - DNA, 700 bp, Nannochloropsis_gaditana
cacgtgaccgaccatttcacacggtctcgtgatgctttgatgctggaggatgcgtcccgggaacataaaaggcagggcaggccggggcaggaccatcactgcgaaccccgcgatcaggagcactgcacgctcccaggacggccgggggagggaccttaccatcagtcggcgtttgccacctataaatgtatgacgataaacgtagagtaggatatttttattgatggaaagcgccgtggtagcagtaaggattggaacttttgatggtactcggttagccaatgcgaatctgcgcccgacatgtgcagaatggctgaggaacggaaacatacatctgaagaagactgtctccgctacagttattgctcacataagagcacgcacgatgcgtgggtgccaaaaaccaaggagagagcggctagctttgtgtccggcgggaggttaccttcgccgcctgcaatgcggcctcgccaggcccgatgggtacccgccgtgccaccacatttcatttccgctacgcccttacactcccactgtgtgtgcttcttccaggtgaaaaggtttttcgagatcactttgtacccggcagggtgtttcgagcattctttgtgaactgggagccatattgatccatttttcttcacatttgtactgccacataggcacacgacacacggcatactgaattcttattgccatg

SEQ ID NO: 5416 - DNA, 700 bp, Nannochloropsis_gaditana
acaacgacggcattttttcccgaagcgggaatgtctcaatgcttcgtgcgcactaaatgtgttgcctcgatgccttggccgtggtgcgtcagaacgggatgtcaaaagtatcctcgagccgaacgagtgcgtgagcagctgcagcacccatcgggagggacaacagcaaaattgacagctcttgtgaagtgcaagcacgcgtgcgagccttacattgacacgacgaccataccaggccctcgctttgatcatatatcaacgcgagggaagcctggatgtcgctaatgcccactgcgtgttcgtgttgtgcgcgcatttggtggggcaggggacccaggcagaaggaatggcccaccatgcaatgtgggccactgtctggtgcaggcggccttctgaagccgctgggattgcctcattcacgatttactgccactgttaccacgtactgtcaacgtttactacacacagcattgatgtcagcctagcaatgttttgaattgcccaaatttggttcgaaactgaccctgctctccctgcccttgcaattccacagcatcaggctgcaacagccccccccgaaaaggccataacgtttgtttgaagggcacatctacgtgaacatcagaccagtaaaaggtacatttaaactggaagtattttcagtcgattcgtgacacggagtctacaagcaacaaaaatg

SEQ ID NO: 5417 - DNA, 700 bp, Nannochloropsis_gaditana
aagtgaagtatgtttagacttgcgtgcgcaggacgcgaaaattaaagctgaaatcaaaatcgtacaagtaagtaggggtagtgctggtaagacatgctttcatgtcattttttgtttgaagaaaggcttttaccatgttaaattgctgtaaaccttgaatcgctcatagattttttcttcccgtcaggcaaagaagagtcgcttggaggacctggtagccaaattgcaggaggaggacgcaaaactcaactatcaaatttcaaatgctttgcaagagcatcagttataatgttttaaagtgggatcggttcccccccgccaaaaataaaaataaaacaaaccttagattaatcacaatctcaggccgcatcccttcgcgtttgaatttccgttttttctccaaaccgttacggatccctcgcaagtttgcaagcaagagctttccatatggaaagtgttcttaggggtagtcaaacttattgtaaatggtaatcatatcattcatgaattgtaaacgagagtaccggtacagctttaatgttgttgcgatgagatttcacgtgggaagacagctacgcagcgatcttattttcttcccgcctcggtctaaaccttcccgccccgttgcaggccataattcgaatcacctgaatttgaaagctaccacctggtgttgtaaggatcacaaaacaccaatatg

SEQ ID NO: 5418 - DNA, 700 bp, Nannochloropsis_gaditana
ctacgagaaaagggaaagtttgcgagcacaaagggacaacctggccactcaggtaagatccgagcttgcagctgtagacaaaataacttcagagaagaaggtaaaagaacaagcccgagagacacagatggccatttacaaagagcaatgggaagagctggataaggcatttgaaggaatgaatgccgaaatgaaagacttggattgcaagcttcaagcagacgagaaacgaatcgctctgtctcgcgagcatctagcgcaaagcaactctaaaatcagtcacatgatgcgtgaggggaacgaaatggaaagcgaatttgataaaaggtcaggcagtgacgtgaacatggagacatctagagaaggcagcaaagaaaccaacaaaaacgtactaacagaaggagatctggcaagattacaaaagaaagtgaaggtaagaaaggtgttcgaggatcgttggcatgttggagtagacggaacccgaatcaatagtctcacacatgaaatgaaagatttaaagaaaaaaatgcaatccactcatacgctttggtaagcgagggctccacaagactgggcaggatcaaaataatcgtatcatacacaaataatccaccaaatacatattttaatcgtatctacagatgctcgaaaaggatcgaaaacgctttgaggctatcaaggatcgccaaagtgaagtatg

SEQ ID NO: 5419 - DNA, 700 bp, Nannochloropsis_gaditana
tagatacaccaaccgatagccagtagccatactcaaaaggccggtcagaatgtagtgcagacttaaattgtgcccactgacacggtgcaccagaggaggggtgtgtatgaggttgatgtgaaggcaaggaaccagctggggccccactcgtgcgcattttgacgtagcatgtacaacagcgaagtgaaaatgaacctgttgatggttgaagggttaaactatgtggtacaaagacagaagacgtgcaggaacgataaatcagatgaacgcgccctcggtcgggttaccgttgctagaccaatttccctccttgatgtttctccgccctctccgaatagctcagattttctccttgatgtttctcaccctcacgagaaggcctgcggccaggcagcgcttgaccatccgatggctctcagcgaggtcttccgcaccgagtgttagaaatgacgagtaccttctgtgcgaagtttttcacgaccgttgtgtcggatttctgatttgtaatgatagataaccaattgcttcgtatttaatattggcgtgaggatgtttggtttcccagtgttgttgattggtggttaggctgcaagaaggaagacatgaagaaactcttgatcaccacacatcagaattatgcctgaccgcagaagcacgatctttctccttcctacgttacagcatcctttgcacaaccatg

SEQ ID NO: 5420 - DNA, 700 bp, Nannochloropsis_gaditana
tcggacgtcgacacaccttcctttaaagcctctatcggcacagttacttatcttccagataaggatgccatagtctggggcattaagcaatttcatggtcaacgtgagtatctaatgcgcgcccacttcggtctaccctcaattgcagctgagggatcatcagcgaacgccacggagaagtgctggaagaagcctgtgcaaatcaaatttgagatcccatacttcaccgtctcgggcattcaagtccggtacctcaagatcatagaaaaaagcggctttgctgctttgccctgggttcgatacataacgtgtgcaggcgacgtataccttcgcatgggaacctaacggaggaagtcaaagcgttgacaactgaagggtaaatggtaactttgtactagagctccagcgactcggcccaaaaaaatgtacaccaaagtccagattgtcaagattttttgtgagcacattattttcatgcgtcttgtcacttgtttcgacggatactttttacgtgcgatgatatccatcgcagcgggccttgtaagagacgcccttgcggcttctgcgggacggccgttaccgtccagccgttaacgaagggagtctagacgtgcctatgcctggtcgtgcgcgaggacttgcaccctcttgtggtgtccacgcttcaatcccttgcacttacatgaatctaaatacaaat

SEQ ID NO: 5421 - DNA, 700 bp, Nannochloropsis_gaditana
aagcactcacgtggaggaaatccacctgagagtgtacattttgctgtgcttaagtggtgcacaattttgttgcaattgtcgcgacgcgatgaatgaatcaatcaaagcactttcagagcgttccgtctcgagttgcgctttggactcctctttctttgaaaacactgcgtggtgcccgtttcctccgcattacagattacacataagcttaggggtagaatgttttcagtgattgtgcatgcagtgcattttaaatggaagatgcagtcatgactgagtcgaatgggatgctggtgatcagtcttgcctggggcggtacgtcacgtttagtgatgccgcgttcgctgtgcttttggcgctggttgcatgtccagtcccatagcaagtcgatcgaaaccatgtacgtgccggtactccgcaccttagggagcgaacatgcgaagacctgatggctgcatcgacgtcactttgatgtgggggataagtttcgtggcgatgtaaaggagggagaggctaggggaggaattagctctgagagcgcttgcgataaaattccttagcagactgcaagagcgtgcctccgggaaagtaatttgcgcgactatccggattcatcttatcatgcgtacaaatgcacattgataattccatgtacaaataacaaggcgaggaaggtgtggcctctgcggcggcaaaaatg

SEQ ID NO: 5422 - DNA, 700 bp, Nannochloropsis_gaditana
ccaaggccggcatggacccgtccagaaagctctggacctcgtctggccatccttcacacttgttggccggtgcggggccttttgtcgaatcgttgactctacttacagatgtaatataatgcatgtacagaatagttgtgcgtgtattaccttttgaaccgctgcgagtcgagacgtctagttgaacttatgcttccgactatcgctgcaggcagtttccatcagactgctctcgccattttccgctgttctttctgttactctcttaagatgcctccataaggcttttcatacatgataaatgaccatgcaagagcaaagagaattgacgccgaggtgaaaaggagggaggcactccctccccatcactcagggagacgggaggaggttgaggtgacgagatgatgggatgatgtgatgaaagacgaccccgttcctgccccgcgcctccgacttccgcgtcatgcatgggtcttggattttggtcttgcggcctcgatgtgcaagtatggcctgtgagacggttgccttcccaatttaagcttcttatatgcttgactcattattatataaacagctgtaatctgatgtgatcttctacacttatagattcctccctaggttggcagcccgggcgcacgacgcccgtcatccgtcgcatcgccctgctactccgtttgctatcttcagggcaatcatg

SEQ ID NO: 5423 - DNA, 700 bp, Nannochloropsis_gaditana
aagctagaagaggaccatcgcgtataagaatgtggcgtgcataagggcgcgtccatttctctccgggaggctgtgtcttttccttcacttctccagcgcatgaacacctgacgaggatgcctgttcattggtccgttcctcccctcattcccaatggttcctgtacactttcctcgacacaccccgtccctctggtacggcaggccttttacgttattgccgctttctacctccccgacgactacctagcgctggtcatggccacatacacggccctagtgctaatatcagtcttttgctgggcttacatatctctcaccgaccccagtaagccgggagggatcccctgcccgtgcatggcttacacacaagcgcactcccggtactgtgcttcctgccgaaaatcggttcccggactcgaccaccactgcctatggcttaacacctgcatcggtgcacggtacgcctgcattgagggcagaggaaagcgccggggatgcatgtgggtgagcggggactgggtgcttcgttcgcctttctaatctacacttttcgacccgcctcccccttccgccacaggaactactttttcttcttcctcctctctttggccggcaccctccagtttgcgctccagagcctgatcagcatccttctcctcacccactggctcaacaccaccgaagaagtacccgccatg

SEQ ID NO: 5424 - DNA, 700 bp, Nannochloropsis_gaditana
ggaacagtatcatatgccttctccctatcaaccacctcgctgggcgcctcctcgcaagcacggcctgcaaacccctttttccagagatcagctgggcgcaatgattttatatcccctcctcacaacggtacgcgtgcacattaggatggggtagtcaaaaggaacaaatagagacgaaagaatatgaagtagcaaaaagaggtgtggagatagggctatcaagggatattccgtgtgtgtcaacaagcctctggaccaagtttgaagctagaagaggaccatcgcgtataagaatgtggcgtgcataagggcgcgtccatttctctccgggaggctgtgtcttttccttcacttctccagcgcatgaacacctgacgaggatgcctgttcattggtccgttcctcccctcattcccaatggttcctgtacactttcctcgacacaccccgtccctctggtacggcaggccttttacgttattgccgctttctacctccccgacgactacctagcgctggtcatggccacatacacggccctagtgctaatatcagtcttttgctgggcttacatatctctcaccgaccccagtaagccgggagggatcccctgcccgtgcatggcttacacacaagcgcactcccggtactgtgcttcctgccgaaaatcggttcccggactcgaccaccactgcctatg

SEQ ID NO: 5425 - DNA, 700 bp, Nannochloropsis_gaditana
gcatacgatagcacggtcagcatcgctagccataataggatgacttaaaaagctatggagtcaacaatcaataatggtacaggttcatgtgactgtttcctgttgcattctagagactgcgggatggagactttctttgacctgtccccgaaaaaaaggaagaggactgtaagatcttgtgagttactgcccacgtcgataatcctcctcgcagatgcatttttttactttctaatcactccagggcctgcacttgtgcatgcatttaaaaggaattgaaaggagtgaaaataagcgatagcggtgactgccgcgaagcaaaggcggacgatttacccaaaattcgtgaccctgttctcggaacccccaccaccctctttcatgagggcaaccgtcaccatgcatataacgtatacaggtaccaacagcacggacgaggcataatttgaactgtggaggcgtcagaaagggcttgactttcattgtgtcgcaactccgccccgtgactgcctccccccaaaagcttccgtgacctcatatcgccgtctcttcacaacctttttaaactcatacgagtaccttacgattgcacaccacggaacagtatcatatgccttctccctatcaaccacctcgctgggcgcctcctcgcaagcacggcctgcaaacccctttttccagagatcagctgggcgcaatg

SEQ ID NO: 5426 - DNA, 700 bp, Nannochloropsis_gaditana
tgaacatgcggcgcatttgttccccttcaaactcctctttccgtctttccagaagcaattacacaattcgatacaatggttcctttatgacgactacaagaccttcaataacctcaagtggtatcacacgttggattcgaggaagtccccatactaccttccacaaggatatgattcaatcattacggtaggcaacgaaacgctgttacaatatggccattagtgggaaaagtgggcgtgtcgactcatggacgccggagcccaagggcagtaggtgccaaaaagacagctcttacggcgtctactttgcgtgcaaaaagatacgctctcgcaagctcattccagtacaggaatgaaatgccgcatcaattacagtgcaaccgaacagtacaagacatgatttgtgggtgcgccagtggggaggcctgtgggccgacacgtacttatcgccaactcacttgttgtttgaaatcccgtgctccccctccctgcacccatggccccgctctcctcgcccctaaaattcacaccacccacgcaataaatgtagcacggaattccattcgcaccccacaatcttgtatctgtttcgtacgtcattggcggtagcccctaggtattcgctcgccatttatttcgtgaaaaaggctctcgcgcggtccccgacgacctcttcgtcatcagccacctttccaccatg

SEQ ID NO: 5427 - DNA, 700 bp, Nannochloropsis_gaditana
aataaagcgatgctagtttccctgctgatctttgcactaatactgcgagaaatttgtatttcgtacagtctcgcgcatttgaggtctaggttaaaggaaaatcttacctctaacgtcatttgtggcccattccctgtgattgaatcatcaatctttccctcaggtttgcgcggactgccctgctcccaaccctcagtgggcgagcgtctcgtatggctccttcatttgcctagactgctcggggcaacatcgtgctctgggagtgcatctctctttcgtccgttcgatcaccatggacagttggactgacaaacagataaagcttatggaaaaggggggaaacgaccaggtcataagtttcttccagcagcggggaattgctaaaagtgttccgatccagcagaaatataagacggctgaagcggaattgtatcgagagcggataaaggcggtggtagaaggaagagagccgccgaccgagctgcctgctggcgcgcgagctctttcagccagtggcttgggacaagggcccgctactagcagcggagggggtcagggagtgtcagcattggagccgttgccaggcgagactcaagatcagtacgtggcgcgtcagcgacaattgaacgatgaggcgcgacacagaatgcaagcgaaattcggacccggtggattccaaggagggggggggggtcgaatg

SEQ ID NO: 5428 - DNA, 700 bp, Nannochloropsis_gaditana
tccttggtccttgttgcttcggattgtgatcatccgcagcaccttttcatggactgagaagatacgtgtgggtttcccacaaatattttctttgaaagacctgatcattattcatgatgcccagtcagaggtggaaatcctaaatgactgtagggaaggtgccgaggtccgttccatgtcatggaggtgggaaaattggtgcttccctatgaagcgagtcatccgtgcacaccaagttttgtgtcgccgaccatatgcatgcatttttccgtatatgcgcgcaggctccgtgcacgtaagctagtttactggccaccccccgggtgcacgggcttggacctgagctggacgttgaggaacgttacgggacagcgacgtcttccaactgacaagaaacgtccgccgtgacggggccaagtgatgggtactgtacgcatggcatttccgcgtctcttaagtgtacgtgaagtgaacgctgtgtaagaatagatgcattcagcaggtatcctacgatgatgcaaaagcaagtaagagacctcgtgggggcgcattataccccttgatcacaccatgcccctgacgggcccccctcttggcttcctgaaaatacttgttgagtgcttcacctctgtgctcacatcatacgaatcacactctctaaatagcaaggctattctaccaatcacattgctgtacgatg

SEQ ID NO: 5429 - DNA, 700 bp, Nannochloropsis_gaditana
ttgagcagtctcccaacctcactgctatggctttaagtaaagatactggcacaagtgtggaaactgacaggaggcgcatgctgaagcccatgaacgacgtttttgacaaaacatcccctactcttgcgtgcgatgatgatgacaacgcttgtgtcatttattcccccgagcgaaatctggaagaagacaccgacgaacttggttctccggtagtatccccgcccctttccccgtcatctcgaggcatccagcagaccgctgcaataggtagacagggaaagagaaaagattcctatgaaaaaggcccttctgccttttccctcgctcctgttgcagcttgcaataccgtttcgggctttcctgccccgaccgccttgcccgcctcctcgctcgcttcctctgtgcctcgagatccccgtaagcttgcgagggagaagatcgcgcatcggactacggctgttaaaaaagttgatttcctcttgccaaatgaagaagactcaggcgatcatggcaaacgcactacttacatgcgcagccatgtacttgaagccataagggcaacgtccagacagacctcttatagtaaatcatgccagcactgtcaaagtcagctatctacgcttcggtgtgggaagtgtggtaggtgcgagcattgctcttcgatcatcttttgcaagggtgccgagaggcgaagccgtct

SEQ ID NO: 5430 - DNA, 700 bp, Nannochloropsis_gaditana
tcattggcatatgggtgccgacctctcaactttcggtatccatgtactgtgatggtgaaacgggtttgtattttttaagcatggcctgataatcgacgccttgtggtacataatcttggtttttgcacgctctaagcataaatttttttttggttagggtgcctgtcaaacaaagaaagctcatgtcaaaatcaacacttgcgaacacggtatttgccactaggactggggggtctatgagatacccgaatgcgtccatgtatcgtcctcgttttcgacgcatcggcacagggtaacgagaatggaaaaatgcatttaccacatgcagatttccaaacggcgaaggaacgttcctctggcgtgtccgcacgtcgaacccgacgtgcacgcacggcatggggtttacgtgcccggaggcggggtctgtcggggctggcgagactcggggcgagaaacatcacgtgaggggcccgccctgggtactgccgcggccgccctccccacgggcgtggtggccagtgcatcgtttcacaacgttttctgtcaagcttcacacggtccttggtcatacggtcctacagattgcggacaaggggtgtaggtggtacggaagtttgaactggattcagtgggaacaaagcattgaggtaagtcaattgccaactcgcccttaaaacaaggaagtaaaaaatatatcatg

SEQ ID NO: 5431 - DNA, 700 bp, Nannochloropsis_gaditana
aataagcatatgcttgtaatacacttgctcgaccgcaatctcttagagatgagatttctcatggcaatcgtcattggcatatgggtgccgacctctcaactttcggtatccatgtactgtgatggtgaaacgggtttgtattttttaagcatggcctgataatcgacgccttgtggtacataatcttggtttttgcacgctctaagcataaatttttttttggttagggtgcctgtcaaacaaagaaagctcatgtcaaaatcaacacttgcgaacacggtatttgccactaggactggggggtctatgagatacccgaatgcgtccatgtatcgtcctcgttttcgacgcatcggcacagggtaacgagaatggaaaaatgcatttaccacatgcagatttccaaacggcgaaggaacgttcctctggcgtgtccgcacgtcgaacccgacgtgcacgcacggcatggggtttacgtgcccggaggcggggtctgtcggggctggcgagactcggggcgagaaacatcacgtgaggggcccgccctgggtactgccgcggccgccctccccacgggcgtggtggccagtgcatcgtttcacaacgttttctgtcaagcttcacacggtccttggtcatacggtcctacagattgcggacaaggggtgtaggtggtacggaagtttgaactggattcagt

SEQ ID NO: 5432 - DNA, 700 bp, Nannochloropsis_gaditana
gaggactgcgaccgcacgcttccgcctgtcggaattgtcccacgcagattttaccacgttctaggtcgctttaaattcaatcacagacacccgtggcaacatgccaccagattgtgggatcctacttctttaagcatacacttttttcggccacttttcttgtacgctcctaaccccccagccggctgcaacaaagaagctgtcgatcacaccagctcgccatgagtctgcatcccgatacctttagcctacttctgggagttaatgagtgcaaaaaatcccagctggaagcgaaaaaatggaggctgtggggatactattagggccagacgagcttctgccgggggaagcgagcgaaggaatccgaagagcgaacgaagttaaaaatctcggacccgaacattcaatcgagcctcccctgtcagtacgctatttccgcgtcccaatctccctcctcttgtcctcattgccctcgatgacatttttaaagttcggatgacatactgagaaaccacgactgcccaatcattacatcccccttccactgaccataggccctgcagcggtacccctcgctcgttcaatctgaagttttttctttgtgaccaggcatctctcatgaacgtcgaggccagccccacaaaaaaatacaaagttgcaactgcataaatcggtgattcgtactttatttgcatctatg

SEQ ID NO: 5433 - DNA, 700 bp, Nannochloropsis_gaditana
caacgaggagcacgaggaagggccgtcgaagccagtggcaagcatagaattcatcattaaaagatttgaagagtacctgcaagaacttcacatggaatttgacaaggtagtggttggcgataacccagtgatcgcggcggaagaggtttgggaaacctttgtgtccctgacgcagaagcacgtgctgccccttgacaaggagtactcgccccccaggcttgacccctctggcgataccacattcatatccatggccacctaccgcgacgaaaactgtcccaatactctaacggaagctttcaaacatgcagacaagcctgagggactgcacgtgggtctggtggagcagaattgctactcgaattgccgaacgggcgttcagaaagatctcagcatcggtctcgcccctcccgacgtagattgcgtgaaaactttctgcgaaggagagatgggtcaatattgcaatcacttgagaatcttgcgaatcaatgaaagcgagtctttgggccccgcgatggcgaggtactttgcctccaagctctggaacggggaatcgtattttatgcaaatcgacgcccacatgttcttcgcggagaagtgggatatggagcttaaaaagatgatgacactagcggaacggccgaatcctgtcataaccaactatcccccgccccaaggaggacactggcagcggtccatc

SEQ ID NO: 5434 - DNA, 700 bp, Nannochloropsis_gaditana
attggttgccttcgtttcggatgttttgttcattgcgagcaagacgggaataagcggctcggagcgctcgctccagcgtttccgcgagttccgcctcgagcaggcccatgccccccgaacttgtttctgtgacctcttgaacgccttcacgcgcgtggaaagccgctccagacgcacgaagtgccacattccaaaccttcatataccacaattcaggatttttcccggtgactggccgtttggtcttgcagaaaaatagctgcattgatgcaacctaactcaaaatcgtgccttctagtcacgtctagttcctttccccatttaaaacacggtagtacgaccacagatcacgttggatactatgggaagcgataacaatggaaagcgggctagaagcaagtggcttctaccagcaacggcgctggtcattctcttgggtagcttgctttttttcgtgtccgagtcgcctgaccatgtgcgcggactcgagggagaggcagtggggcgagactacagtgccagatcttttacgaagaaggcgctagaatttgcctcagacgaagccggcaaacttgcccacaacgtcctacccgaaggaatcttgcgcatgggaaatgccaacgaggagcacgaggaagggccgtcgaagccagtggcaagcatagaattcatcattaaaagatttgaagagtacctgcaa

SEQ ID NO: 5435 - DNA, 700 bp, Nannochloropsis_gaditana
aggatcaaagtgggagtggcttaaaggggtcaactcggcaagcacatgtccaccaatttaaagaaatataaaacacaagcatgcagtatcttcaataaatctcggagtgaaaatatgagtaaataatatgaagcaacgaagcaagtcgttgacgaatgggggagtggaaagtattccaatgtcgctcctcatcctgcacaacatatggaggcggagaaaagtccttcctccggatgcttcagtagattatcacatcatataattcgaatttatacgcgcgagacgaggcactcttttcatttcattcctgtcctcgtttctccctctccctaatccttcatcattttcccatgagagcaggcatattgaacccttttcaattttctttgatgtaagaatgtatttgatcacgtttcctcctttcatccgtagaccgacaaaaacatcttattcaagctgtcgacggaaaacgagggaggaggttaattgttccgccgcaggcagcgacccgcccgcctctcgcccgatcacatcgtagtctccagtaatgaaatgcaccacggaatcccacgcccagcgtgggttgatgcttttgcgacgtgttattgtgcaaatcctgcgttttcacatgaagatcgatcgttttcattccaagtacatccctttgaaggcttaaagtgcatgcacgtctgtagaaatg

SEQ ID NO: 5436 - DNA, 700 bp, Nannochloropsis_gaditana
gttaattccctaaaaacaaggctgaagttcagcaagccagtcatgaccacatcgccacgcgacattgccaaccaggctaggtctccgtgtcagcctcaaatttactacccttgtacacttccacccgatacgcttccatgctgtcacaaatcagccctgtcgtctgtttgtcctgcctgttgttcctgaatggaacgagctcgtttcgttgttcttttaacacacgtccaacgcccgacaagtaccccaatgcttcaattcaccattttccaatgaagcacgctgtgtctcatacatgtaacacaagccagcttgtccaagcgattaacgttcgcttcatgacaatttgtggtttagttaggccgatttcagcaggcgcctgatcgccccagacggacatctcggccctgtcgctcgtgggactggctgggagcacccgaggaaattatataccgcgtcacttttgaaggaagtggaagaagactacgaacgctttgcatgcgcatccgtgtacacatttacgcgtgtaagcggtgtccgtttctcgtttgttgtttgcttatagttcgacggcggccaagttgccctcctcgtccatctcttcaacccgcttcctgcgcactaacctgcttatctcccctcttactccctcccttcttcctcctttctactttttgatgcacgaccgcaggaaagaatg

SEQ ID NO: 5437 - DNA, 700 bp, Nannochloropsis_gaditana
aagataccatgcacatagaccttctggtaagtaaagagccagatatatgaacggatttcggttcccgaatgcaactaaacggtaaacgacaaggcgtgttgggtttgatcgttcgcggctcttcgcgtgccattcatcatatttcttgaagttaaagtgatgcagtattttttatgacctaaaggaatacagcagttttcatgagttcctgttttaaaatcacaaaaccacaaaatcgcaaaatcaccaaaaaatggtgcaactgttattataaatgtatcacccagctttatcaaacctcgggcacaataccagaaccctacgcagtaagaaaaaaggtccatctactttccacgaggctgcatacgctggaagtctttttctaacagggctagaagcggactgtgttctctttctcgaagaatccttcaggatgcataaagcatcccattcatatacgatgttatcacgtagagaagaaaaatgtaataattcaggggtgtacggccatcaccaagggaaaggaacatagaaaatatgcggcgcagattccaagaacaaagccagcagcagctgcatgggccaggccgctcgcttgaaaagacggcttcgctgcgtcccgcccctcctcgtgcgacccccccgttgatgccttcccacattaaatgataatgtttttcaacataacaggtgaaggatg

SEQ ID NO: 5438 - DNA, 700 bp, Nannochloropsis_gaditana
gaagaggaggaggactcggacctgtacttcatgttgggcgggatcgatgcactgctggcagcgcaacgcgaggggatggatggcgcggctggggctcgaaaaggtaacgtgaagaagaccgcgctaacgaagagcatgggagatactgtaaagcgtaagaaccaggtgcttcgacttcagcaaaaagttgtatttgaaagcgacgcacaaatgacgtcgcaactgttgttccaccccttcgagccgcttttgattgcctcggacgaccacgccaacctccgggtatggaatcacgaggacgggaagaagctgggcgtgttcaggaacgagccgattcctagcaaggcatcgaggatcacaagcctggcttggttgaacgaggcaacctcctccctcttgctcaccgggacggatgagggggtcgtccgcgtgtggagcggggtggtcccgacgggggcggactgggttcccccccgtctggcgacagcctttttcgcccacgcactcgtggggcgtggcttcggcgttgtcacaaaatgggtccacggtgcaggcctcctcctgacggggggaagctcagaccggcttcgggcctgggacttggagagggagcagatggtcagggagtgggagacgggtggggaggcttgtgtgacatgcctggctgccagcacgcctcacggaggggcgggcgggcggg

SEQ ID NO: 5439 - DNA, 700 bp, Nannochloropsis_gaditana
tatattggcccatggtccttccatggtcccgtggcccaacagcgagtgaaaggctacccggaggctaaaaccgcgcgccccgcggccacgggtcacggtcctaacgaaagtgaccacgggcaatgcctgccgacgtcataaatggcatgggtatttcttggagagtaatgccatgcattgtggtgccgggcctcatttgctctttggcgtggtcctgcgcaagtccaatctgagctgcttccctgcctactggttgtcgtggtgacgaaaagtgctgcgtcttccgtctgttcgtgactctctggggtcataacaacttgtgctttcctattggcacatttctcaaatcaatggaacaccatggatgcgtgcttcaattcttttctccttactctcaacatgactcacggtcgttcccccccggtatacggacagggagaacgcaaagataacgagacagaaggacgtgagctggcttggaagtgtcgacgaacattgtcacggggactctaagagtcctgtgcctttttcgcacactgaagtgtgcgtttgatgttattcgtcgagagtgtacgtgacaattgaggtcatggccgcaccaccgcccacaagtcccctgggagtgttccaggaagatatggggcggcttggggggcaccccgacaaggacatcattgtaaggttgactcacatagccatg

SEQ ID NO: 5440 - DNA, 700 bp, Nannochloropsis_gaditana
agagaggccgcgtggggcgaatgccgcgacggaggaaggctcgagcagaaggcagaggagggtgacataacctactaccgcgcggagaaggggcaatgctctgcacatcgatccacctccggaaggccgtcgccgcaatacttttatcctcgttgtggaggatgtcatgatggaactgtgaccaaatgtagtgggtagacgttaatatgcggacgaaaattctgagacgagctagtcggatgcagaaatgacaggaggaagaatgtctaaaattcgttttcctgagcccgccgggcctccctttaattcccgcggtagccgcgacttcacaaatatgcccacgcgcatgcggattacccacgcctcgtacttttcggtcaagcctcaggtgttttgtaacatgccgtgacaaccccgtgccaaataatttcagaagctctccttcttggctcgctgaagcgtgtgtcacagcacgtgctacgctgggaaacttgagcttcccacctacattgcacttcaccacgccaagtgtcctagcgccaggcacgcccctcgcccacaaggcagggttccggccgtgcgtgccaataacccccgtgaactttctcgttgtcttgtgttcttgacatggacagggcagcctccgactttctgcgtctgatatctcctataacacagcttgcgaagtcttagcagcatg

SEQ ID NO: 5441 - DNA, 700 bp, Nannochloropsis_gaditana
cttgcttctgactatgaagctttaagaggttgctcacagcgacgaaaggcgattctcatcatttgggactctctgaaaggtcggagtgaatgtctctttcgacccagccgcttcgttaaagatgcacgtgggcggtacgagtccatccagccgctcgccagggcaagcatttgatctcccatcttggtagtaagcagctttacaggaaaagtctcgcacaacccccacagaagacaggtcgtaagaccaaagacggtactagagcgccacgtaccatgcaaatgtccaccgtcgtgccgcatatatcgtgtgggggcagtacgcgtccagaaatgcaagcattttgaagaggcagctgacggtccggtcgacgcgagcgatccgggcgctgcagagggccagaaaatggaacaaagcgggcaccaccacgttccgcgtgcgacgcacaggggaatgttggggtcaatgatgtcgtggacagggtttggtttctgctggcatggttcttttgtttgtgttgagcatgacgcgttcttgctgctcgagggcggtgcatcattttcttggccacacgtgacgttgctttcctccacgtcactctcggtacaacctatgcaccacccccacaacacatcattctcccacccttatccttctccccaccacgcacgacacactaaagatcgtaaagagcaacatg

SEQ ID NO: 5442 - DNA, 700 bp, Nannochloropsis_gaditana
gtaaattatgggataccgtacacttgagtgtgaagatggtcgaggaaaaatacataggtctatgcaaggcatcgtaaatggaaggatggcgacctttctaggggaattgtaatacgaggattgtacgttttgcaaggcggttgcggtttgctggcgtgcgatggagtaatggaggaagaagaaagcaggccacaaaacccaaagcggtcaacttaaacagaattccttccaaatactttgagactaagaaaaaagcgaaatatcctgatttttgtgagcactgggataggacacgctattaatttctcggcctaccgataacctcctcaccctcttgaacctaacaagtaggtgagtttccctccagccatattgattttttggggggcatgaggagcggttgaattttcaaatatccttcttaaatgtaacaggcgagagttatttcctgtgttgtacatcaatcattcgtcgactgcttcaggctctgccggggagggcgcgggtaggctgggccactcctttattcggacctcctggccatttcccccctggcttgcccacaaaagcaccgtcaattagcaccaaagcactccagaagtttacttcttcttcgttcggaagcatctttactttacgccaactcacgcgtcttcaggcctggcctatatatatcattagcgctccaaggcgagcaatg

SEQ ID NO: 5443 - DNA, 700 bp, Nannochloropsis_gaditana
aataaatatgtacataatgagtttattgtaccttcccagaaaccaggcatagacatgaatggcccaggcaagaaaaacacccgagcccggggtcgatgttgtgcttttcgcggcggatgccatttcgatggagtctctgaaatctataatggataagaagtccccagtgaacaagagggcattatttaaattgagtagaacatcaatttgtgtccataaattgtgagctaggatttcgaaatataataaaaggagtctgtgaggaccgcactctttcttggtattcagacaaagaaagacacataaaagcattaagacagctaaaaatactgtccccaaaaagaattacgcacctcctggctcatcaagtcttacctacgtcaagttttcagacgcaaacgctgttttccccctctcctatgttctaatttcttcgtcaagctagaacaaccgggaaatgacagcgggacagaaacctcctttccccggatccgttccgatccgctcgatcgaggccggcccctgtgtatcttgcgtgcggtctgggaaggcattatagcgcacaccaagcttgcaaatattgtaggttaacccgatcctggggtatgtcttgattgtactcatcttacatttatgacttcctgtaccttagatcttttaattttctgccagagtatttaaaccctcaatctctatcatg

SEQ ID NO: 5444 - DNA, 700 bp, Nannochloropsis_gaditana
agcgagtttcagtagcgatccccgggcttgctatccgcttgcctttacctctctttactggcattctaccgcgagaagcgaaaaggtaattcagtttgagtgtccatgagaaacataatctcatttatgggtttgcatgagagcttcaatcttcacggatctcttgcttgatagttgtgagaaggcaaggcgtgaggcaatagaggtagggagcctagacatcttgtgactcttatcgtctttatttacattatattcctcggaaaaaataggaactaaaattggccagatgccctgtcctaaacgccggagaggcctgttgcgacgctcagcagcgctttcggacaaattttctgtgccgggttgttttttactattcctggcaagtctccacttgatgcttacgcgctccactgtgggggtattcgccttcgtgttagcaacgcctcaccggagccttgccaaagtccactcgctcatcttagattccagtatttcgtcaactgtccgtcacacttgcatggatatgcaagccagcacgcaagaaaaagacctgctggtagttgggatggggacattaggccgctttcttggccagtcctggcgtgaatcgttcggaaacgacgcaattatttacggggaaaccagcaccgataatcgacacgacgatctccgttcgattggcgtgaagccattcatg

SEQ ID NO: 5445 - DNA, 700 bp, Nannochloropsis_gaditana
aaagtggacgaaagggatatttttcatgactttgagaacatttgtccttatttgtaagaatcactgtgaataaagaaacaaagactcttgaaatttgattccgtacgtagtgcttgttcaagtcctttttcttgcttagcgcaagctgacaaaaaatcaggagccaggtgggggcacgagatagcttattggctggctaagggcaattaagacgaataaatgagtctttcgggaggatcaggaaagtgtcgtcaatgtcacagattctttgaacctggcaggggaggggtaacctccccacctcgggtaacggacgtctcagttcctgcctcgtgccctatcgtgaaccttttccggccctgtcacggtacacaggacaacattctcaagcggagtcgttaccaaccgtgtttctcgctgtctttccccgtaggttggagtgaatgttgtttcgggattgccttgaggccgccgggaagatcagacggaggtaaagaagtacaacatagggccggacttgactttgcctgggccagctgcacctgttgtgatgtccagttcccaggacacgacatctggttcaattgggatgaccatcaatgcaagtcctgagaaaagttgtacttgtctcccgaagtgttcaaagacaacggatgagattcgtggtccggacggtttgcagagccaagaaactgtcatg

SEQ ID NO: 5446 - DNA, 700 bp, Nannochloropsis_gaditana
gctagcttggcctctaaatctgcgatgtgttccttttgtgattttatggttttcaccgcgttggccatggcggccttgtaccgttcttcattcgcggaggacatttcgttgctgtgtacagtataagggaagtaaatcgcgtacaaaatgaaaaaacagagcggagaaccaagagtagcctgccggcttggcggggcagcacagtggaagacaatcagacacttgcacaaagccagaaaatttgacaaagaccgggaaacgtgtatatggtggcatcgtccaatgtgcatgagtctgattccaaaccaaggttaggcagggaatggaagatgtggtcaagggccgggcgaggcgtcgtcaggatggaagcggcgagctccagcggccgaagcgaaaaaacactccacctttggggaagaactacaagcgttctcgccgctcggggccgtcctgcatggatgatgtgagcagttgcactagccacagcatggtcatgctcgggatgacgttgtcttcgtgaggataaggggaaggaataaggacggtgaatatcacacgcagggcagctacttgatgcgcagactgcctcctagaagaaacctctggatgcattgatatccgccccgcttacactccagcacggccttaactcggcccttgataccgacaggtgaggcacggatatcagacggtgcgcatg

SEQ ID NO: 5447 - DNA, 700 bp, Nannochloropsis_gaditana
aactaggagagacttggcaatggcaaccatacaaaatttatccctacgtggagttttgataccatctacattactttggaggagcaataatgtcagactgatatatgctagctggcacttaaagtggagagcgaatactatcccagagcatgtttggcttccggcatcaagccattcccgcagatgcgcaccttccaaccagtagtgctttgtagccatacaaagcaacgcgatcggcgcattttgccatcacttacataatgctatgcacttccccaacaatgctgaatcgctctcaaagaaagaaactggaccaaatccattcgcctctgaagtttcatcgaggactcccacgctgggagacaggcaggcaactgcatggtcggcattttcctcgtcatcactatggagatatcaccggaatgtttgaatttttgaggctcgcggaggcggaaaccggtcatgcaatggcaacacgggtgaaggtgatatgtaaccaatttgacccgcagcatctttccgtgccacgcgcgaatggccaagcctttccaacagggtcacaatagtttcaagtatactgtctagatgccgacaagtccgcatgtctcacattattccattttttctcattcagcatagaacggggcaagccgggggcgcatattcttgcattttagggcgagacacgatctcgctcatg

SEQ ID NO: 5448 - DNA, 700 bp, Nannochloropsis_gaditana
gaagaggaagcccggttgttgttcaaattcccgttgcaccccgaggcgcctgaccgggtcgctttgacgtccctagaccgagtgaggctcgaagaaggggagtttctgaatgataacgtcattgacttccatttcaagtggctcgtgcactgcggcgttgggtgtgtagaagacgttgggctggcagacgagaagcggaaagggctgcgagacgtgcatattttctcgacgcatttttattcaaaattgacggaaacatcctccatcacacgagccataaagcggtcatcgctctacttcaaaagcgccacgcagaaaaagggaagcaaggacaacatgaaggaggatgggtccacgatgggaaaagagcaaatcgtggcgactggaaagacgcaggggacggagagggcgggggagaaggatattcacacccccatgtcggaggttagggcgccgagggatgaggatgaccgggatgacattgagcttttgaagaaggccgggcccaagggacgggtggaaaaggaagccgccactgaagagggttgggacccgttactagccttctccttctcccccgattcgccatcgcccgtcacgaaagcgccaactcgacaggagatacaggccaaggagcgccagcgccgagaggaggaaaaatacgaggcagcgcacagcctggtgcagcgctggacgaaga

SEQ ID NO: 5449 - DNA, 700 bp, Nannochloropsis_gaditana; identical to SEQ ID NO: 5410

SEQ ID NO: 5450 - DNA, 700 bp, Nannochloropsis_gaditana
gtgcaataaatttgtccatataaaaaggaaaggaacacttaccgtcgacatggcgacacaactgtaccacaacaagcggaaagtgagctctgcagtcggtgtttgcgtctgctatgtgcatgtgagcagggaggaaattcatcaggaacgagaaggcggttgttcttgtcaccacaagctctgatcgacgactccactgctgcgaggcgcaagtccggtcacgcctgccacaccggccacgcaaacttgccagaaatacgttgcacctaacgagttgattctccctctttattgtcacgaattacagggagccgttttatggggttcatggctttcaggaaggcggattagccacggtgcattcgtcgaagggggctgctcctccctctgggattcctccctcttctttagtaccgccgcaagcataagcagtacacttcaaggtggccagtggattgcgtaggaatgcatagaggtcctaggcccaatccttcatcggacgctggccacggctaccacgaatcagcaaggcagtggggcgggcacgacagctctcgtcaaacgaaaaagaaacgtcacggcctgaccgcgcgagtggggcaagaaacggacctctttcgctccaagctgacaagcgctggccgttatggcagttatagctacaacaaaattggtgtcggtttgggagcagtgaggaatg

SEQ ID NO: 5451 - DNA, 700 bp, Nannochloropsis_gaditana
ggcgcgtgaacattcaacttgaggcaaacgacggtttcgctctgcccatgaaacttatggtcgtgtgtaacgaaactctgaagctctttctgtcataacgaacgaagccatccattcggtagacttgttgctcatgatacattccatggttgccttttgaaaaccgcataagcggcagcgacggcagcaagccacgtcgccagccaagcggcacgccccccccccaaacaacgagtgcgaacggcgggcctttcctcaatgcgaacgatttccccacgtactagtggtcatgcagtggttgtcaggagcccgtacataggctattgtgcatgtccttcgacgcaatgcctttttctacattgtactatggccatgaggtttcatcgatctggcacgattattgcatgcgcaacagcaggcccccatggactgcttgagtgcaagccatcgatcatcgagtatgggtgcgcccaggtgtgctttgaatgaatgataaatctcaatcttacttgcaactttaactcaaccagcattctgctttcgaccgggcctcctgacaggatttaagaagcataaatcgtagcacgggtcagggaaagcgctgatcccgacactcggagatccgttgcacaaattatcatttcaacacgatttccgaaataacacctcctctcgtgcaagatcaagagtgcagaagatg

SEQ ID NO: 5452 - DNA, 700 bp, Nannochloropsis_gaditana
acgtggtaattgcagggacagtgacatggaattgtcgaaaaggatggtaaatgcactaaaaatgcaatatccgcggctaaaggacattcaaggcgtcattaagctctttcgactgaagttgaacaggggaggtgaggaggtgggggatcccgcggacagtgctggaggcaatttgtgagtgaacccgtcggtcccgccagcctgtccttgaatgctgtggtgaaagtggttgtggagcatatttccgcgtgcaacaggtcagtatttcctctgatcatgtagccgagaacgtcccaaacgcggggggaaggctcttaggcctctctgttcgccagtgtcttgcccgccacgctcgacgcaacgccgcccggtaactagagcggcgaggacactggttctggccaacttcgtgttcttgggagcatatgcatgcgtagtagagctcttgtttgagaatttctgactcgacggacacattgcgtgtctttttccccgcttcttcagggttaagaggggaggacacgggccacgaagcagcaccgtcgtctttgccgggaggacgtaccacacgaacaaagtttggtgacctctgccactcgcgacaagactaagtctttaaatttttcctatcgttgacatttgcggctaggaccggcgcgcttggtagcatacacgaagctgccctcccttagttgtcatg

SEQ ID NO: 5453 - DNA, 700 bp, Nannochloropsis_gaditana
aggccaaggagaaacgtggaggggagggaggaggggaggaggaggagtacgtgcccacgcgaccagcacagcgagaggaccggaggctgttgcgagtggagcacgcgaagagggcggggagggtcggacggggtcgtgggcgggaggtgttcgaggcgcaggtgctggaggaggaggtggagggagggagggagagaggtcgcgcttacggggacgaaggcgaggctgagggggaggaaggatcgggccatttccgtgagggtacagagaaagaagaggagcctgtggaggaggacgaggaggacgaggaggaggaggaggaggccattgccagacgccgggctgcgatccgggagcgtctgaagagtttgcgcgtggaggaggaggcggctaccgcggctgccgaggaggaggaggaggaagcggaggaggaggaggaggaggactcggagtacgaggaggagagcgaggagagcgaagaggaaggggcgggggcctctttgcactggctcggcccgtcttcatccccaagggcaagcgggagctggaccgagaccgagagcgggaggagcaggaggaagtggagaaggagcgaaaagccgcggcggcgcgggaatcacgtcgacgggaaacacggctgatggtggcggaggaggtgcggaaggagtcagagggggccgtggggtcggagggggcgatg

SEQ ID NO: 5454 - DNA, 700 bp, Nannochloropsis_gaditana
aacggacggagacgtaggatgcctgcgtctgcaatgtaataaagtgaaagcgtaatcaaccgttaaaaatggtctcatggtccgtcccgcggcgcgtgggaagtggcccgcctgcctggctggctgggccgagagtgacctcagcgggtttcgacacggggttggacctcccgcatcctgagcttcccgagcctgcagagctcgccaagcgactccaatgtcacgccggggagaaaacgagccaactcgactctatgtcggacggatgagaatgacttttactcctgtgggtacgctcgaatactttaggccgttcgagtggatggattggacgttgatgtgttgtgctgttgtgccgctaagcatttctagttggcggcgctcagctcgtttgttagcatgctcgcccacaacgtgattccccaatattccctttggcgcacactttgcacaatacaatgtaaaggcattgctagaccgtgctgcatcttgcttccatcgctatttaaagaaagcaagcgtccatttttcgaggggtatgtgaacttgttcaacgaagatacgcctcatgggttgaggagggtgcgttggagccgcacgtctgtcgtatgtgcttgattcgatcaataatctcacatttacatgccacacattgcaatctcggtcaactttattgtacgatctcatcaccacgtagatg

SEQ ID NO: 5455 - DNA, 700 bp, Nannochloropsis_gaditana
attgggcggaaaaataccctgatcgttcttggtcacaactatgataaatagttttgtcttgtggtcgatacagttgtactcatttgcaaatgtacgaccttttttttttaatataactcgttgtctgtagcaagaaatcaatcagttgttatgatgaataggatgggtcccggggtcacccacctttttgctcctatttcaaataaaataatcccccttcccttcagcgaaaaataggccacgcgaggtgttccactaatgaaatagttttatctcagcactcttgccacaattgtgagctccgcttttccatgatcacgtgctggcatttctgagtgcaggggctggtcacgggaggttttggttccctcctctgtgctgcatgtcgtcgaggaggtctatcgtgggggggcacttgaactgagttcagcattttcccggtagtttacacatgtgacatgcatctgaatgtatggaagcgcgatgctgtcactccgggtaaattgattggcctggtgatgaacgctacctcgtcaaacggagtctgtctagtcgtgctatccttatgcccatcgatctcaccatttcatttgccaacacacctaagattgcaagggatagaatttcttgtcgtcttcttggaggtcctcctttttcgcgctgcctcttcgttgttctcttaatagctgaagacatcatg

SEQ ID NO: 5456 - DNA, 700 bp, Nannochloropsis_gaditana
ctccgccgcctctttacagtgctagacgccaatggtacgggcgcactagagtaccaagagcatgtgggcgcgatgtactttttcaagcatgcgagtcccgtagagcgattccgcgtcatttttcatatgtacgagccaaagtgctcttctgcttcctcttccactacggcggcagccagtaaagtctatctccataaggaccatgtaatggcattgtgcacagaaatattttccacgctcagtgaggtggaagctggcccgcagcgagtcatggcctcatttcaacgggacaatgacgacgtatcatgggacttcgcgcctcctcttgcttcctcggagggcgttgtacctaagccggtctacgtacagagtcaggccgcgccattcaaggatataattggtgttatggtggacatgatatttctccggtgggatgcggacagggacggaagattgaacctgctggacttcgaggcctttgcgagccgccaccctgagaacggcatcgaagatgtgttggggaagctggtgacctcgccccacgtggcgcgtctgatgtacgcgaggaaagtccaaggcaagtttgtgaacggaaagggatagatgactaggacgcgatgatgagcgggccgggattgagatgcgaccatcaaagaaagtaccccttgagaaagaaatgcatagttcaacgtgctcctct

SEQ ID NO: 5457 - DNA, 700 bp, Nannochloropsis_gaditana
gcttatagacttgacccgcaacattcagaaatctcggggcgactacgtggacaaaagcccgtacataatgcgcgacgcacaaaggcatggtggtatgggcggctcggggagccgtcggggaagataggtggggatgcggtcgtgtcgatatgcgaacaagttaaaaaacatgcaaaaagctgttgtgcgttgtgacttttagaacactttctccgtactgttgctatattttattagctttattctgatctaaaaagctgggggggggatttttgcatgttacctcgattagatttattttgatctaaaaagcgggggggggatttatgcatgttacctcgagcattaacctcccagctacatgcttttgtccttggtggccagtgccaattcttcctgtggtatttttttaatatacatgcgcgaagtccactacgtacatcagcgacgattttcattatgttgttgcagtggtcgcttgcataatacgttgagattatacccgcacgatgacattgatggctacgcgtttatcaagtttagctgttttgtccatccccaaagcataccgttttattacctccaaccttctcttcctctacagccgagtcgccttgaagccatgcagactgagtttatatagacttgtagtatggggaataaagggtcgacacaattgcttcccactgtggacaccatg

SEQ ID NO: 5458 - DNA, 700 bp, Nannochloropsis_gaditana
acccagatgataaggcgattccgagctccattgataaagtccttgaatgactttaggtactctctatgcaacaaattaggtgcttagtccagtgtcttcctaggcgcatgtcctggcatacgtgcatgccaaaatcatgttggggaaggtggtcagtgggccactgggaaaaggctgctgtgaatcatggctatcccaataaggtcgctcctcgccgttctgtgctgcgtcctgtatgtcctgtctcacattgtgtatggtcgcgtgcactcgtgcctctgatgtccaagcgacgactcttcatggacgcttctttatcgtacgaagtatttttgcgggaggggcagtggtcgggatgtatttgtcgtcgcgcgggtacatagccctgagcttgtcctgtgtggcttatttatctatctcaacgtcatcaagagcgacccccccctagcccgcgcatttcagcacgtgttggaacggggcctcccggattacaggtcggcattttctgttaacacgaccctgttttacttttcccccgcacacttgacagtcacgggagaaaactgcgttatcggacccgcgcgaaccaagtctcagctaattgcttcttcggcgaccccccagccacgatccttcctcctgtgcatcttagtcttgtggtggcttcggtaacccgctaccgcacctgtcgtcgataatg

SEQ ID NO: 5459 - DNA, 700 bp, Nannochloropsis_gaditana
cttcatccaatagtgcgcgtgctttcccctcaagctctcgtcgcagcaaggccctctcatagaggaccttgcgcctccccgcattctctatctgctgctgtttctggtagtggcgaagctgagcgggatctgttgaagtccttatcttatctaatgccaaattatatgcgtacagtgctgtttccgattcgcgaaccttcgttaccaaggtgtgtaggcgtttttgatatttctgggtcgaggacttggcgcgaagactagatttgaggtctttccgcaacagcattacctccccatttagaaaatcgacacgctcctgcaacacggctttcaaaaacgaaacgttttgagcttctttgctgttttcatactcgccaatctgcaacattgtcgtcgcagccgagccccgttggacgagggcaagtagcggctccttctcaccctatccacgtgtgggtgggagggtgtatgagtaataaattttcccaaatacaatcaccgatctggttcctcagccacaagcattcatggataaagggatgccaatgcgaagacaccacagcgttctcaccgctggtgggaaacccggttatgcctgggccaggcatagcaacggctctgactgcgagcgacttgacgttgactttgccttcggcggtcacccccggcattgccctatcttgccaacaatctgatcatg

SEQ ID NO: 5460 - DNA, 700 bp, Nannochloropsis_gaditana
tacacacaaagcgggttcgtgattgtcatgacatcgatcggctttaaagttggaacaaatagcggagcaatttaatatcgtatctgatggatcctgtttatttcttgtttttcacttttcgatagatccgacaagcgaatgccctccctggcaccgcatcttctcctcggcctgtgtgcctgctcttccatggagctttgtctgatgggcgcgtgttttattcggttaaaagccagcggtatgttttttattttgagtccttgctgctcccagcagtttactggtccattatccattgcatatctgtgtgtgtatgctcattatgtagtgtgaaagtacttcttattcattcgccatacctttttctaaacattttcataatcttcgatcagaggtctcggatgctaccttgctcgtgcgggaaactgcgatgtctttgtagcagattttcgaggacggggactgagcaggttagggcgacggggtcgtaaggaccgagtcgatgtaggcaaaattcgtgatgtgggaagccgagcgttccgcttatataaagatgtttgtcctgaagagggttggctgaaatttgcttccatgattgaaaacatgacgtcaaatgatcagaaatccattaacgggaatttaggacgcctctctatcatccttttccacagacctcccgtatcctcgctctcaaactatg

SEQ ID NO: 5461 - DNA, 700 bp, Nannochloropsis_gaditana
tcgtctcccgttctactatgtctgcgaccatatccgatgctcgtacacattacacgaattaatagcattgtattggttgctcggaatgccatttgagtccttttatgtctgcgttcaattgcctggcatcctgattgtttgtcactccttaggagagtgaggttctgatgctgccatcatttctcttcagcattcgctcacactcaaacgacaaccgcaacagtacatccggtggtaaacttgaagcgtactctatcatggcagcagcagtggcggaaatgcagcagcatgcgacgatcgagcaaacgtctggagtaggagagcacgaggtacgtggattgtttcttggggtgaagatagaatgtgttcaaattcatcatccgcggttatgaatcgcaaaatcatgctaggaaaaagggcggcatcgtttttggactgcatttcgatgtaggaatatttgaacatttaccatgcatacacgtttccttctatctttcaggtggtggtgaattttcgtcacattaccgagcttgagcatcacggtgtgaatcgcacagaccttacaaaacttatggaagcagggtattgtacagtcgaatcgatcactcatgcaacacttcgcaagctcacggacatcaaaggcatttctgaccagaaagctcaaaaaattaaggaaatagcttacaagctggttcccatg

SEQ ID NO: 5462 - DNA, 700 bp, Nannochloropsis_gaditana
tcgatcagttttcttctaatttgcacttcaagcactcacaccatttaccggctgatggtgtggatggcgataggatggatcatatatttcgtgtggggactcgagaattctcaaaaggtgatggagcgcacaattctaccaaatcgcgaacatgacgatgggaatactttaaacgaagggcggggggctgagacgggggtggcgatggtaacgaccgactcgtagagcagagagcgacaggagactcaagtataaggcacaaagtacggtaaaggtcatcttaagcgataagatgagaggataacaggtgacataaactgataatcattacaagtgtgtagagcatatgatggtacataactcagaggcacctactgcctgtgcttgcctataggcaactataacgtaacttcatttacaggggagcaacgacttaaaagcactatgacaacatgcaaataagatagcctgtagaattctaattttactttccatcagtcgaaggcgccgtagtgtcctccaaacagcatgtcgctggcacttttcgggtgcgtaacccgctgggcctgcatacccggatgtagacgcttcagctcctcagccgcgagcggatgaccaaggcaatttatcctaatttgctgctctgccacgacacatgcgagcctcacatcaatcccaacatttctgttcacatgctagt

SEQ ID NO: 5463 - DNA, 700 bp, Nannochloropsis_gaditana
cctcgcctacagaggagcggcgcctcttgctgggggcccgttgcctggtactgcggtgcgtgttcaaagggagcgcaaaggaaatattaaaatgcattcaattgtacatgattaataacggggtgcaatgcatggtcacaagcatcgatgaatgcgtgctccatttcatttacctctcgtcgtctggtggtgggttctcaatttttccctttcagccacaaggcacatccaggcttcctgctcccacttcctaggcctgtatcatgaaatgatcatttgagtaagaaaatatctcgtcggttttcatgagctcttcgtgcatagaaaggcatcattgtgttgctgaaacgcgcttcttgtgatacgaggaagaaagagcgaagagaggaagaaaagttgcccccgggtggtcctggagttccataaggactaattatacggacacacacgcatcctctcctcacaatttttgtcgtcatttatttacaatgcacgcgacacgcgaaacaacgtcggtgtcagcacaatgacctcctgtatttttcgattaggcaccaagagaagactcgcgcaagacgtcaggaagctccggagggagactcggtcgacctctcggtgggctgattatttggcaaagaaaaaaaatgtatcccaccaatttataccgaccacataatttttttctgtatactttgacgac

SEQ ID NO: 5464 - DNA, 700 bp, Nannochloropsis_gaditana
gcggagaaagaatgggtgcacttgcggacgacactccatttttcactgtgtcgggatacccgaaatcctttactccttaaattacccgcgcttcgcatacagatgagcgcccgttgtacacggaaacaaaaactactgctcgatgaatatgccaactgagggtcacgtagaaagagccatgacaacaattcatttcagatcagttatttgtactataatgtgtacttttgaaatcatacagctgtttactcgacctttccttcgagcgctcagtccttccccctccgttcccctgcgtgagggagaagaaggatacccggaagccgccttgaggtgcttgttctgcaactttttcgaaatggcccgcatcccgcgtaaagtcccgtgaaaatgccaacgactgctctgggatggagagttgccctacgatgctttacgtcttgtttcaaacgcggagtgggacacgtttttactgatttttaatggaatggaggcgccgttttgcatcttgactctctcaactgtttcatatgcgtgtctttggctgggtcgcgtgcctgcacgcgagcgaaattaattttccgagatcggtgacgccctctctgagatcctaaggatttttcagtcatgaaaagttcagaagataaattaaagctgcgaacagcatcttagctcacacggacgccatactatctccaca

SEQ ID NO: 5465 - DNA, 700 bp, Nannochloropsis_gaditana
ctggacgggtcgggagattggcacacaagatacaaggaggtcaaagaacagggggaaccatgtccaggcaaggaaggggacgttgcgacgccacaatgcacatttctctttctctcgcatgcaggagccctacataaaatgatcaagattcgagggggaaatgcctttctctcgatgctcccgcgcccttccgtctgatccccaacatgatgtaagccctttgacatgtctgcttaccggcacggtcgaccacggcaatgcatcccagccagagccacttttttgctttttacgtttgggcatgtcgtcgtaatgacgaagctgtagtgaggtaggcgcagtgatactatgtagtctgcgtgcatgagaggggaggtcagggagagggtcgtgggggccgggaggaacgggtaggagggaaagtcagacggccccatttcagcacttgcaaagctgatgattggttgtccttcgagaaacgacgtccacaccagtttgtcactccatgggcgtacgcatgccatatttgatgcaagggcggagagggagggagagatactcgtctcctcttgcggaaggcgattactacgtgcgtcacttacatagcacgtaccgcattcaattttgatcgaatcacggtcactaaccactgtgtgtctcatgcaattagactccgaatcttggtgcgcagtgagttatg

SEQ ID NO: 5466 - DNA, 700 bp, Nannochloropsis_gaditana
caatcggccgcataaacgcctaagatggctaatcgtaggcgttcttattacggttctgctgatactaaacattgtgtcactccgagggcggcgtagcgatccaatttccttgattggacagctgagcaataatgaatatctggcaatgccccttccggcgcttcctcatggcaaagcagtgagtgatgaccctccacgacgacaagaaatgtctcttcaagattttgcaaaagaaagtcttacaacgcctctgattcaaacatcatcagaaaatagtatcgggagccaggaacatctggagctagcttcgcgagacacaaatgagaatgcttctcatacaaaagaagaaagacaaaagcagcgagagagcgacaaagaagacgagaatagggactcatccaatctcatcgaaatgacaacttcagacgagaaagcgtccattgtacagcttgtcgaggcagaagaaagaaacccggccattccgttgctccaacctgcaggcgacaaagccatccgtcatccaatctctggccgacctccgttgcatcgccctgcttccgagacgcatatacaaaaaattatgctgactatatccagctttgaccgaggccagcgcatttcccacctgtgggccggggataagctgcagacaatccaagagactttggttagtgtccgggaattttgcgagcgtggtttt

SEQ ID NO: 5467 - DNA, 700 bp, Nannochloropsis_gaditana
gcggctccagcaaagcaagcacgtggttggcggccagattctcttggggaaccaagccttgctgcggattgttttgcaggttttcggcttctccgatgagcttggcaagaagggtcaagtaccgctcatcattcatctccattgcatggaggaagctgataaatcgtgtgtccgaggagaggtggaagggatgagtgcatagcttttgtgagtgactgaccatgtcatgcgtacctttgcacgtcattagggctggcctcggtcattgcttcttgttcctgatggctgattgttgtgatgttcttgctttgatcatgtaaagtaggggaagaaggctattatggtgactaagaattaccgtgtagtgcgagtcatagacacttatagtaataccacgtcgcttagttaacctgattttcataccagaagattaaaaaaacgctcgtatgtacttcgactagcatgcgattcgacagggacaatgtgtattcgattgcttccgcttggcgactcggaggagcgacgctccagcgagttccaccatcaaatcgccagacgcacattactgtcccgttgccccgaaacgatgccctttacaaatacatttgtcaaagtaaaatctcggtggcaataagaaacccttcatgattcaacgattctttctaaaaacgcagcggtttacccatcaagctcagctatg

SEQ ID NO: 5468 - DNA, 700 bp, Nannochloropsis_gaditana
acacagaccgccagccgtcatgttcaggggtataaccgatggtaatgtgcatcaacgaattgtctcatccagccaacagcagcggacttggttcaggatcatagggttgctcctgatatgtgtctgttttttgttcatgcggagcgtcacctggcagattgatcgagactctggagcaagagcattgtcttcatccccgcgattgtcctacaacaattctttcaatcttttcggaataaataaatacgagcgtaaaactgtcgcttacgtaatctcggtgacagcgtatggtgcccactcagacggcgccgcagttctggcccatggcattcgaaaggccttcgcaacctcaaaatacggcgtggattttatcgctatagtgcatccaaacgtcactacctcgcgtgcggcactccgtcggtcgggctggaagtaagtatggtattttgatcggaagctcaggacgcgttgcacccagaatagagacattctacagagatgtaagctactaacgattctcctcttttgatccgaatgtaacagagtgatagagcgggacattcctgtggacatcaccgatatccagggcaccttcttgcgggaacacatagcgaaaagcggctgctgtggggcaacagagcttttgaagctgtacgcgtggacactgacagactatcatcgggtagtacacttggatatg

SEQ ID NO: 5469 - DNA, 700 bp, Nannochloropsis_gaditana
atggaaactttcaaaaacgcaggaccgcagctaacaaatacggcgagattgctttttcacaaggctgaaccaggccttgtctatccaattaaattgacaaagtcaagcgctttgtgcgtacagcaaggtgtcgagtacgtacttttagcgatgcctccgtgtcaggcacttgcatctgtcttgcctgatggttggtcaaattctttacaatgcacctatgaaaccttgatcagagtatttttagagcaactagttggaaaagtgacacttcggcaggtacttccgcagaagatggatagtaagactgaggtcaacagcaccacagcgccaccttcgttggataagcgagaggaggatcacgtcgagtcaccacatatccctgtctaccagcatcctggccagccactccagggtggtggctggcatggtgctctaatacgatacctggatcacaccccagaactcaggcactttatcttctatgagacttcggagtggatggctatttatgacggctaccctaaagcaaaggtccacctgctcttgattcccaaacccgaattcttgaccattaattctgtcacggaactcagccatgacaaacacaacaagcaaataagtaggctgcattctgcggcccgatgtatcgctaccaagttggaaaaggacacgaatggactgcgtctccgtatgggatacc

SEQ ID NO: 5470 - DNA, 700 bp, Nannochloropsis_gaditana
atagacgggacaggacagagttttggaaggccgggaggtgaagttctccagtgtacacaagcatgaaacctgcgacagataaagatgtacagtcgagcgtaggagatagggccacagccaaaagaagttgtgcactcactaacggtgccgctgcgaacgatcgtgagcctgcggtagtgacactcgcaatcccaaacttcgggcctgccgagagagtaaatgcaagcctccaaatccttactacctccttggcaaattttttggattcaaagttcattgtaaggttgaatgaaagtgccggcgtaataaaaccttcacaactcgttttggaactcgtggtggttaaagaggccccggatggagacgcggcaaaattagcagctcgggcggggtatgttaccagagccatgacatgcacaatcacaaagccgcgtcaacgtttgcatcaaggggaaactggcgcactgacagaggagacaaggggctcagggtatcctcaggttattgccgtgccatgttcccgttcatttcttcctacagatcatcccgtggccatggaaactttcaaaaacgcaggaccgcagctaacaaatacggcgagattgctttttcacaaggctgaaccaggccttgtctatccaattaaattgacaaagtcaagcgctttgtgcgtacagcaaggtgtcgagtacgtactttt

SEQ ID NO: 5471 - DNA, 700 bp, Nannochloropsis_gaditana
tgggagggctccgcttgtcgttggctacgaaaggcaagaatcgtaatttaggcaaccttggggcttaaatttgactttggcgcaaactcggaaatccgaggcgatggaggatggtcctgattctcgcatcccttcccgtctgctttttaagaccctgtgccacgtacacgcgggtttggccgtccgtgtagggtcgagattgaaaaattacgacaggtgacattgctctggtgtcttttatagtttttgtttggatggcaattatcgcctttcatagacagccacgcgcaaaccgcataaatacgcagtttcttccaccgtctcacacaattgttgagcttttaacaggcccaattttcatttttttcaactcttcatgcaatcctgacagtaaacatgatctgatacattaaattggcaggaaatatgcgaacctctggccaagtatcaccgtagacgtgtaaagtgaataagctcccgcaccacacctccccatctcattacgtcttttcacatacatacatggacttgagttatcgtactatcacacatttactttttaaactttcccaatatatcaaaggaaaatggaaatgcgtcgcgtgaaagaacggagtcagaatctatccgcaaaatgaccttccgtttgctgcaaacccgtccgtgaaaatcagcaactgccgggctgataaggatcatg

SEQ ID NO: 5472 - DNA, 700 bp, Nannochloropsis_gaditana
gcctctcctacttggacacaccgtcgcatttctcatccaagtgcatacctgcagtacaacaaacccgtcgtcatccctccgaatcggcttcacacgcaaagcatgccttgttgctgctagcacactgacaggatcacgcacacgcccccggcgtcgtgatcttaagatcggtaagccacgcccggaagtacccgatgaggctggcgatgacgacgactcagaggggggaggagggaaaagatgggtgcgagtgtaccctctcgggctgggatcatacggcggacagacggcagtttttttagggcggcggaaagaggtcgaaaaagagaatggtgggcgcctggaggctttgccagtaccggtcttcacctccggcgacttggagatgctgcaagcagcatttcgagaagctgaacgaagacggaaaacggaggcggaaggattgcagaacagccggggctctaagagccaattcaaagcatcttcgatgtggacgggcaggcatttgtccaccaaagacaacggctttttcgataacgcgccctgggagtgggcagaaaggatggctagggaggcaggagaaagcgggcagagcgtgccgaccgttgcagcgacgaatgttaaaaaggaagcgttcgacgcctttgttttcggtaagaatgtacgggcagactggacctcctctccttacgcactgatg

SEQ ID NO: 5473 - DNA, 700 bp, Nannochloropsis_gaditana
ggcccatgcctacgcgaagaccagcgccgtatttctccaaagcacccacacatgcttcatctgcttcgatgaacagccaggtctctccttcgtgacattgcaatgcggtcattggtggtgccgatcgtgcctgcggagtatggcgagtacctacgtgaccgaagggggccatcacttacaatggttggtctgcccccgcccagactgcgccttggaaatcacaccggacgttttacgtcacgaacttttgacctcggaggagttcgcgcgctgggagcggctgtctttgcagcaggcgttggaccggatggaggacgtggctccctgcccgcgatgccagacaccgtgcctcactgaagggggaagagggagggaagaagggtcagacgaagggaaagtggatgggaagggaaggtcgaaaactggtggggcagatttgggagagtgccccacctgtaattttgtcttttgtcctcagtgccaggatgcctaccacgccgggactccctgctattcctccgaggcaaggctgaagcaagtagagtcagaaattgcccgtttgatggcgtccacacagggtggccgggccttggccccgtcccaaaacgtccgcttagaaaaactccgacgggcggcggaggagtccttgtcgaggaaggtcgtggagaaagacgccaagtcctgtcctgcctgcggcatg

SEQ ID NO: 5474 - DNA, 700 bp, Nannochloropsis_gaditana
cgtggggagtacaccgatgatacccggagtttctggatactgcgactcttcctgctcctgcaatggcgagatccgtgcatggaaggcacacgttctcacaaatatgtaattgtggacatggtatatcgataaagatcgggcgttggtcctgatgaaagcttttgcaggaaagattattttacatgtgagctctgtcacttttaaaagctctttccccttttcacgatgaggggctctcagcggctccgtcatgcaacatgagtgggagatggaaaacaatggggagggtgcatactatggcacacacatatgtatagcgacacagcatttgtttggatcacatccctggctcgcacgtctccaaacatagacccctttttttccaacgtctctccgcctcacgacctcctgctattgtattgtacatcaacctgaccttcagggcgcgttgcaacagtaactggaggagagccacaggagtgtgcaagaagggactataccaagaacacctgtactgacgcattatatctactccaagcggtgcgagtgtggtgccagtaggataaaagcagacggtgcttcttattgtacccggcctgtgccctgcaagcattttgttgtagcatacattcgctcttaaaccacggttcaaacacgttcaagtggacaacggcgggacgccgtggccaaatccaagatg

SEQ ID NO: 5475 - DNA, 700 bp, Nannochloropsis_gaditana
tggcatctcttgcacgtccgaaggagcggtgaaggtggcagagccttctcaaactccttgcggaggccgtccatatgcccgcctttcctgtggaagaaagcaaggggaaagaacaacacgccatcagtctacgtacgggaaacttttcggtgcgaaagactgtcataaaaagggcatgcaagggccaaacgaaatatataacggggttcagggaagcacatgcagtaggaggttacagtcttagggtggggaggaaacaaacatggcaacagaaaatgactcccgggcagccgagatgccttccatgtcactcgctctaagtgctctcgaaacctttgcgccgcattggtcctttaccttcttgatccccccaaaaactcgcccaagctatttctcgtgcctgaccagcgcggaagcagcgagcgagttgaggcgcccaagccgacgcccgtctgagaaagattccccccgtcctaacttcatgcttggcacgttggtgcggtccgcaccgtctctgggaggctgggatcctatgcatgacaagtccgggtggccttttgtttcgacgcgtggtctcgtccaccggattccttggctgcgcatgagagggcctctcttcttaaccccgcccgacaactcacatgccttcatacacacctctgcgtggacatcaggcaattataaggaaagcagcacgatg

SEQ ID NO: 5476 - DNA, 700 bp, Nannochloropsis_gaditana
gcatggacgtcttcgagcactgggagacgacaagcgctacagctcccacgagcggcggcatctatcaacaaggcagtttgttaacttcaggtggcgatggggatgctttgcaccaaaattctcccagtcgcaggaatgttgcagtccgaagacgggaacgaggatcggaaaacgatgacgacgcaggatcatcctttgtgcatttaaatgacatattttcattgcgtcgtatcgacatgtccgcggtgctcgcagctgccggtgcttcaacaaacacactgataaagccttcgaccgcagccaatgctcctgcgagtacctcatcctttcacagctccctgacttcgacgacagccaccggtgttgcgagccgtactcagcaggaccaggtcactattgaacatgtggcagtgcaaaatggagtcgtggttctgtgcctctcaaacgccaagttcatccgttgggggctgactggcactttcgaaccgcaagtcatccccttaccctctgcgacatctacgcctcttcatgccttgggcaaccacaagaggagggggggcagcaccagcacgccgagcaccagcggggtgtacaaagtctttttagatcccacgggcagccacctgctcgtcagcacccgggccgcggagcatttctacctgcacgcccgggcccacagctttagccgactccataaatg

SEQ ID NO: 5477 - DNA, 700 bp, Nannochloropsis_gaditana
tctcctttcaaaaattgttcatttcctttcgtatcttcctcacatcccccccatcaatcctggggccgcagtctttcgtgcagaaggaggcgatacgcccacagagacaagtcgcaacggcagaggagcaccaggagacaacccggaggccgacagcgaatttgacacccacagagggggttccaacgcgagcctcgccttcggaagtgaactacaccaaggtgaaaacgatgaagaggccgtcaagtctccctcctccgcggcggtcgctgcccccactgcctcaggcaagagtcgtccacccgcattgagcgacaatcttctacattcctccctcgccaacattagcatacattcctccccggctcatgaccacgggatgctgcccggcgccagcggccacagggggggggcaacggacgtgccgagcgccgtgaagctgctggtgtcggcgggactggcaggctgcctgcttggcaagggggggggcaccatcaacgtgctccaggaggagaccggggcccgaatcaagctctcccagaaccaagactactttcccgggacacaggaccgcgtggttctcatatcgggggaggcggagacgtgcgtcaccgccactctccgagtcatcaagcatctgcatgccagcgccgaggcccggtcggctgctgcggccgtgagggcggtgtccctacgggca

SEQ ID NO: 5478 - DNA, 700 bp, Nannochloropsis_gaditana
ccgctcggtggacggactttttggcacggggggctgtaaagccggaaggccgagcaggagtactgggataaagtctcgacgctatcacttgctgctgcgctcgtcaaggtaggttactgcggaggcgacaatcttgagtgcttgacatgcgccgagaaccgaagaaccttggtgtaacgcaggcaggtgtgcttccgatacgctcaaggatgtcttctatgaccaggaatgccggcgatgccatcagccggtacttgtgttacttccatgtcggccagcctgaaaatgctccatacttcatatattggatgatttccacactttcatagataacttcaatggcggaaccaactagcgcagagactagcatgaatcacgctcctccaggtaggtagatgattgcgagcaccggtttgcaagcacactctttcaagccctccccggagtttgcgcggcatttgggctgctctcctttcaaaaattgttcatttcctttcgtatcttcctcacatcccccccatcaatcctggggccgcagtctttcgtgcagaaggaggcgatacgcccacagagacaagtcgcaacggcagaggagcaccaggagacaacccggaggccgacagcgaatttgacacccacagagggggttccaacgcgagcctcgccttcggaagtgaactacaccaaggtgaaaacgatg

SEQ ID NO: 5479 - DNA, 700 bp, Nannochloropsis_gaditana
tgtcggagctttggccattttgagtggctttcctcttgccacggcatgctttgcactttaacgcctgaatagacaacatcgccgggagaaactgtatccactacgcagcacattacttttatcagtcatgaaatggcatcatgctgcaagtgtcgcattaggtccgagaagcttttctgtaccccccctggttacgtacccatccaaggtggttttcgtatgtccaacctcatgctcatttttttctgttcccgtctcgtgtcatagggagccaaaaaaccgctctgcccccgctgcagcgtctttttcccacaaacatggctgcacaggcggaggcccctcaagtcatagcggtgcatctgtccgacgagccccgtaaggcagaagagcgtctcgaacactaccatcctgagcaccatcatttttatgaacccaacaaggcgcatacgggaaaacgcttgcttcgcattgttattgctggcacgggcttcctttccgacagctatgacctcttcgttataaatattggtaagagcagccattgctagagggggcgcgagagggtaatggagtcttaggggatgtccaggttgcagttgggagggctttctgaggaagatcaggtatcattggtcatttttcctcccttgtttgatttgtcgtgtgaaattccatgaagccacgtcgcccactcacgatg

SEQ ID NO: 5480 - DNA, 700 bp, Nannochloropsis_gaditana
agcggccatcctggctgaaaccctggcatacccgtggcatgacttgtctctactgcaatgttccttgtcggctggcgaacacgtgatatgcagggtcgggagggtacattgcgtacgtttttcggggttcccgggcgctcgcatcaaacgaagcaataaatgtagagcacgcacatcaagaagaccgctgtgcgtgattatgaatgtacaaatctatgtcggagttgaatgcgctctttgtttgtttgtttgttgcctgtttatggacgctgaggaacctcctacccccgacgttgtgacttgaaagctgtcgtccatcgacacactttccagccaagcataaggtcgtaaagagttactctgttcacatcatgaattgttcgcacatcaagacgtcctcgcatttccaaccgtgtgcttttgcaccgtggccaacccatccaaagggattggggaaggcagttgaagcgcttccgtccgtcccttgctctgcggccgtgacgacctttcagtcgcttggatctggaacttacgcgctttcttgcccaatcaaggccttctttaaatcatgattgatgataatactctgttctttcattttattaatggttcaactacaaggggctcttcggctcggtgcgctttcggtcacgtgaggagaggagagggcgccacgaggagctaggagacctgaacaatg

SEQ ID NO: 5481 - DNA, 700 bp, Nannochloropsis_gaditana
taacagtgaagaaaccacaggcatggccatgtagggcgtctactcggaacgtaccgtacacaaaatcgtcattgtccttcgaggcattctttccatgatccagattcaaagatcgccatgctcccaagcttcacaaatcacattgaaaaacacgtactcttcctgtccttccgtaaggtttgcatagttacggaatacaaagccacttttgcggcccggcgggcgctgagaggagggggaggatgaccggaaagaccgcagggaggaagttgcttctgcaatcttccccccagttgccgtgcacgccgtaggagaccagatcagcaggaacccagacgtcgtaaaacagacaagtactgcgtttgaacacacttttctattgataatcacgtggccgactcagcagtatggtatcttgcagtcttgaatccttgatatggtaactcaaagtcttcttgtccctcctaaacagacggttgtgcagtgagggctcaccggtgcgaggtggctttggcgttgacacattcactactattttggccaaaagaacgaacaagaaaagcatacgacgcagtcaagcatggcacgctcggcgtagagatacattcggaaaagttcttctcgggtctcttgtccgagtaaggtgtggtgataaaccgcctgcgactgacctcctttgaactgctttaacacggcaatg

SEQ ID NO: 5482 - DNA, 177 bp, Nannochloropsis_gaditana
acgccttaggtctactacactaggaagtacaccttcttgcaagtgttacagagcgtgtgcctaaccctgtttcagccaaagacacgcatggctctctgtccatcattcgattccattctaccttaaaatatgcctgagagtttatacgcatctctcacaggatacataccggtcatg

SEQ ID NO: 5483 - DNA, 700 bp, Nannochloropsis_gaditana
  misc_feature (1)..(579): n is a, c, g, or t
  misc_feature (685)..(694): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccacagacgttcgttcgacctgccacgggatctcagctgctctcggcaaggcaggcgcagcgattggcgcggcggctttccttaaggtggccaatatgttctgnnnnnnnnnngcgatg

SEQ ID NO: 5484 - DNA, 700 bp, Nannochloropsis_gaditana
  misc_feature (415)..(424): n is a, c, g, or t
acgaccgtatgcaacgccaaaacatcacccgtgacgcgtgggaacgactcgacggatggaaaggcagggaatcctggtgtccagggccctccaatggggcacacactcgctcagccggccggggcaggcaagaagaagaagaagaagaaggcggtctctgcggccgcagggtcaagcacagctgcgggtctacctgttggaggtgtgcagaaaggacaggcaggcgtggacggagacagcgcgcgtggcaagggcgcatcgggggagggcaaagtaacagaggagaaggcagcctcgaagcaacggggggaggacccgagaggagacggcggtaggacgaaccccgtcgagggccgcggaggccgtggaacccctggtgccggcgtcgggactctcagaagatcgattgaacgtnnnnnnnnnncctaccctcgacctccagtacgccctgttggtctgctccatgcaccgtcggactcggtcgtgcgtgtatttgtattcctgcatgggcaggttccaagaggcggtggccctggccttgcgggacggggacgtggcgctagccaaggagcaggcggataagccgccgcggggagggggagggggggggtacgtggcgtctgctccctgcaggacgcatgcccacgggacgggggtggaagaagggggggaggcgctgcgcaagcgtttgtggcaaatg

SEQ ID NO: 5485 - DNA, 700 bp, Nannochloropsis_gaditana
ttgtacacagtaagtcattcatggtcctcgatacagcactctcgcaacagctgtattctcaagaatgaatccaagggtatagcgagaccaatggtagccacaaccgacaccttaaagaatcttggcgtgcgcaccagtagttcacggttatctggtgggctgagttaaatgcctcgaggagacagaatcccagagcctctaattaaattgcatagtcgcacaactttctcgctacctgcttccctcgtccagaatctttggagagagcgcggggaaaagcctgtagtcacctgcaagatgcggatgccgcgaagcttctatttcagcccatcaaaaatcaaggggacgtgaaattatcaatcttcagagtccttacaatgcgctgcttaatcaccgcataccggaaggcccgcttccattcgtatctcgtcccctcatttcctggcacctctgcgaccgagggtgtccgtttcccaaaagggaacctcccggcatttttcgtcaaaccccgaggagccctactatccctgccccagcccccgcccgacccctaaccctcgagaccctccactttcgcgcgtgttcaacctcacggtcttcatttttccactcttttcgtaggctatggtgtgagatgtcaatggaggcgagaaaagtccatgttggagctgttggcctttctcaattgcccaaaaagatg

SEQ ID NO: 5486 - DNA, 700 bp, Nannochloropsis_gaditana
tgttaccagcctccccctccatcctccttcgccccttcttcaatcacggtggaggatatcgaccaaaggcgaggcagaaagtagccacctacaggatcaacgccgctgccgccagcacgtcctgcggtatgcaggaggcaacgattccaacaacacttgcgaatcgacctgtgcttaagaagatcgcaaatggcatcaaagaggcgaacggcatggaaaataacatcgaggccggaccggtatcaaaggttgggttcttttgaggatttgccgggcaggctgccggcagtgccagtggggggggaggaggcgaatagccccaccaaattgaagggaaagcgagctggctcgagcagactgcgctactctgcaatacacagcgaccaaagaggtcgagccgacgtggaagcctccggacacaagcatgacacatggatgaaatgcatggtagagaaggcgggcaagcacggtgcatggactgttgtcgaattaatgctgtcatggcatgggagggggagagcgagctggcggggaggcttgtgcgtgcgtgttggaagtcgcaaacccgtgccttcatccccgtgcacaccgatccgtgcccatttttcctcatagtgcccttgcatttcgtctgggaacaggcaaggcatacatttgttggaggggttgagtttttcatcgtcaagttgcatcgacaatg

SEQ ID NO: 5487 - DNA, 700 bp, Nannochloropsis_gaditana
ccgcccattaccccgctgaaagggtgtcacggtgcaaaggcgcggagaaataccaatagcggcccaggttgagtgtgcaatgcagacaaggatcaccgtcaccagcgccagaaggctcgagcaccggatgcggtttggtcttgaggccatggctcgtacaaagaatgactgctttaacaagatgaaacgaatgagtcgtggatgattattgtgggagattaccaccgccacatgatgcgtgatgagctttcacggggtgtcccgtgtcctcaagccaaagcgataaaaagtgcaacgtgggaaggcggaggcaggaggttcttccacatgacaagtaaagtcactgaataaaaaccgagacaacaacaagagcgatctaccacgtgactgatattattgcaacaggtggatgagaagtcggacgcccttgttgcagttcttggtggcctctgtctcttcgtcctcgtcgttcgctgcgggacctacgtcgcacgcgcacccccgtcctcatcaggccctagccttcgttacacattcattggcttggggttccattcgggcgatttcttcctctatcacactagtctctgcgtcttctgtgggtgatcttccggcggcactcaacgaagggggaaagggcggcacctgtcgttctttttcaggcgttccgctccacagcgacagcaagagcaacaacatg

SEQ ID NO: 5488 - DNA, 700 bp, Nannochloropsis_gaditana
aggagttccattgtactgtatggccaggcgataccgctgcatgattcaccaacagatgatagggttgtgtgcgcagaccctccctccaaggagcgtcataagcgccatctcgccttctccagggcggcatctacggctgccatcctggacaaatgtaaaagcaggcccagtttagcgtacatttacccttttaaatgcttcacgacgagttgaaaaagatacgtggccatggtcacgggcgtgagaaatttgggagccaggaggtaaatcgggggagcgagggagccagtcgaagcttcttcagcgaccctctttcctgccctggttgttgcttttccatccggacagagaggcaggatggtacttcttggagcgcctccaggcgcggtatgttcctttttcgcggttgaatgtgggacatttgcctcgttcgtgctgaccgtcatcatgcactctgttttatacaccaggcttggcggcggccttctgtccctcagctgcttgcggggggccagcacgggaagaaatttgcgaagcgccgctggaggaccggcacgcaaccaaagtcccacggtatcacattaattttaatagggtcgcatctggtggggggggttcgaccttgctggacggcttttgggactctccatcttcggtgagtgagcacagtgcgaaacactagtcctggtcgactgctatg

SEQ ID NO: 5489 - DNA, 700 bp, Nannochloropsis_gaditana
gaccacgtgggcgggagtggcggtgcggagagcgatccaacaacacgtgcagatggcggcgcctggggtggaccctccagcatccttgccgccgacccggggaggacagatgtatgggagagagaaagctgagggccaagttgaggaggaggcatcgtgggatgaaaccctgccgttcttgcagcgagggagagacgaggggagcgatcatgatgaggacaaggaaggggaggaagacgacatagagtgggagggtggggacgacaaggaagacctgtcggcggaggaagagagggacgagagcctgggagaagaagggatgacagtcgacattgatggggatgtcagagtaggaacaacgtttccgggcatggttgcaccgacagaggcggctgaggctcccacaggcgtggcttggtcgcgaccgactggaggaggcagtggcgtgagcgcggaggccggccgagggtctctgctgacattgcttgagcctgcgaatgcggactcaggtggccggagggatctcgaagaggcgagtgtgacggtgaggaaaagtgaggaaccgaagccggtcgcggagtggggaggcttaggcacgggacaggacgtcatgggccttggaaatgcagggagagtatgtgaccagacagaggcgagggcccatgcggaagatgcaaaggagcaggaggaagaggagggg

SEQ ID NO: 5490 - DNA, 700 bp, Nannochloropsis_gaditana
tcggtaccacacgtctaagagcaggaaggagaacggataatgctctcgaggatgaggcaatatttctctgtggtatcaagacgcttgcctcccagccggacataatcctcagacacgaccactagagcatgtatgcatagggattaaatatgggttttcgaacttagcacgtagtctcatctttgtaaaatcgccccctgatatggctgataccatgcagtgagggaaaaaaggcttgctccaaattgtggttcagagaaggattatttgtaaacaatcaaaaattttaaatttgtcgaggtgcttgctgattaaaaccgcacgcctaaaattattatcgtatcaattttcattggtatcctcacattgtttcggctagactggcctttcaatgcataaaaatgcttctcccaacctccccacccgccggccctgatcgggcggacgcgagcgccgcccattcgcccaactgcagtcatacacataaatgccctccagcgtttcaccgtagtccaggcggaaaaaaaatcggtatcgaatatattggttgcgtgtgcgccttgacagaatggctgaagacgatatatcagggaccagagttaacgccgtggcctgatgttcagccaaaaaaatgacacgaccctcggagaaagtaagtatcttacgtcttatacggcacaggcaggtatttcccaggatg

SEQ ID NO: 5491 - DNA, 700 bp, Nannochloropsis_gaditana
gtaggaaggaaaacgttgcaggtaacaagtccttgtccttggaagacctctcagatacggagcgaagtgagcggaagatgtgcctggaatcccgcaaggccatcatgaaaagcaattcaaaggtccggctgaaggtatcgattgcgaaggcctctgtctaattttggactgcagcgaaagttgttgaaagtatgtgtctagttattcagccagtgttgcactttgggttgtccgagtccagtgaccaaattttgatagacgctttcacgcttccattcttgtcgacgcatagcgaagaaattggtcagtggaactgcagagacatgtactcatagcatagataagcattcaataatgtaaataggtctgtgtcgtacatcctgttttgtttgtgctgcactttattttaacctcccgtccctgctgctctctcggacaccttctcttctagttgtacatcgacagcgatttgtcgcaagtttgcgttaagcggcgactgccgttgctcgcaatacttaatcgctactttagtgcaatttttatcaataactcacccgtcttctctatctccggcctgatgatggtggcatgtatcttgacgtgtatccactcaaaagtcgataggatactaattcattattctgcttcttttccaggctccacaccaagtaactctgcgaatgaaaggagcaagatggga

SEQ ID NO: 5492 - DNA, 700 bp, Nannochloropsis_gaditana
acctgctcctcttgtatgtgcgacgacgcttgggcgaacacgaataccggtgtcggctcctgcggctcatggacgccgtcatcgcgcttgagcgggagggtcagagcatgcctttgctgccccctgattctctgcttctggcgcgggagatgtacagtcctgcaaatctagagctggttcgtgtgaagcccccgatcatcatgcacatgatcgagcagcgcgtcgggcgtaagcctttgcgggacgttcttcgctcagtggcctgcccacccccggcggccgcaagctcgacaggcgagccttcagacggcatcgaccaggacgcggcggcagcacgcgacatggatgatcctgacccgtctgcatcctctcccaagcatgctgccggcgtgactcccgtgtccgctgggaccgtccgcccgcaggcattaaagacgctgggctttctccgcctctgcctcaagaccagcagtcggggcgactttatcaagaacctgcgggaatgctggctggagggtcggggtccggcctacttctcggtttttcatgcctttgaccgtcgcgctcccaagcctgaattgactatcactttgagacagactgttccgccctgggggcgccttttcacgggccctcttcgcatccgcataatggaggatggaggtccctacgactacgacagggacataagtgaggccga

SEQ ID NO: 5493 - DNA, 700 bp, Nannochloropsis_gaditana
gagtcgatcgatgctggaggttttccttttcaaacgtgcactccgagcatgagaacgaattccttcggaaaaatacttggaatagagtatacatagactgaaaatgcctgagttacatgggcggcgtctcattcttatcaaatcgttggggggatgctgtatttgctcttttccgtcggcccatgctccccttttcctgccccagtctatgttttgcccttttcttgcactgtgaaataccctgccctacctattgaggacaccttgtttttcaaaagtatttcaagtgagataaaagggtagaagcaagggacagggggaggtgaggatgtttgaaccacaatcgcgcgcattccaccggcacgtgacggggaggcagccagcatcatgatgaagaggagagaacgaggcgctcgctccttttgggtcatcttgggtgtcatgctgctaatctctggaaggattcatttcaaggcatagaggtgccacttttgtcgaggctcgaatgcaagtgataccgctatcacagtctttctgtcggctgatcttagccattttccatcccttcgtcaccacgatcgctcgttttgaaaaccgcgatgcctcaattgcgagtgagagcgttcaatctttcatgcatttactcacctctccgcccacaattcgtacactaaaagctacaggacgtccttgcgacatg

SEQ ID NO: 5494 - DNA, 700 bp, Nannochloropsis_gaditana
agcaagcttgtgtgccgagggattgggaaactacatcttcgcagatagattgaaaaaggcaggctcgctttgctgcagaaaaatcgaagaaaatcctgcccttaggggctcagagagtccgcattcaatgattgctgaaggcggttcactggtgttatcccctcccgctctggccctactcgacaagttccgtcaagcggctcactcgcagcaagcctcgcaatttgagcggcagagtcgcgaagggatggatatgatgggtcgcttacaaagtggctgtaccacattttcagagtatgagtcggcagctctcaaaaataaagctctcgcaaccattcctttggctatgttgcatgccaatgccctggctgctggaggtgatcctttcagacgacctctccaattccatgacatattgttgcgagagcttcttgcatggtttaaacgggattttttcgtttgggttaacaatcctccgtgtgacggctgcggttcgactgacacaaagattgttgggggcgtggcgccgacagtaagtgaggcagccggtaaggccagccgggtggaggtgtacggatgcaaaacgtgcccgaaacagacgcgctttcccagattcaacgacccaggtgttctgttagagacgcgaaggggccgttgtggggaatgggcgaactgttttacgctctgttgcgtcgctatg

SEQ ID NO: 5495 - DNA, 700 bp, Nannochloropsis_gaditana
ggggggtcctgcattgctgcgcattattggactcaacccgccaccaccgcccatcaaagggctcgccatgatcttttacccgccttttatggctttttctagctttagacgtaatggatcagccttcgttattggtgcaaatgcgaaatccaagtgttcagagggaggggatgttgccggtcgatgactgatggacaagacgacaacgtgtaaaaatgacggtgcctctacaaagtggccgtgatctgtgttggtggtaaagcattctgatgtgagcaacgaagagcatcaggacgcagcctactgtctcctatcacgaggaggcatgtgactcgctccttttgttcactctcctagagtctgtcatgatccttgcttacccctggtcgtctagccgtttctcacgcaagtttttcctccaaaggccatctccttgcgtgctcatgacaaacaattatatacaacattgtgaaatgtgtgctcttgaatgcataactgtggccacggtcccaatgctgtcacattttgccaggcctgcgtctcctcacctccccattccccccttattcttcgctgccgtctcacaggacgcctcttgttttcctctttcccttcatccattgcgttagaggtcgggacagacgtctatacatcaactcctcgcatcgccacgtctaggtgaaaacctgcagcagccatg

SEQ ID NO: 5496 - DNA, 700 bp, Nannochloropsis_gaditana
gaaaggagcttctcgagggcagccctagatctccctcaaaacgctcagagactctctggattcttgtgtacatggtcacaaaatgccgagaaatgagcgcttattccaaacgcagcctatcttgttggacttgtatgcaccatttaaggaatataaatgcggtgaagtcagaccgtccttcttgcctgtaccagcgaggacggcgagaaggactcagacttggaattgggaacgctttggcagccacggaattcaaccgtgcagtgaatctctggttgagtgctttccgcggtaccccgaaaagcatcttttcacaacaaggccatataaattgcctttccctcctggatctccgaggaagagatgcaaatttgtgttatgtacttcctattttgtgcatgggccggttcaaaggctggatcgctcgatcgtgtgtccatccctcgcacgacatgctcgttttacatctcggtgaagcctttctcagaactctccactacctaaatgcaggattgtgagaaagcctatcgaggcgaagatggttagatcttacctccatcgtagcggcttactggttccagttttcttgcttgctgtcctttctctcctttccaacgacgcagttgaagctacacattcatttaatcccctagcgagggctgtcaaaaagacaggcaaggccatgtaccgacgcatcatg

SEQ ID NO: 5497 - DNA, 700 bp, Nannochloropsis_gaditana
ccaccaaaggacttgctaagtccatagaatattcgcatttggcctaaatgtctttctatttcacccccccgccccgccaccggccttcaaccagcaagttgcttcgacgtgtcaggaggtttcttgaggaaggataaaccactcgcagatagacgcttgacaatggtgccagcgtgatgaagtagaaatcgacgtcttttgaatcgccttttgttcctgcatgcgtcgagtggtgagaagaaagtgttagatcccggcacatcatagaactttttgacatgaaggcgaggattgtgccacatgcgccaaagcatgcctgaagctgacatctccgcaagttcactcggctgattcaaggcggcgaggctacgctttctaaccacgaggtctctctctttatacctgtcgatgtttaatatcataagtggagatgcggggacggcaagacggtgtcccgtctgttaccagcccgttgcttgcaggggtgaagcaagaaagctgctttctcgagtcccaacgtccgtgccgagcgacaaaaaacgtgagcggggggttacaaatacacatatttactgactcacatcccctttatggatgttttgatttatttagaatgaagactggcgtcgtattccgtcgattcctccgcgagcaacattcaggaccattccgacctcctccctccctcctgtgggccatg

SEQ ID NO: 5498 - DNA, 700 bp, Nannochloropsis_gaditana
tttgttcgcatttctctgtgtacagtcaatcaattggcgctcgatcgactcgctccagtcggcccatgtagtgtccgtggcgtgtcgcaatacggagcgctcgagtaaagaggctgagggagaggtcgctcctcgcctcctcggattatcatcaagcttcatgattttatagccgtattaccttggcacacccatggaattcttcatcgagaaggggagcggcctgcaatgctttctcgtgatgtatgtgggaccccaaatctgcccctggttcaagcacctgaccggggagtgccgagacgctggccgggggcactttcggaaaagatcgtaagggagcgatttcaagtttttgaaatatacctttcagccaggcaccccggagggaaatgcgcactgattaggctgccatcaatgcgcatggcatcaccttggcgtggcgagatttatggcttcaaaatgtagatatgaaacctgcgtgcaaaggggacgctttttgtgcggtttaaatcgttatagtggacgtcgaaaagatgacacctgggggtgcgtgccccatcctcatcgacaggcggcaagtttcctgatgtccagtccattgaacatcttgctgggtttttctatgattcccttgcgttttgtcattttgactcctacatacacattctcatatgtagccacaagctgtccattaaacatg

SEQ ID NO: 5499 - DNA, 700 bp, Nannochloropsis_gaditana
cggaggcgtgactccggattttcccccaagccctaccgatgtaattcgcgggccgcaaccctgccaaatccacggcacaaaccctccaaaaggttgaaaaaaagccagaaccacatgattttatgaagacaataccctattgtcaatcaagcaacggggccttggttgagaggcggacattggtcatattgaaccccgagtgccacgactcgacccgaatatctctcctttgcgtcgtgtcgcctaaagcggcttggccgccctacctcaactgtgttctgattccccagaatgtgccctgcttaacccctgtccatgtggatgtatgttaataaaaaaacaggaaaacttatgcacgaccatgaaagcgggagttctcgttggtgtatctcttcttttgaatgcggcatgcgtcacacgcgccttccttacttcgtatcacccgaacggtgttctccgtagccgccccctcccttgcattacggcttcaagtaaattccatccacgacttttgagtcgcctaagtgcctataaagaggatgacggggacgatctcacggaccgctctatatcgctgcttactcaagtggccaaagccttgagcaaggaggttccagtgccctccttcctagtgcccccccgtgccggcgacgtgggccgggtcacttcctcagtttcatcctccacgacaacaattatg

SEQ ID NO: 5500 - DNA, 700 bp, Nannochloropsis_gaditana
actgcagccattcactacaacattcccaattttccatgtcaggagttccgtatggttgatttcaatgatttaaagaaaatctctcttccatctttttcctggatcgaaaccagcaaagacgccatcagtatgtgggtagagtcctctcgggtgggtgggggtgtgtccttttgccttacgacacgagagagtcatgatcacacctgcatagaatgtcacgcgccttctactgcaacttgcacacagaattacatagcttaagcacagacgaattgcatgaaattttaagttttcgaatgcattccatcttttgagacatgcgaaaaagatccgtcccacagcaggcgagtgactcgcccgacctgcctcagctcacctcaggcgcgacctgaggcttgactagaacaatgaaaaagagcctcgagggggccttctatagctcaaatacgtagggctctattgatctctgatgcttccaatgccaaaagcatgacccggaacacgggcattgttaatatagcagccagcgcgctaggatagtacgtatcatgacgctcgagccatcacagtctcaccttttgcccaaagtattgcgatctcatccgctcaattcctacacataaatacaaccccactggcgtatagttgaaccacagaaaatgaactttgtggtggcctgttgtttttctatgtagcagag

SEQ ID NO: 5501 - DNA, 700 bp, Nannochloropsis_gaditana
agcttctgatgcgtgcgcccccggacttacctctacgcgcaccttaaagcgctgtggtaatgaccgcaacaactttacacgtatacataagccaataagggtcgccatggagcaatgaggaatagtcggtgtaaatcggatactgatcgtggagcgggagtcgtccacgcgcacattttcgagcgtggctaccttcagctgctctagagtcaacgggtgctcgggatcgttcaaatttcggattagttcgaacacctcctccgctgtaaaggcgtctcgagcatcctcgtcccaatttgtttccacgtggctgcttatcgggtgatcctgtgaccaaatattgccaagaagtgaggcctgagggcggaagggaaggaaagacacaccgatacgaaagagacaaacagcacgtacttaccctgcgcttacgctccacggcatagatagtagggttagcgttttccttcataatcaacctagaatcaagagtgcatgcgcgtgggacagtaaggagagctttgggtgaaatgagattgaaaaatttacgcctggttctatgtggctctaggcggggggggaaagggagttagggaggaggttatgtactgggcgccagcttgttggaggatttggggtgccattttcgaaaattcaccattttaaatgtcacaattgtatacgacagacgtggcagacgatg

SEQ ID NO: 5502 - DNA, 700 bp, Nannochloropsis_gaditana
gggccggcggaggaggagtacgggagacaaggtttttaaagcagcggctttgaaacagtaaatgacaaaatcaaatcatatcgccatgtacttgagatgttgtgtcagtaagatgaaaaattgattgacgacgaaaactcgcctcgtctatcaccttgccacaacgctctgtttacctctcttctcacgctttgagtgtccttcttgaagactttcttgtaccctgcgaacttcttctcccaaactcgcatttccattttcaattttgtcctcgttcgctgattaaatcttgggagggagcgcttttgccagccaaccccccacattttcccacgtccatttttcgcgccttttcccgttcaaagttttaaatttcgccttcctccactcccaaccctgctcgtcacattgcccctacacctgccgggtgcgaagcatgtagcttatcaggccgcacagtgaccagtttcttcatcttagtatggccgtgtgtttgaagtgagagcgcgtccatggaaacgcgactttggttaagcctggtgagcatcgtcttttgacagcaccatttaacgaccacttctccctggcataggcgacatccatccaattgaacgcataattcgaagatttctctccttctctccacgtgcgataggatagaatgccacaaatgacttgggaagagacgcggagcatcatg

SEQ ID NO: 5503 - DNA, 700 bp, Nannochloropsis_gaditana
gcgtggaagaggattggcttagcagcaagggaacgagaaaatgaaattatggaggataagaacacaaaaaaaggaaagtaaggaagaaaatgtttacatggcgtgaaagcttttgtgcgcttactcttttcaattccatctcacgagaggtcgatgctgcattaaaactaaaaggagaaaagtgagaaatacgctaatgctgcgtgtcagatggtgttttggtcaaattcatctcttctgaaaactaacctccccttctacgcagaacaaagtgactacccggaggacaacgaatcatcgagatcgtggacccttcattcgcaaattgactgacaaatctgtaatgatactttgcttgcacacgtacataccatgcacagggcctctgctgacctgaggaacccggtgtatatttggagcggtgagtctgagttttcgggtaatgtttaagtacggatcagatggagccaggggaacgcgtgatgtgcgcgaggactgaaaacgttttgagcgggcatcgtggcatttagctcattcttacgcgtcagtctatttgaaattttgttgagctgtaccttaaagtcatgccaggtgcatcgaagtcgtttgcttggtgtgagacaaatccccttctctttttattcactgacacgcagcacttcctttccctatattaacgccgctttttaatgcgaagatg

SEQ ID NO: 5504 - DNA, 700 bp, Nannochloropsis_gaditana
ctttatgttgtgtgtgatcacgggaatatatatagtctccaattaaacggcgcgcttctgccccataccaggcgcaaaaggcagccggctcctttatgagtcttacatgaaacgacataacgtgatcgctatcgcttactccttcttcgcaatgttaaggacctgagggagtgtacaccaactaggtatagaccaggacactggatacagtaatgccagggcgttgggaacttgtgcggagcaaaattgctcatttcattcgtttatgtaccatcctgaacaacgagcaatcactataactaatcctgccaagacgacacctttttcaaacagttctcttatttgccacaagatcgtaacaaaaatatgaaaagaacatcgatcatacttgttgcagtcactctagtggctctgccttgggccaccagcgcttctaacgtatctgatgcaaatcctctcgcggctggccaaaaagtttgcagcaaaaggcaactcaagagctttttagggtgcgcttatgccgagaaaggtagcgcaagcatttggcccagtctctcgccttgtgaagggcaactgggaaagtgtcgaggatgggcttatgatggacttgacgcgcaaattgtgacaaacgaggacgagcctttccttggagtcgcagggctttcgaaaaacgcaaggtactttggctactatgcgtatg

SEQ ID NO: 5505 - DNA, 700 bp, Nannochloropsis_gaditana
tacacaaaacctattggaggggttcacaaatttcttcctctcattcgcaggtttggcagaaattcccttccagcctcaaacagatgcaatgaattaatgatttttccggttcctggctagacatgcctgttttaaaccataaaatcaaagtcgcgaaatcgtgtcgccaaagttcaacaactcgaggatggaggaattgagatcgtttcccatttcacacgcatccgagactttgaattcttgaggccatgaaacttgaaggcatcccaggcccaaaacacggaagagggatgtttacagtggacacggtcgaggcgcagagctgataaggcgatcctttgtcctgttcagtaacggctcaggcacatttaagattgaagcgactcaaagagcgaggagcgcaggagcatcgaacagaggtgtgtctcatgtgagcacagagggcgctcgtgccagcgagcaaatcaccttggaagcccaaaattatgctgcgaataaggctactcatacatgagacaaagaatttaatggcaaattgttccaaaataatttacatttgacaattatcttctccccttcacaccacaccagtcgaacaagaccttggtcctgatctgggaccctctcttccctcttggatttaaacttctacatagttgccgcgacctgcataatgcgatgcctttggttcgaaacaatg

SEQ ID NO: 5506 - DNA, 700 bp, Nannochloropsis_gaditana
gtgccgcgggctcaggaaatctatcgagacatggctgaggcaggggtcgttgcgcggtttcggggccacgaattgcattgcaaggattgcattcgtctgaccatcggccaggcccacgagaacgacacatttttggaccttttcaagaaaaccacagagaaataccttggcaagtacacataagagtgagtagtgcgacgggtcatctactaaacaagaggacacttgagacacgtaccccaccaattgcagcccgaccagtagggccttcttgcttttctatttcggtctttcaactgctcgatcgttatttctttttgtttaaaatctatcttggaccgaaattgtgtcggtgtgatgcgattcagcctggataacgtgaagggagccgagaagaaatgcaacagatcgagttgaaagcacgcccatcgtgcgcctaattgaaagccacaggcaatcacacgtagactgtgagcggcagttttgggtttcttgctgacgtgaccacgttatgtttgcatgggtatacacgtgtgttgtcatgtccttcatagggagcgaatgatttttgcgattactgggctgttgccttgccttcataggggactccccggaggagcggcaagaagcgtcatctttccgtcaactcttccccactgatgccccctgcacaggcgtttctgtcgtagctgaaatcatg

SEQ ID NO: 5507 - DNA, 700 bp, Nannochloropsis_gaditana
ttcctcttcgaccttgcaagggcagttttgcaagcgcgtaaaagcaccactacccacacctgccagcccttcttttacgcggcaccacttatacacttcgcgtcacgcccaaatccgtcctccaaacatctgccgtgcgggcggcggcccacgtgctgcattccgacgcccacagaacttctcgctaggggggaagcagatgacgtgcccgtcaaacgttaggaaaaggcgaggcttaagtgtaaaatgacccgatcaacaagggggcaacaggggccaggtcccaagcgggtcgtgtcacagagcgtgtctggcgtgtttgatcggatgagtggctcgagaatgttgtcggggtcatgagtggaagtgtggagggtttgtgctttgtgtggccatccccccttagctacgccgtcgagtccatgtctgaggtacggactaaggggccttgcgcggatgcatggatgcgtcgcacgccccttctttttcgtcgtccagccctgaaaccactcaagttgtgattcatcgcgatgtgtatccatgttgcattttattatatctcactctaccggcgtgctaccacgctcctttaccctcaaccaaagggatcattgcaggaggcaggaggctagagggcgtacaaggtgacgacaaaacatccaccaacactgcacgcaatttgagcgccaccacgaagatg

SEQ ID NO: 5508 - DNA, 700 bp, Nannochloropsis_gaditana
gctccaccagcaacttgacggtaccgtcccctgacacgtgcttctctacgactcgggacgtcgtcaaaacaaaatgctctgcaagctctgcaaccattcctgtgggtagttgcttgcccatctctagctttgccaggccgtccgcctcttgcaaagttttgggccgatttttgatgatcaccttccatagctgccgggcgtgcaattgcttgattcccctctcctccaaaaaagttcgcacggaggcctcatcgaaaacaggtaacggtgatagtttccgggctttcaccatggttcagtccgtacgtcgagaaaagagtcctgttatggaagcaggcagccaagcagtggcagggaggaggttgcgattgagccgacttgaagcctgtgactccttcttgacggtaaaatggagaaatacgcgcaccatgggctgagaaatgaaaaataagaagaagacctaggattcaaatagctaagcgcggttgcttgttcctctcttttcaaatgtactgattgagcttacggctctctcccaccagcaacacggcgaacaagaagcgaaggccaaaaacctcctcccttgagcaggcgtacccccataaacgggtttcattgactcacattccaaagctcagacacattttaaatccgttttcttttctccctgaagcaggagtttaacgtgctccacgcaatg

SEQ ID NO: 5509 - DNA, 700 bp, Nannochloropsis_gaditana
aattttatgaaatgggaagatttttttggttttttgtgtgttgtttctccatttcattcctgcgtcgcgtgcatcgccacgaatatgtcaacgtgtaggacttgatatctaatggcccaaccctttgatcatccggaaagtaagaatgaatctctcaaaaaggtgtccgtcgcatgacgaagatttccatatcatgagccagatcacagtacagcattaaatgtccccttcccagcaagagtaaccaatgagtggggtttgggaagatcgagtcgtaacggcgtctgaggcagcttacgccgtggcagtcattggaagtttttatttacacgacggtcgaagatgtatcccagcgccccggacgcatatattagggtaagatttacatgataatggtatgacatgtagagtaaatggcctatgtatgcgcaaacatgtggagggctctcacaagtaactcgacctcagccgttgaggaatttgaattcttgcatgcgcctccttgtctcctccaacctcacctcccctccttttctctgccaatctacgtataatcccttcattggtttcgtccatggaatgtacgctatcaaaatctacatcgatttaagcatctcacaccaacaggcgcaaagttgcggaacaggtagtcatcgaaacactagaggggcgaaacgtggaagtgggcgacttcatcatg

SEQ ID NO: 5510 - DNA, 700 bp, Nannochloropsis_gaditana
gcatcgtgataccgtcaaagtctcccaatagacgtagacggtcagcaggtggcagggtggagacctcatcccttacccccaatgtggcttttccgagagtgcaccgccacgcaacacgcgcatggacctgtaagccctgttctggcataaggatgatattcatgacaacacgtgaagatgagagagaaaagcatggtgcttgctccgcccgatcatcatcgtcacagaaagtgcttggatgcgggacgactcgtcgggcccgggatgctcgagatatccctgccgaagtagacgcatacttaaagctgtagcgcgcacccaccacataacaaccgcgttggtgtataacaacctctccgcgagggcaatccattaccaaccgaaattggcttttgtatcgttcctaagaaagtgacatcctctctcccgcgaagcaagaacaaggcgagtgtctccagcctcctccattcccttgcccatatacttacgtccctggaattaccgggatatcccagctctggtacgggtgacgcattggtgtggtgctgatgattctgaactataccgttgagccgtcaaggataggtctgaacgagatgatttggtcgagcccttactaaagagggccggtcactagtatcttccaacacgtttaacgcctgtccttcatttttcccatgtttcttacgtttatgagata

SEQ ID NO: 5511 - DNA, 700 bp, Nannochloropsis_gaditana
tcgggacgcatattctccgacttcgcgtgaaagcagagcaagtgaatgatgagcaacgggtcaaaagtacgattatgaacattcggccagtgaacctcgttcaagagatcagagacctcataactgctatcaaagcgtacaattaggattgaggggcagataggacaagggaacgatagcatgcgaggtaaaggtggcaatatgtaggggaacaagaagaagtgttgcattttcaagcgcagagatgagggggtttaacaggatggtaattggatactacaaaatgaaatgggccgctcagagtggatgtgtgcgaaagtggcggtcactgaacgaaagaagaaaacaaatgtgacatgatcctcaatggtttccacgcgaagaagttcaggcgtccgatcaagccgaattgcttccgtttattgcacccgcgtgaacttcccactcacaacgacatttctgcgcaccttggcggcggcggcgagacgcgcagcattgatatcagtcacgttcctggtcaacttagacagacgagtgacaaaaagggaaaggcctatccacagtgcaactgtatgagaatccacaatacgtgatgttcttttttttcgagtttcttagagaagctcatgaatccatcaacgcacgtccaacaggcgtatttttgcatcagttcagcgcttctggcgttctggcagccatg

SEQ ID NO: 5512 - DNA, 700 bp, Nannochloropsis_gaditana
cgctcaagcagtcgttctgggtccacgaggccgacgtgctggccctggcggcgagcgcggccggcgacactgtcttcgcctcgggcgtggacagtaagctggtctgcctcaggcgtccttcccaggccggggcccgagagcctccaggggcgccagaggacgaagcctgggtcctggccgcctctaaccgggcccacagccacgaccttcgcgccctggcggtggtcgagaggtcgggggggaggggaggcgaggggcgccggtcctctctcctggtctcggggggggtggacaccaagctttgcacgtactcggtcgccagtttcgcgcacaaccggccccggtacattgccccctacccttactaccccgtggcgagcgtggcctctgcccgtgggcgccgccttctcatgatgcagcacagccgaaagctccaactctggggcctgggagggtttcaggaggagacggcactgtgcctacaacacgagccatctcccctacttgaaatccaagcggtcaaggggcagctgatcgtgtcgtcgtcgctctcccccgacggccgctttctggcctacgcgacgacgggaacactgcgggtccttgccttggaggtgggggagagcgagggggggggggcggaggtagacagagggggtgacggacacgcccggccccgtgttctcttgcgtcgaaataa

SEQ ID NO: 5513 - DNA, 700 bp, Nannochloropsis_gaditana
ggaggaggatatcgaaggaaggcagctaatggcgaaaaggagggatcagcatctattgtatattcataggtgccgctttctcgactgggagcctcgcgctatcgtatgcatggccgcgtgcgcatcaggacggatgcttgctgtggcccgggaaagcggggaagttgaaattcgcctggtcgatgaaaagtttcgagtggcaggtgttgtgcccgtacctggaggaaacgggctcattcgcagcatgacatggtcgcggcaggtctctgaatcccaggggcgccttttcgtcgggagcttggatacgtcggtattcgagatcgacgtgccaggcctgcgggtgcggcgccggcaggactcctacggcggccccgtctggtgcctggcggcggaccctcaccgtgacctcctggccgttggctgtgaagacggctcggtcaagctgttcagtaccgcggatcagggcttcgagttcagccgggccttgccgaccgtgaactctcggatcctctccatggcctggcaagccccgccgtctcccagggactcccccagcctctttgttggcgctgtggacgggacgattcgccacctggatgcccggacaggccacagcgcgtaccggatgacggtggaggccaagaacagtgcgcacccgcccctggtctggtccctgctggcactttccgacgggaccctc

SEQ ID NO: 5514 - DNA, 700 bp, Nannochloropsis_gaditana
gtcccggggtgttggtataggtcgttcaggacggtgggtgacaggcctaggccgggcggcgggtttggacaggggactctctctctagtcttggcgagggcgggaaggcgggcgacgcctccctcttcccgggctttcgggggactctgaggcggtcatgccacgggtttggggggcaatagtgatggtgaatgacgggaggatgactggagatgtaggttcccttggtgggcacttttgtgggtacgctcgaagtcgatctctagatgtaacctccatcttcttgatgccgccctgcttgcttctttctgcagcttgacctttattggaaatggtattctgatttggaagaaacagtcatgacagggagaatgtatatggatacacatcttgattcaaatgcttgaaggcacgactggtcgttcgtatggtacttcttgtttatgcctgtgccagtcctcttgccctcctcggtcagcctttgtcattggacccgtttgtttcgtccgcgaaccacacggatgctgtgatgttataatcacgcagtgccttttctcatgtcttcatgttgattagtcgtacgtaccctgtgataagccctaatcctaacaggttgatttccttatctatcgaccgtacgccctccccacacagcgacctgcctgcggagcacatttgcctgaacgttgctgttctcatg

SEQ ID NO: 5515 - DNA, 700 bp, Nannochloropsis_gaditana
ttcgggtctccgccacgatcgacccgtaaaaggtttatgtcgatcggcatctttcggtcttgatgcccgcccaaacgtctccgtcgcacctggtgccgaggaaaaggtgtcaattgtcataaggctcgatgctcatcttcgctttcctgagccgcgaaggcctcatttccgtcttagcgatgactgcaggtctggcaaaacaacaaaacgcgtgagcaaggcaggcctatgtaagcagcaccctcgctgtgcggtattgattttctacgtgcacatgcatggtcgcatggttttttagcttgctgcctcggcagccccgacagggcatctgtctcatggccgttgcctccgggagttgacaagagtgactgcagtcccctgcagtgacaggcactgtgacacaactgacctacactttccctatctacacgaaaatccaacgtgagatcacgcggttaagcctttgtccacaccgccggacagtctctttgtttgcttacagctgtattggcggtcttgcttggctgcgttttcatcagcaagcgcttttgccgaagtacgacctcctcaagctcaactttaccatcttccaaatcaaaccacccaacagacaaatacgccgataactatgcagagaagaagacaagagagaattattatgataatatcctacataagtgttcttggcgtggccttcatg

SEQ ID NO: 5516 - DNA, 297 bp, Nannochloropsis_gaditana
tggagaactgaagagaatgcgattcacttggagggctcatgaaatgtttgctgtttttgtatccatctctttcattcacaatgagattgtcgattctataatatctgtaagtcttggtcacaaaaagtcgcacggaacaaagagctactttctaatccaatgggtactatcgaattctgaataagatattctacacaatttctcataccgaaaccaatgcattcacgcaatatatgtggtttctcaattttttttcgggagatagaaaggaagaaagcgttcattattactacaatg

SEQ ID NO: 5517 - DNA, 700 bp, Nannochloropsis_gaditana
cgaattagccgatggcaatcggagctcggagactccgggaagataagcaggctgaagacggtaatctaaaaatttcataagcgggtgggcctcggagagaataccgcgttgcactagatgggagctcgcgcaaaaggctttatcgcgttcttggcatgtgaagggcctgtcctgtgccagaatcaagaattcttctaatgccgccaccgcctcctcctcagagtccacccgttctagtaagtttaacaatgccctgaaactctgagtcatggcccgtcggagctaataagtagacgaaggagcttaattgggatcaccaaagtccactcgtttacaatggccccacaaattcagctttcctcccatcttgaaacccgtcgcacccacaaaattttacctgtgcgtggttgcttcagaacctttacttgatgataagggcaaggacatgatcagaatcaggcttgtattaagtgaacaaagcggtcacccttccaagcctggccttggcgatggtagcattcccgcgggccgccgctcctcttatatcacagcacctgaatattttctggattccctcccacgaatcacgcattccaaagcgaaacctttccaaaaaacaaatcaggctccgaggggcgagcagtaaagacccaaagagcgtgtggggcgctataggaacgtacagccgtcccggccaatg

SEQ ID NO: 5518 - DNA, 700 bp, Nannochloropsis_gaditana
tacaccttctcgctcttttctggaaaaggttgtgacattttgcctgtgcagtggccggtcgagcgggaatgaagtgcttgggcgaggtaaagccttccctctcgcggacaccaactgccgcggaataagaaacccgtcacatgaaaagacttcaggagtatcttctcttttttcttcttcgcgggaaaccgttttctccaacgaagcatactggtgcccaagaattgaaatatccactaagtgcttttgtaaaacctcaaggcgatgagcgtctggaagtcagacggtcgttttctcttgttcccgctgcacgttatgtctcctccccgagacagaatatcaccaagaaaggaggaaagagaagaagcgacatttcttgtcagcacggccgcagaatcttccatgccactcaattgaaattgtttgttgtataggagcgactaaagcatagtagggaggcgaatcatatgggcttgcaatgttatcagcttgtttcgtcggaagtctaccaggacatctactagtatagatcatcaccgagacgacacgggttggaggtctcctttgggaaccctgcagtctggcatgaagggatattcaccgctatgaggaggcagcatgacgcttcatttttaagacctcttctaggccttttgcatgcacactgtgaaaaagtatactaggaattttcccacgtatg

SEQ ID NO: 5519 - DNA, 700 bp, Nannochloropsis_gaditana
ccaacatcttgaggaccgagcccctctctactccccttccatctcatcctcttgcgtgtcgtgctgccgttcccctccgatacctctttcatcgtgctttatctccggtcgtactctatcctcttgctttcccgtccatttgcagagtcaggggaccttcaatcgagcacttttccaggctttccagtgccagcctgagggaggcagcttcacgatcgacctgcacctcctcctcgaatgccttcaggtttttggcgccgcctcccttaccaacaccatgcttaccatgtcgtacgaggtaagagggcggtaaatgtatgtatatttggcggcgttcagtaaaaatgatggccagaccagtagatgctgagacctcctcatgcctagtattgtcctcatttaaatagccgcgaaaggctgctcttcgcctcaccttagaagaacaaggagtcctgaccacttgcgaggtccgggctctcgaagcaggcgaagatgcctttgacttggcggccctggcctccgcctttcgcagtcgcccagaggtccttcgcgccatcctaaagagcgacgtcctgaaagaagccatctccgagctttccgatctgcccggagcgggctctgtccgtgtttccgtcgcaccgcatgagccgactttccatctggcgaccaatgggatctgtggaggcctggagatattctt

SEQ ID NO: 5520 - DNA, 700 bp, Nannochloropsis_gaditana
gtatttattcttttcatctcgtacttgctggtgacgcaaaagattaaatgtcaaatttctttctacgcaatcattttctgaattacgccaccgccatggcaaaatgaattacaattaagcaggtcaaaaaaggagccaggcaatgattagagatcaaggggagctaaaagtcgacacgggcaaggttgcattatgtcaaagctcttacactcaagtgggaacgaacaaaggtcatgagacgagctttgcgagggttaaaaaggtggcggcaattgggatctcagaaacatagcatgagaggaggttatctcccaatagccaacgtatttatggcttgatgccatccattcaagctgtaatctctccttgtgcctatgatttctctatttttgaatcgtttccgggaagacctcaagcagaagaaatggaagaattgactcaaatccgtcatacgtaaataacaattttatcggactccaattcacccgttgaacgttgaagtttaggtgctgctgatgacgacaccacgctctgaagacaaattcaaatttattgtcatcaaatagctttcaaagtagtttatggcgccctaaaaaagggttgaatgatccaaagaagctatcccatgtagttctttgacgtatattaaagatttgtagaattttgtacctcacatttcattggccttgcgacagggatg

SEQ ID NO: 5521 - DNA, 700 bp, Nannochloropsis_gaditana
agaaagggaagagaagctttggttgtgtcctacgtgagccaaatgggaaaactggttgaagccgagcggtcaaagacgagatggatcgcgggtaagaaaatttattccggcacgaaaattagaatattgttcgacataatacgtgcataatagcatcagtatcaccgctcacttcagagagaagggaagatccaagtaagcagaaggagcgcgaaagcatatcatttctcttgtcattggtcatggtcggtcgatctaatttctacgggtttttttaagttctacttattttctcttagaaagcggatgagagcatcgtcttgatgctttgacgctcagagtgtctgtagatctcgtgcttgccactgaaggaatcgttggtgcgagacgccgtatgaacatgagcattgagtgaagcttgagcttctctccagctggaggtccagctaccaagaaagaatacccggacttgctaggtgtcgcccgcagggcatgtaattctaataggagttcacgacacaaagctgccgggaaagtgcagtgtgaggcaggagctgatatctgacgacctatatgttcgtcgacacgctgaacattcgctgcgtaactatcgccccgacatttcacaaacctccacgcccaccacagaaccgcacgtcacactgctgttgagggggctgcgctgcaactgggctgtatg

SEQ ID NO: 5522 - DNA, 700 bp, Nannochloropsis_gaditana
gtgactcagcaggaccggcactggagaaggcacggagaaatctgtacacgtgccaattatgtgccctaatgcttcgtccgcaccgtggtctcggacgtttggtacgcgtcagtgtagccattttttaaaccctttcctctccaacgtcaacgtccccgccattgaagttgaggcgccccttccttcccacctctccctctctgccttgtcccgattcttggcaccgctgtgcgtttttcctcccccatgcttttcgatcgcgtacaacgttgggatggctgtcacggagatggacgggatatgcgtgtgtggacgtgtggaagtctgcgaggacaccggtgtatgagtcagcgagagcgaacaagagcaagcgccgtctgttctggtccgcggggctcctttgtccgccgaggcttgtgcctatgcgggcgcatgccgcaaattgaccgcaatgtaaagcttttcaatgtggatgccaaagcggcctaagtgtgcgggggtagtgcaccgcatcgaattttggggccggtgtagagggcgccggtataaagtctatgcaaagcatctcatccctgttccacccacttctctgttcccaggttcaagaaggttgcctcaacccatcttagcgccacgagaacaccacaaaacaaagaagcggtcttaacacactccctagactactgaaatagtaaatatg

SEQ ID NO: 5523 - DNA, 700 bp, Nannochloropsis_gaditana
ggaccccgcacgtgagtaagccgacgctgtatggagcaaattgctactcgatttttgtgtcttgtagacggatgttcgttttatctccacattccttttatcgtaaaggagatgaatcccacttagtggatggacctgcggaagtgtgaaactgttccccatgtttgtggcatacatttccaagacttcatggctatgatgttccgacacagacgtccacgtcagcaagatgcgaaagacatgttttcactccctgtcgtctgcacacatcttatgcggcttcatacattgaccactgtttttaataagggctcacatgccatattgcgtaaaaagtgaacagaaaatagcaggcctctctctcacaaacagctcgatcgctcacatcggcacaggcaaaggcgcgacgaccgtcagctcggtgaagcgatccgccagtcccaccggtatctctcaccttagtcaagaagcaggcaaggtcaagactattcgagatgccatccgtgccgaggataaacgcctccgtgcagcttaccccttccccttgggtgagcactggcaaagcgttgtgggcctagccatttacgtggggtcgtgggtagtctggggggtagccacgtacgcgtggtggacgggagggttgagcctacctgtgttgatggtcgtgaatgccttggctatctccctcttgcatgagatg

SEQ ID NO: 5524 - DNA, 700 bp, Nannochloropsis_gaditana
cgtgcgcgcttttcgttttccgccttattcctctctttcccccttgccctctcgaaagcgagcgaaagtccccgcatacacacgccgcgtgagccatttgtgcggcacgcgtgctctagcgcgatgtagctgtcctcgcgggaaatgtgcacgtcgtttccgagttgatcgtgtgctttgccgggtcgtgtcgcgtttttacctcctccccgctacaaccgctcttatgtggtttctttttccctcctttttctataggaacaaatggcttcctcttccaccaccgcccacgcagcttcgtctgctgtcggtgacaaaaaggatactccacaagaaagattggcggccatgctggaagaccctcggtataaacaaggagtggctttgtgcaaacgaggacagtttgacgaagcgcttgagttcctaggctcctgcgttgcccttgctgccagcgaggatgatgtgtctctcgccgcggctcctgtgtattttgcatatggtgatgccctccttagtaaggcggaagagtccgttgacttgtttggagctgccatgactgccgcgaaggagaaggtgggagaggaggaggaaggcgaggaagaggcggaggaggaatgtgaaggtcatgggtcaacctcggatgcggcggccgcatcgtcaagtaatgtggctaacaacagtaaaaatggtgtggcaatgg

SEQ ID NO: 5525 - DNA, 700 bp, Nannochloropsis_gaditana
tctctaagggatatcttcacctccccgcggcctcgtcctgtgcttttcgatggcagacgatgggaaaactgtcggagaccacgtcttggtcatcctcttcctgcttcttgtgttgctcgtgggctggacatactggtttcgttctcgtccccgcacatccgaagtggacttcgaggtgtgtatcgggattattgagctgggcgtgggagggttagccagcaaaaagcgtctgaatgcctcaagcatgttagcttctgtaggacttcacatcaccttctggctttgaaaatgggtgtttacacattcaaattagtcactcatccaagttacatcccgcataccatagagagaaggcgatcaaaagacgagaataagacatgaacgaaatatttaagctccgaccgcacaacgagacaaaagtatttaacaatgctgaaatgtgaatcgaagcaaggagagacgcaggggtgagaatagatggtttaacaaaggtgaagtccgatggatcgcagggtgaaatgggtgcgtaggggaaaatgaaagggggaaagggggggaggaggaaaaagagtgttccaaacatacatgcgacatggaccttctcgaaatatttgtgtgatgacgtcggattggaataaattgatatataggcattcaatggcaaccgatgtacaatcgaaacaatcctataatcacagaa

SEQ ID NO: 5526 - DNA, 700 bp, Nannochloropsis_gaditana
atctttgacgtaattgcatgcgcccccgaacaagtgctggtacgcctacaatctacatttacatccatctcctccggcttgtccccaagtctttgaaatctttttcgatcgctttctgactgcaatggcttgcagtgtataggtcccagtacagaagagtcgaaaggctctcccggatacacggttaggactgttataatgatgaggccgatggccacgccagcctatttcaaacataaggcgtgtttgaggataaggactgctaagggatgccatttttaaaaagatggctcagaagagcaaattttcttaccagtacaaagcctagcagctcgtgagtgcgcggatgttgcgtgatatactcgcaggacgggaagtcgaaattgaagaggggcggaacattacgggtcatgttgataaagtgagtcggcgctcttaaaagagagtgcgcaggagcgaacgtggcttcgaccgttgtaggcgttctgtcagttcttatgtcaatgatgacgggtatgcctgtatataagaaccaggcaggcgagcttttcattggtcaggttatactattcgtcctttcttttcgccttatgagccgtcgttcgccaagcgagcgaacgagcagcggccctctcgccaaccaacgtgacctgaaatccaaaaaccttacacttaatgaatagacacgcttcggacacag

SEQ ID NO: 5527 - DNA, 700 bp, Nannochloropsis_gaditana
gtccaagaggtgtgaaggaggagtaccgccgtggtcgtggtcaccaagacagaagagcctggtctccgccgccgcctagattctaccatagcttccctccctaatgatgtgttgaatggtaatggaggatggttggtcttaagaaaataggggggctgtgttcgccttacaacccgcgtcacaggcttgaacgacgtccgaccacgctgaatcagccactcaaaacaccagacacaaaaaatccatcacaacaaaatgcgactatgcacgatacgctcctaccatgccatcggtgccatggacgcgtcgcatccaggtcggtaattggatcttattccctgctctcaggagctagacgcgcaataggatatcacgccttttccacgcagagccgctctcgcgtttgagcccccccgccctgcgacaaccctgtccacgaccacaacaacacgctccctccatatcgcatgggcagggtggtggggagatgtggtgcttttcattcgtgcgccgatgtgcgcctgatcgttctttgcttcgatgttcggggccgcatggaccattcagtaggcattttctcaccacccacgtcccacatcgagccagactctgagtagtatccgccgggcccccgcccattctactcctctcgtataagcacttctcatagcacccgcacacaatcacgaacagcaacatg

SEQ ID NO: 5528 - DNA, 700 bp, Nannochloropsis_gaditana
aatgtgcttgcctttgtaaacttgggagcacgacaatgtgatcttatcacggcttacgacaactaaagaatttaggaagtcaagagacatatgtagaatgctttattgcaccccgcttacacgacgacacctattataacagcatacttgacgctgacttcatatggagaaaaatccgcctagaagaatggcagttttgcgaagattgggctgggccgctggactagttatagctctgaatgacgtgccgtctgtccgagctctaagtggcatgggcggaagcgcggctcttggaatggctatttctgccgccggagacaaaataagtctacgaaaagcagcaggtttagataaaattgacgtgtcatctgtcgtggagacaccggactctccctacgcaacttttaatgaagtgatgcaaatgtcctctttcgttgctgccttggaatcattaacagcgaatgaagaactcaaaaagcaggcagaagcctatttatccgcatcagagtatgcagcatacgtcgacctggcacgccatctctcaaaatgctacggatcgctgtcgcctgccggaggccctttggctgatacttggacctcgggtgtgagaagcactactcagggacaggccgccgttttagcggtggatggttcagttaataaactgtcaaccacacctgttcgaaagcagcaagccatg

SEQ ID NO: 5529 - DNA, 700 bp, Nannochloropsis_gaditana
gcatctgtgccgcatcccaattcgagaggcttgggacgtcagatactgcccctgaataatcttgcaggaggttgataatgttgtccgccaaatccatgccttgggattggtgttgcaagcccagcgcgaatgcaattgccatgatggcgaagatgactacgaaaggtgcagaagtccaaagtttaaaaaaggaagaaggggccgtgttgtcggtcgggcgtgtgttttcctcgcgctctccgctatgaccagagtcaggaattatgcccttgttggtcgtctttctaggagaggacattgaggaggatttgcctttgcggcgagtcgtcattgccgtttgctgtaaaaagagatgtattgtggaggtgatatgctatgtgacaagagggagacatgtgttggagcgagtacttcccggacgcataacaccaaacaagtcgaccatcgccccaagtcaatgcactcacatttcccacatatgcttgcacgaccccacttcaaaaaaatggagggttatcaagtttacatatgtccaaatggacatattcttggagcgaatgcgcagaacaaggggttatgcttcgcttgacaaatttaaattcaatggatcggatcgctcctgtgcggtgctgcttgacgttcgcatggtccacccggccgtattccaactaattccgtatccattgttcttacagagatg

SEQ ID NO: 5530 - DNA, 700 bp, Nannochloropsis_gaditana
ggttcgattcaatgaaacccattccgcccatgtctgccgccaggttgtacacatggtggcaacctttggaggccttgatacagttctcaagctcacgaaggtcaaccaaaaagaattcatcgcagaactcgggttcggccatgaactcgttcttcttccaatccgcgactaccacatagttgccgtccttcttgaggcgcctggccaagtgtgagccaataaatccgccaccccctgctacgaggactttcttgccagtgaccaaaggggctgggccgctcataatttgatttctgtgtgtcgctatgaggttgcagtgatgttagatttgaatctgggcggataccggctgtcccttaaaaaggtgttcctacacttaaccacaggtcgcacgaaaatttacgcattgcgacattgacttctcattacatagaagcgtttgtcaccaccgaatgacggcctaacacaaagaaacagaacccggacgcccgacgcgcgaacaattctgcccgcttgattgttttctttgttgtaggaaaccatcatcatgatgggccatgggaagtgcctcgaacgcgtcgctgctttgttattagcgactgagttgttcggaatacctggccgtagacacagtgcgtgcccacaacatgtgcgaaatgtgttcggagagagtcgtacgtgcacatgcaagcttagaatg

SEQ ID NO: 5531 - DNA, 27 bp, Nannochloropsis_gaditana
ctgattctccactctgatcaagctatg

SEQ ID NO: 5532 - DNA, 700 bp, Nannochloropsis_gaditana
ttcacacccgggggccctttctcttccatcggcgtcgtccaccaaccattcaacctgccttcgtgctcacatggactggtttgatgggtttctagatggacagcaggcccttccaaaggttttgcgtctggtgtcgccagaaaaagtgcaagccggctgtaaattgaaattagcgactggtcttgtcccctgtgggtgcccgcttctggttacacccctgtcctgaagcagagacttgcgtcttcgcatcttcccagggtcttgaggccttataggatagaatgtgactgaggatgggaattgtgccgtggatgtggaggagacagtgcccagtgatttgatagccattttatcccatttgaatatgaactggcggggaacagcggcttgatactcgctttcacttagtaaagatagctaattcaacccaacatgatcggtacctttcattgacatattcacagtccatcaagaacgtgggtgggctggcgggtggccagcatcagggtttcggctggttgcaacctctcgaggcagaggaaagcgttcacgttcgcagtcaaacatgatcactgcagtggaggaggaaagcgccacgccgggtgtttctgcgtcagcggaactggcaaagcgaacaaaatggctcatgggtggactgggcgccctcgtgatcttgggtggggctgtaggggcgggcatg

SEQ ID NO: 5533 - DNA, 700 bp, Nannochloropsis_gaditana
ggggcttagggtcatgggtttcgagggcccttcatctaggtatgcgtatgtcgtgaaaagcgcgcctgtcaaaatatcgaaccacggcttggtaagcaaggacaaggccaaaaaccacgtcagagtgagcaggatcaaaggcagccgcacggcgatgaggacaatggctaggaggccggatgccaccttggacggtaaggaggaggcagcgcgacgttggggcaaaaatgggtttattcccgtgcccttgtcggcccacttggtaaatttctgtccatttcatgtgatttttggaattggaggaggaggaaggaatgaaggagaaaagatgaaaaaaatagcaacgcgtatgtctcctgagcgcagtcacttacctccattgagggattatccgcggttgcttcgaaatttctttgtgtatattgctgtgttctcgctcctgccacagtgctgtgtaagtcttgaaacccggcggaagtctgcgagacaggaataaagctcgtaaaaagaaatattcgtggtcgatagtccaatcgcttttttccacctcccactaggcaggcggcacaggagctgccacactcattccttccatgagattttcatgccatcatggaaactatgtgtacctgacgattccaccgcacacaatgtcatcatctacaccacatccagatccttgctgttgccttctttcatg

SEQ ID NO: 5534 - DNA, 700 bp, Nannochloropsis_gaditana
gcgggaccgacaaatgacgtgcaaggaggcctactttacctggctgcatgcctgcaataagcatccgccatggcctgcaggaactgtggaggtagtcaaggcttgttatgcaagggtccaacgatgtgttaattctgcacgaagagatcgatcggggtcgctgaagcacaggacacgaacaaaaagcggcgaggatgcggtatccgagaacctcgccaccacgacttttcccaatcatccagctcgcgccctttaagttagcggccagcccatcgcgacaccatcaggaccattgtggtacctccggttctttttgggcatgtcatatggagctctctcccctgacacgcgtgcacacggacattcggggccccaactcgcgacacgggcgcttaaagattcaggggccttggatacttttcctaacgccgactgccacttgcaaaaccccgcgttgtatccaggcctgccgtgtgcaaccccccccccgccactcgatttgtggattttaaggtcatggaaaacctgcgtgaacgcaagaaacatttcaagctcataatgagacgctttactaatcattgatctggccttgtccggggaaatttcatgtcctttagatcttctcactgcctccttcttgttctccacacaagcccaacgctagcaaacaacaggaagacttttcgtcaatttcaaaatg

SEQ ID NO: 5535 - DNA, 700 bp, Nannochloropsis_gaditana
acagcagggttatttatgcggggcgtaatggaggggggcgatgggaaaattggggaccttgaaggtttttccacgtgtcacatactgagtatatgtctccatgtctaaatatgaacaaaaggaacttattcctttcattaattataaaagtcatgtggaaggacgaatttcgtcttctcgcttagtatgatcccacaaacattcttggtgttttataatagataacgatcagagctacaagattgccaatgagctatcctcattactgctctttttttattgtggatcataacttacagattttctcctcgatatgtcacaaatcacggggaatggcacaggtccagatcgtgaaaacctttagccagttgttgcaaggaatataagtgcctcttcatttcacttactagttgtaaagaccaagtctactaatagagccatcacaaccataaatttgctaccaaaaatctagtgcgttctacgaaaggttccgtggaatttgcttctcgccctcgagcctagttgtcggcccatttccacgcgtagctgccgtctgttgttttcgcgcgcttttcccgaatgcccgcgagttcattccaagccaaccaaccaccgcccttccacgtacgtttccacacgcttagaaacttccatccatgcctcgttatttgatgcaattccttcctttttcacagagatg

SEQ ID NO: 5536 - DNA, 700 bp, Nannochloropsis_gaditana
cggaccgtggaattcctaagatgtcgacgggactggcctcggcgcttattgctatgactgccaccaaagtataaacggggagcgtccagagtatcatcataatctatgacattatgtgtgcacgaattaggcaagctttgttcgggctattggttgagcggcagcttttttttggtgaagtagctctcgccgccagaatgacaacaaggcttgctgagttgcggacactcagcaagccttaccgaatgagacgtgacacacgacatccattgcctgggtcaccgttgaagcttttttgggactgccttttcatatatattgcccttggcatgtttgccataatcgccttttcccctctttatcccttccattccccttgaggtctttttagcgaggacgattgccaggcgaaaacgcgcgaatgacggggaagatcgcatgcttagaagccgttacgcccgcttgactaggcgaatggtagcattttacaatccattcattcgctcctgtggtacgctgatgctacagctggctgtatcatacatgaagataaataaaaatttaaagctggcatttcaaaacgctaggaccttataagaaaccttctttgtcatctacattcataagtttccctcggcagattcgatataacgccaccgcacgcagcaccccactggtaagagagactgtgatattcatg

SEQ ID NO: 5537 - DNA, 700 bp, Nannochloropsis_gaditana
gtagtagacgaagactacgacggccacaaacaggagaaaagctcccaccaattgatcttcctgtgacggaattaagaacccatgaatatctcggtatctgcagttggagaaatttcgaactgtcaggcaactcacccccattcacggcacaccgggtcctgattttgtcttgttcggctttcgcgtcgctcgttgcaactcgataggcgctacttcctgccgggggagttgaggagtccttgaagtcagggggaagggcacaaatacattcccgccaacctcccactcgtgctggcatgtgcatacccatcgtaaaatgttgtcttccatgccatgtcttgcaccggtggggagccccgggacgccacgcgtgtgcatctaacatgccaggcaggggggagtcggcgattggaagatagatccaggctcgcgtgccgtctgctccatcacgcgcttgggctgcgtccattttaaccacggacaaaggtgccgaggccttgccgggcacagaggcagattaattacaaagcaaaatacaacttgaagcggtttattacatcgagaagcgactttcggtgcctcacggctcgactggcgtcgcaggcacgcagatcgtagtcagaccccccgcacagagggaaaagccgtcctgcgcttcgacatagttttctccttcctaacctaagaatcaccacccatg

SEQ ID NO: 5538 - DNA, 700 bp, Nannochloropsis_gaditana
ttaaaaaggaagagaaccgtcataaaaggtgtttagaacacatgtagtctgtcctcccccttcctctcgaaagagtcggtttggcaattgaaaagtaaaccatcctcggccaagcacatttacataccttgattggccaccaccctagaagaggaaaggttgcgatacccccctggattttgccggtgcccccgcagcctctatttaaataggccccgtcacacttcggaaagtttttgcagggaccagcagacttgatgacagtgtctgattctgccgaggaggtgtcactggacactgtcgaagaggaagcggccttttctagggcgtcggtgctcatgaaaaggatggagtgcgttctccttctcacgacaacttcaggagagggcttcgtacaaacaatgaaggcctccgatagcagcatgctagccagcaatgagataaccgcaagcaatgaaagcgtatacatgggccgtatagggaaaggttgacgtgctgtactctttagtatcacagcgtaggggaggggggagaggaggtcggagcgtctccggctgggctctgtttcattcatgacgacacgaactaggtgagaaggcatgtctagctgtttagtactatcagggaatcacatattaaggttcaaggtctgtttgtgtgacgcgcctttccgtagaagttctggttgtgaacaaagact

SEQ ID NO: 5539 - DNA, 700 bp, Nannochloropsis_gaditana
gtcgtcaaggagtaatgtcttggcagcgcgagccgcgaagtagacaacagttcggtcatgacttggtagcaatcggcacaatgcgtgggccatgggagcgaaggagatcatcggaaagaatgcatttcctcctattagcgtgttgagatccgttgctgccttttgctgatctgctacatcttgtgagtgagctaagcttacgatgcgcttcacccgaatcatggagtgcggctgcttccgaccttgaacaggtaatacatcctccagttcggccacaaaagtggcgttagccattagcctagttgttgtttcacaggtcagttccataagctccatcgaatggattgtttactcctacaatttgttgtatgattttccatttcacggcccattcgaaccgttacggagagagccgacaggccgatcgtcctgcctctctgacctcctgagtcgcccttttgacctccacactatgattaacgtgactatttactataattatcacagttctggcctcatttcctgcgtctacctccttcgcttattccaccatcacatgcgtcggtctctcccggcatatttgtcgtacttactattgctcggcccgtgttgctccccaacagtaagcttcaatttagcgcctcaattctccatcttcaagcacctacacccgccattgcggacatccactatcaaaatg

SEQ ID NO: 5540 - DNA, 700 bp, Nannochloropsis_gaditana
cgggcgagactccaaaaggtgacgggcaggtggaacaaagtgaggtccggcgatgcactgcccctctcgtcgcgagcagattgccacctgaccgtcgtagatctatgcaggaaccatcatgcttcccatgagtccggtaaacatcctgtactgacctgtgtgtggattcgggacaagtgcaggaaagggtccatggctggttcacttttttttgggtgtgtaaagggaaaggtggagtggctatcaaatagcgatctcgccagcgtctgtcctctgactcgttcctgatagaagcgtggacaattagggcactcggtcgcctgcaacgatacggtgcaataacagatgaacagattgccgcaacttgatttttgctcacacgcgagacgggccgatattcgtgtttttacatgcaaggaagggggaggggaagtagctgaggaagaggggatcgaaaaagctgacgacgcgaagagatgttgtggtctgactgagttgatccacgttgagccgatcaaaagtgttccacgttttatgaaagacttttattatcacgtgttgcactgtcagtttggcataaaagcagggagtgtccattcttttggctaacatcctccccctacaccctccttacgtcaccgtttttccatagactcaccccttcacccagacgtgcgtcctcgcgttaagaagaaccatg

SEQ ID NO: 5541 - DNA, 700 bp, Nannochloropsis_gaditana
ggaagcaggaggcgttgcagagagaaggacgacaacgtcacgtggacttgcggcctgagcgcaacgcgatcacacaaatcgcacggcagatagggtaggtggaaaaggcatgggtaaagaacggataggaggcagtgctcagaaagatttacgggtgcaaaagcaatcaggcgtagtgtctcctttccctcaggcgtggctcaccctcggaggggcctttcgttgcatgcctgtccgggatcgaattggccgaccacagggtgacattaaagaggaaatgcttccaaatgaatccgtaacttttgatccgccgcattgtcatatacccccccgcaacgccatccttacccccggccctcccccccaggcaggaggccacggtcctgtgcttcgacgagtttcaggtgacggacgttgcggatgccataatcatgagccgtctatttgccgaactctggcaggggagcggggtggtggtggtggccacctcgaataggcccccggaagacctgtacttgggaggcctgaatcgaccttacttcctccccttcatagacctgctcaggcggcagtgccgggtggagtccatggagtcggagagggatcaccgccgaggctttgcctggcagcaagggaagtatttcacccctactgtccacgagggggtctcagaggcgaagaggagagttggagaggggga

SEQ ID NO: 5542 - DNA, 700 bp, Nannochloropsis_gaditana
aatggtcaaaaatgtgaaggtgatttttcccctcagttctgcatccgaggccttcaagcatgattcctcctccagctcacgcaaagcagccgctttaatcgtctcattagtctccaccttgcctccaaaaccattccattttccttgcccgaatcctctctttttcattccgaggagtacttctttgacattcgttgttgggtttgcccgcctcacgaagagcaaggtcaaaagcttggtctttaaagtcggctgagggacactagagcttgctttcattcttctttctgctttcaacgtcgtggcaaaggtacttttggtcggcaaaggactgtaatacacgaaagactgccgtggtgacgctttgttgtggaaaagggccacggagcttccacaggcagaaacagcggaggcagcagaaataacagcaactgcggcggtagcagatgaaaaaagacacgggaccaaagagaagattgttctatcccgcatgccctgtgtttttaaatatgaacgccttgggtattgaggtacgatatatgcaacgtattgaacatcagcagcgctcaacatgggcgataagacaaagagatcgtaatgccattcaccatcattggtggttgtccgtcatcttttccgtcttcaacgcctgggcattcaagcaaagtataagcggtcatgaatacccccatcgatcatg

SEQ ID NO: 5543 - DNA, 700 bp, Nannochloropsis_gaditana
atagagcactcctttacgccaggctgttccaagtcccgacttctagcaacaatgctcaagcgaagatatcgccatgcaattgaacggataggacgggaggtgtaaaaacaggcgatgtcatctaccgcaaagacactgtccacccacggagatggattctggggtggtgtcaagacacttggctcggatatcgaagcgctttcatcgcgtcggtaaaattgacccttaaatgggtgagtctgaaggctgaggtcgaccatgggaggcaagaagcgacatatcagtcccccgctttcttcatcgtagaataagcctgctccatgcggcgtgagaagcgccactgccccagtatccccgtgcattaccaaagtccataagcaccaagcacgatcgcggtcacctgacaagtacaagtggttttggtcatcgacacataaatattggtttgaattgacgttcttcagaaaaatatcgaagcagtcgtgacaccaagggtaagcacaagatgtggggcccgcagactcgttcacgtgagggttcctgctgaagtcattctcatcaaacatgacgttttcatgaccacttgcatctatcaattcaacagtccattgttcgtcctcgtaaggtcgaatggccgggcaagaggctgcgcggggcttcttgcacacgtagcaattcgcgcgttcttcatcgtcacatg

SEQ ID NO: 5544 - DNA, 700 bp, Nannochloropsis_gaditana
ggagaaacataagcgtgaccatccatgcgcgtgcaggaagctatttggtctctataccgggatcttttgacccacacgtgaattggcagtcaaagatgtgcccggcggccaccccgaatcttgacaggaatttgagttgatcgttggcatgaacggtcagatgagattgaagcaaagaaaacgctgggcatcggcgaagaggatagcgaagagcaatcgggtccttgttggtcttattcacttctttgagatatttttactgattggatcccttcagtggcttttcctggccgtattagagacatattcagatttagcgaagccgcatttatgaaatattcgactatcccccacccaccacatgcccattccttgtgcccgtgagccacagggtctatcaagagtaacggcggttaaagctttcctcgagatgttgagataggtgacttttaatccgatgaactgcctttgggacctcttgcagtcgtgaatatgtgttgaacgctacaccaataaataagcaaggtaaaagtattagtctcatccattctttaagcatgaattttctcctgcttccatgcgtgaaaacggtcgtcatcgaggtcttgctttggctataaccgatgagtaatcatgcaatatacgtacaattacatttattcgttcagctgcaggggagataggaataaaagctgtgatg

SEQ ID NO: 5545 - DNA, 700 bp, Nannochloropsis_gaditana
cggaccccatttctggtcattacatcgggcgcagggaagcttcctggcctcggcggctacgagggccggggcgagatcccgcgaggggcatccgctcgtccggtgtagcaacttttgtgtgcgagcatcgcgaccgtcgcctggcagtctgctcacatgaccatgaacctccagggcggagtatcgcacacagacagggaccgtggacgaggaagggaagggggcggtgaagtgccaagactcgtcttttcgcccttagcccgctcttgaacaaagtagtacttgtgctgcatagcgcccgctcgataggctgagtttcctgaggaattgaggtaaatttggcttctatatttgcatactatttctgcatgttatctttcatttctctgtgtcttgcttgctggctgactgtggatttggtgtcatccctaattcgatcgagtaggactcgtggcggatatgagtgtctgtacctcccggttgagatgtctcttttccgatcatacattgttggtgacgcctaacctgacttcaaaagacattatcaattgcttttttaaagctggaattatcaagtgactgaagagttggagagagatgcctcttacccgttgatcatgccaagaaaatttccacacgttccatctctcgacgatcacacttcaggacagaaagttttccacttagcttgccgaacatg

SEQ ID NO: 5546 - DNA, 700 bp, Nannochloropsis_gaditana
gagtcagttttcctgcgcaatagtcaacaagatcaaccagggcgtccccggcggcctcgcaggctttgagatggtagagcaagacttggaggaggtttaccagggtggcctcatggaataagacaaagtatgcccgcgtacttgccccgcgggcgaccacctgggagatgagtcgtggccacactttgtctttccaaacatccagtaagatcaattcatgaagcaggcatgtaattttgtcgtgggcggtaaatgcctctacgatgaactcgccgtcgcggctgtcagggcagcgggcagactgatgcgcctgggcgttcaagcgctccaaggcctgatgctggcgcagccacgtagatgatccgacctcctgcaaagtaaaaacacgcaggttacttaccaactcgtccgcttcacgaactgatagaagagcggagattgtgacaggggtatcctgctcttgtatcggtaagctagtaccgattgtggcctggaccgttcctccggatttgctgctggcgctatgtgactcgtgtcccaatttggcacgtggctttttggacgatgactgcggagacgacgcggacaggaattgagaggacaattgcgtggaaagttcttcgatcacaaccatagtctattcgaggctgtattgaatgtaagaaaaatgaagaagaaaaaaatgggaaagaaaaacatg

SEQ ID NO: 5547 - DNA, 700 bp, Nannochloropsis_gaditana
gaggaggtgagcattcaaggttaatgctggggcccatgggccaccctgtactgcaacatcggccaaggacgattaaaaaagacacgcagacgacaattcattgactatacccacgtataccaaccatgcggagatgatgacgagcaaaacgcgagcccatcgagcgtctgcacggcataccgggggggagggagggagggagggagggggggagggctacggccggcgcggtttcagcgacgccctagagaaggcggaggactgaggtggcggctgattcgtgtgcttgcgtctggtaaagcatggacggacgaccacgtcaggatgggcgtggtgcatgcgcatagatctgtgtcatttttcacccgaggacgtgatgcctgggatgtttagcaggaagagtgcgacgaccgcaaaagaagaggctggaacaagcgccttcaagctcagagcacctcaacctctttcagcctcaatgctcgcacttgcttcgtgaacctggggagtgcgttcccatagtacctcattatgtcaggacttatttttgagcgtagccttgagattgtttgtgaatattgcaagattccaacgtccttttgtacatcaatcctttgattctcttacgccaccagctcttcaggaaaaaacttcaaaaccacccagtacaacacttccatacatttttggacgttcttccatg

SEQ ID NO: 5548 - DNA, 700 bp, Nannochloropsis_gaditana
gatgctgaagtgagcgatcatgtacccaaagttgttctagcaggagacttgaaacatagctcatacaggtcttctacggtggcttcaggctcccttgccgattcctcgttcttttggtcacagctgagctagaatagctagaatggaaatgccttgattaaagatttctcaccctctaatgaagactactcaatgttaaccccatccctgattccggatgcctaggccaaattctttggctggtcacgatttcacacaacctcctcgatcgacacaaacatggcgacatgattttataaaatgaatataagcgtatttttaaaaagaactccgtcgctccctgaaacaccgacacttgacaagtgtttggctccctatactggtgtcattattcccctccacaaaaatgttcacgaaaatgttcaagttaagtgagtgtgatagttcctgtcgagacgatctttcgtaaatttttcaaataaaatctattgcactcaataattaataaaatgagccacgaaaatggatgcacggcgcctgttttgtatggtgtggatacataccaataacctcctgcctcagctccctcgtcgctgcttcaaacaggatgcttggcagcgatttcttccgtcatatcgaaaatagtcttaactgcaatttttgttgatgtcttttatatgctacagggctccttacgatg

SEQ ID NO: 5549 - DNA, 5 bp, Nannochloropsis_gaditana
ggggt

SEQ ID NO: 5550 - DNA, 700 bp, Nannochloropsis_gaditana
caccatggagcctgacccgctgtacacgtcccgccaggccttccgagaggcctccgagctgatagctcgctacagcttcgtcactccagagcggcattggtctctgttgctcaacgcctgggcggcgggagagtcgggcaccgtggtctacatccaaggcatggaacgaggggatccggagggcggtggcgtttggcgtgagctgcgagtggacagggcggaaggcgatctacagctggtgacgcggtacggggaaaaaacatctcaacacccgcggtgccctccttgctcatgacgtgcctattgactattcccttcgagcgtacctccaagtagcctttctgcaacaccgcatgagaatcaccttgttgggaaaagacgttccgacgccagacctcctcgagaccttgctgcacgtacggcgttacaacctgctccaagacgagccaacccgaaaacccgtcatagcctccgtaggtttctcatccgaggcgaagcgattgggcttgggcggggccatgtttttttgcaccaacgttctgatcgcgtcctacgtgcgacaggagatcgggattacaaatccgcgggaggggatgggtgtgctcgccgtcgtgcatttagatccccgccactacgaaacccagcattccaagcaatccttccgtcgccccaacccggccctcgagaaaattgaagagcg

SEQ ID NO: 5551 - DNA, 700 bp, Nannochloropsis_gaditana
ttcgtggcaaggatttcgaaatgaagcgtgcgcaacccgcatgtaccacggaagtcggtcaacacatgcaggcgtgctagtgctggagcacacggtcccggctgcgtgtccaattagggcgcagacggtgttctcttttccctgaccacacagtccgcccagcgtatgcgttgaacctgaccaagatcgtgcacatggtgcggctccgcgtcccttccgtccgccttcatgtcacccccatcgttatcacctcacgccgtgcgtgcacggcggtgtcaacatttcgaggcgcggtcgaagtgtgcacagagacaccgacacaggcaaagtccttcaccctttttttttttcgttttccgcgattgctgttcgtccgttgggattgtcctgaccctctgaagggaatggaaagggggcgcccaagcccctgcaatcacgaggatgcgtgtgctgccagttgtttcatttgcttgctttcaccttttgaaaggggaaggcgccactggggacccttcgttgttcattgtcagacggagagctgcacaagcctccaggaagccgtcctttgacatctctttcatgatgccctaataaagccccttctcctcttcctgtgtccacatccagagttactgaggcccaggtagtatcctatcatcctctatctttcagtctttcctgagcctccgcctccatcatg

SEQ ID NO: 5552 - DNA, 700 bp, Nannochloropsis_gaditana
aggatgcaacgaggcgtgcggcggggcgagcgtgctgtgagtgagaaaatacgatgatacacctcgacccgacatccttgcacttgattcctgcttgaaatcatcgccatcattcgactctttggatgcagtcagcgttagcaaagcctcacgcaggaaaagaaattggcaatgtcgttcacttggaggagatcgtcgcgggaatgtgagggtgtgccaagacctgagccgtgagccttggtaaaatgatggatcaactcctgaccggacaaatgcatccacacccgctgaaataggacatagtatggctgaagctgcgaaaaccattgtgcgccatgggggacggcggcgtttccgggttgtgcggctggttgatgttgactgagacgccgaggctgcaaccctgacattggccatcaaagttcacacacgaagtttacgatcgaagagcatccccactaactccgcgtgtcttcatgaccatgtcatggtcgtctaaattgtatctgttttagggtgttacaatacgtgagtggcatttttttaggttcgtatcctgcgccaggcgctctgccgctcgctcgccttccggtagtttggttatcgccgccacaaattcctcgtttcttatgccaacactggttttgatcgatataaaattttacccacgtcaggacatcaatcgaggcgttggaaaatg

SEQ ID NO: 5553 - DNA, 700 bp, Nannochloropsis_gaditana
gcgggccttgtttgccaattgctgttcccagaggcgacacttctaacctcccaccaagcatttctcgccgtcagaagctttgtgtcgtacaaactgggtggaccttttgacgcatcttcgtgaggattattacatggaagtaacctttacttgtgtcgcgtcacgtgatctctatgcgtacttatccatgcagcagctaatgactgaagtctaaaatagcgagatcgctgcctttcgccatgatcgctcacataatgcccttcaattcttacttacgttatgcccacgcttattccaatgagacagatgatgcctttgtctaccgatgtgtccccgcttaatgttgtgtgtgtgggctctggcattgcatttctttatgcggtgctggtgggactgtggcgttggtgcacatacgaggccaggaccgctgagacttatttgcgtttagcagccttggcggctgcaccattattaccgctgtgcatgttcgtatttacaagccacaaaagtctagaaggctgcaagtggcaccttttgttagcagcattgctgctgggatgggacgcgtacgtgttgcatcgcatttggcgtaacttcgtcgtagggccccgtttccagtccgtggatctgcacggtaaagtcgccatcgtcaccggtgcaaatactggaattggacgggaaacgtcccgttttcttgcgg

SEQ ID NO: 5554 - DNA, 700 bp, Nannochloropsis_gaditana
ttgctgttgttgctcaccctcgtcgccgtcgctttcttcgtctgagcttccaaaaagattttgatagtctagtcgagaggcagccattgtgcagcaccctgatcaaggcggagaaagaaattgaagtttttaaagtgtgatgtcggtgaaccacatctggtacttcggtaggagaaacaggagtacgagtacatgacccgaagcaagaggcacgaggaaagtgagctaatacgggtataatcaggtattggcatatgcccacctgagcggcaagacagagtacggacgcgagagtaaagatttaagaataattaggaagataaaggtaggaaggataactatcctatgaatgtgctttaatgcacgcatgcagttgcctgatatgcaatcatcatttgttcaaaaagcgatagcaggaggttataagaagttgctttagctaaagatgagagcgtgctaaatcctggacgagacattctcaatgcgaagtgctcaaacactagccaagagatgtgatttgaggacttttaatcgttgttaggttgattctcccggccatcttttcttgctttttctctctccgtggtgcccgatgcaacttgacgggctgtgggaaagtctaaggactgccgactgacactacgaaacccagactatctatggttaccttgaagaatgttaaaggctttgcagatctatg

SEQ ID NO: 5555 - DNA, 700 bp, Nannochloropsis_gaditana
ctgcatgagttgatggcacacatttgagcgcttgaacggatgttctgggcctcgttgttaccgtaaaggctaaaggagtactgcgggtggtcaggggccctgctcatcatcatgcgcaaagggtcgttcatggccttggaccacagccatcctgtgctttgatttctcccgtcccgttgtcttcttgcacaagctcctctcagccctgatttattttttattcacagggcacttgccccgtttgccttcaggttgccttgttcagtgcggttgcaacgtgggcaagagtatcgaaggccgaggccctgcttgtcagcgccccttcctctttgagacagtctctttacgcattccgcgataagacggtgtagagcggacaatgatagttaacagcggcacaggtgctgatggtcgtagtggcggcggcattggcagcggcggcaatggggaagaacaacaagcggcctcgctcagtcacccacgtcaagggtatcaaatgtccagcccatccgtgtcttccacaccgcaaagccagcctcattcctatggtcacggagctggacagtcttcacagtcctcgcaccactaccagccgcatcagcacccctccggtcctcaatacccacccacgcacaggggcgtgctctattgttccacacgaggggggtgtcgggatgtgacatttgaggaggtcgtcatg

SEQ ID NO: 5556 - DNA, 700 bp, Nannochloropsis_gaditana
tcacatacgatgtcgaggtaggtagagataatagacacagccggggggggagcaagcgagaaggggcaaatttcagcgagggcgtcctaatgtacgactgagagggcctgctaccgcgaccgggcgagcgcggtgcttcttggggcgtaaacttccactcatatgctcaactttggtcgatgcgtgtagtcattataaggtttctccggtaatgatcgctcattcgcaactgttcccccccgcagaccacggaagagaccccacctgcccaaagtgggcggatcgatcgaaatggaacaggcccagacgcaggaaagatacgcgaagaaccatctcgttgaagtccaggtcaggcgtactcgacgtgctcattcgatgtctgctcatcgtcagcacgaggccaggtacgcttggacttacaagcctagtgcgtacaatgctggtgaagggtataagggtttgtaagcttgctttaatcggctgatcttccgttccgaatcacttcacaacgattcgattgcttgtcatcaagcgagtggagggatggaagggctgcatattgtaaattgtacatcgacatccccatacatggccatcccaatttccaacgctaaattttccgctcctcttttgtcaacatggtcgagcttggagacacttattcctatgtgcactacatttacgatagaatcacttcgat

SEQ ID NO: 5557 - DNA, 700 bp, Nannochloropsis_gaditana
gtcggaaaatgaagcatggattaccgtgagtgagtcggcgccagcacgtaccagtaagggagtgcactggaagaatgggtaatagtgctcgtgagcaggcgcgagcatcccgcatagaagagtgcaacgagagggggggaacgtctgccctgagctcgcaagacacatcccgagtcggtggcaaaacaggcgcccagcacacattttcaggcatgcgcgtgtgatttgtgtaaaacttgctgtacatagcagggtggtaagttttcgtaggctttccgtcgtatgtctgcgaccgtcacggtgttcctgtcgcctgctagcaccggagacaggctctcgcccacaccccatgctgccttttcttgccaccctgccagccatgcggagaaccgcgagcgtatccccgcgtgccgatgccggcacttactgcgtcgacaactcgctatgctggttatagtgtttgcgacaagaggtaggccgggcctgccctcgtccagtaatcttgcggggaggaatccgcctcctcgttcacccttcaaggtgggcttaggccccctcaccaatttctgctgcacctgtgcatacgaatgtgcttcctgcgggtgcgcatggtcgcgctggcacgccttcgatgcctgaatccacgcttacaatgatcatgccttctaacttccatgtactaaattggcaacttgcaaac

SEQ ID NO: 5558 - DNA, 700 bp, Nannochloropsis_gaditana
tatcggtttgcttatttctccaaacatacacgcgcttgcagccatagaagcaccgcatgtggcaccgaatgccaatgccctgaagacctccttaggagctaaagagggcgggagggccgggctggggcgttgtggtagggccgcgggtgcttccgtccggcccatatccatccaagccggagcttgcagcgaagccaagcatttcgtttctgggcgagcccgggtccatctgacagcaggtgatcgatgctcaactctagcagccggtgttacatgcacatggccggcgtctttcgcaccgtctctcatctgcagtcaatacaaatagacagtgtcatcgcattttttgatgcctcccgaccagaggatactttatgtcaaggaaggaccctaaatttgcgaaaattggggtcggaaacaaacaagtgaaacagtagcgaactcattcaggtggtggaaatgccgcgacgaccacatcgctcagcgggacaacgcttgctgtcaatgacaacgctcctcctcctcaacaatgctctttgtcctcaaatatgctgtgaagcttttcagccagggcattcagctgtagtaactcagacttcgacaacgacccgaggtttcggtgtggcaacagccacgttccgtgtcaaggtgcacgcgcatcatacaaatgcagcagaagcaagtcggtttcgtgatgtga

SEQ ID NO: 5559 - DNA, 700 bp, Nannochloropsis_gaditana
gtggaggccgtcaaatttagcttcgatatctagaaacataaataaaaggtggtggaagtgcttgaagttgcccaaatccatccaaatgcagctgccatcagagtttgggtcctcgagttctggtcccgctacttttggcggcactgtctcgcaaaagcttgatctcgaattagaggagattaagcgctattctcgtcatcttattctgtcccaggtaggaatggaaggtcaacggacgttaaaggccagttctgtattttgcgtgggcgcgggcggcttaggctctccactcctgctgtaccttgccgccgcaggagtgggccgtctgggcatcgttgacgacgacactgtagaactttcaaatctgcagcggcaagtcatacacggacagggcactctgggggaagctaaggtgcgctccgcggagcgccgaatcaaggatgtaaatccccacgtgctggtggacgtgtacgaagagaaaatgacggcggagaacacgcttcgaatcctggcgccctatgacgtagtggtcgatgggacggacaattttccgacaaggtacttgatcaatgatgcttgtgtcattctcggaaagccactcgtgtacggggcgattcttcgcttcgaaggccaagcctctgtcttcaactaccgggggggcccgacctatcgcgaccttctgcccgaaccccccgctcca

SEQ ID NO: 5560 - DNA, 700 bp, Nannochloropsis_gaditana
tttattacgacaagacttgtttacttttctttaatttcttcataaaacgatggtctcaattttcccgccatggcccacagaagaatattgaggccacctgtcaagagctcagcactgaaggccttcattccctcagacgcaagctgcctgtgagtaaagtcaagatgaactggtcagatgcggctgctcaaaacataagcaaagtacttcataataatacggaacattgatcgtgatgaggcatgtgacgaccgtcctgaagaaagtttaacctccccactaggcagttgccgttcgcgtagccgtattccgccctgcgacgcctttgcttttacaacgctcaccgctttgtttgaaaaatatcgcatataagacatttctggtataggtatgccaatttggacgtggatgcgtctttctacaacctgtggcgtggttgtaagcgttctaagcctcggtattgaccgcaaaagtatcttctgtcaaggctcacgaggcttatcgtcccgtggaaagtctgcatttgctttcacccccccaacagcgtggaggccgtcaaatttagcttcgatatctagaaacataaataaaaggtggtggaagtgcttgaagttgcccaaatccatccaaatgcagctgccatcagagtttgggtcctcgagttctggtcccgctacttttggcggcactgtctcgcaaa

SEQ ID NO: 5561 - DNA, 700 bp, Nannochloropsis_gaditana
aagcgatatcacaagagttggtgaatgtcgcagaccttagttggaaaatagagcccgtgggggggggcattagctcgtcccagctggagcagctccaagagatcgtgaaaatgagtgctgccactcctgaatctctctccttatcaggcagcgaccgcctggtagccttgcttgccgaagaggggggaagtagtaaggacggtcacgatatggcaaaaataatggagaccttgtcctttgcagatggctcggggaaaaaaaaaaacaaaaagaagaagaggaagaaagccgtgtctgttgctgcgcaaccgagcgcctccgtgggacgactaataccccatacatcgcctggaatcgttgcagacgatggtgacgtaatggggcaactggagggtggaggcgggggcggggatgacgaggtcatgcattgcctggaacgaacgggacaggaggcagtatggagcgaggggacaaagggcaaggagggaaaggtcgacggcaacgggaagcgccgagaggggaccgaggttagcaaaaagctgcgggagaaaaatgatgcgggcaatggcaatgacccaaagcagtcaggaaaggagcgcagcactgagggggacaccagcgagcacgagggacaggccgcggccctgaggctattgggcggggagcatgctggccatggagcggtgcagacagcgggaga

SEQ ID NO: 5562 - DNA, 700 bp, Nannochloropsis_gaditana
gcccctgcgcgcctcgctccttcctcttcctccgtcttgccgcctgcagaacacggcgcatttcatgcttttggggaagccttcaatcttgtttcacggacgacccacgtgccgaatgaggacgtgaccgggtagcgtgtgggggagctaccggtgatgtccgcgtccgcgatactcagcttttcaggggattgccgagattcgcgaccgctcatcacacgaaggtatcatcgacgcgccgttcgtatgtctcttcgcggcttatatctatccgcgtggggctgcgggcacttgtttcagtcactatcgagcacgttaagttgacggtgtgctttcgaaaccagatactgcaaagcaatgaaacaattagtattggagcgtttgatgggaccaagtggaagctgaacgggaggagcggctgtgtggggttggacaagtgctttgtgtcatgggctaaaaccgctcgtcttcctagccatataatgatcttgttagctctcgtgcacgctgtactttgtattttggttgcaatgcaattgtaaccgtataacaccactttgttctcgtcggagtcaatcgaaatcgcagcttcctcgccctgtcgttctcacgggtttcggtatatatgtacttatctatgaagcccggggtgtacatgtcttctcacaagtttcatttcccttcaatacttgccatgcag

SEQ ID NO: 5563 - DNA, 700 bp, Nannochloropsis_gaditana
cggcaaggggcgtccctcccgggagcttgaccgtgtagatgcgaaaaatatctcgttagattggggacgtgtgcccatgcttgggggggtcgggccctccgccacatctaaatgcagctttgtcaggcctgacacctccatcatgaagaggcgaacgccaagagaactcagcccgcccctgctaacccgagtcgcgattcagataaatcgcacacgtaggcgcgggggcaaggttcctatcgcaaaggaagtgggtcgatgagtatggatacaccggaaatctaaggattacatcgtggtctttgcttgacatatggcatggaagaggagaagatgggcgcggcagattgagcacaccacgataacgcccgtctcggaccacaccgcattcatggcctccatcacacgaggaacagtcaaaatagtacttgagaaactacgttcggtgctcacgcggcgccgcctgctgggaaagagcacacgcccgcgctagatcttgcaggtggccttgcccttgagctcgctgcctgatcgtcggggtcacccgggtcggacatcccgctttggaagctttccagtccctactgccaccagggggcgaccctctctgctttgcgccatccatgtcatcgacttcgacgatttcgtatggtagggtgtctggactcagcctggttcacgcccttctgtacctttgaac

SEQ ID NO: 5564 - DNA, 700 bp, Nannochloropsis_gaditana
ccgacgcttgccgcgtcgaatgtcgaagatgcgtgcggtcaggtcggcaaagagtttttctcacgaagcccttcctgggtaaaacccttggtgagcctcgatgcatgcaaactctcgcagtgcatcttgtctcgcctttggcgggtatcaacgtctccaacacgaccttcagagatggaggaaacccaagaacaacgaaggacgaatctcaggaatatatgcaggcgttccagttcatcgagcggcgggaaagaaatttgccaaagacacaaatatccgcaattttggaggagcgctacagaagagcaatattttagtgtcttaataagacattgtgtatgggctgtactggataggcgactttgtgcagtcgaatgggaatgggagcgacttatgtgtcgaatgatcttgcggtggccaaggcaggcatgcaaacgcccgcctaagagatgcgatttagcttacaattttggacgacttctgagacgtttcccgctacgttggaatgttttcaaaagtaccgatctctcgtagtcgtgaccgtctgcttcgacgcggtctcactcttgattcacggggcatatactattcaagcggcggccatcggatgcgagaatcatctcaaaatcttaagcgtagccaacgcttttgatcgagcttaccactaaagtaatcctcattaattttgccctgtcgcaca

SEQ ID NO: 5565 - DNA, 700 bp, Nannochloropsis_gaditana
ctccgcccacgtcgcctccgtttagttcttattatttcctccctgccttgatgcaccttgtctctcatgacttcctttttgttctcccctgagcaagggcataggagaggcatggctacctgacaccttttctccaaccacaccaatccaccactgacgtccctcctcaaatattgcgtttcgattgattgtgagtgcgcgaacacggatactttaagtgttgagacgctcctgtcataacgagcacgggcgaatgtggtcgagaaggatcgtgaggtacgggtgcttggggactgagcgcgtccacaaatgcgggcatcccgaacgaaaacacaagccagcagctgccacaaccgcgaatcgtggtattgacaaagattggcaactcgtgcttcatttttcgagaaaaacggggttggttacctccccctcccagcagccaggctcattgaagtggaaaggtacataccagaccgcgcttagctagcagctgtggcgagcccttcttatggcgatcctccttgcactccctcactctcgatccttccgcctcgatcttgctcggtcatgcccgtgccggctaagcggatggcgagtgagcggaggagaccggcgagccatgcgacgggcagtgcttgcggccctccgggcgttatcacactctttgaatacatctttgaaatatgtatattttgttagg

SEQ ID NO: 5566 - DNA, 700 bp, Nannochloropsis_gaditana
aatcacagaggacgaggacgaggatgatgaggactgggaggatgaggaggaagaggatgacgagaactcctttaccatggagctctaagagcgaaatgacttttctctcagtgtaaactcctgattttctcgtggtcgtcttgtgggaggtagcatctcgaggtttgtcgcaaattatgagtgtgcgcctcctttatgaggcatgaaagctgttttgttacgaaatgatgcgatgagtggcgcgccgtagacaccaggaaaatgtgagttttctgcttaaagcgagaaccgattgcatcagccatcacaaagcccgagcgtggctccctcctctcgcctcggaggatgccggggaagaggattgcagtcgttttcagggttatcagggcttaatgtcaatcatagaattaaaatgaaacccgaaaagcgcgtacatgttttttgcttgcatcgctgcgtatgctgcttttacagccatctcgccgacctggaaaaggcgatgcctagatcggtctcccggggcttcctggaattcttcgcgctcccgagagctggtgtgaagccagcaaaatgcatttgatgcgcacccacacgccttcttggggtcgccaagcctgtaggaggatcgtttctgcaccatggtgtcagccgcacactttttgattcacttgtgatgtctccatgggtatctactaacgga

SEQ ID NO: 5567 - DNA, 700 bp, Nannochloropsis_gaditana
atgccggtgtctagatcaggtgtgaccccgtagagtacacctgaggatgcgaatttgcctctcgagaacacagggttgccttcagaagacggcgattatttttatattccgaaaaatgaagccttgagataaaacgctaacgtgaaaaggagatagaggagatcatcaacagcgtggagcatagggctagacggaggggtgcctgggacgcgcagggcatcggggaggttaaacccctccttacgtccaaagtgctgcgagagatgaaccaaaacatgcctgcttgaaaatggcgcactcgtcattcgacaggtaatctcctcagagcctgatcgagttctggaggcctgtgcgtctttcaatacggcatgcaaccaagctctcccggcatggccttggcgctcgcggtgcctcgctcgctcgcttcctgctccctcctcttccccttccgctcttgccgccttcggcccgctaaaacacccgcgactgccggattcctgttgggacatttcgccattcactttgctcaatgtgcaacttcattcaaatgttgggggcgtggacttgtcaacggcttttcgagagatatgaagccgggaaattgattcgggaagtgggcgattctagtaatccgcccggcactccacagggagcataccttgtctagcccgctcattgctaccctccacaccgcaataca

SEQ ID NO: 5568 - DNA, 700 bp, Nannochloropsis_gaditana
tcgccgaaacgaagccgatatgggccgagggcgagcgaggagagccacccagagaacggggcgaacggaccaatcagaggcggcctcttggctcgaggaccctcccggatattcgctctcgacctctgtcttcagacgaatcgttcatgcttgactgcgttcgcccgaggtaaatttaatatcaccctgctgtgacctttctctgccgttggtgtccttgacacacgcccctgatggcagctcttttctttttcgatcatgccgtctcgccgatcgctgtcgaagtcgaggctctagttctttctctgacttacgtgacttcgtcgacagtacattcgatgttctccctgcgaacaccgtgaggcgaagtccgggatcctctgtgtcgtgctacaagtgttcttcaataaactggccacatacgtttccgcgctgctcggtccaaaagtctgtgaagcgtgcgcccccccaagggacagcaaccatttttgaaattaccatgctcctctgcattcgttttaatagatcttgatccacgctagcattcaatgaagaaccgatcaacagcaattgaatacctagcctttatcctgtcttaaagtgcgtctgcctgtgcccgcgttaagtcgttcacgccctctttgttgtccttttacccaaggagccctcatactcctcttttcatcgaaccactcgcaca

SEQ ID NO: 5569 - DNA, 700 bp, Nannochloropsis_gaditana
tcaagtaatcttcgctcctgcactgccagaaaaatattgtcgtcatccaagacccggttttgttggagatgctgcatccagtccggaatgctgaggaagatggcgcgccgaagcctggatgcccaggacctccctctgagcggagaggcaggtggtgtagtattaaagccaccaaggctacccgtgtcagtgaccggatcgggaaacttgaaaggaaaacgcgccaatatgcggcattgtcctggacgggagggagtggcgtacgtgacggtccacgtggagacctcaggggtggatatgaggtgatgcatgtagctaggagcgttgaaaagggtttcccgctcaacacgccccaagtgcttcttggtcatgggactcgccgggatgttgcgctcccaggtccctcggaaccctgccagggtcacctcagaggtgagcttcaatggcacaggactcgcataggaacggcggccaattgtggcatggtgcgtgaaaggcacgtgggatggatccaagaggttttctttcgcttgctcatacgagtagggcacgtcacggctcacatccaagcaaatcaggtcctcgtccacaagcggggggcacaaagggatgagatcgacgcttggcgtacggccgcataaggactgcaatgactgtccccacacccatatgataccctgagcgaccgttgtaggatagg

SEQ ID NO: 5570 - DNA, 700 bp, Nannochloropsis_gaditana
cttcaccctagctttcatgtgaaaatttgagtgaagaaatttgagcttgtaccgaccaccatctcttggttcaatgcatctggtcataggatcttcacagcggtgccaagccctgtaaaatcatgaaagcggggaattgtcggcatagataacatcgatcctccccgggtcggagagaggcgagtggcgccggaccgctcatcctcgcccaggtcgagccctccgcttgcctcgcccgccttcgatggccctcgatcgtcctcttttcccccggctgcaaggcctgtctttctcggaccccatcgcacggccgggttgtcgcctggcgtgcccatctcggcgtgtgggccttggtctgcgcgtcgcgctgaccttcatgttcggcacgccttgtgacggcggcggatggctgagagacggcgacacccgggccagcattgcagaaggagagagaaggcgacgcgtcatattcgcatggccacgaactgcgtacaaatgaaccatgctatgaaatgaatgtgttatgaagtagtataccacagcggtctgttaatgctcatttttggtcccccagcgtagtgttgcaccgtgcgcgttcccacctccccgcttcgactgatgcctccttcctgtttatatccaaccaaccatcaattcttctgctaaccaaagctatttgctccgctccctcttgacaaac

SEQ ID NO: 5571 - DNA, 700 bp, Nannochloropsis_gaditana
tcgtgccgcaggcattgtcgaggacgggaagttgcttgataaaaataggtgcgattggcagttgaggatcaggtggagactcttgactcggattgagcgcgcgatcgtcatacgcgagtatcaatgccagcgtctctccgtgcacaaaccccaagtaatcatcgtccaaagagaatacatcttggaaaaaaaatggacatgaaggggtgcgggtgtctgaaggcgtagatgaagggcttaatagtgtatgtagcaatgccgtatagacctccgcatcgctctccagtgcaggccaacgatcgcactgtgccatggagggtgtacttgtaccagacgtgtcattactcgtcatcattttatcccctgtgatatataaaagcgttttgtgtgacagtctgtatttctcatgcttcagttcgcgagtcacgaagaacgacgctagattgaaaacgagaaaagcgatagcgcaactggtgtttttttccccacgagcaactcagtataactccatagatacaacaacgattgacgtttatttgacctttcaatatttttgttgccttctttaaaggcctcacttccaactccgctctatctaacctcctgcctgtcgaaccccgtggacaatgaatcattcctttcaatgacttgaagctattgcttcttaccttgtccccatacagcagcacccacagccatg

SEQ ID NO: 5572 - DNA, 700 bp, Nannochloropsis_gaditana
aacttcggtgcatccttgatccctcaagcgccagtgtaccgcactccacttctttgtgacctgagatctcacaaatgacatcgatttgcttgtgcggtgtacctcatcttagcaatggttgccaggcctttctactgaaccacccccactatctaggaggtgacatgtccaagattctcatattgctatattcgatcgcttcattgggaggcttcatctcttttgggacggcacgccacttttttgtctgtgtcatctagcctgcaattcgttccctgccactgcttcacgacccacttcatacctcttcaaacctcctatgcacatggtcccctcgcttgcgtattcacaacataccttcacaagtgtcatctcaatcatcaccatcatcgtcaccgccatcatccctccaacctgtctgcatacctgcatttgatacgtcctgatcctcgcctcttttttagccaagcataactcctccactttcactttttgcttcaccacaccgcggcgaaatatggtatgcacgcatcttcctccctccccttcgcacatcctgtttttttacagatggcgtgctttcattgtgaagctggttagcgtcaacgctctgtgttcacgtatccatctttcgcggtaacaccttttgccccgctttccgtcaccctcctgccgtccctccgtcccatccctattcatg

SEQ ID NO: 5573 - DNA, 700 bp, Nannochloropsis_gaditana
cagcttgaagcaagtgaggcccatcgtcaggcctcggggtccaaaagatgtgccgcctccctgtcgtgcccgtgtccacagctgcgaaaggcttgcttggccacctctttctcactccattcactttggtgtgacggggtcaaattctagcgagagccttattgtgggcatgcgatgttccctttaatcgctgccagaagaacttccgggacgtgggctcataaaatacttccaacacacttaagctcataaaatacttccaacacacttagagaggagatcaatcggaaaagaagggataatgggaattgttttctccatgggtacatcagctgccagtgccttggcctcatgctgcgtcggaagtgcggcttcttgcgtctgcgcaggcttaaagcaatgcctaccgagtgggtacagtgcagcgaaagtatacgccctgctcctctttttcgcgtctgttgtggccgcattgattctgcgcaccacagagccagccataaatgctgactattttactgtgcgttgcacgggggagttcaaggaccggtgctacggttttcaggccgtataccggctgtctttcgtcgattttttcttttttctagcgttggccttgggaagtaagtttgtcgtgggtgtccatactcatgcctggggcctgaaatatctagtttttttgggctttctcatcggcatg

SEQ ID NO: 5574 - DNA, 700 bp, Nannochloropsis_gaditana
ttgctaaaacaacgagctcatgtccgtaagccaggcattttgcaatgctgaaaacgctgtccttaccgccgctaactaatgcaacaaaccgcattctagggtggggaggttaaacaacaatagcggacggctctccccgattggaattttgggaatttatgaggagaggtatctccagcacttgtctgtgtgtgagttttatttagttgatcgatatattaatagttggtgagcaaatagggacaatgtactcggaaagagcgtaggcaaccttctcgcctgcagagcaactcaagatactgcacctggcgccctgcagtactgcccgccatcctcttttttcgtacgcgagcacttatttcctctttcaccactcacgcaatagatgtcaagaggaggagaccctttgccacacccacagcagccgtcaccttcctcattgtttcccttatctgcgttctcagcatcgtctcccccaaagcgagctaccaactacacttggaaatccaggtcccgatactccgcctccacgctgctccgtttgcgattgttgctgccattatttatcctactagagatccgaccggtcaacgcattcacatcgccatttcctcggtatcgcttccacagtgccttttcacttggctcggcgcggataagattgaacccttggtctttaccagcaagcaccctcatcatg

SEQ ID NO: 5575 - DNA, 700 bp, Nannochloropsis_gaditana
gactgcgaaagaagcatccgcggggaccgccacagctttttcaactcggaaagttggccttgcacaatttcttccatgcttattcacgtgcttttcccgtacggcttcggctggaaggaagaaagggccgcgtttaggagagggagtgaatggaggttggacagaggagaggcatcagttcgtagaccaccagacgggcaggagcttgaggaaaaagcgagacaaggcacgtattgcaacctgccaaggcatcagcaggcattgagggttccacgcaggacgctgcaagtcccgaagccagagactgcgcgaggtcctggtagggagagtggaggccacagagcaagggagcaatcgaggggtcgtaaagcatcacaaggcaaatgggccgggggaggtcggaccccgggcgatgtttggcgttccgctggtcacggtggctacattgccgaccagggcagtgtgtgattcatttgtctgcgcagttttatgttacgtgtggtcatgctttaaatcgatacttgtgtatgtactcctacagctacatgcctccgtctggtacactgtgcacccaggcctctgtcctcaacttttccagatccaaagcaataacctggacccggaggaacaagctatcctgccttttcgagccctcttggcattcagacatcagactagagactggaagaaaggtacgggc

SEQ ID NO: 5576 - DNA, 700 bp, Nannochloropsis_gaditana
aagtgcgagcgccgtgagagggtgcgtggcatcagattctattcctaattcggactgacgccgtacacaggaaaacagcaagcaacccaaacaaccacatcctgtcaagtgcaacacacgaaatggtccagcattcaaacaggtaaaaatcaatgtgtggactgctcgtacaggccatagccgtcaaaaagacgcaaatcacggtcaaatcttatgagttctctcagaacaaacggccatgttggctgtcgagtcgaagcacagagagaggcttgtcacaagccgcctccccatgtctgacgctacaaaaaacttgatattccgtggtcaagtccctgaccggccccggcagaagtgcagggcaaaatttataccagacaaggccaccctgccgcgtgcggtggtcgttacgcacattgcttcgtcacagtcgcccggtgctttgtcgcctatggcagcgaacatgacgcaagcgggtctcaacggccgacgagcgtctgcgcgtgaaatgagcaaatagaccgcgcccacccatcacaacaacaacgcgcccgggcgaataaatgcatggcccggacgttctgggtggggtgcggttggcaggtgggagggactgtattgtcttgaggatggatgttgacttgattagatacacatttttttcgacgtttctaatcaccacagccactcagtcaccatg

SEQ ID NO: 5577 - DNA, 160 bp, Nannochloropsis_gaditana
gcttggttttttccagagagatacgtgggggggggagggggagggggaggaaggggaggagggggaggaggggggggaaagaggggaaggaagcagaccctaccttcccgcaggcttgtcactgcttcccgcggaggaggtagaaacggtgggagggatg

SEQ ID NO: 5578 - DNA, 700 bp, Nannochloropsis_gaditana
ggggtcccgtcgcggcagctgtcttgcttttttttttccgcttttttttcttcctttttttctccaagttgtctcccagtaggacatgcatctgatccgttgcaggtactgcggcattgttcagtgacatggtcctcaaggaggcttccaccatcgcctcttccccttccacgtatttgcccccaccaccgttcatccccttttctcacaaccctcccttgaccccccgctgccgccaacaaacgatacgtttcacaatctttgacaggggcggatctgtgcgttgatgcatgccataatgcgttggagttacggggctgcagttagtctgagttgttgcagatgttgctcaatcgtagctttctcgttgatatctgcatgattttttcgaaactcgagtgtcccaacctgccatgcgacccacttcaccgcccacatgcatgcaaaaggatgattatccatcagacgacagcgtgtatgtggcggatttgcccgctatttcctttcttcttgtcgctgtgaaagacagttgcaactcctaaccgggcttcgccgcctgtcgcttacacgttccttgaaacgagaaatgagtgaattccttttcatacgcaccactaaaatatgctcccaacactgcttccgtacacttgttccaaagcggacagtacattcacaggatattggcaacatcatcaccatg

SEQ ID NO: 5579 - DNA, 700 bp, Nannochloropsis_gaditana
gcatggctagcccttaaagcacacgcagctgaagtgtggaaaatttcagctgctgtagccctgattaagctgccaatcatgaaagccttgaagaaaaaggaatgagacgcaactttcagcatacgatcgatgcgaaaacgcagcaagctgcaaacttgcgcacgaaaataaactgaaaagcaggaacggagacgtatccctgtattttgcgttgcgggttaaaaaataccacgagtatatgggagagagcttagatacgaggggggggaggtagtaaagcgtatggtatgatcaagcttgtaagcccccaaaacgcatgccaaccgtgaggcaaaagtcgtcaggcatccacgcgagaagaatgctttccaagcatgaagcaatcgggtaaacattcagctctcctcccacgccagtgtacgacaacctttttgacgcatgtatcgccctccgcccactcagccacacaaaaagcgagcatagcactctgccgcattatcgacttgaatgtttccacatctcctttccacgaaacgatcgcacagagataggtttcgtccccaacaaaaagacgacgcggtcgctgccgccttgttgccaggaatacatcaaattgtgtcaaggagtttagctacgctgctgcttcagtacttcaagggaaacccctctctgcatacttacgttccgcgcgataaccatg

SEQ ID NO: 5580 - DNA, 700 bp, Nannochloropsis_gaditana
cgcttttctcgctaacctccttcaagaatcacacgaaacacatgctcacgacctcacaccccattccatcccctaggagacccaacctttcgtgcagcagatacttaatgccaccaagacgtcaagcacgcccgtgggggttttcattacattcactccctccctggctcttcctttctgccggggccacgctggctttacctcctcccgtggggtctggcattgcttttgcacgcctttcttcatggaacacttgtcatttctctgtgttttcaagatctatcacacacaaaacgtcgcatccgagtatattaccagggaccttccataagtattacctctcaggcataggatctgcttcctcctccatcttggctagtacattgtccacggccccgtcaccgccagaagacatcgcggaggccttgaaagagcgaccttggcgaacaggcttggagccggcagaagacgttgatttgatcgagttatcggcagcatgcattgaggtacgtgggattccaatctcgcacataatgaaaaacttatgcgttgatttttggctgcccaggcacacaaatttcggagcaccctcaaagcttatttaaaccatcgatcgatgaccctctctcacacatggcgcttctttttccgttccagggtaccgtgccctccgacctcgtaggcaccttgtatcgcaatg

SEQ ID NO: 5581 - DNA, 700 bp, Nannochloropsis_gaditana
cactgttcacgttattataatttcattcatataaatatagcgagaaataattaatatttcacgtaaaacccttccacatattctcgttaatttgcactcgttctttttgcgtcgtcggatgaaagagccgtctgcggattattccacgggaggtgatgccaccgttgttgtacgtatccaccacaaggcaatttctatggggctaaacacccccaaaaaactcattcatgccaaaaaaatacccaacaatgtaacctgcccccagaattacctcttcaaccacgaaccaccgggaaaaagaaactttgtccacgaggggcagcccttgatttgaaacttcaaccgtcgagctccttgcaacggctcaagcgtgcgtcacattctgagaaacaatggggagttgaaacccgaggcacgcacacaatctacgcggttcatacccgtgtatgttccattcttgttcacggcttgaccttaaccgccaaacaaagaccacggagagaacataatctgctaataggtcttttttatgtgtaccatgaaggccggcattcggcattgttctctcaactgcgagcacttcggtcgaaataaaagaacactacctcgttcccggcctggcttggtttgcctgcaatgaagtcgattcacaatatttttaagtactcatcgtcaatgattatgacagcgtaaaagcatg

SEQ ID NO: 5582 - DNA, 700 bp, Nannochloropsis_gaditana
cccccagatgtgccacataccggtgctggtccaagcgtgccaggtcatgctccctgattatgcgcttgtaatcatcgaggactctcttgatccgccacgccgcaaaacccgccgcggacgcccccgctatcaggccgatggcgcgtcggttcctcttcaggaaatggtagacttgctgcagccgacccatcttgggataactaccggtgatggccgtgcacacaggtccaagagtagaagcagggaacgatgtgagatgagagagagggcgccctacggctgagtgcgacacttgacgcgtctcgactgggaaatgccacggggaggctaccctccccaactcctccgccaccgcgtggccccgccgtgacagcgtccccgaaaggacaacaatttgaccactcagagtcggtaaaagtcaagcattggggttaaaagaatttttttgttcccatcccgcctggtccgtgctcgaaatgagggtgggagatgtgacattttccgaacttagggtctctgtgctctctttgatagctcaagagtcaaaatgatacgcgtgttgcctggacgcatttttctagtcaggcaagttcgttgtcctttttcagcacaccatccccctcaatatatcaatttatgcagcacaggtcacaggacatctttcaatcgaacggcgccggcttattactgctccatcatg

SEQ ID NO: 5583 - DNA, 700 bp, Nannochloropsis_gaditana
ctgagaccctccaacaaatattctcgccttccaactttgttttctggacgccataaagaagtttcgcatcccttagtgtgtacaacacagtactttattgctagatgtgctaatgggaagttttaattggtatcacggctgaagtatctcggcatagcatgcaggaaggtagtccatagtaattcatacgttatctagctacaagagccttttttggagcgcgcaaaagctcgttctacaggttgaaagcgcaacacacgaagaaaataatgcagacgagcgcttgatttgataagtaatgggcttgaatcgtggaagagcgcgactgtccgcaggaacgcattctcattgtgcccctacgcaccgaactccgcaacgacgacacccacaggcttatgttcagcggaattttccccaaaaagccggatacggcgggggaaaaagcgctggcgcaggccttggggggagcggaggatgatgagggagacagcagtagctctcgaggcaacaaaggcgggggaaaaggctcgggcctcttcgacccgtcaggactcgaacggtaggggggtatggtggagaaattgtattctattccagatggtggaaacgattgtctaaactctgccccaatctttattttcacgccatactcatatggtattcgtgtgatatgtattttcttccatcactctacccgatg

SEQ ID NO: 5584 - DNA, 700 bp, Nannochloropsis_gaditana
gcggttcacatcaaaaatccaagctatttgtgtatttgactgtgatatagataaatcactactaccagccgatggatacgaccagggagggattacatatgttgtattcagggctaaagttacggttttagatgcgcagctgaagcgaagatcaactgctgttggctgagagggggaaggattgacaaggagggacacctgcactatcacttcttgatttagaagcggaccaagcggcggacatgaaaccgctgtgactttaggtgttaggttcagaaaaggccttccaaaggtatcaagaatgaccaggcacaggcaagcgcacacccgcacgccattgtagcgtggacgagaaggaaaaaaattctccataactgttttttgttgtgaaaagggggaggttcagtagtgcaaactgtaattttttaaataaaatgtgcattaaatgcgcttttaaatgccattaaagaccaagccttaatatttaacgtataaaagttagtgatgtcgtgcccctcgccatgaaaagacgcggtgaaatggacagagggactgcgagtgagggccgtgggccgcgtcaagggccttccgagggggaaaagggcgaagcctcgctcccgctcttccatttcacacaccctgccttgtacgtccacttacacgtcaaaatacatggccacatatgtatacagacaagatg

SEQ ID NO: 5585 - DNA, 700 bp, Nannochloropsis_gaditana; identical to SEQ ID NO: 4540

SEQ ID NO: 5586 - DNA, 700 bp, Nannochloropsis_gaditana
cttttcaatgcgatcaaaaagggcacctgttgcttcaccgaagtcaacttgtatcgtctccggcgcgacctgacctggttttcgtcgcacaaagcgtgagtcgccaccagcacttgagccaaagggaccagagccggcgttatttgtgccacctttggattttatggcgccccatctaagctgctcaccggcagaagtagatgaggaggaaaaagccttgatgctgcgcgagacactacgcctggtagtcaggaaaaacactgggaaaatatggagtttgccgcacctggtcaccacgatggccttattcatcgttgaagcgcgcttccacattctttggcctgtgatagtcgcactggaggcgtgagactgtagaagcacaaggtgaagagaagagagcgtacgagtgaaggagggatgatgtgatggaagaggtacctgcatctattttgaatctcacctacgtactctgcttcctagcaccactcgaaggcaaacttcctgtgagcgacgactatttcgttgcacctctttaaaaatcattgcgtatttcaaatgaacaggaatcaggccattttttagtagcataaaactaaaaaaatcattctcgcgaccttttcaattaccagcaggttttatctttcagcgccttgcttgcccttgattgctcacgcgggagtagccgcattgggggggaatg

SEQ ID NO: 5587 - DNA, 700 bp, Nannochloropsis_gaditana
aagttggagcaccacggggtgctcggccgggctgttgaagcgcagaaagcggtcgcggctttcctcgttgtggtacagggtaggtgcggtaatcatctccgtgtacaaaaccatgcgcttggagaggaggcgcagcaagaaccgaagatgtctgtaacgttggataggaatcttagctgtggcttcaaagcaaacgagacgttccatcctacgagtgaacgcgcgcctacctgtcggtgtactccatcatgggggccagactgacccgctcgtccgggccctcacttcctccatcctcctgggaggctcctcttccacgcgtagagcttgacgtcattgtcctagctacactccttgacatcctccaatttttggacatgcggccatgatgttgcacaaatgctgcagtactcctggccgcaccaggtgcgcccgtcatcacagcgatgaaggtaaagatggaagccgtcttgattacgattaaattggggctcctgctcctctttgtttgtgggatcgatccgcacatgtgtgactccttgtcttttaaggtcacaggcgccctgtgcaatactatggcacgtcaggcgtcagcgtgtgaaggcacacaggggttgcggggtcgtggaacagagcgatgtcgcccattccatcttcaacacagcgccaggcgctcggcaaacctaacaaatgaaacatg

SEQ ID NO: 5588 - DNA, 700 bp, Nannochloropsis_gaditana
gtcagacacgtcggacacacaaataaaccgtacgtcaagacgatcatattgacaacagggacatgcagctcgcatgagtgcaaagtgattgccttcgcgtcactatggcggccctgaaagcgctccatctcgacggaaggaaaaacttggcgaaggctctcggctcccctcagaggtcgcacgaaagcgtcggctcaggtctcggatttctaccttttatcttcggactggcgacaaagcgctcgcaaggatgccgcagctctcgaatttagagagaggttggtggacattataccatcttgtcggaagagagagacagcaggcagcgtctggctcggatcaagaaggccggactaaaggagctgttcgagtgggaggttgctcgtaaacatacaagacgtcgctcctcaacgtaaaagcgtgagacccggcctttattattgttcgtgcaccacgctcttgccctggcggatctatatgatgcgcgtgtcttgcagcgtttacccactttcatgatggacatgcatattaaaaatgcgacgaacacttcgcgtaataagcctttcaatgcccatgtcgtagccttgatgaagatgtgggattggaagatagggataatttgaaaacttgcaggagcaatcgcaagcagctcatcctctttctcttgttgttccttgtcataccagccacggacgctatg

SEQ ID NO: 5589 - DNA, 700 bp, Nannochloropsis_gaditana
gccgtaaaggctcgcccaaagtatgtcaagaagcatagcgacagggaggagaacgaataaaagggaagtcaaaaacggtttcgggatgtgaggcacccatacgcctaataaggcaataggaaagttgtatgaaggctgcgatcccatgctggctaaaagcgtcaaagcgacacttagcaaacttagcttgagaacggtcatcccccagtcgccggccatggtattgttcctgtgaggtgcggcagataacaacttatctttagctacaagtcatacagatctgcgcgctgctgcccagggtgtacgccttcgagggcaccaaaagctgaatcgtgcaagaagagcactccttggccgcgtcctggataggagacaaaagggattgtgcctcatcagagaacattttcggttgtctacgtgtgcttgatgccttgatagaatggtttccataagacggtgatttcaccgcgcataagggaaatgacgccatcaccgcagtggatggaacaatatgatgaccgtcgtctctttgccatctcatctcatctgaagcggcgcctataagtagggattcttctataccatttctttggaagccgaagcacgcattggatgcttgtcaccctctgtgcgcgtgctcgaatttgccatcgatcctcaatatgacctccccactccaaccacacaggtggttacgatg

SEQ ID NO: 5590 - DNA, 700 bp, Nannochloropsis_gaditana
aaagaacttgaaattgattgtcaggagaagccgccgcctggtaggtaaacccggtcatgtacgtggataagaaccgcgaaatacattttaggagaacacgaagcagaaagaagttgcgcgtgtattgaaagcttttgaagggtaccccgcctaaagcaaaggagtggacgttgaaagtcatgtcaaagcctgtcctagcctcaaattcaacttgcccaaagaccccagcttttaatgcctttgaccacggattcaaacctctggacaacacagcacgttcaaaccattactggttcaccaactattttcgtcgattcggaaggaggggaccaagtgtgcgttactgaattctcgccatttttctcgtcggttgccaagtggtgatgccataccaacacccatcacgcggttgaagcaccacgggagaggcgatcagtcctcaaattcaaagtgtttatttgtgatggtattccgcaatccagtataaatgccgcggggagttggacacggttgacatgtgttcttgtcacgatcgtgtgataatggcaactatattggctatgcacctcacgatccctctgggtccctcgctcctcgcccaccactaccacatgcaacccacaggctgcagcgagtgacgacgttggtcattcgaagaggcgtgacaacattattattattgtcctgccaaagcggcatg

SEQ ID NO: 5591 - DNA, 700 bp, Nannochloropsis_gaditana
tttccaggatcttttataagtgtgtaaaccgggattggggggctagggagtggactggtagggcaaccaaggcgatcagaggcgatgtatgtcgagcgcccatgcgcgcgataccctggagtccgcccctattatgccctgccgcgtacgattcctgctccgttgctgatgcgaggagcgtggtgatattgtcaccgtggacgtattgagtgcggcggtgcgttttgccagcggcgtctgccccgcaatggcctactgctcgctaaaacaggacttctttctcactaccatcgtcgtctccgctcttaccttgctgtgaacaaagtcactgcttcaattcgggaggaatcccgcgtgcacctcttgatttgtctgtcacatgcgcacatggtctcagtacgtgacctttctcggggggttagccccggccaggggagttcagccaactgcaccttgtgttcatgatgacattgtcctcatgtgtgcgatcattttgacattcccgtatttaatccgacattacggggctgatatcctgttttaaacaccataatgtaacgtctcctctttgtttggcttgttccatgtcttaccctttccgcgtttgatgtgcttttctggcccggtccttggacctggttaccatcgacactgtacagggggtggccgctgcgccgcaaaacacggcgctgcaagcatg

SEQ ID NO: 5592 - DNA, 700 bp, Nannochloropsis_gaditana
gctcacagaggatggccagaccgccctccataatatgataacttgctgtgtaagggaaaattgagcagggaggtagggactggaattcaatcaactgcatgacaacaaatttcaaatgtcaatatgcaatagcagatcgaagatagtctggacttgattgatgtcgacagtcgctttaaattgtgcgataaaattacaatctggactttatccaccttactagaaatcccccgactgccgggaggttatagccgcagcacgctgccctgccattcaaccccccccagccccacgccctagctgtcctgacatatggggaaaaatatcaccaagtgcacagtttgaaatatctgcatcgccatgacaatcaccatacctctttccctacgattgacatactttgattccgtctctccatcaaatcaacgcctcaagaacttacaccccctgaacaacaggaaaacgggtctcaagcgataggatggtgcggaaaaaggtggacgaccgagtgcgaactttgatcgaaaatggtgttcaatctcgccatcgctcactcttggtgctcgtaggggatcacgggaaggatcaggtggtaaatctgcattatatcttgagccgtacccaggtcaaagcccggccttcagtactgtggtgctacaagaaagagttaggtttttccactcaccgaaaaaagcgcatg

SEQ ID NO: 5593 - DNA, 700 bp, Nannochloropsis_gaditana
ccctccttgtcgaccctcaatctcaccttcacgatccgtcgaggcaacgtcgcagacatatttgagccgggaccttgcctgggacagggaattctcagcgtgcctcctcactcctctaccggctgatctaataggctgccagattccccggcgtaggccctgttgtgaggaaaagtatggcgtcgcagttagcacctgggcccacccgagagagggagggccttgcggccatccatcccacatttgacaccccgccacattgcagaatgcgctagatgaattgttgggagataaacacagccgtaccatcctgcgagcgtggacccgtgtgctcaaagcccccgttcccgaagctcctgaggcttttcggctggcgatgactagccgtcagagccccctccttcccttcgacttggtcgaggcgaggcctgccacagccatgaggcgctctggctcacggggtcacggatttgcctgcctaaatgccacctttgtcagattgtacaacaaaactgccgacatggtcgattaatgtgtataattatccacatcattccggccgacggcctccctacttcccctccctactgctagtagcttcctgcacagggagtgccggacggctctgccgccccagtccggtaatctattgcgctgatccccggcgtttcttatcagccgtctaatatcttgcgccatg

SEQ ID NO: 5594 - DNA, 700 bp, Nannochloropsis_gaditana
ggttgcgacggactgtttcattacatgttcagacatatttaaaggctgaggctgataacataaataaattattcaaatatgacgcgtcctccttaattataatatgatgctttgctagcccccacaattcatactaacttgcctgtgcctgcatatagcacgcactgggtgatcgacatattccctcatctcaacgaggatatgttttggcaacgtccaggcgttgagattcccctaaaaaaatatgccttttacctggtccaaaaagtcttgcacaagaaggaaaccgtgcacgcgtcagaaagagttgagtggaccggaggggggagtggttcgcttgtatctttcaaagctcatgctactgtgttaaggaattcggatgcctcatcgcaccatcagtgttgaggttcctatgatgaagaattttagcggctcgagctccttggaacgagtgctgcagcgactgcagatggcttgttcctccccatccggcgcttccctttgtcgcaatttcaacgcgcttcacgcacgtggtgtgggggaagaggtgcgaaaatgacagacaaatgaaagggagtcctgtgttgctgcggcgtccatgcgcgaggatgctgcaagtaaattgtcttgttgtataattacgctgcacctttcccacgttatttttcctactactgacgaagggaagggcatacacatg

SEQ ID NO: 5595 - DNA, 700 bp, Nannochloropsis_gaditana
ccacggccctctcggcctcctccccctgctccctgtcgtcccccccctcgttctcgtccccgctcacagagaagtccgagtcaacctcgtcgcccgactccgacgcattcgagtactcagactcggcgtcgtcaaccttccatttgctgtcttcccaaaaggtctcgtccttgtccagctcctcaccaaccagattccccatccgcttccccattgtgacgcgtttctcacgcccaaaggccaggctgtcctgcaaaagcacctcattgtcctcctcctcgtcctcttcctcctccttgtcctcctcgtcctcctcatcctcctcatcctcctcctcctcgtccaaatcctcttcttcatcatcatgttcatgttcctcttcctctttcagttcctccccctcctttccctctccctcttccatttcaatcttcgccgctgcggctgctcgcgtattccgtcccatgattgttggacgactattccctgtgaatattttcgcatgaagcgtgacataggtgcagcttaggccaagcagacagggaagctgggcagcaagctccaccccctgagatgacgggcaggggaggtcagggtgggcgagcggcccgctggctgcaacacatttcccttcctgcttagagggacgccactctttaccgtcgcaattttcacacgcaaatacaccagagattccatg

SEQ ID NO: 5596 - DNA, 700 bp, Nannochloropsis_gaditana
aactaaaattgtgtagcataatgttggaggcaaagcttcgtgaaggcgcgtcagccatctaatccatatgataaagcattacgcctggcccccttctctgcagttcagaacttatgacgtttgtaagatgattctcaattcagtacacttgttgccagcaaaagagaatacaaaagggaggctgtgtccatgatctgttcgttgctgtctgttgtcgtgcaatgtccacgtattttctttagacgctaagggcaggaggttattgagatcccgcgccttgcccgtgtatttgttcttcaaatcactcgaagcgcaccctgcacatttggtcgcaaatgccactcaaatgtatgccgtctgacgctgctaattcacacctctagatctgtatcaggaccttccagaaagggtgcggaacatttgcgcgcttcgtatttctgtgctttgcgcctgctattcctgggagcttccagcgtgacataccatggccggatggcgcgcgtcctcgcatgcccaccggtcttctcagacgtcggtccctaggcacaacaggactgccatactgctgctaattttaatgctcgtacaaatgcatggagcatttgtggttatcccaaaccctgcgcggcgtgcggcggcgcaatttccatcaaagcctttgaaaaaggcgagcctcgttgtgatgcttggcaatgaaatg

SEQ ID NO: 5597 - DNA, 700 bp, Nannochloropsis_gaditana
tatgctccgttcatgcactcgatcgcgtagtccgccgcctcgaagctgtcaaaggagacgaagccgaaacccttcgtgtgccctgtgtcgggatcaaacatcactttaggtggctgcgtgatacctccaaaagctgaaaatgtgtcgtagagatccttctcgtccacctcggccgccaaatttccaatgaagaggttggcccccacgtccaccgtcttcctgtcctgagaggccttattcacccgcagaggcttcccgtacatgcgcaccatgttcatgatcttcacggcgtagtcggcgtcctcttctgagcggaactcaacgaagccgaagcactggtgcatgcccgttaccttgtctcggggcatatgtacgtgtaccacgggccctacattctgcatcagttcccagagcaaatcctccgtcactttctcgtccagaccgccgcaatacaccgtggcatcctgattccgctgttcaatcgcaccagaagccatccctggaggatgtgcgtggtgtgatggcggatgtggcctcgttagctgtggtgtgcacggcctggaggacaagaggtctcgctgctcggactctcccctcagagacccctcgctgcttgtcgcccagcactatcgcacgcaccgagtcagcagtccctccatcccacttcctgattccctacattcgaaaacaggcagtgatg

SEQ ID NO: 5598 - DNA, 700 bp, Nannochloropsis_gaditana
ttgcttactcggccacgcagtcccttcctttccctcattctcacttcttagacagctaccaatggcacctcgtgccatgaatctgtacatttcatgaaacgaaaagatgtgtctcgtgacattcaactgcattttgcgccctttaccgaagacttgtttacctcggaacagggactgagtgaaagtggctcatattgacactttccccgtctgctgctgacaaatttccatgatcgcatgcattcagtaactcgtatgacttttcaagcccaattttttctcctgaaactttgcgtggtgagactgacgtagcgaccgtgcgacggggcagtcgtcgcacttgtgcccgaccggttcaggcacctagcaggcacattatgtgtttttgcatgcaacaactgaaatgcaaccctattgagcctatgcgacggtagctctgttcccgaaacagtgcgaatgtgcatttacgcgccacatgtcgcgctgatggctgaactcatgtctgacacggctcgccagctcacatttttggtcgcctatctcctttcagtcccacagaacacagctttttgccgcttagccggggacaagggaggaaacgagacgacttgctgccattccacggtcacctagtttgtcttttccaagtccaagactttctgaccaggttgcctgccgttgtgtcccgtgagtcactatg

SEQ ID NO: 5599 - DNA, 700 bp, Nannochloropsis_gaditana
cagcaaagaagacaagccaaaatctgcagaggtggtcggtcgattgacgcctgcagaggtaaagcagattttgaagcaacgtgtagaatttgatccgcgggcagtggagtctctaatttttaaataactccacacaaggataccgctgtaaattgtatgaggtgtatcaacagtaaattaagcacatctttctgttatttcatgttttacatatcctttacgattttgacgtgtttgtctccaataatgacactgacaatcttaggggaacttacactcggtagtttatatttgcgagtgctactgtcgatgaccagaagttgttttgaggagaatcgtggggcttctctcaggtaggcacgtgctgtgagcttcccagtgcttcgatacccggagatactgagtccccgtgtccaggaaggcaactacaatacctcgtcgtcgagcgctaaatttagtgcttgcacctgaacgtgtgcacaggtgaaatcatgatgtgagagaatggaaaatgccacctttttcggatatctccttaagtccagccaaatcaggtcaacaaggcagcaacacgtccgctcgtgaactttcggctcctcctttttggcagtactgcatcgtttatgcctcacacatgtcaacttacgatctaccatttacgtgtctattgtacagagtttttgtggggttggaaacgatg

SEQ ID NO: 5600 - DNA, 700 bp, Nannochloropsis_gaditana
gaccccaggagctcgctccccaaatcacatccaagcgtctccattaaaaactcgtagccttgctcgggaagagcagattggccacggtctatacatacaagaggaccatcatgcctgacaacgctgggttgcttcgcgctcgctgccccgtcacctcctgatagggttttctgagcatgatcactcgccgtgtctattctttgtgtgtccatattaccgcttgtattttattgcctcgcgttcggaaagtgtcacccacccacatacaacttctctgctgcctgttcagtgaaagtgtatatatgtacacatcaaatgtatatgactgtcgaagctacgctttcaagcgatgggacgcacagcgatcaatttgatatgtaagatacttggcttctcgttcaattcaagccccttcctgctcggagtcagacggagaaatgaacacgcatgccgcgatctcacagtgcgagatgcaaccgtatcatacccacctgtatcataaatcaagccagcccctcttgacatttctacaaatgtgggttccatgaagtcgccaaatgcctggaagcagcgaagagcatctcctacgccccaccccatcgtgtcccgcgacaaattcctgaaaatccacgtatggacgcaagcttgacactgagtactttgatttccattcatatcgcaggaggaagcaaaaaatatg

SEQ ID NO: 5601 - DNA, 700 bp, Nannochloropsis_gaditana
tttcttccagcttccgccatctcctgtaatcgatgaagcatccgatggcgtggcgtctccgccagagccagaggaaagtagcacggaccccttcactgaggccattgtgcggttccacatgacccttgccgaggtgcagcagcagcataaccggccattatcagagcttcagacagaaaaatacagaaaaaataaagaaaacgacaacatcgacgaaaagctgctagctgggcgggatgtagcagcgccagcactgggccgcctcatggaagatcttgacggtatacgcgctgagatgtatgtgggtgacactgccgctgaaacgtctccggaacaaaaagatgttcagcaggaaatgctggaggactgtgaacgcaaaacgggcgatgtggtgctgaatttactacgcaaggccacatcggccatagctccagacccggctgccgctccggcgtggtttcttgagtgcgtgcggctcaaacaagagaccaaggcggccaatatttatggaggatttctgcaacgccggcttatcgaatcgacagaggatgcactacaagctctggacagtgtccggtcgctgcgccgtcttcagatgggcagcagcaacagccaggccgatgatagtgagggagtaggacaggacagtcagcctcacgtcaccggactgagtcgactgctgggggaggcctcccgaatg

SEQ ID NO: 5602 - DNA, 700 bp, Nannochloropsis_gaditana
ctccatggtccgtgaaggcatggaatgaccgcaataatctgttcatcgaaagtaatgtttgattgctgcacgccaatagcatgcttgcgctgtcgtattttagtcagcctttttcctcccgcttcatcaactaaacgatcttgcagagtggtcgttgccacttccgcgagtcgacaagactatgacagtcgtggtcgttgactcaagcgaattcgatctctacccgctacacgcagaaacatcagctatgcatgctacacgcagtgaagctgccacatttcatggcaagcattcgtcctcgcacgagcatgaggcgctggcaacagacgacggaccccaaggaccagattgccttggtccgttgatcaagcccggcgtctctactcgcagcggccttgcctcgggtgcctccaggcgtgcacttggcgacattaccaacaacagaggcgcgccttcgggaaagccgggacagcataataccagcaaacctatgacacgcgccatgtgggcaactgcagcggccggagaggggccccttccaggcgcaacctccagtgttggcttggcttcggtggcgccgccacccgtgctttacgaacaacctcttccagcactgcagaaatcagatatggacggcaaacggcgggaagaagcagtggatgacatggacttaattcaggaggtagaagaaatcgacatg

SEQ ID NO: 5603 - DNA, 700 bp, Nannochloropsis_gaditana
gctccgcgttggtagagccaggcatgcacctgcttagcccggtacttgggctggtggagggtgttctggagaaatccgcatagttcttgctctgaaagcgcatatatgtcagtcaatgcgctcggcaagcgagacacgacggtattatcggtctcagctgcagcaggtacagctaccgccttagcttttttaggaagaggaggatatgcgcgccctggcaccgcagactgccatcgacgaatggataaaacgccggtggatgcaaaaaaggctgacgagcttcggcaagcagtcactgttcttggtcgcacgacagtcgaccctaaggcgcctataagcatgaccagaagtgcaaaagtacgccccagggttcggcgcaaccgtcctcctgctcttcctcttcctgcaagtttccgatgaaaatgcgccgaaatcatgcaccgaagacccctttcctgtgaaaacaaaacgtgtttcctgtgtcacctcgcccctgtgagcctagcagggatatatatggcttccatgagtagagtcttggggccattaaagggcaacagaatcagaggcagcagggccgctgctcgcgcaatccgcgatgtggtgactcggaggcccctgcgacgcgggcacagccaaaatgccgtgtgcatgagcatgtccaaccctgacggtcaatgttactgacaactttgtcata

SEQ ID NO: 5604 - DNA, 700 bp, Nannochloropsis_gaditana
gaattaagactcttttataggaattaaaaacgggttttcgtatcaataaaagaagagaaataaaagaaaaaatgaattgttgcctcagttgcccttgcatcgtccattttctggcctccttgaccggcgtttgaccaaagccctgattttgacctcccccccccccgcatcgccgcctctcgtcgcgcgttgtcacaggccgacgtatccagtggggccttatgcattaagtggatggagacgactagaaggtgtggccatggattgtgatcttccggtgcgtgggggagctggtaggggaaataaacacgacttgtgcggtggacctgcattttatcatcgttcgtgacatttttcatcaaaagtcaacgggtggataggccattttcttttaggagaacctgtacattcctcgcagagtatcgatccttacgcctagacatgttcgcaaatgtcatgaaaaaggatgaaacaggcattttctcggaattttgtacaattaggttctctgttctcaaagtagtattcctgttgcaaacgaccttgcgactcaaatcaagccgctttatttcctccacatctatttgcatttacaggtctcgagggagaaatgatcaacggtctctcatttcggtgttctcgctgagtaaacaaggcaggtgtgttaggtcaggcgggcaggatagagccgtcaaacatg

SEQ ID NO: 5605 - DNA, 700 bp, Nannochloropsis_gaditana
tggtctccgaggtgatgctcctggaagggccgggggaggggtacgggaggcgcatgcacagcttgctgagatactttctccacttcgagttgaggacaactgaacggaagcacggtcttcatttccccacgtggaaacaagtgctgacgggaaagcccctaattcccgcgatattgctcttgcaaagtcacgccaccgcctaccctcctgtcggccccagaagatctctcacgggtagcctcctcacctgagtattggcatgcgacgaccaagcgccagtgtgttgcttccacggcggagaaacatggttgcgagcatctcgaggcaagttcggctacgaggcctctgacctgatgagtgtgcgaggtaagtgttgcgggatgagaaggggccacgacagaggacgtggtgacttgagggtagaggagccagactgacgatcagcggacctcgcggtcacgcgtggaaatttaaaggacgtgaaggagaagcaaagcccggcagttgcgtgcaagaatagtgcaagtacctcctcggcagcactctgccatctgacagtcgcgtcctcgctcgcatcgccctcgagctcaggatcgagcttgccaacatcctcaagtccgggcttgggacaggcaaccacgccgtgagcacgcttttttggctaattgttcctgccacaaatacatgtgtagaggacatg

SEQ ID NO: 5606 - DNA, 700 bp, Nannochloropsis_gaditana
gtcgacaccttcctcacggcgcgggcctcgcagcccatgctccgtgtcgcctggtccttcttcgcctccagcatcggggcctgggcaatttcctccccgcgtcctacccggccttcgggggtggctctccatcattacctacgcggtgtcaacagggttgcctctcttgctcatctcggagtttgggcggaagatcctcaagcgcaccccggacgtcctgtccttgaacgactttgcccaccgggcgtacggccgtcccgtgcaagtctttgtgatcgtcttgtcgctgctgaacatgtctgtggcactcatcagtgagtacacggccatcggcgacctgttcgagcactatgtcgggggcccttcccgcatctacatcatcatcctggtcggtctcgtgacggctgtctacacggcaaagggggggctgctcatctctctcctcaccgaccagcttcaagccgctttaattttggtcttgattttgattgcctcgctctatcttgtcgtcaactttcgcgaacccctgcgccagcccctgccggagcgtttaggcatcaattactcggggttcagctccattttctcccttcctatctccctcctctcctctgcgtgttatcaagaaagcttttggcaacgggtatgggccgcggaggacaagcgcagccttcgacagggagcgctcttggggttcatg

SEQ ID NO: 5607 - DNA, 700 bp, Nannochloropsis_gaditana
ctcctttgctcccccgaggaggccactgacttcgtcctctatgcacagaaagcgcagggcagcatttgattcagcgtgaagggacgaggagggaggctccgggtgtcaagcgcctgccgagtgtcgtttcccaggtacgtggctgtagtattcatggcctcacgggacattttagccccgagcttgtacgtcccgcctgagtaatcctgttggtttataccctggatttatcagcaggcccggcaatttttttgagctcgaacaaccacacgtctctgcgcgcgcatgtgtctcgttatttggttgttggagaaaattaaatcacgctagacaccgtgacccgtcgtccacaggctaagaggatggctcccacgctgacaccaacaggcccgccacccacttctccggccaatttgaccttcacgattgccagctacgtctgcgcagtcattaccctggtgggtttcgcggcaatcgcgctgaccatgtcacggcgccatcagtccagagacgtcgacaccttcctcacggcgcgggcctcgcagcccatgctccgtgtcgcctggtccttcttcgcctccagcatcggggcctgggcaatttcctccccgcgtcctacccggccttcgggggtggctctccatcattacctacgcggtgtcaacagggttgcctctcttgctcatctcggagtttgggc

SEQ ID NO: 5608 - DNA, 700 bp, Nannochloropsis_gaditana
aacaagtccttcaaatctgagactgtgctcgtctcccaccccgctgtcagtttttccagcatctttacagcgcttgtcggaaacgagtacgggtgagcctttgcctggaagaaggataaagcggggaggtgggcagtgtgcacgtcaataaggactatgaatagggcagcaagtccggacattggcatcccacgagggtagagaacacttacatgcacgcttgggcgaataaagactctattaatcaagaggaggacaaccctgagcccttaaggcctaaaactagggcatgcgggccggatacgccgaagagcccttgcctcccgccccggtctctcctttgctcccccgaggaggccactgacttcgtcctctatgcacagaaagcgcagggcagcatttgattcagcgtgaagggacgaggagggaggctccgggtgtcaagcgcctgccgagtgtcgtttcccaggtacgtggctgtagtattcatggcctcacgggacattttagccccgagcttgtacgtcccgcctgagtaatcctgttggtttataccctggatttatcagcaggcccggcaatttttttgagctcgaacaaccacacgtctctgcgcgcgcatgtgtctcgttatttggttgttggagaaaattaaatcacgctagacaccgtgacccgtcgtccacaggctaagaggatg

SEQ ID NO: 5609 - DNA, 700 bp, Nannochloropsis_gaditana
gtgcccaggaatacgacgcgtttggttccggcggacttggaggaggctgttcaggaggaaataagggatgtcgcgtaagtttgccgcttgatcgaacgaaggaggtcacgcgaaaatgcccacaactctgctttcccctttttcctctgagtgctggtcatacaaacccatctctttgcatcctaggcatagcggaaatagaggatttcccacgtacctcgcaggcctccaagtctcctgaatgccggcccagcgtttcttccgattacctcttgaacagctcccagccgtcgtccagccaatgcaattggcgtataaaaagcttttgaagtgctgaataaaataaatgggagcatcacttttaacaagtaagctggagcagacgtcgcagcaacaacgctacgggctccgacgcgctgacggcccaggctcatccaccaccaatgcggcttttatgcgagaacaccaccacgtgcagcgcgcttgaatgtactgatactctgtaaatctagcatggcccaaaaaaaagtctcagaactggtgaccggtccgtgcaagcctgcctccctgctctcagcgtcgctctgatgctcgccactctctcgtactaatggtattgatactttcctgttcccacgcaccagcaactcacgcgcatccttctggtacaggcggtcgcaaggaccacagtcgcacaatg

SEQ ID NO: 5610 - DNA, 700 bp, Nannochloropsis_gaditana
tactaatgttgataaataaaatttgtttgccaactacagatgagcttttcgcaacaccgcgataattcgtggaagtaaagacgcacctttttatcttcaccttcatgaagttttgcgattacagtgcatcgccggcccaccctcgaaccactttactataatgagacctgacggctaccgtcgaaaggatgacaaaatatgtgaggaatttaccaggcgcgcacgcaagacatctcttccttagctttttccgtgggcaacttacaagttgtgtgtcgggtcactagtcccaagcaggaggaaaatgaaggtccctcttccatcacaaggaaaaatgcgatggcccacgtgcgggagcgtatggccgcatttgcgacaagtaaaaacgtcaaaatgaccgtcagaaacgtcttactttcaacattgtcatgctctttatacttaatgaacaaaaatgactaaaacaatcttaacctggcatttacttcaatggcaggctttacctcctccatcatgtagcaaggtgctgcatttcttgctgtgtcgaaagtctcggtgctctttcatttgaaaaaattaccacgcagagtaatttgctggcaagcacatcactttctccagaagctgaacagcatatatttcacattttttcgaaaataaaaggacggaatgtatcgtaaccttatgaacgagtcggtcg

SEQ ID NO: 5611 - DNA, 700 bp, Nannochloropsis_gaditana
aggtgcacagctgtcgccttccatacgttcccacccaaaataatgttccatggctgtgtccgaacccggcatgctaccacacttcccagcaaaattattgctctgtgaattatagtccaaaactcaccgcaatcacgttactgcattatgtgtcacttgttatgatgagtttctgaaatcccatcaaacttttgttaaggccggaaccaccttctcgccagggaccgggctccccctctcaattgatcacttctcgatgtctgctgccggtcgcgataccctcaccgtggcatcgatttttacaccaagtgagtgtatgcgtcatttagaaagtctagaatgtggcaaaatacatggcaaaagcctgctcaatgaggcagagggatatcacttcgacccaaactccttgcaagacagcccagtaaggggccctgcacttaagacgacgagcgatgaaatcaaacctccgtgtcagtcatctacctcttccgatagctttaaaaagcattacatcacatggctgtggattgctctcggtctggctctactggctctgggtgtgttgacaggattccaagtgtactcgagccttcagaaagctgaagcggacaggcaaagcactcaaacttcctccattttcgccatcgacaagaatgataccgtgacacgtatgatcaaatatgaagagcagcttaacatg

SEQ ID NO: 5612 - DNA, 700 bp, Nannochloropsis_gaditana
acgcttccatgcaaagcaatcactttgaaaagataattcaagatatctacccgaaaggttctcattcaaccatggaaaaaataatacacttcacatttttttaaagggtaagaattcctctggtattgcatttgaaatgacggtgtactcctagttgtacgcattcaatttacgggacgaacctcaccgtctttttttccatagaggaaactgatttctatcgatttttaaaacgaaggaggttgaaacacgagatatgtactctagcacgccaatactttttaacttatgtttacaaggcctttttgattgctgctcgtgccgtccaaggtttttgccatgaatcaccaaagcaagcccaatgctaagttttgtttttgtcgtaagatcgagtatagctagatgctcttaaaattcaatctctgccgggccgctatcaaagtatggatctcctttcgacaagtagtgctcaacctcctctcctttgtatatttggatccttctagtggccgtgccagcgagcgtcgctttctggtgcatgccgtcttctcctctgtcgatgtctgtcggacatatttgcccttttagcatacagttacactgtcttcgtgcgtcggcatttttcaagcaattttaatcaacatccttctcctcatgtgcgcacaaaacaggcaatgctgggagaggaggccattttatg

SEQ ID NO: 5613 - DNA, 700 bp, Nannochloropsis_gaditana
cggctgctttgattgatgcaatgagcggggcgacgagaacaatagtccaggaacatgaaaagcgtctggaaaaactcaaagagcgaaaccccacaagaatccactccaaagcaccacgacctcggtctatccatccgcatgacaccatttctggcagactttgtggggtctaatgccctgggaagtgccccgccaacctcctgcggccatcgccccgagtaagtcgcgcgactacgccacgcactccgacccgtcccatcccctcctgacgcggaggcctcacaaccagggctctggtggtttctgtcgacgaggcttgtggggatatgcggtcacggtagagacaaggccaggtggaggatgacgcgacgcattcgcacggtcacggcgtggggtgaaggggaactggtaacaagctgaagagctggggttgggcgaaaggggcgtgcgggcatatgttagcccataatcgagtgacagctcgcccgacagaaacaaccacccctgtggcaccgcctcgtcatagagattgatggttgcgtgtgtgcagtatctgctgccgaagagatatttctatcagtgcgtccgctctcctccagacagtttccttatccgacgaatcaacattcacttcgtgtttcatttccttgcagcttacatctgccacttacaggtgccgacgaggatcctccacaccatg

SEQ ID NO: 5614 - DNA, 700 bp, Nannochloropsis_gaditana
acacgctgacaacactcactagtgaacggtccagcagggtgatcgagcacagccttgacccgcggattgtttttaataaaccctaccgccagcaatcgggctttgagcgctgttactacgcctaaagccatggaaaaattgcaatttatatagccaacgctcgccttcgtaaacgggagcctgttcaaagaagcactgcgccgcgagggacgtgtcatttacggagtgtgtttcatgtggcagtttgcgttagaatgagtcagcgttcgtaatgcaatgatggcatgtacaatagatcaggacatacgtgcagtcagtgggtgggcccgtcaggctgtagacgcatctaagtggatctgcatgtcgcaatggcaggcctcgcgctcctcgccgcctctcccggacgcgagctctctccaggcacacacaaagcgtcaaggagacgacaatgagcctccgcgaagaagaatgtctcgagtgagccagagcccagtgagtttgaagaccgagcgtgtctctccaagcatcgacccgcatgcccctcaatccacccgatcatcgagttcgatttttcactttaacctcctcagatggcaaggtaccacgaagagaagacaaatcttcattgaggagttaggtacactgttcactgcgttggtcctttttgttatcagaagtctcactctatcgggccaacatg

SEQ ID NO: 5615 - DNA, 700 bp, Nannochloropsis_gaditana
gcgagagtaagaaaaggtgagatatctttctcgacaaagaggggcataattgaatagccagagcaacggcttgatcctgacaatttttcaaggtccatttgttgtaagtagtcttgtcgtgcttcaatgtacaagtaaatccactcgcaaaaaaaactctccgtaaaggcagagagccccacattttctgtttcagtcgcctttcgctcctccgactcggaggaggcgtcgacgggaggtttgacaagcgaaaccatgataggtggccagtaggaagcaatctgtgccggcaaagcgccaagccggagagcgcggagtgacctcttttccgacgccaggtagagcggcgacacagtagactcttagtctgcgtgctgaatggtgatcgcgtactgtgagcggccatggcgcccgagcgactgctgagccgtgctggatgtggttcccgtgctggtcctggggcgagacccctctacccgtaagacctgcttgacgtttttttttaaacggtatcttatcagctcacgaaaaacatctcacgtgctttgtcaggctgtggccccttttattctcgaagctgcgaagcaacgttggggtagggttgctactcctcagctctaagacaagccgtctctctgtgaaggaagttatttgggcagaaatatctgctcgctgcgatcatcctttcaataatctcatg

SEQ ID NO: 5616 - DNA, 700 bp, Nannochloropsis_gaditana
gataacccagcaaactccgcaaaaccacgcatcaacgatcgcaacaaggaattgccatgtcacttttctggacgatgatgggctttctcgaattcgatgataaaatatgggtcgcagatcacactcacagagctggaggaaggctgacaattacgtacttaagtgcaagccatgttgtgaaatgagagacgggaggttaggcgtttgtctgctgaatcgattcgtcctcttttgtgtgcgtatgtacagtcatatccatgataatgcattgtcccatctcatatctcgctgcgctaggtcttgaggagggattgcgccagcccgccccctgtggctagcacccgctctccatcttatctgacctccttgtgtcgccattgcgtcataaattaaaaatcgatgtacgcgggattgtcaaccatgccactgcattcaagactatgctggagtctcgtcacaatgctggccctgggtatactagcaacttttcccacccattcaaaagcttacacacttgccaatctcagtcgactgccagctcacaagaagtgtggagccttttttccccggcgacctctcgtggacagggatctcagtcggtctcaagtgctctcaggaggtatttcggccatatcaggatctttcttggtatgtttgggtgcttcttttcttcaaattaagcctgtgatcgctgccgatg

SEQ ID NO: 5617 - DNA, 700 bp, Nannochloropsis_gaditana
ttgctgtctccgtctcctccctcgtcaagcctatgcttccgcaaaattgggtacgctttcagcctcgctttcagttggcgttcgaatgtatgaaaaacaaagccaatttttcttttgttcgccaacgttgcctccttacttacgcatgtcaatgccattttgaagtaagccttgcgaattaccgccgaggccgcatccttagcgacgcctaggatctcgtaaagcgtcttttttttcccgaatgccttggcaacctgcgcttgaggggtcgtcattgcttccaatgcccccatgatgatgcaaggatgtgaggcgcgcacgcaggttagcatgtttcaacagaagtaaatgcatgtgagttttgcccagcaactttattcctttcaacccttctcatgtgacaaaagtgacatgcaacgttcaaggcagtgcttcgtcttcgatctgcgtgtcactcgaaggaaacactgtttccacaccgaagctgaacaagaacactgcccgtcctgacagcgaaggcctgtgatggaaaaaagatggcgagagttggggcacaaagtggtctctcactcgagcgaggccatcaccgagacggtggtccttacggctcgatactcagagcgaaagggcagctctgatgatctggagggaaaagcgtctcatgccttttttgtgaaaacgatagagcaaagacagcatg

SEQ ID NO: 5618 - DNA, 700 bp, Nannochloropsis_gaditana
agcccggctcttttgaattaggctgctgcctttttcgtcttatctccttgcgagaccagttttcgacgataaagccgttcaaaacatcaaaatatcagagcaaaaataaagaaataagttagctggcatcatgtgatgtgtttaaagacctaaaagctcagaatctccaagcagagaaagaggagtgacggttacggcgaaggcaacgctcctaggcttgctccctgccctgcgtccgaaaacggtcatgagccgcctgcatccagaggacgagttgcttgggaggcagattgctgcactttttagacggtcctggcaccctacgccactgaatcccaagcgtctcaccaccgggtgtggagtaagtgagcacggtcgctgccgtcgcccgcgctgaagtcggcgatccccttgcctccccttcaccagctcccagctagcgcccatgcggatgaggcgcttgggacaagcgcaaagctaactcatatcaatcgtggttcttcactgtctcacaacattctcttaccacatgtcctatgcacaaacagggcagggcgctagttcattggacggtggcttgctacttttgtccgctcgtggaagtcaagcacgaactcgggaaaatcaggcacaagtctgtgaaagcatagctccgagtacagcgtgatacgccatagcttaaattgaagtataaatcatg

SEQ ID NO: 5619 - DNA, 700 bp, Nannochloropsis_gaditana
tttcgctcaaaattctcaggagcacgttctgatctctgatcgatgaagataaatgctataatgtcggcatacaagcctgaacagtttgcgtgctctctctgtgactctggtggacctcgggcgcaagatgaggctgactgaagcctccgtcattcttgacattcgtacattcccactcttagttttatcgtgcctgtgtcacacgcaacgcttttcatgtgtttgaggtgctccgtgtttcgcactgagtgccttgtgggggtaagctagagcccgatggtgaataaatctgtctagcaaatggctggctagcccgtggctgacgggcgagctggctcttgtgagagatcttggtggctcccgctccactcatggcttgtagacacgacttttacgttggccttgtcgttccgcgcgccttttgacgattcacgttgacatacactcgcaagcatgtggtgtctctcatgacggtgcgaagtgaaatgcgctcacgttctgaaatcgaatacttggctcgcgcgtgcggtaaatttacactcgtcggctttgttcttgttcctttgctgtacaactcactgttattcaactattgcacattgcaaaaactcacaaacgtcttcctaactatttcttcatgtcttatatcgcaggccgacgcgcttctagccgccactccgtctccttcacgtcaaagatg

SEQ ID NO: 5620 - DNA, 700 bp, Nannochloropsis_gaditana
gaagagactttcacaagggagtgcaaaggagatgtcgtcaaggtttttcgaaatctggatcccgccctacatccttttgacaaagcccgggaatatactcgcgcccttcaagcgactaagctggataagctgtttgccaaaccatttatcggtacgttgacggaccatgaaatgtctttggtgagatatttaggagcatagtttcaatggcacattttgattgctcctgatccttaatttttagcaccttagctggtgcagcatgtagtgtccgctagtttaacgtgttagctgcatatgtgtaaaatgtcatacctccttccgcaagttagaaattgttttttttacatctttgaatttttaacaggtgcattggatggccacacagatggtgtattttgctctgctcttagcaaacgaaatttggttcagttcttaacaggagcttgtgacggtgaggtgcgagtatgggatttaaatgtgcgcaaatgtgtgtggcgtgcgtatgcacacgcaggtttcgtcagaggtctttctgtagcacccggtgggggaacttttttctcttgcggagacaagacagtcaagcaatggacattatgcgtcgcagacgactccagacaggtctgtgctttagatttcgacgcatccgccatttcaattcaaatagtcaatttaccaatttccttggtactcgatg

SEQ ID NO: 5621 - DNA, 700 bp, Nannochloropsis_gaditana
ttaaatcagaacccaggcaccgaaatagcatacaagcgcagtgcgcttggggttaaaaacatgcaacaagggaggaagccatccattggataggcggaggaagttatagacgtaccgcgttggaaattttattcccgttttcgcacatgccattacgacatgtgttcatgatggctgcaacgaacgagaaaggtcttggcaaacgcatgcagtagcagcaggagcgcctgctagggttacaaaagttgagctatacgtgtcatcgtgcaacaggcacgtcgcagccagcgggttgctcagtccttcattttatttctcgtgttcgcgacgcacgacaattcccttgagtggcatgcaagcagcagcaaaaaacatgacatgcggggagctcgaggcggcggctcttgaagacaggtcggcgagagagtctcgagcttcaaccggggcctcgagcggcaacacgtgggccggacaagcaatccgagcatagtcaacagacccggccctcaggagacattcttctaatatgaataatttgccgcggtgcaaaattctggtaaatcaaagttttgacgagatgaaaaggaattgacggcatcctagaaatgccctgcttactattccttctgcttactccacacgtgtgcagacacctcgacaaagccttagtggcattattttgaccgtctctgccaaaatg

SEQ ID NO: 5622 - DNA, 700 bp, Nannochloropsis_gaditana
accaaatcatcatcactcaactctatcttgatgtaagctcgctcttgctttaagcgtaatcatgcgcgcactggtttaaatgtgtgtgtctctgccaccgacgcgttgagtgcaatagcgggcctgcgtctgcgcacagcatcacgcacaagctttgctgcctcgggcggtggtctccttcccgatccttctacttctcactaacaatgtgcaaggattctgaccatgacaaccatagccgcctcaaatgcctgatggcttccgagtgagagttgtcgctctgggtagtgcacctaggtcgcggagggacaaaggttactagtaggagtcgcctcgccctcgcctcgctgacctgatctaagccgtcggatcagggatttgccacgaagggggcgtgcagcagagcttgctggacggcagggtgacatgcgtgttggatttgtacatgcttatgataggtgggatacactcccccgctgtgcacggcgtgacgtccgtgctgagaggacccgtgcaggatgatcgagcgagggcgaggaaggagggacaacggcctcgaaaccagggctgggacgcacgccacgctcgactttgcgaggcctactgaacatcaaaggcgcggcgctttattttcctgtcatgttcttgccagaatatctttatgttttcactcttctcaatggcttccacaaaaaacaga

SEQ ID NO: 5623 - DNA, 700 bp, Nannochloropsis_gaditana
atcgcatttaaattcaaggtcttccaacgtaatgtatctttcgggaggcgtacgtgatgggaggccagataacagaaaacaggtagagccgcagctgaaggtggagggaggccattagtattcttcaatgtgccaccacacggttgatcatatcgattgacacgacatacatacatatatataacactgatatcgcatcggaaagccgacaacgatttgttcccgagaggtagtgatctctccaataatttcccccagcatcgtaagagcaagatgtgtccgaacccgatgatacaagttcaagttgcgcaggaccccaccacactaacgcgatggactgtcctagtctgcacagcgcacgttagtttggctccggagattgtgatggctagaaaagatttttttcggtgccataatttgatgagacctttcaaagggaacgagcagaagacgaggcgagtgggctcatcatccacatgcactacttcgctgtcctcatcttgttgaatgtcatttgctacatgaaaacttctgactgtcacatactcaggcccagtttttcatgtgtttaaacgaaagtctagtcaatgatgcagccgctgcacacacacgtatactatccgaggtcgcacatgaagcaatccaagtacatatctgtatatcgcactaaattaacaccttgcggacaggagacaacatg

SEQ ID NO: 5624 - DNA, 700 bp, Nannochloropsis_gaditana
gctccatcactaccatcacgcgatgcgcacacacttaagtcaacaagattctcagggccaccaccttcatcaacagcgcatccaagcgcctgagcagcgtccacagcatcagcacgaccacgggaatgcatccgggcagcacagcatctaccaccagcagctgccgctacaaatgcagcaggacgatttgcaatcctcccagctgcagttgcagcaacagcaccacgccgaccaatcaaagctgcagtcccatccacacgaccagcggcatctgcagcaacttaatcatcatcatcatggggacccactgcggcagtttcccctaatatatcattcccagcaacagcgacaacgacaccaacagcagtcacagcaccaacagccgcaacaacaacaacaacagcagcagcaacagcaacgacccccaccattgccaccaccatcaccagcacagcaactacaggagaggcacagtgaggacgtcgaaggcgcaaattatagaccaaaccattgcatcgagcacgttgtcgataaagtgtggagatcggaaggggtaaaaatcaatgatattgagccgagtagaacagacttcaaattgcaagagcttcccttggcgcgggtcaagaaggtgatgaagcaggatgacgaaatagaggggatatcgcgtttcctcgtgagtatggaggcacttatcatcatg

SEQ ID NO: 5625 - DNA, 700 bp, Nannochloropsis_gaditana
caggcgccaaagtgatgacacgtgaaaccattgaagacgtcgtagtcccatgacagtctcattgtacggcaacggtgcgacaaaaagacatagtgtccacgctgttggccgcagcatgcgaactcatggaatttcttcgccaagacaccatggacagctcgaactagctcaacatgcgaagcacaaatcgaactccgtgaaaatgattgcctgttgcgcatacgtgactgcatgtttactagagcttagaagacatgcgcgaaattgatgcctcgttgatgcatagtgaaaggcatgaaaggcgttttccaaacctcccgcggcctctcatctagtggagatgaaagacgaccatgttctcgagtgtgcttaccaatccgatcagcctcgtaggcgtctattagcagggacagaatcacaacagtgctttcaatcatgtcgcctggaaagcattgtaggaaaccgcttttcgtttcccgccgagaatcctccttttcctctaatttctcttggactcccgcgggctcatcccgttacctaacttttcttttcatctcatcattggatgtagcgcaaacctttcttggacttcagaggtagtatgggtgacaaagcgaagggagcagaatccgggaaagtggtacatttagtgagccaggagggagaccagtacgaggttgaggtctcagtctgcaaaatg

SEQ ID NO: 5626 - DNA, 5 bp, Nannochloropsis_gaditana
tgaag

SEQ ID NO: 5627 - DNA, 700 bp, Nannochloropsis_gaditana
tccccatctcttgcagcggctgctttgttttgggaaaattctatttttgtggtatcgcctagcgctgacactgtcgcacttgccacgtcctttccgttcacggccctcaacttttgtgcctcaacgagacttgaaaccaccataaagatggttattgctttgtacatgccggtcatctataataaaacaaaataaaagctaagcagtatataattttgacagtggtaaacggctcacatcgtggctaaggacgtttgttgcgaagaaaattgcaggcctggcgggggcagtcgggtagggacgggaaacgtggtcggatatttcaatttgaaattcaaattcgggacattttcctgaaaggaaatatgacgcccggggtccacggaccctcggacaatggccgacacaggatacttccttggtggcccaaatcatgttgggtccgggggacatgtcaagtacacccgctggtcctgtatgtgatcaatatcctgagtgtaatataacgcggtgcgggactgcatttcaacatggcctcgacgctctctgtaggtcctgcaggtggctgggaacattagaaaagcgattgacatggatatcagagtcctcatgccagtgcatcatgcggcttcaagccttgttttaaagttttaacaagaattacacacggtacccacacatagattctacttcagccatg

SEQ ID NO: 5628 - DNA, 700 bp, Nannochloropsis_gaditana
aagttttgggacgaaaaagaaagagcaagtgcaacaaggttgccgttgtttcgtttaccggcccatgccactgctagaatttgaggcatccagggcgtccttcaattggcgttcccattgaaattttcttgctatatgagtcaagcttgattaaattgaaaattccagtaaaaactaacctttaaaagcgcaagtgccggatatacctttccgagctatgtcagatcgaccaatcaacaagagggccgtatcctaaacaaaggacgcgttaaaaatatcaaaagttacacttacgcttggaagtaattgcacctacaaatgcagacgcataatttctcatcctactttttgagaagtattcataggagtcacttctcacggcacaagatctaggtaagagccgtctaacaacttgacagataatggtcgcgatacggagacataatgtttggcacgcaactctgcaatttttcacaatggatcatagtattgtagtactgtacaaaaatgtttcctcttcttgtttcccggtgtcatttaggccttgtatatcgattttggttcaaaaaaggggagaaaactacatgacgtgggaagaatgttatattttaaaaccatctaatcaactgcatggttttcttctacacagtcatttgatatctttgtcttgtcttttgacgttctgtgcacactcgattag

SEQ ID NO: 5629 - DNA, 700 bp, Nannochloropsis_gaditana
ttacatggatcagtctgtccgaggtacgagtaatttggtgcaacagattaaagtgagagctggaggggagttcgagctggatcttcagcaattttgatttccttacagatttttgtgagtagcggtgtagaatatgtatcaaaagcttttccataagtgaaaaaatctcacgggtattgaacagacgagtctcgtacgttaggagttcttccggttctcaatattccttcctcgtcacctttcaattaatcaaatcagttttctctgtgcgatagcttgtacaaaattgacaagctatttaaactagaatcctgtcatttttatttagaaaaattccgtatctatggtaaacaaatgcaagagttttacagtcaaaaaatacttcgtggttaattgagcagaaagggtctgactagctgatccatccttttagagagctctcgatatggccaatacatagaaatacatcactttttgcattatgcgtagtttaaaatgcaaaggcaatacttgtttaacacaatagcgacagctaacgcattttgaaatggggagtttatattgggggataatatcaacctccccatccgcaacggatcggaccggattggggcgctttgctttaatcagaatgatcggaaacccaagtctgttattcttgtgtcttttactcacgctagtgcgaaaattttcacacaaa

SEQ ID NO: 5630 - DNA, 700 bp, Nannochloropsis_gaditana
acgctcacctgactcttattgctggactgcatagggttatgactggtaacctgtaatggtaattcctcggtcactcgtacacaacctgtctcttgttgtgcgaccacttcggtcagacaaaaatgacggaaagagatgaatcaaattattgaggtgatgcagccacatatcacgttattgctcgcagactaggcgtgcaatcacaattcccacccgtacacgaaggcccatctacccgtttcttgaattttcttgggccggcccctcggtccacaaaacgcaagctcaggccgggttgtcggtccacaaaagaccggtgagctcccctcttccaacctgattcggtcacaaaatcccgacctgattcggtccacaaaatctccctgccggaggctgcctccgcctgctggaacaactttcgggggcttgtaatccccactcatgtcatccgctgctattgttcctcttcttacttacctttgccattttttttcaaatttggtcacagggatatcaacgaaaccattgggaggttgaagtggtgtataattcagcatttttttggcttgcctcccgtccacgcctcgtccctgttgccacgtctcacccttgccacacaagtatttttttgcaacgcagtcttttctcgcggtaactccgaagcgcaaggacaaaacaacaagtaatatcaaaaaacatg

SEQ ID NO: 5631 - DNA, 700 bp, Nannochloropsis_gaditana
ccaatcggtgtcaagctagcttcttttgaaaacctttggtcttactggtacgcttcccttccaggacctaccacgaagccacctctctttggttcttgatacctatcccgtcagattatagatcttacaagagcttgaaacttacatttgaacgtagacccctgcaaatgcttggtagtcgaagcaatatgcggggattttcttgaatttctctttcaatccggaagtgatatctcctcaaatttatctaaaatgtttcacatcttatagacaaccaagatatgccgcgagtgcccatgtggctgcatatcatatgcagctttatgttttgtggagcttcgatgggatgggtggcgcgtggcctggtttccaagcacgataaaccttcgtgcctggttaataggaatccgacggcgcggaagccgaagcagcttccattatttcctgctcctgtggtttctgaatcgtcacaaacacattttttacgcagcaatgcacaattctcggcaaaggaaactattgagtgctccaatagcgcaatgaagcctatcgtgtgtgacgtagctatcgtaggtgggggcccggctgggtctgtcatggcagctttacttgcacagcagcatgaactcaaagtagtaatgatggatcccaagttagatcaacggtggatccccaactatggtgtttgggtcgaggaatg

SEQ ID NO: 5632 - DNA, 700 bp, Nannochloropsis_gaditana
tgctttaaaaggcttgtaagctccggtgccttagcaatgtcgcgggcgatgatgagctaaaataaagagacacggttattgatatgagcaagaaaggcaatcagaccgacataaatactttcaaaggtgcaatcaatcaagacgtggtcatttatcgagcaaaaatacgtacttgttggtataaaggcatgcttggtcgtcaactcgttaagcctccaagctgttgtgcactttctgaaacgtcacgtaatggctgttgtgacgtgatatcgtcaagtaatgatatagaggagcaagtcgggagtcaaactcgtgaccttgcttttgcttttgtaataccgcgctgcaaatcttccagtgctgctgcgcgacgctcaaaattggtcgaataaatctaaagcttgtagagtgttgagcaccgttgatgcgttgacttgagagcaccaggggctgccagggcagtgcagagaggacgcgagtaccggaaggtagtatgagagaagaagagaagtggtggtaatcgagggtgaatacggttagcacgggcataaaaaatggtcgtgtgccgggggctgtgagggacagggagtctcctccgacctcggtcgggctccggcgctcgctgagtacggtcaccctttcgtccgctactcgttttttgcctgacaaccaccccgcatctcaaagaggtggctcaatg

SEQ ID NO: 5633 - DNA, 700 bp, Nannochloropsis_gaditana
agctatacgagctgtacataatgacatcacatggctttggacccttcaaagcattagtcgtcatcaagtgggctgtaagcgtgtctttcacaaaacatcaaattagcgtgtcttaccgaaatcaactgctatcatgtgccatttttctgtcgctgcttccttatttctttcaaaattcttagcacccattccaaaaaataatccaaaactggccttcacatccattaaatacttttagcggggcattcgccccagtcgcacttttggtaataagtcttgaaccccccagcacgaataacggctcgggactacgtccactcaaatttaaacggtcttcgccacgccgaggagaccaagtgggacgggttccttgtcgtgccaagcatttgcctgaatgagcctccatagtcatgacagcatgatcgaataatttttatttgacgagtgagaggatggctccattcagattttgaaacgccgatcggcggtaacattcttttgcactcgatcatttgacggcgggccacggcatatcgttccattaattcacatgcatttttttaatgatctcacggttgatccagggttgtgatttggcagcgtacagcaatgacatggcctacgacagagaatgtgcgccgtaggagcttgcttctcctgttaatcgccttactcgcagcgatgattgtgaaagcaaatg

SEQ ID NO: 5634 - DNA, 700 bp, Nannochloropsis_gaditana
gaccccggaaagtgttgttcattcccatgtgatttttgtgtgaaattcagagatcaaaggacaagaactgtgcaagaggctctctcgtgcttgtttcttcatcaggtagcgcgcagtcgtcggctgatagaccagcaggtcgttcaagccattggcaaaagtcccaccctctgttgccatccgtcccagtattagtatagtagtttatcatttttgacggtacccgcaaggaagagaaagatatagttatcaccttgcaatatgatctctagggattctcccctgactcccctgatggcacagtggccgatgacgcatactgtcttatcgctgattcgatctaccctcagatcaagaaacatcattctacctcttacaactgacaacccattttttacatactccgagtagttagtacctcctactacttggtaagcaaggccccttgcgccttacttgttcctcctcgcctaaccggcaaacggatgcacccacttcaggcgacatgacagtgagatatggacgcgcaagctgaaggcagaaattcactggctggtcctcgagcctcgatcgaccaatatacttacccatccacatcagagtggcctctcctttgggcagaccatttcatattatatatatatatatatatccattctaatcgcaaagcaattttgggcttcacaggaccagctctatg

SEQ ID NO: 5635 - DNA, 700 bp, Nannochloropsis_gaditana
gcttggcagcagatagagcgttgttgcatacgaagaatttgaaggcgctgttcctgttgcatacgtggagataacataaggggtgagggtagcgaccagaatgcttgatgttaaaaaaaagtttatgtcgaatcataaatataatatatatatatggcatatgtatggtatatggcacctcgtttttatttcaaaatcatgtttccaagatagcgtctacatgtgttattcgattacatacccggagattcgccaggatacccggagtcaaaggatgacgccatgattttcaaataagtaaatcaaccaatcatatggcagaccgtaaaaaaacggtttgtacatgatttcttgtcgaccctcaaacgatcgatccgtgaacatgcttccaagtgataatttgcaaggctatgtcgtccgcctccttacccgtgtagcccttacgactgtactgcgtggtgtgtcacttcgtcgtcaaaatattgtaagcataactctacgtcatccatggccaaaacgcacactctctactttttgagaggaacgcctaccactgggacatgctgctgagaattttggctcttcgaagcctcaaaatttaatgcctttttctttttattattactgtccttcattttaatcgctggtatatattttacttgcgcatcatgacagaactttctgcttcaccgttaaaatg

SEQ ID NO: 5636 - DNA, 700 bp, Nannochloropsis_gaditana
cagaggggggaggagaaggaggaagtagtgccggggaggtttgttgggaggaggaagggggggaggacgggagggaggaagtgcgagtggtcgtaggcgtgtcgaccatgacaacacctgtgcgcatgagcgtgagatattattctataccattcatcgagctcaattcccttggggcacggtggacgcaacgcttcaagatgacactggcactcagggtgcgctaccaagctctctgccgatattttggcggtttaagagaaatcgagtaatcggccccactaattggaaatccctcttcaatcccactggacgaagcaaaatgtcacagcgagcgataaattcactcaaaggcactccttccagcctcgcctgccccccctttcgctgtgggtagcgtgtcatcgcccctctctctggtcgctcgctcatgcgcctcctctgtggaggaagatcaatagaagtcacagtccctacatatctctcaagtctctttttgttctcacgtatgtaccggtatttcaggtctacgtcctcttaacatcagtgccagggggtcgtctgctggacggtggagggaggaaagcccaagcttctcccgcggcccagtcaagctctgttgttgagagggtggcaattttggcgtacccacagggcatccactcgggattgaggctggcctgtgttcctttcaatcatg

SEQ ID NO: 5637 - DNA, 700 bp, Nannochloropsis_gaditana
ggtttggccttctacaaagcctgatagtagatgatacaagcgaaggaaaagcacactctcttgcatgctgtcaaggtcctgcgccatctcaagataatcgcagccggtttcaacgtgcaggacccggccgggcttctttctgttcgcgctcgtgtcccccaccatccgggggcctaaaacatcataaggtttcccccccggagtgcgagcgcgatattagtcgatacgcgaggaggtccacgtgagcgccgacaagattcctagccaagcactctacctctgctgtgctgctgagtacgtattcattgccggtttttggggatcaaatacgctatgcatgttggggtcgattgtcctcatcgatcgtgttggggtcgttaaacatcaaatcagcccaagctcatccgaaatgaagggggaaggaagatcgaagagcgtgggatgggaaggcgcctcgcctctggacccctgcatattttctcccacttcctggttttggcattttaaaatcctttgccgtggtcctgttacatagcaagtgtgcatgaaatcacgcgattacgaacgtgttgccgatgccgttagtgtgggcaagagtttagcggcggggcccatgtgtaacgtcttccgccgcccgaaacaacatcttggcaattatctgaacactacgcgtgccaacaatacacaacaggacgcaatg

SEQ ID NO: 5638 - DNA, 700 bp, Nannochloropsis_gaditana
cccatcttgtacttggcattataaatagagcgttacgaatagttgtgtagatcaaggctgtaaaaagaaagcatttttccaaacgtgagaccgccaaactgccttacgtttcttttaccgcacccttgaacagccgctgcttcacgcattcatagacaacgactaattctgacatggtagagaaggtgaaagggcggataatatgagctatgcgtctcgcgactccgcgtttgcccaacaacccaccccaacggttccctcttcacttggcgggggggggggaggaggttaaacttccttctggcctggacactaattctgtcccatcattattcaaaaaacttacagaccggtcatggcgcgggcgagtgtgtatcgaagatggagaatgttgtcagttgggaacaagtatgcgcccagcatcccgacccttggagcgtgctttcagtacacgctttcaccaccagccagagtatggcgtcgacatcactcgatcagggcttcctgcgtatcaaagcccttttccacagccgccccgtttgtgatcccggcaacaccaggcctgtttggagtgacaggccttcgtcacccagaggactttctgcgtctggcccgggagtctgtgagccgctgcgagaatttgaagcacggccttctcacagggcgcgtcccagcgggggttgatgtcatccgcgacatg

SEQ ID NO: 5639 - DNA, 700 bp, Nannochloropsis_gaditana
catgacgccgctacgacctcgaccatttttttcagttcctgcgtcgatggaaagcatcaccatcgacaaataagcggaccagcccaaataaagaggtaacaaatatatcaccttattaaaaaatactttaaaatcacctcaccttggtgttgagctccgtcaagcctgcatttgaggttacgttcgactccaacatttgtatttgtgctgctgctggtagacatctaaaaaagactactctcgaaaggccaaaattgtgcaagctaagagtgcaatttctgtcgtgaggctcttcagcgtgattttcaaatgttcgagaccggagtactgtggcaaatggggcagaaaaaatcagccagttggattgcaaatatcttaaaacttgttgtttacgaggaaaggatcataaatgtatgagaacttgcaatggatgtcggctaaagcataaaataaaatcttgccgtgagctgatcgccgtttcatttcaaatggcagcaacggccgaacacgacccggtcgaccctgcatacacatggggagttctgcaccgaggattaataacggcaaaatatgaacgataactccatcacgtccatgagtatcagcatattagaagtccattgtcgtttcccactctaaccagccacagtagggcctttcaagccatctttcaggtggctgacgaagcaagcgggctatg

SEQ ID NO: 5640 - DNA, 700 bp, Nannochloropsis_gaditana
tgggacactcaaaaagagtggatcaagccactgaaaattctgattatgctcagtaagaagggctactagggtggtaattacgtcgtctctggcgctaaacctattgcttatcattgcgagcaagtttgtggagacgtgcgccgctcgacaaaaaaagagaaaggggggtacgccataaattttccttcaagaggatagatactccacgaagcccaatgtggcgaggaaacaaatagaagaaaacgaagctgatgcagtgcgcggtgtgacttaaaaaagaactttgaatgctttgcaacctaggccgagtagcgtcccccccatccaacctccccccatctcctatgcccccagcgtcccagagctctcactcccttcctgaaggttacacatcacaaaatgaaaaccctagcccgaagctttgatgggcaccttttcagcttcgtacaagacttgtattatcagacgagctcatctcattgctctcattctccacaagccgcccaggacgagtcggcccccgcctgtgaacttgacggtcaaattgtttacgttttatagagaaagcagcctgcaatctcgagagtgtagtatagcactcatgcaggcgctaggaacttcagaaagacgggggggaaagtactgtgatgtccccaagttagatttggagagtgaattgagccagcatacgatggcgatg

SEQ ID NO: 5641 - DNA, 700 bp, Nannochloropsis_gaditana
ggatcccggggggcgagtgaaatgcgtatgaggtgtcactcactgcgacgccaggttcacgacggcaacggagaatgtgaatgaggcataagtggtggtgtggcatggtgcgcaaactaactgcatccactgaattgataccaaaccttcaataacccaaagaaacagcccccgttcgcctcttggttcccgtggcctgccatcgccattgcggcggacactccggtcgtacccctcggtctcgacaatccttgctgaaagcgatgagggtgccaaggctggcaacagcgctcttgacatatttagccggggccgtcacgccctgctaggaggaaagtccctcccaaccaccccagcaggtagagtggaggcttccgcggtccctctcgagatgccggcaggatattcaacggcaggcccgctcgctggtgggagagtgtcgtccacgcctcccagcggccgaggcgccccccagtcccatcctttgcgacaggtggagcttttgcatacggcgggcacggacgtggccagagggcctcgtctttcccgacacgcgccgctcccgtccttcctgccgcgaaacgaaggggccggacagcccccgaatcccacgttaggctcacagcggggctccttgacacccctggcaagcctcccctcacggccgagaccccttccacatgcaagtcccgcggccatg

SEQ ID NO: 5642 - DNA, 700 bp, Nannochloropsis_gaditana
ctgaattagagaggccaggcccccggccgccagaacctggcttcttaggtcgtttgaggccgccgcgtacttcccaaggtggatgcaggcatcagctttttccttctttgtcccagtccggagcttgcagacatggaatagaataaggttggaggaggagacccgcgtccggccgtcctcgtgcaggtaggtctcgcagcttaagcaagcggcggggggcgaaacttgacctgtggtcgacgtggcttcggaaaccagcttttcgttgccctgaccgtccatagtgtgggcctgctgaggaggaagtgcaaggaatgtgaggctgagtctctgcggcctccgggggaggcggcttgaccaggaggtagtacttaaactcgaaaaagtattccggcgagactgcctagcaggggagaacaaagaccccggccacaatgacattggttcgctctgggtccagaacgactacacctttgagtcaggtcgatgtccaatttaaccgtgtgagcaatgcattggacatacaaaagacacatacggcctgaccgtgatcgaaagagtcatcacacgccgaggggggggagggtcgagcatatgtcaagcgaccgcgttactgactccacaaacaaacgtacaagcaggaaagcgacgaaaagatcagatgcgcaaggaggcagccatgatgattgcatgtctagtt

SEQ ID NO: 5643 - DNA, 700 bp, Nannochloropsis_gaditana
gatgaactacacccgaaagaaaatgagctgagacggctcgcttcctcttccttaaaaggagcgtcggcggtgcttgcgatgatgggggcccaaaaggtagggatgtctcccaagaggggagaaaaatcgaggacggccgaggcgcaaaaggtggccaaaacagcggtgtcgattatcagtggcaagcgaaccagataaaatcaagtgtcgcaaagcaatgacaaatcgagatccgctgacgctggtttcttttagattggaaggaaggaaggaaggacaaggcggggcaggaggttgattgctaggactccggcctccgtcatgcctcgctcaataatattacgttgtgccttctgaataaaatgccaccatgcaagcacgctttcaaagagaaatgttttaggtgatgtgatcgcgtcttgttggcggggaaggacgtgcaagcctatcccacgggtaagccactcctcgctcagctagcttagcgggcccctggcgccttgcgccttccgtcggcattgcctcgcacacggtaatcctctttccgtcttacatgtttggctctattacaacacagaatttttccaccatagtatattctgtatcctggaaaatttgctccccttcgtgtgggtgcaggaaaggcggggctactttcgtgaagctctgtccctaagcctctcattgaagtggaacaatg

SEQ ID NO: 5644 - DNA, 700 bp, Nannochloropsis_gaditana
gaggctacagacgggttgtatatgccgccttacatgcaagattgtatcaagccccaattccttgcggatggcctgaccgtgggaatataaagcccaagccttggccttgtcatttcgacagaatcccaagtaaggccccatgcctgggatttgttccatattctctggcggggcagttgcgggaggcgtatcagccttgccggaagggctggcagtctccgcactaccggaagcgccggtgactgaagaaatcattcccatgaggttgctgaaaagtgagccactctcatctgaaaacatagacgtctcttctttaggggacgtcatgaagctgtacgaggaaaggtgagagagaatatgagggggatactttgcatgaatctgccacaaattacaaacaactaagtctctcgaatgcacgagaccttgtctgtgtcctcgcaaaaagagaaaagcgctcgaaagcgacggcaatgacgctgcgcaatgccacctgggcggcctggctgggcggatttttcatctctgtcaacaagaaagggagggaggtcgggtatagggcaatggcttctcgtcgggggaaacggctcccagcggtcaggaccaaaatcgcctctttctgtgtcaagctttcttctgcattaatcaattcagagctttgatttggtggcattcacgttgttattgtttcgtcacgagc

SEQ ID NO: 5645 - DNA, 700 bp, Nannochloropsis_gaditana
ggaggcgaatttgtcagtgtaccggtcagagattgctgctatccttcggggacatgcttgggagaatatccatgacaacaattatgtgaagtggaaccaccccccgcgagactttttttttatgccgcagtgtgcgccgcaacgggtgccaaatttcgatattgttcttccgggcggatggtcgggggctggcttgcggcgggtcggaacggaaagcttttcaggaaatgattgagagggtttcgggttcaggatctctgtcccgcggcttttcaacaccaattttactagatctagcaggataagactaaaagcaagcagaaactcctgtctgagctcaggtttgcgggggacaccggcaaactacggagtgtaattaaagccctctgctggctgaggctcggaacggaatgcgttctcggcgccctgacttttcttaattaacacgttttaaacccattttagtctctgtaaagggaagctattcatcgaaagaatcccacagaagaaagaatggaaagaggtacccattggcagcggaggcagcgtcccttgcgtaacctctgcctgtttgcttcacttcggcggagccgggccatgatggaaacacagcatatacccagtggagccttagaaactgtccgcacagcgccaaaaggacggctgccagactaccagtcaccgggccaggagcaaaatg

SEQ ID NO: 5646 - DNA, 700 bp, Nannochloropsis_gaditana
actcagccatgcgtttttcctcgttcgctgccttctgctccgccttccatactttctcaacatttttgagattagttgggttccaggtctaagggtgaggagagaggagtgggcaagaggcgggagaaaaaatgcataaattcaatatgtaagggtgtatgggttgctgcgtaggaatatacgggggagaaatgcccaagaatgaagtgggacgtcagcgttcactccattcagtcccaggctgagtacgtaccttcttggctaagaattttagagacatggcgctctctggttgcggtgccaatgagggaggagggaagggatcacaccgcggctatacggggacacgagcgggacgacaagtcaaggcggctccaaggagatggtcgtgccagtatcgcagttattgcgacagtaatggggtgcctacttatgaacgtatgtattatacgtgagtgttgtccccatcaatcgtgcgtgcccccccttgtaattcggggtgagccgacgcctgcatcgcgtctagcgagtcgaccgccaagaaggtgctttccctctccaggacactttgaatccattcctgcgcatcgcttctcacacttctcgtcctgtacacacatgcgctctgggctttgtacaggcgagtgtcagtgtcccgtgctgtctgcccttgggcacacgctgttcgatatcagccatg

SEQ ID NO: 5647 - DNA, 700 bp, Nannochloropsis_gaditana
tgctcccaaacgtgcacatgaccacggagggcgcatcgtgcggtgtttgctgacttgttccacttgtaggacggacctcaaggagaggggttgccacgccattgcagcagtcgaaaaattcccatcccatcagaactcctgtgaagagctaactccccaccacatggcttggaaattgctcattcactggacgtcttttaaaggagaacatccaggatgcttgtgctgcgtggtgtgtccccgtcctacaggcatgtcggtgtgtttgcatgtctgatagatgctatagtgctctgcttgaagagatggttgaggcaacgcgcagaggtgtcttctgctcccaagaaaatggatttgtctaaacccccgcccggcccccgcaatgccgttttccttttacttcttgtcaaacaaggatacagatacgctagttgccacgagaacttcgcaaaagccggagctgagcggccttactctctgtcgctacgctggtctgccgtccaagcacgttgatctttcccagcactgcgtcgcacacggggtatgtccaacgtcccacctgccgctagccttctttgacgcgcacagcacaagccacattgtttaagagggcggcgagagcaggagcaaaagcaatcaggacaagaagcatcgcagatcgggagactatcactagacctctcccctccggttcagcatg

SEQ ID NO: 5648 - DNA, 700 bp, Nannochloropsis_gaditana
ctcgaaaagaacatgaggaagtagccgtgtgttgtaattgtggcacagagtgtgatatccgcgtgcaccgccccgtgaccctcccatgctctagcgaagcccgtcgcccatccactacttcctacggtggtggtggcacgccacttgtcaggcattctcggcccccttgctcatggaggcgtgtgtatgttcatcgcccagcatgtagttggaggcgggaagagtattatgtgcgttgggagacaaaaacttggaagactggaggagctgaggaccatccatctcctcccttgcttcctcgctgcttcttcgttgctcacagcaggattacacgcaatctgaaagctttgacaaggctttgacgcacgcattgagaaaatgtcgtaattgagcgtagtaatcaaggacacagacggtggtgacctggagataaagtgctgccaaggcatcttttctactgtcatccatcctacacaccgtgcctcggtctcgtcccggtctcatcccatttctcactcttttctattttgcaggcggatctgtttcaaccatgcagatcttcgtcaagaccctgacgggcaagaccatcacattggatgtcgagcccagcgataccatcgaaaatgtgaagcaaaagattcaagacaaggagggcattccccccgatcagcagcgcctaattttcgcaggaaagcagctg

SEQ ID NO: 5649 - DNA, 700 bp, Nannochloropsis_gaditana
ttatcgaatcgggtcgagaagaaaagcaggggaagggggaggtctgggttccgcgcgctcgcattgcaagctattcaaagcgctcaaaactatcatatactggagggaaactccaccacggcgtacagatgccgagctagcctagcgctcgaaaagaacatgaggaagtagccgtgtgttgtaattgtggcacagagtgtgatatccgcgtgcaccgccccgtgaccctcccatgctctagcgaagcccgtcgcccatccactacttcctacggtggtggtggcacgccacttgtcaggcattctcggcccccttgctcatggaggcgtgtgtatgttcatcgcccagcatgtagttggaggcgggaagagtattatgtgcgttgggagacaaaaacttggaagactggaggagctgaggaccatccatctcctcccttgcttcctcgctgcttcttcgttgctcacagcaggattacacgcaatctgaaagctttgacaaggctttgacgcacgcattgagaaaatgtcgtaattgagcgtagtaatcaaggacacagacggtggtgacctggagataaagtgctgccaaggcatcttttctactgtcatccatcctacacaccgtgcctcggtctcgtcccggtctcatcccatttctcactcttttctattttgcaggcggatctgtttcaaccatg

SEQ ID NO: 5650 - DNA, 700 bp, Nannochloropsis_gaditana
gacgcgagggcccggaagtgttatcgaatcgggtcgagaagaaaagcaggggaagggggaggtctgggttccgcgcgctcgcattgcaagctattcaaagcgctcaaaactatcatatactggagggaaactccaccacggcgtacagatgccgagctagcctagcgctcgaaaagaacatgaggaagtagccgtgtgttgtaattgtggcacagagtgtgatatccgcgtgcaccgccccgtgaccctcccatgctctagcgaagcccgtcgcccatccactacttcctacggtggtggtggcacgccacttgtcaggcattctcggcccccttgctcatggaggcgtgtgtatgttcatcgcccagcatgtagttggaggcgggaagagtattatgtgcgttgggagacaaaaacttggaagactggaggagctgaggaccatccatctcctcccttgcttcctcgctgcttcttcgttgctcacagcaggattacacgcaatctgaaagctttgacaaggctttgacgcacgcattgagaaaatgtcgtaattgagcgtagtaatcaaggacacagacggtggtgacctggagataaagtgctgccaaggcatcttttctactgtcatccatcctacacaccgtgcctcggtctcgtcccggtctcatcccatttctcactcttttctattttgcag

SEQ ID NO: 5651 - DNA, 700 bp, Nannochloropsis_gaditana
aaatccaagcagctcaggcccacgcatagcacccctcccacccagggctctgtcatgcccccccctccctcgacgtccttgaccaaccccttccttgtcaaccctcgaccgactcctccttcccgccctccctccttggtttcggccagaacatcctccaaggcggccatctgatggaagaagccagggtcggtgcccttggccgccccctctgggaccttgaacaggtaggcggtcgccaaagccacccgtcgggggggcacattctttcgcgcaaaataatcgcaccacaccgccacgtccagcatgagggggacgcagagtatcgagtccatgcagcgagtgtaggtcagcatcgtgtgcggtgcgcccaggaacccgaggctggtgtactcgaccacgtcccgtttctcgtctcccatgaaaggggtgtacatgacccggacctgatggtcgatagcttcctcccacccggcaaaaatgtcgcttttcacccgcattttcgcgtccagcgttttcttgctcgtcaaattcagcatgtcattgttccccaggtggttggaggaggcaatcaccgtcggggccaggcccaaggcccgcaggtactccactgcggccgttttgaacttggtttgaccggccttgaagtccgtgccaaggacgtagcaccgggctttcacgggcccgttgggcgtgtgca

SEQ ID NO: 5652 - DNA, 700 bp, Nannochloropsis_gaditana
accttggaaattgatcatcaggtgggggtacccaaagtgaaacgcggccacgccctggacctcgcctgctcgcactccctccctcagggcagccaaggcctcccccggggtgaaggaatcgttcgcctgcaggttcacaaagcagccccgggcacctgaagaggccaaaatgggcagcaccgccaaactggtgcaatgctgagcgtctcggatgaccagggatgtgtcggtccccgcctgttctaactgccgcagcagctcgtctccgtgcacgtcccgacccattttggtcaagacgtggacgatggacgtagtaaaggcgcattccctctctccctccctccctccctccctccctcccatccccagcatgtccgccaaggccacagaggacctgtggcgccgcgccgcccgggcaaaacacctgcgtttgaaaggtgtttatggccccaaaggtctccccgtctccggacgcgcccaccagcatcaaatccaagcagctcaggcccacgcatagcacccctcccacccagggctctgtcatgcccccccctccctcgacgtccttgaccaaccccttccttgtcaaccctcgaccgactcctccttcccgccctccctccttggtttcggccagaacatcctccaaggcggccatctgatggaagaagccagggtcggtgcccttggccgccccctc

SEQ ID NO: 5653 - DNA, 110 bp, Nannochloropsis_gaditana
tccctccctccctcgcctccctccctccctcctccctcacttctttctctcctgccccttcccgcccctctcccttccctgcccgcgcgcgccacagctgcggccccatg

SEQ ID NO: 5654 - DNA, 700 bp, Nannochloropsis_gaditana
ctcaacaaggcgtaagttcagtcagtgaaggattccggcgcgaacgagcactggaaccgtggcgtcagcgttcacgggagggggggaaatgaacgacacctttagcaagacataccggctttccagtgccttaggcgtcgtttcgcatccattttgaataagcatgccttagttctttcgtgcaataggcgaatcagatgctgaatgaaggataagtgtcgcgggaaagcgtgagcttcatgactctcctaacctcccaactacaaactagctgggcatgctgatgggctttttgaccaacttcaatggatgacatgctataaatttttacacagcattgggtaaaaatggcgtaattgtgcggcccgcggaaaatcgagctatgaaatggaatttcctcctgatagcactgagatatctccctgtcagagcccttcagtcgattcttccaccacgaaatacaatgcaggagaaatcgcagggatgaatgcactaaaagatagaaaaagcatattgttataccagctgatttgacattgtctctcataggggctacttcgcctccgtcagtcatgctagccctcgtgcatgaccgagttttcctagcgctcacgccccgatccgtccttgctcctcttggggtgacaatctgttccttctcacagggactactttttccgcgtgcatccacccacgcatg

SEQ ID NO: 5655 - DNA, 700 bp, Nannochloropsis_gaditana
ccgtggcggcccggcatgctccctcccttgccgtgcttcacgccctccactcggctccactccagaacaaaaaaagccccaaaagcggcgcacacaaggcacgtctcgcctgctgactcgttcactcggcgtgcttccaccggcggcaatttggtgcaggtcggggtgagtgtgatgtgtgtgcatgatttttcatagggcgtggtggtgtttgggtgtctaaggacatataatcggttttgcacttacggcgggtcacgccctcttctcgagcctctcactcgtgacggcaacacttaaaaggcgtgttccccttggcgacttgtcttggcacttcgcaagcccgaagtgttgacaagcatgcatgcatcatgatgcccgtcaccaggcgtgcatggaccaacttctgtgttgtttgcgtgtgagataaatgcccaccttgaagtccgcccgtcatgcgcgctcggggggcggtgattgggcccttgtctgctcccaccgcgcactccgcacactcctcaatctttccagccgccattctcacgctagaatagtgtaatgtaccttacgactctaatgtttgtgcttacgttcatcccataaagtcggtggcggtccaataaaagcgcgctagtggggccacgagcctgcccaactcggtcgaagcgtgaaggaaatctgattcccaggcgtgaatatg

SEQ ID NO: 5656 - DNA, 700 bp, Nannochloropsis_gaditana
tttagattcttcgttgtccacggatacggctgttgctttatcgatggtcgctgatgcgcattttaatagggatattcttagtgtggaagaagcagcagatgggagtggtgtcaaacgtgtcgcagcggtccaacttgttcgagctcgatgcgaatcaggatttataggggcgacgaagcctgaagccgaacccagccacttaattgcagtaaaacacataatcaatccaaattttaagcagatcggtggccgcgtcctactgtcatgaaggagaggcatggctgctaaatgacgcagcgcttgaagtgccctatccgaggaacagaattcgatgggactctgtccgcttaaatattcggcctcgtctgctctagcgatagagagaaatacaaagggctgaatgaccatgaaaggcaatgttgtgggtagacaggcaagaaaaggcttttcaagacgtgctgagtatcttgccacaggcctcgaggcgagaacacgagtcggatgacgcagagacgatgtgatggaaaatgccctcaactttgaaaacctcggatggcttcttgttcctacatccaatttaaaagaagcatcaacgacgacctaacatgccatgcacattgcagatagccgggagatgggatggcgactccctgggcgcaggaggtgctgctggggaacgcaaagaaaagactccagcatg

SEQ ID NO: 5657 - DNA, 700 bp, Nannochloropsis_gaditana
attgtactttaaatttagagttggtgtccgtgggtgagagagcctttaatcgacacccgccttcctccgaaagcacaaactcaaagcctgtgcgtgtacaaaagattgtgagtgaaagctggttaagtaactgtaaatcataaagatgccaaggggcggtacctctcagcccttttgcattgcccgtgtggcacgcctctaccggtcgtgctcgcacgacgtactacgccactgcggttgcagccggtggaacaatgggccttcctcttttgccggtacctgccctcaaggaagacaaacgagtgcgatttccccggttgcaaaatcccacctcttttctatttcacggagctctggtgccttgctcagtttgggacaaggctagaggtaagattgttgtcgaaagggagggacggcgggccatcaaaaccgttgaatcctgacacatggccttcgcttccgcgacctgcgtcccgcagcacctcgccgactgccggggcccttgccagcacctccaagctatctccgtgccccttgcgcttttaacctgatcttaagcccttcttcttgactttttagaaatgttttctcacagttcagattttttccgcttcctggaagcgtcataaacagccgtcactccatctctttgaccccgcaagccccatccaagatacaatttctcacaaccaacatcatg

SEQ ID NO: 5658 - DNA, 700 bp, Nannochloropsis_gaditana
agagttatggccttcttgctctcacaaagaaacgcacctctatagagggcgtcgataaaggactaacttcctcaagttcatctttgaaatggacacaactacctgcctggtagtagtcttcataagaatatgggacggaaagtgtctgcatgcttttgactggggttctcggcgagagcgacggccacctcgatggtgatgtggctatcttgccgctgcttcactgtccgccaccgcctgcacaagactacggaattgagtgttgttgtactgaagcgcgggaggcagaggaccaccacaacggtcgcgaatgagtattattttttattttccacacattataagaaggcaaacgtggaagggtcggcacccgaccagaacatgtcggcgggctcctgcaaaattcaaaaatccaaaccgttgaagtcctgaaccgtttcacatacccctcttaaatgggtctcccatttttatatttcgtgtccttgctttcatgctgggcagattaaatggagatatcaggttttggaaaagaacggtgggtagaattactttggtgacttctcccgtaagcggaacaagctttattgtctgcgtcaagttgttactgcgcatcactcaacacgactatcacttaccgctgcccgtccactcatgcacgacttcacacgaaacactttttagaaaacaaaaaacaatg

SEQ ID NO: 5659 - DNA, 700 bp, Nannochloropsis_gaditana
agcgagagacgatgacgatgactcgccgcggtctgcccgaaaagtctctgaggtgtgtaagcgccaaagatgctgcagcaatgctttccgctgtttccctcctctgcttttccggtcatccgcacacaggggccagtccaacgcgtacgggtcgacaccctgccctacctcgcgccacatctccttctgcaggtcctggcacgggcgcgaatagaagacatcggccgcagccgccccttgggccctacaggttgtcagccagcgctcaaagagggactcggggatcacgtcgtggccgtccagggcatcgatcatccccaccacgttttcgaccgggtccgtgaaagggttcccgatggcaaggcctcgcaaattgatgtactggtcgtcactcgcgggactaattctatccaggcggacgacttgaggagtgctctgtccccgcgttttcccaacggctcctgtctcgctggctgccaacgagtcggcgcgcttacggttgttgcgaataatctcacgcgctagcgtaggaatgtaatgcccgccgtacgactcagacgtgagatagagatccgagcttcgcaagtgcgggaagcgggcgaagaatgtttgcaagacgagtaaattgtcgcgggcggtctgctcgtccccaatgtaatattccgtctcgtcctccgagtagctaaaccccaccccgact

SEQ ID NO: 5660 - DNA, 700 bp, Nannochloropsis_gaditana
tcgctcgttggcgccggggtaggaggtaacaattgcgtaaacaacgaggagaggcacatccaactggtttgcataatgaatcgcgacttcaagtgcgtgattaaaagaagaacggacactccgttgcatccaatagaccacacaccgcgatacactgctgtcttttgcgacaggagtggtaatatttgtggaggcaggcgcaaaaggaggggaggacgaggaagaagacctcgaggaaaaggacgaagaggaagtgtggctgtacaatcgtgcttcacagccattcaaccacttcagtcgagtgtgatgtacaccagagggcagtgtttgagggcgaccggagacagtgtagggggatgtagccattgagcgggagggggaggaggtagctcaagagccacgcacgtgcaagtcgcttcgattagaaagacgaccgcagcatatgattcggcaccaggacgtggtcgacgcaaggcccgtcggcatgtgtgtgctgctctcggggaaagaacatttcagtaaatcgaagggcgcaaggtgtaagtttccgtagtcagtaattggtcatggaactcgccatagcaaagttgttcgtcgggcgatcgcatctgagcgcacaaactctttcggcgtcaaaacctatatcccataatccacgactgagtctacaccatatacgtcccactttccagacttcatg

SEQ ID NO: 5661 - DNA, 700 bp, Nannochloropsis_gaditana
aggagagccttgaggtgcactctcatcctcctcgcctccatgtccggctccctccttacacgcacttgcccggccaccaccgcgcacgggtgaggcagcagtggttggcgcaggtgtctcaggctctcttcgctgcctgaccacgcatgcaacgcccgcatcacacctgcctggcggggcggggctggacatggacggagagagcgctcacctccgtcgcccccgcaggaagcgacctccccccttgctggcccctgggaacccgctttagaccgtctcccggcgtccgtctcaaggtatcgcgtaccgcggggtgtctccttttaagccccaatcagtgaaagttgcatggaagcgcgtcggcgcacggacatgtcctttgtaacactcgcatggatgctgactgactactttcgaagcatttctggtatcaaactcaagtcaacaatgcacgatacaggacggggaggacaagctgggatccaaatcagtgatagtgagtaaaaaaatgtcgataggcgcaagacaaagtgtatggcacaggcatttctcagtattgtggggctttatgatcttcacggttctgactttgctgcaacaaggagcatggggctttctagctccaccacggacaacgctgaaggattcatgtgcaataagggcagggaaaagcttagtgatgatgtcagcggagggcatg

SEQ ID NO: 5662 - DNA, 700 bp, Nannochloropsis_gaditana
ttgaaggcaagtggcaatatgtcgccagctgcatgaggtgtacatgactcagaaagtagcgtaagtgttgaaagcatctttctcgttcgccctgaaaaacactgttcggcctccaagaaatcaaatcaataaaacccaaaaacagacaacattttggccagccgcatgtgtcaaaagactcgcacattttgagtcctcgtatcacgttggttctcaacccatttgacctctccaaaccctcatctgcctgctcacctttgcagctggctttttcttgcccttgactacgttgctggccttttttgaaaccatatcacgtcctgataggatgatctgtgctagtggttggacatattttcgtgttaaacgtgctggctcacacatttgtctgcttcacctcgctagaagttcaggagctcgcaactcggatgtaggtgtaccgttcgcgccataattcctagaagagcttgatatcactcatgacccaccatcccttccaacacgtccacccgcacgaccgtggcatgtcataaagcatgaggcgattgaagtgattgatatgttcacttctggtggagataaatgagcacaacgtggccaccgttcgcttcatttatattccgcgctctcgcctgcacgtgccctctgtcagggggagggctggcagctgacacccggaagtccgcgaataaaccttcgc

SEQ ID NO: 5663 - DNA, 700 bp, Nannochloropsis_gaditana
ccttgtacgctttgaaaacacaatacacggtttttttggtcgcatggtgactggcggcgccagcggtgtcgcactggcagcgacatggttggagcgcacatgcgactggggggcggatgatgaagaggcattgtaaattaaagctcaaggtcttcaggaaggaatttaaaattgagatattcagaggtacataggtagagaattgtaaaacagatatgacaaacatgttttacttcggttttttagatcaaataggtttgaaaggaaagaagaagccacaaattgtgcagagaaatgatgattcattttcttacgaacatacgccataccatctttccaagacttgcccacagaaagtcggtaagcgcaaaaggtgcgattgtatgcgattgtacttgttagtacgcgggccgaagcgggaggttagtgggagctcattaccgcgcatgaaaatctctatgctcattcacagtccgtgacaacagttgtaagatcatttgttacgctgccactctgcatgtttcggccacatcatgcattgagcgggcataaaatccagaggccttgctggcagggtggccgcatatatgggccctccttcaacaagaattaagtgggttgcttcttccgcatgcacacggcaacttttccaactaaattatttgaaagttcgaccacagacgtatttgaatacttaatg

SEQ ID NO: 5664 - DNA, 700 bp, Nannochloropsis_gaditana
acacacttttttcctgtcctcctgtgtgtgcagaggaaaaaaacgacaccgtgagttcgctgagttgttagtcgccttcagcctgaattttacgtgcttcttatccaacaccatcgatgcgagaagaggtgttcttgacatgacaactttgtggaatctatgcaccgcataacacgcattgccatactaagctagacttatcttataccactctgcatgcatgctgatagaggtccggtctaataatgcacaataattcgaatagatgtgttaagcccgcggtgctgaatgcggcgatatgttcgttgcaaaatgttgcgccggaaagaacacttgccggaaagaacgtttctccctagtgcgccacctgacatggtcgtactcgcgcatgactggcatcagagccaccgtccggtccctgtgctctgttcggtttgggtgcgcctgccagcgcgacgggctggccccaggccccgtccggtctcctctttctcaacggccgccctgcccgcgccccgcgccggacgacaggtccctgcccaccaactgttccaacttcacgcctcgtgcttcgcccgtgctcgacatccctcggcagaattcctgccaatcttttaattgacaaaatcacatggtctttggttaaatattcactctgcgatcgtgtgactgaccgaagacatcgtttctggtttgcagg

SEQ ID NO: 5665 - DNA, 700 bp, Nannochloropsis_gaditana
gaaccatcgcctacaccagacttgaagcgacgcgttatttgtttgcttcggttcacgaaatcgcagcagagtgctgtcggtacacattggacttttgggcgacggaattctttttcaaatagtacagtacacatacaggcaacaattaaacagaaagacaggtagtggcatgcttcgattgccccgtgtggcggcacacaaagcatgcaggatgtccgtgcggtcccaaaaagtaattggttgggaggctaccgtggaaccgccgtggagacttcatctattagctcccacaaatatgtcctccagggctgcgtcgtcactagtactatccttgcggctccgtggaccctcttcccgtctaagactacttccagtcctcggtcatggtgtccattccctcgcgggaaagccgcagcggcttcaccattttaaggggtttcatctgcagacatcttttttgcccagtaacagccagtacctgcacgtgcctccacaagcagtcaaaccggaggcgaggttgaaggaagatggatcgttcgccagcgaaggatcagacccttcaaagacgaccatcaagcggcccccctcctcaagggagactatgtggacagtgcctaacataattaccttggcacgcattatctcgtctcctttactcgcgggcttgattcttcaaggtcgatactcgtatgcagtgatg

SEQ ID NO: 5666 - DNA, 700 bp, Nannochloropsis_gaditana
  misc_feature (1)..(23): n is a, c, g, or t
nnnnnnnnnnnnnnnnnnnnnnnctatctcatcgttggacgtctcagcgccagtatccgcagcaattcgtatatcatcgtgtacgaaagtgccttcgacatcgaccatgttcgccgtgctggggcagacgggcacacaatgctcgatgctccccttctccgtctattgccaaggtgtacgggaaagaaagcatgtttccagggacaaggggaaggaacagcagtgagttagaatgccagtcggcttggcctgtccaggcatgatttttgaaagcaaggtcaccgtgcgaggtggcgcccgcttgcctcccacctttttgtgcacagaagtgaacatgtcgtcgagtatcgctgtctaaagccagagctcgagcgagccagggcgaggaagatccactcagttccagcaacagatcaactagcccagcacatgcgtcaggcccccaggactgaagagcctatcttgggtgctttagttctcgaattgttttgacgccatccagagcatggattcgccatacccaggcccatgtcctgtgccttttttgagcccagcgcgccagcccgccctccccgccacacaggagacctcgccgcgtccgagcccgtgcagagtagctcttcccgtctgactgccactttgtctcatttttagccccatctcccgttcatcctgtacatattatatccagagaaggatg

SEQ ID NO: 5667 - DNA, 700 bp, Nannochloropsis_gaditana
tagggatgcacaagatccacacggacaatataggaatgatcctggcataaacacgaggcatcgggttggcgcatcgtcacgatgtgaccgtgattatagaggaaaagatatatgaggcaaaaggattcgaagaaggatgacattttagacctcacaggcgataactttcgagcaggatgaggttttaggcctcagcttggagtgagagccctagtctttagaaggatgatcgctaagacctcaggatgaagaaaagatgatccctgaggccgcaacaatcaggcggagtcgtgagacgctggtctcgtgctcgtgcttctcgagcactatcttcattttcttgcctcctcactcctcaattgttgcagtcctgtctttgtggacacgagcctatgttattgatgattgtattcacaaatgtgacctctttctgaaactttttatttgttgtatctgtacacaggagcacgaagaatcatgcaacaattagcgcagcggacaaaactcaaagaaggaatagagctcctctgaagacggcagtcgcggaggattagtgatacgaaagggccagcagagcagaacatagcgtaaaaagtcgagtaaaagggagattgcgggaaattaagacatctgtgggttctgtcaccctttgtgagggcgacattcttccacctcccttatttgcatcgttggaattatg

SEQ ID NO: 5668 - DNA, 700 bp, Nannochloropsis_gaditana
acaatgtgttgttcggtgatgccgacgacgaggattgcggcagtgaggagctcaagacgctgagggcacctttatcccagaaaacgtcgaagccagtgcccacagcgtagtgttccgtcgtttgacactcagtagaaacctccagagacaaaccccactcaagccaccaacgccgcaaaaacaccggtggctctattactaaagctactgcgatagcaaggacaaggacggccgcggtggcagtgcttgaagggaccaccatgaatgaagaccttgtcttggccctttgatggcgttgatcgaagaccagtctcggatgttggtcttccccaagggagatggataacaaattagtcagggtcgagccacataatgcaaagagctctgtaatcacaagaagaaaggacatccgatggcacggaaccatgatttggcgaacaacgatgacgccatacatcagccggcgggctccgtcatcaacagacgtcaagacagacgcaatcagacagaggcaccaaagcaagaaatgtgtttgttgtgagaagatgtgtacgacatcgaataggctacatgcatgacaagcgcgtggcatgcctgcagctgcaaaagtggtaacagctacaccttaccgattcgcacttggaccctgtccctcacacaactgcagaattcctggggaaacaagttctctgccaccatg

SEQ ID NO: 5669 - DNA, 700 bp, Nannochloropsis_gaditana
attggatgtgctttggtgcctcctcctttccctttctggaagtatcaaagccaaaagggcttccgtgatctcatcgtcgtcatcttcgtcatcacaaagtgatgagaaagaaagtgcgcgaattatggagtggatttacgaggttttcctctggtcattgccgacaagttgattattgcgcttaactttcttctcagtctccaccaatactacttgttagtcatttatcattcatttcatgccccatggatgtcgcgcaggcttccatactacgtgtttcccgtgctatttccttccatctacttttggcgcgaaagttctgtgacccatgtccaaacccgtcactgctttcccccccgtgtggaaaacctgtatgtgattattgtattcccccgcatttcgacgcatttgccggaatttgaggcctagctttcctcatttatattttagcagtcttgttcatttctactcttttcgactttgctgcttcccaggactccgactacacgcacaagctcccggctccgttatcgtcttcaacaccacgtgcatcttagctaagcaactcagcatcgtcacgatgaaacgcgactgttgcatcgtactagttctcgtatcgattctgagccttatccctgcagatgcttttctggtgcctgcgtctccgttacggacgcaagcttctagtctactgaccatg

SEQ ID NO: 5670 - DNA, 700 bp, Nannochloropsis_gaditana
tagaaaaagggaggtgaccaacttgatgaagcagggctgttctgcttgatcttgtagtttgatgcattgaaaattccacaacaccatgcactgaaaaagctttgtcctggaagcgtcatcttaaaagctcattgactttgcagtatgcatggcacgtgtcctgacgcaatccctttgcgcgtgaaagccgcgctaacatcgcgtgtgcccgaatgttgtgtgctgcatgatgtctctctcatcatcggatcggaagatatcttttcccgaagcaaccttttcctccaccaagtcaccaattccatcgtcccacgtcgtccattcgacatcaaaagatgttgcgttggaaaacaaagagtagtcaattcatggcatgcaagcaagggtcgttctaacacgtggatatggccttgtggtgtgctggaacttgagacataccgatcagtgctaactattcccggctagaagcgagtagtacgttgtcgctggcgtcaaatttctgctacgctttctctttcacccttcagcacccctaaaaactaaaatgagctagctgtagactgatttccagggataagggtgagaaatccttatgattctcttgcttacaagtgcttacacatattgataggtcactctcgcaagacttcacgtcctcttggtgccttcaactgctcccttgatagaccaggaccgtatg

SEQ ID NO: 5671 - DNA, 700 bp, Nannochloropsis_gaditana
cgattttttttcagtgtgctggatggcaccgatacttccacccgttgtttgtgcgtgttcggtgggggatggggttttgttggatctgcaggatgtgtttcgtgacttaccctccactgccacggcgaagaagcgatgcggacagcttacgtcggaaaatgatgggggccaccaggaggcatccaaggaaaacagtacactgggctaggacgtgctacattctcacctttattttccctcttatgcccacatataggcgtgtttggcgtggtggcgtggtgagctaggcagcgtcgagacgccgtacgcctcagaaatcacgcgggaagggagagaggtgctccgacgcgcgtcgtgttacgtcgaaaccttgtgcttcgcacgggccgcgcgtctcagttcggtttccatcgaaagagcggcatagccagcaacagcaagactgcaattattgcgtgatcgttgcagggcaggcattctttgcgacccgttatttgtgccgggctccacaagatcctgttttccgccatcgaaggtcgtcagcggctaaataattttgcacgcaaacgactccatttaagagcactcctctgtcgaaaccggttgacgcggacaccctcagccgccgacaccgcactgtaagcctcacataagtgggagggcttccgcaaacctcaagtctcgtcctccaccctagatg

SEQ ID NO: 5672 - DNA, 700 bp, Nannochloropsis_gaditana
tgctgctatagatagagtgcgaaacccgtacgtctgggcacggttatagcaccacctaccaagaggttaaccttcgtgatccgtggtaaaactgccccgatgggaaatcaagtcgtccacgcagacccttcaggatctatgtaggtgtacaaatacgtatgagaggaagtacaaataagtacacgtaagccgggtaaaatcatcgcaagtctggaggacgccgaagccgttgcttcctctcagtcaagtgcaacgagaaggggaaacgagctttatctttactacgtcagcattttatgccatttgcttccataaatgtgatagtaaagagctcgttgttatttttccaaagccatgtacatttattagcactgcttttgtgggaagggttgaatgcgagggtagctgcgctcgtcacaacagccaaggctcttactgactacgagatggattgtgccgattgaaacttgtgcacaagtacacgcttcttcgtggtggatgatacattatatgcgaatctgcagggttgcaagtagattaaggaagaacgtgtgataatcataaccttcctattttttttaatgcttttaaaatgttgtcaaagagcaagttgaaggtaatcaaccccggacaccccatcaactgatcaaaccacgatcaaccacgcacacacagtgtgttgaacgctacacagttaatg

SEQ ID NO: 5673 - DNA, 700 bp, Nannochloropsis_gaditana
tactgctgctgctactcccgctaccgacctcccctgtcccgtagagcttgatttcgtcctccgtgtagtcgtcgtcggaggaagaagaagaagaggccaacgaaagctctgttcaaggatgtacaatgtgaaaaaatgtgaatacttcaattctcgaagctttgcgcgaatccgcagggcgttggcttgtgttttctcatccttacctgctgcctccgttccacctggagccggctccgcatccttgtgcggcagctttccgcaccctttcggtgtcgaagaggtactcttcgtctttttcttcatagagtcagctgtaaatacgttcgagtatgtttaataagggagggactgaaagagatatgtggcaggacggagcgctcgtagtatggcgaggcacatcgccatcgcaatccggagtgttccagctgtagaggaaaattgcaaactacacagcgaatgtgtctgaaagtgctgctcgaatcctcctttgtagatgataaaagatgtcagcagtgctcgattgtgcgtcctttccaacggaactaattttataccaacaaattgcaacctgtgcgtgtagagagggttgcacgcgatatgcgacgaacgccggaatcagtgcagccaggaaagtgagacaaatccgacacacaattccgggttgcgggcgtgatcatactacctcttcaagctcatg

SEQ ID NO: 5674 - DNA, 700 bp, Nannochloropsis_gaditana
atttgaccacgtgcgcaccgcctcgggtgaggtgccgggagacttggccacttctaagaggccggcctagcctttgcggccgtttaaaccgcgaccgtttaactccagaatgcctaagtacgtcagcacctgcttggctttttctgggacttgtggcgacgagaactttttggggactgcctggaaggatgacgaaacaggggtgtgggatgttgaggcttcgggactagttgccggtatggcattgtagcgttggcacacccggccttgcgttgccatattggttgattttggtgcactgttcacgatttggtatctgtgtcgtgaaaccagcatctgttgtgatgcagtcatggagatcttgctgctcgccagccatgcaaatacgattctccacccgcatcctattcaacttcacttggtcactaattttacggaacacaggggaaagctacgatggttgattttacatttaagatattgcgcaggcttgctcgtcgtggatagctcgcccttcacaacaagttgaaggggttaagggggatggtggagaagaggggggtggaccccaatactctccttccatcctgcgcaggaagccggcaagtttacttacctgtcgtcggtgcatcccgcaaataatcgcaacatactgaaattttttctttagtatttgtggaatactctggccagtgccatg

SEQ ID NO: 5675 - DNA, 700 bp, Nannochloropsis_gaditana
gacggcgttgagggcacagacgagggcgaggaggggaaacggtcttcatccgctaacatggccttacgcagcgcacagtcttccgagacgtcattacccatattcctgcacccgcctctcttcttcttcttgttttgctcgtccgtgttgctgactgttgacgtggggatggcaaaggaggaagggaggcgatggagtatcccatgcacccaccgtgtgcggcccgacgctgttcggatcaagcgtacgttcgcgtctcgttcctcacgaagcacgacgataccgcgcgccgacggcgtggagaggtggtccggagggcgggacgggagcggcgtagttgtaaatgaagtagcggggggcggcagttgttgtacgtcggtcacagcccaatcttggcctctttatttccgtccacaaaatgagcaaaagaactcctttgtgagcgagtggcctgtgtaatgtggtaacgcaagacgtcgtgaaggccccattaagcggacagcgagaggcaaagagtatacaaagtcaaaaatcggcgggggggccgggcgagttcttgttcggaagtctgtgcaagatgaagatgaaaaatgcagccacacgccagtgcacgcgtctttgaattattaaaccgcgggccttgagaccagatacccacagtaggcgcctctttgctgtcacatgccctctttttcacaga

SEQ ID NO: 5676 - DNA, 700 bp, Nannochloropsis_gaditana
atgttacacttggttatgatttgacaaaaatccggagctcaacattctcaagcaagcctcattccttatcttgtgaatagaagataaagataaagcaaagtacaagtttggtcacgaattatagtgcttatttgttgcttttaaggattgctttgagtcctttcattcgaaagatgaagttttgcgtgtagtaatcattattttcagagacgggtgcacatttatccacatgaattaattgctttccatacgaaagttatcctagcagcaatgtcatctgctcatttggctgttgagtcgacggcgcaacagtcattttgatatggtacacgacctacagcacgttagttggcaggtcgccacgtcagcgaataaagcatgccttacaatgaaaagggttcgatctgtaagactctccaggtgctcatcactgtgaaagacataaacgaatgtcctatcattaaaaagggcgaatcaatgccctgattccgtgaagcatgtctgatacggtcgaagagggaaacagccatgttgttcggtcaaaaatattgcgcgaaggctcatcggcttctctgtcaagcgcccaagccctccgctctccgtttttattccatcgattatttgtcttcaaattctgaaaaacttaccaaaaaacatattctatgcttaaccatcactagtaggaactcgcgttgtcatg

SEQ ID NO: 5677 - DNA, 700 bp, Nannochloropsis_gaditana
aagaagcctgacatgacgcccacaaagacgaggccgctgaatcttcttgtcctcatgaccacctctgtcgtgcaagggaatattgtgagtgagcgtggaagggaacggcaacatgacgtggggaatagcggtgtggttttgacaagcaatctaccatggacaggggtgggagttgagcttgaagaggagggggcctctgtggttgcagcgccctgtccccacgaccttccccggtcgtggcgtgcctttcgtccaccatacacaaacacatcattacgatgaaaaaaggcactcagcccaaccaccggggctgcacgattcccctcgtcatttatggatgggtgtttaatgaacagcggggagccggcaaagcaagcaggatcgccaagacggatggtaaaatatatgctcaggaacttaccgtgcaacagaacactcacttcacgaatgccttttggggtacggcaggcttgtggaggtatttcaattcatgcgcttgcttcctcgacagcctctgcgacggacaaaaagaagcgtttttgtggttgccacgacctcctatttcctagcctcaacatcaacacaaaattattccaaaactcctccacttgacttcccttctcgttttgccgcagccagtacaaacaacaaacaaaatcaggcacaccttacgtgtggatctcgtttgccatctgcaatg

SEQ ID NO: 5678 - DNA, 700 bp, Nannochloropsis_gaditana
tgtagagaggtgatatacggcataaaattagctcaggtggtagggcgatggagtatcatacacccagttcaaataacgccagtagtaatatattccttcttgggcatttgggttgcccatcattacaaaacgctgctgacgagtggccatagccagcgacacgctcgtatcttggcccctctgcgagtgaatattgtgactttgtcctgcccgaccgagcgtcgcattaacaacggagtaacctaagacataacgggctacgaacgtcgctgaggagagggaaggacgcatgtgcgggcaagccacatatctgtgatatgttggttgcctccttcatcccagctgtacagtggacacaggcatgggctgctgatgtcaacgatgccgtggacaatggtgccgtgtgggtgcggaggaccttgtcaactggctttccaacttgcagcacggtgccaggaggaacgcggcgcctctgccctctttgacaaaagttcttcaacatgcgttttcttttgggaagcctgtttgcagtgctcctgtttgaaagcgtcatcttatcgtccatatctactcgcatccatgacatgatggcttagtcttctttgttctttttaccagttcatgaagtctcattttatggccttcctcagccttgccacagctagaagacgggctcttcaggagaggcaccatcaatatg

SEQ ID NO: 5679 - DNA, 700 bp, Nannochloropsis_gaditana
tcgagtagagattatcaacatttcagtaatcaggtgattaaatttgaatcaattggagcttctgtcccggtgcgtattatatgtcatgtcaagtctgcagtggatgaagtgagtaggatgctgtcctccttaacagtgcctggggagagtcgctttttaaagtcgcattaaaacaagaagcaaagagttcctgcaccctgttcacgctcctgagagaaatacttacacaaaggcggaaggtatttcatgacttttgacccgaatgtccaatgcgttgtgcaaggcccttccgagtcccacagccccgcctggaccctctctcggcgatacatctcaagccagaaattcgtatctccacgcgcgcgccagaacgtgactgagcccggttgactccctgtctctcctgcgcgcaggctggcgatgccgactgtgcagtgagtgcaagttcggcggggagttgtcgtggctacaactgcgataaattaccgctttgccttaagtcttgttgtcagatgtcgacatgacgccgctcaaaaaatgatcgcgtgcaaggggtggggcgtttctgttcttcgtgacggcgtactagatgtgcttgccttgctgattatcttcacgcctgatcatttgacaggacataagtcaaggcccaagacccacatagtagttaacgtgtgaaaggagctgctgcgaaagtatg

SEQ ID NO: 5680 - DNA, 700 bp, Nannochloropsis_gaditana
ccagcaccagttcatgtccttgaccactgctttcttcaacagaaattttcaagacgacaccggtgatttgcgggcctttcttttggcgatatccaatccgaccacgggcatcctacaccgtgaaacagcctcgcactaccgggatgtgccagtcttgtggttggtcaagctgctgggtatagagcatgtcttgggacttgtgaagctcttgctgctagaaggccgaattctgttctattcaagcaagccctataagtcctcaagcgcggtgttggcgctacttacgctgattcccggcctttacactcaagctttagaggacgaggaggggccctcgagagccttgcgcggctatcggtggagcaaattcgggatgcctctccgtattttccacgaagacaagttcgttttgcagcccctgctggtcataagcaaggccacgtctttcttcgacaaaaaccctggcttcctagtagggacgtcaaaccctctgataagtgctcttccaagcgctcgacttgatgcggtcgtgaatctagacacgtgtcagatcgactcccagcgattctcggccctcacagctgctggttcggtcatagacgatgcctccacttccaggagcagtgctgcctcgactcacacggagccctgttcggagagggggagagagagtgcttgtgtgtctccgacttcgttaatg

SEQ ID NO: 5681 - DNA, 700 bp, Nannochloropsis_gaditana
ccctccatcaagaccgaaagcttcttttcccgcgcatttgacagcttttccagcaagcgtgcacagagcttctgccgattttcggcatacatggacataggcacctcgatgggtggcatcgtcgcagtcagggtgggatgatccaggcgccgatgcaccggcgccccgtgcggcatgcgttccaaagccacgcgtcccacgtggccgttcgcatgctgagcgggcagggagttttcagatgaagagctcatgctgtttcgactgttctgatgtcttcaatcatcgggacgggtatgaatagagagagcatttaagacgactcccctctcatatagaccatagataccgcaaccatcagaagttgatggtatttcaatcaaatacattggaaagacgtaaggattatgagtctggcaagaagtagtgacgaaagagggcaaaagcaagacagcgatcgttgcggtttggtgacgatcctgcttgagcccaggtgggctgctgcattgatatcacacgaattggtcgtcatcctttcgcaatgcccgtccctcccatcctgcggcaccgcaagaaatccccataaaatatatactgacgtgctaatcgcactcacagtgtaacatttcccccctttcaccggagacagaggggccagcgggacaggcagccctactccaatgctggggtgggctcgagcatg

SEQ ID NO: 5682 - DNA, 700 bp, Nannochloropsis_gaditana
agttttgaaagtacttccttcatttcattgtctgagagaccatggcttgaaagctatttgttgagaaagtatgaattggctttcaggaaaatgggccgaagaacaagtttctagctaaactcacctggatgacgtcttgagctggaaaggtgcaatttgacgtcaaggatgtcatctgtttcactttttaagttgattatcttctgaacattacattttctatgcgtgccaaatcgtacaaagatttactttcaaatagctcaaaaagggcaagctcgcccttcctcgaccggatcgacccaccgccttgtcctagcgaaaacgtgcgcacgttgtaggaccaccggcaatctttttgttgccgtcttgttggatgctgcaacaaacttatataaggcattgccattgcttcgatgcaaattgccttcaaaagcacgagaaatttgcccaatggtatcgtggaagccttccaccgcttccccatttcggaacttgttgataatttgtgccttacgtttgcttctgccatgtcacgatatggcgtgatatcagcatggcgcataatctctaagtctacaacgattttggggcatgtggtcagtgtgtgtcagctgctcatatttttagggcactgttgtgttagtttgccgcctcattcgatacgatctgcacactgaaaaaagtcaacaccacgaccgac

SEQ ID NO: 5683 - DNA, 700 bp, Nannochloropsis_gaditana
atccacgttgctttatgcaaatgtcatccttcacatgggttttgccttggctctcataaaaactgatatattgatgcctcctcaacatgaatgacactctcacctgattaaccattcgatgttgtgctactagcgccttccctctgaaaagctccgactcaacctccatattatacatagctccacagcctcctatattgaagagaaatacggtcaatacacatctgactattgtacgagacttgacatgcggccatttcaaacagatttcaggcctggacccccttgtccaatagccacgtcgatttccgcgtacctgacacgtcttgaatgagaaggtgtgtcggcttgaaatgttcagatagcagagcgcgcatgcgatcttctcgagcaatagactcggcactgttgtcggcatcagaggacaaaaatatccgaggggtaacggagcacaggggaggccggcgagcaagggcgcaggcggcagctacttgtcttaacatcccaccgacgggcaacgatgcagacaatatgcgtgtcatatgatgcctcggtacgtctgtgtaaaaatatggacagacgaactatgaggtgtggatgataaaggtaaattatgatcgaggaggggatgtcccgggagtagcttcgtatccgggctttccctgagtatcaccctaattctatatgttgctctcgtcag

SEQ ID NO: 5684 - DNA, 700 bp, Nannochloropsis_gaditana
ggaacgggtcctagtaacaagtctggttcagcagcttgacgtgcagcgaatacgagatgacggtccgctgtgatggaaaagggccccacagttcgatgacggagaccccttgatgacgatcccttgtgatggaaaagggacctgatatgcggtcgctactctctgcgcataacacggatggcagagagccagcggggtccgagtcccttctttttgtgctggcgcgagcttccatggcttatcatgtgtgacgatgtttgagatgattccagcaaattttctacgggagtgacggatattgctgtcaccctagcactttaccgcaagtcctgtagaaatctcccgctgccatccaaccttctgccttgccggcagcacgctgggctatcaaggaaggactttttgtgatggataaggcgcaagactgtggtcttcgtggctcacaaaggcatgaatgtttcaatcttaaaacatcggtttgctaaattttattcttctctgtggttgtgaccctacggaggacgagagtctcccttcgccctactccatcgccttcttgcctctggacgaaagggtgggaaataagtgtacacggcaacatcctgtacagacgagcgtacttgtcgcattatcgagtacttagcccgcccactgcaaatatttgtttcatcctcgccctccttcgcgttgatacataaac

SEQ ID NO: 5685 - DNA, 700 bp, Nannochloropsis_gaditana
gatgtcgatgttcctcttcgaacgtgtctttcgatctgaggtggcgatctagatctggatccttctggacaggtaaagaggaaaaagaaaaaaatgcagtgtttgatgtacgtggtttgttgataaagcacaaccgattgtgccggacaggtataacccctttcggaaaggagaaggcatggacttcccgaagaagaaaggcgcggaggtaagacagagtccgacctcaatacgtgttcctctcactcggaggcgagatgaggacgacgtggctgcatatgagaacgcatacgcggcacaatgttcatcgaacgcaccccaaatcctccttgacgtttcaaaaccgcttccagacaagatccctgacccacgtcgcgacggcgcaggcacgcgtgtattgccggtgtgggacatctgctgaggtggtgcaacaaggcctcgagggcgaggcctggcgagggcccgggaccccatgacgtcatgcgtcagctgacgcttctttttccgcggccggggaaagcatggcccccgcctgcgacgtcgcggcacctggctgtccccctcgttttcctcgtgcccatgtttccgagaaccccgcgccacgcgctaaaagcgcccaaaattctttctggtattctggttgtccaggtcgatgtcaagtctgtactcactttccctccgctacacaggcaataccatg

SEQ ID NO: 5686 - DNA, 700 bp, Nannochloropsis_gaditana
  misc_feature (1)..(170): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggttgcttgccacttggtggccagactcctctagcgcccgtagggccccgccggcttgagtggtggcaagcgcagggccgaccccgggttgcgtgtgaaccgcggcgcgcgtgtgctcgtgtgcacgattgtggtgcggtggagacggaagggtggtatggattgctcgcagtgaatcggcgtattgcaaattgtttggttgagcgagtaggggcagaccctggggaatggagggctcggaagcctcgctctctcacaccgccgaacctgtttcttcccagccttggtcatgattacaacgatcgcgcgtgaccattgattgtccatgtgtaaaaagaaagcaaaatgtatgatgtttatcggtgtgtggtcttcgatacagcacgggggggcgtgcctcgtccctgtggaagcttcggaaggcagactacctcgggccgctcaacaagtcaccaggttgtgaagctcagatcacgctcaatactgttctcctgttttcattccatcgttgcaaagagcagatatcatg

SEQ ID NO: 5687 - DNA, 700 bp, Nannochloropsis_gaditana
agtgcccgaggcgtctcttgatgacgcgtgccaagccaaagcgctagctttcagtcggggggccatgacggcttcttctttgatctcatttttaaaaaaatatgcagccagtaagaagggtcagaccctagacaaattggtggaagcgtcggctcaggtcgttccaaacgagagcaggcgggctctgcttatcaagacgtacgcatcactctccagctccgcgcaagcaagcagtttgaccagatttacatcagcaccttttacttccccaagtgtctctggattcctattaggaggcaagtatcgtgtgattagcactgggtctcaggggccgcggataagtagtgggaaaagcgccgttctcgacgccgtcatggaggacaactctgtaactggcagccggaaagggatatcacctcttaaggccaagttaagtcgaaatttagccgctttacaaagggagaggaacaatatcattgcgttgcgggggaccggtagcgcggcaaagaaaagtattatcgaagtcttggaacttatggaaaattacgacggtcggggtggccatgccctcgtcatggaagcaggaaaggaagatttagttgccaagatcaagagagatggagcatcttcacgccaagaattgaaaaaaatttgcgcgactgccggggatgtcctcctcgcgttggagaaaaggagacta

SEQ ID NO: 5688 - DNA, 700 bp, Nannochloropsis_gaditana
ggccccttcttgcccaaaagtttggctttagaggtgcagcaggcgcacggtattggtccgaacgatagcaaatgttaattaagaaatttaaatcaatgcgagtcgttcatttttaccaatcatgtcgcaaggcaaagttttgcttgccttcttcctcatctacgtcaattacgggggtaaagtgcgcattttgtggggcctcggttgcttgctgctgaatgcgtgatcgagggcaatgcaccgcgtggcagaacaacgagaagaggcggcctctctgagctgcgccgccgcctttgattgtgtgcacagcgcggctggctgaatctctttgggaaactcttgcacaatgtgcccgccactttgttcggtgtggggcgaaactgagctaaacatagatgtcactccagactcagatattcacgtccatctcaaccgcattattgagcgttttcccctacgatttccccgctcgcgaggggatacctgtcgtgctcgctcatcacttgtgatctctttgccatgttaaaccgcctagccctcttaattgtctattaacggtgcacaggcctctcaaaaagggctttaacagtcaggtacgcagacaggaagcaaggcacgccctgttattcgtcctcgactctctcaaacgagaccagttttagctgctttgggcatttcctttcccgtaccgcacaatatg

SEQ ID NO: 5689 - DNA, 700 bp, Nannochloropsis_gaditana
cagcagtcaggcacccaagacgtctcagcagctgcttcaacctcagcacagcaattaccacggacatcaccgctcgtcaactatcacacacagtagcagtcctggtaacatcctgtccttggcgcgggatttctcggggttgagtgctggaatgagaggcacgcccccgccggcgcccggccacccgatgcacacggaccggagcagcagtggggtcggcagcagcttgggaatgatggagggcagtgggagtgggagtggaagcactggtgggagtgtcggagggagcgggagtggggtggcgcgcagcggtgcggcctcttcctccccctcgacctccgtcgcctccacctcggagacggcgaccgtgacaggtgtcgcggggacgagcacatccgagtcgcatttgcagcggcaatttcgtgcccgtttggatgaagcagagcagcaggcggcctactggcaggcgcgggccaaggaagcggagcacgcgagcgggaagagccagagggattgcatctctttgcgctcccaattgagcgctcaacagggcacggccgtctcgcggggcgaggtgcttgcctccatgtacgcaagggtggaacggattatggtcgggctcgggatggacgtcgcggccctccctgccgtggcaagcaaggaggcgatcggtgggtgtgcttccacaggggcggggggg

SEQ ID NO: 5690 - DNA, 700 bp, Nannochloropsis_gaditana
gttcgaagcggttagagtgagttggtggtgtaggcggggagcagatcgctgcatcgcgctctacctgaagcaagctggcttcgggggggtaggaggttaatttttcatggagtttacgttcactcatgatgcagaggccttcgcgactcccgcagacaagatgcaagctcgtgaatttctggagctcccttcatatgcagctgccttctattcttcaaaccatcctccttttcctcctacttctcctgttgctcaaccttccagcctcctcacctcagcaaacggcaagcacaacgacgatttatcttcgtcgacttcttcatttcccaataccactccctttcctgctagaattgatcaatcttctcatgatgcaagcggtgtcacccatgacattgcaagagaagaagtgattggccgaatcgaggagttcatttgcgcctggatagcgacactcagcgacaacgacatatctgagccccccacttttgaggtccgtcgacgcacaaaggcaaattcaatttactatccaggggagagaaaaaatggagagtcatgtcaacaacttcccggactgaaacaaggggatggagtggtgatcaagaagctttccgaaggtggaagaggttctgctcgttcatacgccgcaatatttgccattttggcattttctcatcggattttgctgtcaaatcaaatg

SEQ ID NO: 5691 - DNA, 700 bp, Nannochloropsis_gaditana
catatctctctccgtcccaccctgattgatcttcccattactgaacgtaccgtctcggctttcgtcgccatcataagtggttgtcctcgggaaggcgttgggatgttgacgtgaaggaaagcatggatgatggaagcagtcaaggccaaaaagaggaggaagaaggaggtggaagagcgaagcatgatgctaacgaggaaaaaggtgggtctgcaggaagggacgaaaattgaagaaggaggatgcaatcagcccgaccatacgtcaaggcagtcattagatacgcataacctgactgcctcttgccgcgggactgcgccttccacggcatgcaggctcggtcgaagcgcctccaagaaggttgcatgtgtcgcagtagtcgcttcggcgacggagtttcctcaacttgacccctcgcggccttagctcaactcaatcgtaccaaagccatccttccctcaggaatgccataccgcggatacacacacacaggatcacttaaaagcatagcatgctagtgctgcaagatgaacgtcagcatcactcgtcggaaacgttctcggggtccagctgtccgagccctccgtcacctcccctctctccacctgctctacttgtttcaagtgctgccgcagaggaatgcgcacgaaagacatcgaatcattcagcaagattgcaagatttgtcggaggtatccatg

SEQ ID NO: 5692 - DNA, 700 bp, Nannochloropsis_gaditana
gtctttatgctgatgcagactgcgtcgcatccgcagttcaagacaatttcctttttgatcaaggagcatgccggagaacccaatcccttcaatgatttattgaaagaaaattcagcgctttgaataatcagagcttagtttttgattgaattacatgggatttaggagaatggtggagaaaatgaccatttcgagagctatgacagcacaatgatgggatgtaaccttcagcagcgtggaaaaatgtgccttgaagagcaagagatggaatcctcaaaaagggtactttttaccaaaaatgcactcaagctttatttggctccctgcgcctgggctcaagccaaggacagggtcattttcatacttttctgcgtattacttgaccatctcgacgtttgtctggttttcctgttcggcgagggggagggcgaggaaatcccatcccaggccgatatactatagacatgggacgccagcaagtgtcctttcacttgctgagagcatgaaattctgttgcgatcctctaacaaagtttattgcgtggctgatgaggtgacgggactcagtaggaattatcatgcttactctgccgtcccaaacgtcaagatacttcccaaaaaccacatcaacagggaagcgactgtcatatcgcatcactaagcccgttcgatctgcccgccacctggagcagctgcatatg

SEQ ID NO: 5693 - DNA, 700 bp, Nannochloropsis_gaditana
ctttttaatgccactatggtggcgatatctcggtataagctttcatgcatggcctccctctccttatctgaaggatgatactcgcccttttctaaaataagccgcaacaaggcctctacatcctcttgaccgaaacaatccatcaagtccttgctgctggccagaacacctttactcacgttcaggaaaatggcgtgggtttgaagcacctcgtcgatgtccttctccaccccttgccgccagctcaagaccttattgcggtaacatgcaatttcaaaacgcttcccacccttatgtatccgtaccatagctacatttgtcaaccgcacttggtttactggctgtccaatgcgtcgcgacatgggctacgtggacacctggagtaagtgtgacggagaaggaaacggttcatgaggaaagtctttgcgcctagtccgtagactactagcccgctcagatagaatagaaggccatcaaggttaagcctttttatatcaatttgtagaattcccgactttcggtccgccttttccgcttgatccttcataaacattattttatcggtcagcctacgctctctaggatactcgctagagctctccgtatgagaggcggcaactgcatttcctcttttatctcacagcacttcacttcctcactcgcagctccaattatcccttcaaaagacacgacaggtatg

SEQ ID NO: 5694 - DNA, 700 bp, Nannochloropsis_gaditana
ccatgttgtggggaccacggggttggacagggcaacgtatgcgtcttgtggtggtagcagactgaccggtgaaagaaagccaaaaagacgaggactgaaggccaaaatacttccgatgtcgtaactatcagctgttttactcccgcagccttgatttttcctgcttttggcgccacacaaaaatgtttattagctcatggacgatgctgctagtgtgcggttcagggttgtactcggtacttgccaaaatgagccctcgctgttttcgcttacaagaaagttggcagcgaatcacaaatctggcacaaagtatgcttggtactagcgtgatcattacgacatagccaatagaatgtttaagaaaagggctgaggtcgagcgtgtgtaattagaaaaggcggccgatcatctttgccgttaagtcgctcgaggaaaggccttaccgcagagactgacgaaggtcgggcatcgcattgatgtttatgtcctttcagactctgtccatgtagtagctctttaattccttcaaaattgttgtcgttttctgctgaattaaatcacagctttagtcaatcttttctccagcttcagccctgtgcctcaggagctgactcatagactcatagactgtaaattatgaatgtataacttacatcccgcgcgtaaaagcacagaacttcgtacctacttcgctaccatg

SEQ ID NO: 5695 - DNA, 700 bp, Nannochloropsis_gaditana
ccctgccatatcaaccctcagtcccactgccttaggtgggttggaaggatcgagctcggcttttgaaaaataacggttgagtatcaaccaccccctccgccgcctatggtaaatagaaaatggcttgctcgcttcccgtcgagcttttctgctaatattgagttactttggcttatcaacatttttattacgtcatgatgtgcacgacatagcaggcgaaggatcaagtcaggttttccatcgcagagcggcgacacatcagtatccttcgacgcttgtgagcttcccagcgaccgtcgggctacatacataaagttgatcaattgtggcatttcataagataatgtcgaactgggagcgccttcagatcaaaatcttaaaggctgaagaagaacgggtcaagaaaaaggctgcagcgtcgaatatcggagctggtacctcccagaagccatcaatgtctgatttatcccaagggaagccgacacagattgcacgctctgctccaaaacacaaaagaaagcggcgagagatatcagaggctgtacgagaggctgaaagagcgcgagaagcagggaaagaaaaagaggatcggcttcgatctctaacgctaagcgcggacgatatgacagtgatggagaaatctttgtacgtaggtttggactgtgaaatggttggagtgggcgatggaggcaagagaagt

SEQ ID NO: 5696 - DNA, 100 bp, Nannochloropsis_gaditana
ctcttgaccccttccagcggggccaggcccttatccggcgggcggcagagatagtcgaggcgctgggcgtcgcagagtacctcactgtcggatagaaggg

SEQ ID NO: 5697 - DNA, 700 bp, Nannochloropsis_gaditana
ctctgcaagtcccctccatcgagcacgcagaatgcgcccttcgccacgaaaccaccatcgccgatcccgcccgcttggtccttcctcccgacgtcctacggtctttccaccggccccgcctgcccctgcgcctccaggatttgtcttggaccttgcgaacgcccaaggacaagagcgggcaggccggcgggggcggccgaggggccttgggccgggggacatcccatgtcgacccggaccatccggaccactaaggacctcaatgcctacgagggggagttggtcgtggtagaatacccggaggaacgtccgcttttgctctcgaacccaggcatggccagcaagctcctcaacctgtggcggttgtcccctcagaatgtggaagcagagcgcgccatggcgctggagcggcatgcggctgggctggggggcggtggcggcaaaagtcggggtccgccgcggatcacacgcgagaacctgggcgcgagcagcgtggcgatggacttggaccgggtgcacgctggggtgcccgatttcaaggagggacagacctgtgtgctgtatcccgaagatccctcccccttcattgggcagatcgaggacggcatgcgccagctcgcccttttcaacaacctgtacaaggcccctctctttgaacataaggccaagccgacggattttttgctggtgcggagccatc

SEQ ID NO: 5698 - DNA, 700 bp, Nannochloropsis_gaditana
gccaggccgaggtgtcctcgatatcaccatacccggatgtagagcttccgtatcaaaacaaaataatgaaaatcccaggcacctttcaaaacaccggatgtgtataagaatacatgaaatgatagcagggacatgaatgggccctgtttgcgttctttgcgacggcacctctttttgaacatttcatagtctttccctggtatgttgctccttcgccatcctgcttcactgtttagcaggcttcgaaggcactagctcacagaccttggcacccatgcacacacagtttatcttggagtgattcaactagtcagatcttgcatggctgtaaaacacgcgatagtccgtcaggcttagtgtggcgaagctgggggttgcagccactcacctgataaacaaagctgaggtaggtcattgggtaactgggtggaaccgggggggcatggcagaggttggaactagagtatctggaatggcagtaacctatgggcccgattaaaaatctggttctcctcgggatatgctccgtgtgtggcagtagaggtggaaggacagcatcgagaggtccgcaagcaaacatccttgaagcgacctctgtagctagccgcgtgaagcccatgttgtgctgaatcagcccccttcgcatcattgattcacatttttccccatcctcacattctgggctccatgcagcagcatg

SEQ ID NO: 5699 - DNA, 700 bp, Nannochloropsis_gaditana
cgcatttttgtgaatatttatatcgtattcgagttcaggaacttaaatgtgacttcttacgcaccccaaggttggacctggaaataaaatgcacacaccgaccaaatgccaaagtagacaattctttcacagaaaaatcctcaaaacgccacacacacacatatccgcaaagacgtgcttgtcaatgtcacccgggcacaccttggaaagggctgacgccatttctcaagtgttcggttcgtaacctcaacaaattaaaggaacttatcgggaaactgcaataaaacctagcataagtccaaaacccaccaccctcgccaccgaaccgaagatatggctgtccttgccacgagattgcctgtgtccacgacgtgtatgaacgtgccgcagtgccaccgtgtccgacctcctcctctttttctgggcttatttattgttatggctttttgcatgtcatgttgaccctgttcgtggcccttcccgtgctacacagaggcccctctactttgaatgaaatttctgcacatctcgcatgtgtttccgttgtcccatattaccacacacacaagcacaggattttctttgaagtaaggatagaagtttttggtcgaaaacgcatgcgctctcttcacccattgaattgaaggcttcaaagttccaacctcaaggaattgagcacccaaccgcacagtcaaacatg

SEQ ID NO: 5700 - DNA, 700 bp, Nannochloropsis_gaditana
aattagcggggcaattcctagtttttgaaagaaacacatgcaccgcgataccacgaggagcacggaggtgatggagcgacgacgtcagtggttcctgttgaggatgccgacgcttgccacgtcggatgtggccaaaacccgcgaaagcggagccatcatcagagggatgagagagggtgggaaagaaaatagatgatgaggtcacaggccagggtgtataggaggatccacctacactactactataaataagagggccattgccccgattatgcctccaaaagggggcaggatgaaaaaacacacccctttctttccgaaggtcgagcgtagttgttcggacaaagtacgatgtagttcttctcttggttctatattcgttttctgtttaggggggcatagattgagattaaatcggctgcatagaggagacgcaaagcaccgaggctgggcaggggggaggtattactaccccccgtcttgagccacgcacgccccgcttttcttgcttgatgtccgcaagcacgcgttacatcaactttgttgtgagctttttgacgtcttggaggagtaggattggcgtgcatttatctcttgtacgtggtcgatggacacggtggacggcaaaggctacgctacatgatttttctgcacctcctctttccttgcgtccctcccagacctcacttaggccacgatg

SEQ ID NO: 5701 - DNA, 700 bp, Nannochloropsis_gaditana
cgtgacatgaccgcaaagtgatcgataaccaacaacacataattatcaacacgtaatgtaaaccttttgtgcgcgaagcccagcgccttgcgtcgtgttgccgcgctcagaaacccgtcccgtggtgtgcgagtcccccaggtctgtgacagcgggggggtggttttaataatgcggcttgcagcaatcctagctaacagcaactgctccctgaaccctgtcgcctaacatttcgaggccagactgtgggcaaacttgacttcgtggcacgcactgctgtcatctcttcaccatcattttctcgtggtgaatcgaaatatggcgtggggttatttggggaggggatggatcttccgggcactcgaaccaaagctcgcggcggaatgcgtcgtgtggttctcgatccattggtggtatcttgctcgtacaacttacccagtttgctcgatcatttatccataaagccttgtacctcgtgcatatccatcgtataaaactacttcagcgtgcttatgacaaaacctttccttgccatttcactccttcatggtcgtcaccgcgacgcttctgctgtcgtctaaccctcggatctgctgcagcatcatgtccctttttcttatttctaacggcactttttttttatttcccgctatgcgatatattacagatagcagctcagtagaggacgttttaaagcatg

SEQ ID NO: 5702 - DNA, 700 bp, Nannochloropsis_gaditana
agcgcctgacaaaacaaggactttcccgccccgttcttgcctatcacgcacacatggtcaccgaagcgcaacacgtaatcttccttccctccagcaaaagctctgaaagttttaatgccttcgtctgattcctgggcaacgaggatgccgtttctagcgtccagccgggcgagttcttggggaggcaaggctttttttccggcatgggggggaggtttttggccgtagatctgacgccatttggctgcatccgtctggctcgtcgcgaatctcttgttgccagtacacgctgatgaaagtgcggtacctgtccaagaaatgtgacacctccccctcgttggtatgcggcatgcggccattacctgtgcagaatgacctccgctctctgcgatgtaaaaagatgaagagagagccggattaattcctccacaagacaggacggtcgaaatgataagtgaaattttgggaggcaactggcaaacaagaagaacgtgcaaaaatatgtaggaaagccctttaaaagccaaggcacgccagtgacgggcggtgaaaccaacaaggcagggaagttctcgatcccttccctggcgatgattcgctttacgcctcgtctcctggacgccctgtgacgcactcaacacgaatttatacccccccttgccatcagcgcccgtcaagcagggacgctgcgagggccatg

SEQ ID NO: 5703 - DNA, 700 bp, Nannochloropsis_gaditana
ggaagaagaggaatgagcaatttgatgatgaaacgcatttcaataaaaaaaagaggccggtggtggaagtgcaagcagaaagggacaagcattgaacagcggtggagctggaaaaggtcataaccatcatcagtagaaagaatgcgtgttggtcgtacaggacaaagtaactcagaaacaattatttattaaacgggaaaaagttcgcttgcgtcttgtatatccatcttgttcaaattaattctcctgtgtcctacctgtcaagatggtgcggtgcagcgtaaaagacttaacggtatggttagggagggtttgaaattttgaacgttccccgacgcttccgtttgcttcgcccgttaagctcacggatccaaccgtcaatcgcatttggcccgtgtggtccctcaagaatctggtctccaaggaattagcaaacatagatgtcatttcaagtgtagtcatgcgcatttgcacaattgatttgtccttaaaaagtctattaggccttgttgcgatcgaatgtgaggtagggctcaggccggttcagtatttttctttacttgcatttatactcaattcaccaatcacttatgatggtataatcggtacgaacattaaacacctcaaagtcccacctgatttccccacttttgcttcagggtgtccgacaaggcgagtattcaccagaaaaccgacaatg

SEQ ID NO: 5704 - DNA, 700 bp, Nannochloropsis_gaditana
ttcctcttccgcctctgacggacagggagacacaaaggaaatggtcgcgacgaaaggcagatacttatcgtaaaatatctttaacctgtttaaaacgaaaggatttgtctgcataagatttctttttgatttgtcgttttgcgtgatgtgacaagataaaaagttgggggccggggtacaggtgctgccataggtgttgtcaacgatcttgagggaagcatctgccacagggacgtaatgtccgtccatattctgctcttagacatgtttcatgcacgtacgagccgtcgaacctactgacgggaaaacccatgtgctgtgtaggcagggggtaacgtgcttgcgtaccaacggccgcctagcgacggggagactcggggcgggttcaagcttgagccaggccgaagtccggcgagtgcaccctacacgcaacacctgatgcattgcagggtatacttggcgctcacatttccttgttattcattccgtgtccgtaagtggactgggaggatgggaatgcccggcgttgcatccatctcctccaggccatggctgatacccaccccatcggtagtatccttggatgcccgacatgctcacctcttttacacgcacattcgccctcattcacggtgtgtatgtacctatacaggatttttatcttgtatttattttagtgcaatatttctctggagtcatg

SEQ ID NO: 5705 - DNA, 700 bp, Nannochloropsis_gaditana
accgcaaagattccttccctatagttacatcttacattaacacgacctcgttgactacacagcttgagacccttgcatcatggctgcaactgttcgtagcgacaaagtaaggtcagcagcgtgaggcgacgctcgtgttctcttgtcgcaacgctcgcgatccacacgacggccctttcgagcgcccgccgcgatgcctcaagcccccacgactccgcgtgcacattaaaagcaatcgatacatcaaacgcataaatcagttgaaaccgcgcagggcataacgcggtcagagtgctccattccaggatggtagcggctgtccccccaaagggaccagaaacggtcgggcagacgttaacttccattcaaaagtcaagaatctcgaggtgagctcagagcacaccgaccacgactagttggcggccacgggccctctcgtccacacttaccaaaccatgcagggtagaagtagagccattcttttgcacgtgatctatgaaccttgatcattcttgaagtttttgtacctctgcaacaatatcaccgagtcgttccgtgggggctgtcttcttccttcgatgacggtagtcgtcttccgtagccccactaatctggtcatttttcaatcccgatctctttctgcttcaacgtttggaattagacttgtgcttgaagcgtgccaagaaacaagcttgacatg

SEQ ID NO: 5706 - DNA, 700 bp, Nannochloropsis_gaditana
cccgtcggtgaaagccttgctcagtaagttcggaagccagcgggaagaagaccggctgaagggctacctctcctttctgaaaattggacctcgaattcttcgcatggtcccggggaggaaggcccgggacatacggacctggctggaggtgtacgcctactggaaccaggggggggcggccaacgtcgtctccctcttcctccttctcgtgcggcgattttctctcttgggcccggaggcaagccgggcgctggtacaacccttgcaggtgaaggagacgcccgcgcagggactcatccacccgctgactccccggatcctccagtcccccaagcagtatctgaggtggtacgtggatcgggcagcccggggtcgggttcaagacgccatggtttcctccccgcagacggccccccgcgtggcagttctcctttaccggaagcacgtgatcaccaaccaggtctacattgcgcagctcctccggattttggagaaggaaggcttgctcccggtgccgatcttcatcaacggagtggaggggcacacggtcgtgcgcgacctactcaccacccgtttcgagcaggaggaacgtcggcgggggttacgccgcatcgactccctctccccggaggcggtggaggtggatgcggttatcaacacgatcggcttccccttggtcgggggcccggcggggagcatg

SEQ ID NO: 5707 - DNA, 700 bp, Nannochloropsis_gaditana
atcctttcacctcaaacaaacactagtccctctccaacattcttgccctctcgccctgtttgccaggtacaattttattacctgcaccagggacgctgtctgatcgtgaaacaggcccaacttgctgctagtaatgcgctccagatgcctacgtacaatgcctttatcacgttctgcctggttcttgtgtgtacataatgtgcaggagcgggtccaaaatgaggtgagtggagggtcaccacaatgtatcatggcgccggttgacgctgcaaaaaaggcgtaaaaacatgcctcaacccacgtcatgccacgcgtcatgcacaacactatgtttctgttgtctcgaacatgtaagcgtgtcgagcgcgtggcaataattgaaaaaaatggggcactcctatggccccctctcctccactcccagaggccagcctcgcggttgcaagttgccgcttctacttgaggcaaccggcgccagagatcggatgacagaatcatgaatgtgtgacgacgtgatatcctgaaagcgtccgcacgtgcagtggcagaccaatgacactcgacacgcgtgccgcgttagatcttattgaggtagtggacgcgcttcagctcggaagaactttgttcctaccacctcctacaagtacacccctagcgcaccctctcatcgatcgaacaatacacttgaatctccctcaca

SEQ ID NO: 5708 - DNA, 700 bp, Nannochloropsis_gaditana
cggccaaccgtactgttaggagggggctccatcttctctgaagtcagaggcccgcgaccagcacccaatgtaccatgtccaattagtccccgactctcctttcctccgacctgattttcgcctcgttcatctgctttcttgccagtgtcaaggaacctggacgtcacgtggtaatttatttgcgaaggtcctggatcgaagtgataaggcacagatgatggcgactgcacagacacagtagaggaagtcgtgtcaacattgacaatattaccagaacccttgtgatttgcaacgtcctcgtccagaggtttatccacccggtccggcagcaccactaaatcttcctcgtgccagtgcactgacaggcctggctgcagcaattgaaaggcatccaccgaaaatgtgcatccgcaggccggacacaaattgtttttccctttcatacactggcaacaaagcaaatgcaaacacggggtcaccatgaggatgatcaaaaaagtcccgcacgcatcgcagggagtgttcacgtacgccctgaggcggttcaaaaaagcggccacccgcgccacaccgaccgagactgcctcctcatcctcctcttcctccacggccgtccgctcccttcctcggcggcgagcctcctgaaactctaagaacaaccgccgcgccaactgaagggtcatgacgatggattgctgct

SEQ ID NO: 5709 - DNA, 700 bp, Nannochloropsis_gaditana
atggacgacgcagcccttccggtgcaaggtggccaaatagcactcttccttttcctccctactgtcgtccgtcgactggtcagcggttgaatcaaatgtcgggtctgttgggctgatgcgacgcccccacgtgtgcgcgtgtatctgccccggaccctgtcctaccggccgcaataagtgcacgagggccaacggcttgatctccccgaggcatccttttaaagagtttccaagccaagaggcgatgtcgtacacgcgcacctgcccgtcttgcgaggcaacgctgatccagccgcagggtcccaagagggggccatcgacgagcacagcggctgctgcagctgcgggcagaggacaggtcaacgcgttgaaaactgtgccagcgcgaggagggaccaaaggtgccaaaaaaggtacactaacgtggtgctcaagcacaagaaaacgctgcttcatcctttcatatgccctgttatgacgcgtggcggggggtatggctaagtaggtaaacttgcgtttttgtacaacaaaacgggtgggaaagtcagcgaggacggcgagacagggctcgacccggcttctcctccatcctttttctgcccccactcactccttgtttctgtggaaaacaagcggtttatatcaccaggacaaatattgcctcgctgctgtggtggacgctgacagcgcgcgaaggatg

SEQ ID NO: 5710 - DNA, 700 bp, Nannochloropsis_gaditana
aaattctgaccgtatgagtttgtgacacgaaggatacgacttgcggagtcctctacatggaggactatcttcttttgttgcagcatgtacagctcgatgcatgtccaaggcggggatgcacagccgggggaataataatatacatacattgttttatattagacatcgtgatgagggaagaaagcatggactcctagtaggaggaggatgaaagcaaaactaattccgtgcaaaatgatattaaaaagtggtatatgtccgccaagatagcaaaactgctacagtagtccctccggccagtcatgcacgctttttgggcttccacggtactttttaatggtcccatcaaggagagtgagcagctcgaattagaaggcgctagaagctcttttctggagaggtcaggtagccggtctggtggcagctaagtcacgccttttctccggacgatgggttactaggtctttcaaacgtttgatcttgatgatgcatggcatgcggtgaaaacggggctgtgtgtttatccgcggtagcgaatacctgagactccagagatcatggatggttggggcgcagaaggaggaggtcatcccttctccgccgcactgagaagtgcttttatgtactcacatctcattccgtacatcccacagccgcgcgaataccattgacgtggaactacacgggtgatagactcatg

SEQ ID NO: 5711 - DNA, 700 bp, Nannochloropsis_gaditana
tgcggacgtgtcgacttaggtgggggtagggtttctggtaaaaagggtcgtcacaatgtaagtagtacgatacagaaaggagttttaccataatctttgtgcgcgatgtgtcccggatgaaggggaaaaagtagccttctcgcactcgtcgtctgagagggcgtatgtgtgttttccaaaacgcttcgaaacatttgtagtccccttctccttgctcacgaccacaaacgtaccttggtctagtgttgaaaccattaatggttttgcaggtaaaggggccctcatcttttcagtccttactgacgcatgtcgaaggtggatcaaggcggtgacgggggaggtcgcgacgtgccaagccagcagcacgacgccccatttgagccacggggagaggggcgacatcgctgccaagggcacctagcaggataggttgggcgcacggtcattaacattccggtctgtccgcctccccatccctttccagcgcaatgcttcgaaccctaacccttgcgtgctgccgatgacggcagtcgctgaactcgcgtaatgccgcggctttcacgcgaggccgtgcagtcctgcatcgacatctctctctcatgaacttacgcaatccgctccatctcagagtgttagtgaggcctatgacgaggcggagacggcgcttgtacatcgggactggggagcagccgcaacaatg

SEQ ID NO: 5712 - DNA, 700 bp, Nannochloropsis_gaditana
ctgaccagtatcctcgacgtcgcccgctttcttacacgtcttttctccggcagtaccccattcacaagtatcacccctcttgaccaggttggtcaaggatatagctgagggacaagaagggcgatggccgaaaacgtccgttgctccgacacgaacctcagtcagtactgaacctaggctgaaccacgaccattgctcctccgacggtaaggcaaaaaccctcttttgaccacgtttcgcggttggaccagcagcatatgatgaagtgaactcggcaagactcgtgctgctcgtgcttgcctccatgctcctccaacctgtaggaagtagcgaggggtatggtttactgtgtaagcagccacgggctcggacaagcgcttatctcagtggtaacatgtccctgtttgatacatatatatatatataagtagccactaagtagtcaaatacggccccaagacctacgcgtgttttcttttgttgacgtagcgagtgacagcaagtctcgagtcctgtcgctggtttcactcgctcgtcgatcacttatctgcctttccacttccacctcccctgtctctataccaagcatctgccctcgtgattgccaaatagtccatcccatgagtcttatggcaactgaggcggcaattaattgtatctaacaacactttgttggttcgcagacaaagccaagtagatg

SEQ ID NO: 5713 - DNA, 700 bp, Nannochloropsis_gaditana
cgaactgcagcggatgcggatacaattacatgtttcatgttttgtctctttaatattatcatcacttgacccaaatagcagccaggtggtttagtcttatcgctgcccggccttcaacggcgcgggccccacttctccgacggcaaggccttttccgacgtagtgcttccacagtgcgccaaccatgtcacgcgcgtttcctcgtctgtaccctcgggcacatgtcggaaagggtgctaagaattctcaaattggtctctattgcaattttattcgcgatcaaggcaggttgacgggaggaagaagggtctggcaccacgagcggaggacacaggcctggaaaattgtcacgccacgaattattctacgagggtcgaggaaacgagtatcactcctatcagtacaggcagaatgaatgattggaggactgatgtgttgtgtgagggaaaggggtttcatccccgtcagtttgagtacagcccacacgttcccgaccgcctagtgttcgggacgatccgaggggaggttgtaatttgcgagggcagcccgaactcgcggagtgctaaagcttgcgggcgacgaaaagatgtggaaccacacgcgggaagaggcatgcaagtaaggggaggagaccgaagaggggctaagagaattgtgaggcaactgggtaactcgaccgagacacacttcgccaagcatg

SEQ ID NO: 5714 - DNA, 700 bp, Nannochloropsis_gaditana
agcatccttacgcgccatcaaccttagctctcgtagatttccttgtcgtgaccaactttgcacgtgctttctttcagtgttgaagtgttcctctcatctccgtcgctcagcggctgatctcagccgaggctctcgggtatatgcatgtccaaggcgccgaaaaatgctatccttatataagtcagcacctggcgcgataacatgaatgattaaaatactattgccacatttcctggagatcctatgatcctctggagtcgtgaggtctcgaccttgtctattcagaacataatgcttaggtccgacgtctccagaacagcaaaggaaagtatctttataaggctaattgcagtatactcaccagttacatcaaccattcactactgatgtcgcgccacgatttgttggattggttctttatcaatacttagtgtccattcacatgtggcttctggagaacacgaaattgggaagatgagttgtgcgccgcttacctcctctttctccgagctccgtcctacctggagggaaacacaattgaggaagcatacctgctcgtgtgatttgtttccacacaacaatcatgtagtatctagaaagctgaagatcaggcctcgcaccacactcaccttcttctacacttcgttctcgtttctcacagcagtgcctgatatccttctctatatcaccattaagaatg

SEQ ID NO: 5715 - DNA, 700 bp, Nannochloropsis_gaditana
tccgtcatccccgcgcgggcggggcctgggagaggaccgaaattcgctgagctatggctccagaaacgcattacgaaatgggttcctcatctttaaaaacgctctatcgaaaggtaatgtataatttaggttttatacgattagacgctggagggatgaaggcttacggacgatgctttgttaggaattcactccacgataaagaaagagaggtgtctatgcattattgccttgacccttcaagcgaggcgatgtcaaagcaacccgtcaagaggggttgaagagagtaataacagggtcccgaagcaagctgagcatatagcttggtaggcatgcttacaaactgtcattggctcagtatcgggatgctcatcttttcatacctggaacgtgcgattagtggcaggaatgtcgggcaaggctaaataacaggcattgcgtgatgcaaggacacatttcaataaaatcccactaccatttatgtgatcaacccgctcactcaaccatgcagcaaattgtcggatcattgcaagataaggcctggtaaattttgttaaatcttaactacctggagaagcgcacttgcttcatatttagcgcacgccaatatttgttcctcattttcaaaccccatcatactcatctccagagcgctaaaacaccagcaagtcgcgcgtcctcttcgatcctgactatcatg

SEQ ID NO: 5716 - DNA, 700 bp, Nannochloropsis_gaditana
agaggcacaatatgggggtgaccaccggtaccctgtgctttccttttgaggtcctcggtgcctttgtcgactttaccgcgattcttgtgctatattattgtagaaacattactagatggcattttgcaatgtttttgtcacctctactgcagacttgatggcgtaaggcgggaacgacagtctaagcaataatgttttaagacatatgggccgagcggatcgcacacgctggaagaaaaaaatatcaaatctcgctgcactattgagactcaatttatcataaagcaaacaagtacgaagtcaggatacatggacgtgattttcggattctggatttcagccacgtactgaaaaaacgagaaggcgtggagaccggttcgggacttcgaatttttttaactgccgcaagtagttctttcttgattacccacgaaagggtcgcatttctggggtcaattaggcacctacaggcgaccttggaagattaaattaccaaagtcgttttctgttacgctaaatcagggtgagatatttttagggcgttaaaatttaaaaatccgatttgcatgtagaggaggtcagggacggcagcatagtatatctttccttttataagcttatttcgatctcctacggatcaagcacgatgactttgtctcccacgcaggaaaggcctccatctaagttgtcagatctgctt

SEQ ID NO: 5717 - DNA, 700 bp, Nannochloropsis_gaditana
tacgtgccccctccgaagggcgcgtgctatggcagcaaacgcaatgggaaagggccgtccattgcgcacatgctcgtaagctgcctcacatgctggattggagcacactgcttcgctctgagcggacatcacgagcgtccccatggtcgcaccggcaactgccagcatggcggcagcctcggctccctgacaaaaaacaaaataacgagaggagagtcgtgcagataaataacaaaggaaagtgttgggtaagtgttcaaataaaaatgtacatatagatcataggaaaaaagtattttaaatgtatctacttattctttggtctttgaatgtggggtgaaaagagtttttcatgttggcaaattaggcgtcacggtaggatgctcagcatcttatgaggggaacgtacatgctttgaggtggcgcggcggacggaagcaagaagcatctacgatttatgatgtatttatacttttaagttcacgaatttcgaacggtgtcaagtggttattgaacattcgtgcggttattagcgttccgacgtgaatcggcgagcaagaacgacgacggcgaaagcatggtacgtggcgggttttgacgtgcaatgaattgccataggaatataattaatccacttgctgtttcttcctgttcccacattccgcgcactaatctgcgcgattctgcagggtactttatg

SEQ ID NO: 5718 - DNA, 700 bp, Nannochloropsis_gaditana
ggatagaagttgaaagacggcacaagccgacagaagcgcggtgacagtgaacaacggaccctccagcacttcacccataaaatggagacggccacggtcaacaacccgacgtcatcccgaaatgcaaggctgtacgactcggtgagctcaacgtgaccgtctttccccttaaaagccacctgtacgacgctgttcccgggaattctcggggaatgctccggggtgaacatccgagacggccggctaccgccattcgcgccccgtccgccataaaatctcgatgtcggacagcaccctttccaccatttattgccgggccgcgcgccgcgggtacacagtgcatgcttcgttggcaaaaaggttgccatgttcttgcaagaaaacctccgtgaccattggcccgggcattttcgtggttggcaggaacgacctaacattccacgaactgttttcggcccccttcgtagaacccggtcgtcatagagatggatatgtattgatgggacagaggtcttccatgtgctcttcataaatctcaacacctttgtggttcactgtttgtatggctaacggatgtttttaagaaccccgtatatctgaggtgtcagccgtgggtcctggaaaatcaggcgatgctttaaacataacccgcgcctcaaactcaaaactttcttcacgcccggtttcccagccatacatg

SEQ ID NO: 5719 - DNA, 700 bp, Nannochloropsis_gaditana
ctcaatagccgtaccttggtgcaccgggaatatcatcaagtctggaacgtaatggcttttagcccctggcaacaaaaacccatccatcgtactgtctcgcttccccccctttctcctcattctgttttttactctattgaccgaatggttgccaagcctcgagacagctttgtgcctgtccagaagcgtgtggggaaaagtatgcctaagtaaatataaacaaaaatatgaaggaagaaagaaaacccacctgcagcctcgttcacctcctctctcggcatgtcggctatatgttggcatgagcgtgacctggacccaaaggatctgtagcgggaggtgtggtgtgtatgttgcgcaagctatggttgagttgagctggatcgagcgaggaggcgagcgtcgaaagaggggcgataaaagtggtggaggaggctgggtatgagctgcaaggaggaaaaaagtgttttgcgtactattcctcccgtgtctgttaagtgcattacgcatagagtttgatgtagtgctctttgtcacctactacggacgttaatgatttttgtatgccatctccatatccctttcgcccaaatgcagcctagcgaagggaggggcagggaaaccttatctctttgcccttgttcctcttcatgtttcttcccgttcatgccagacacaggttgtaggagagaatttcgtcatg

SEQ ID NO: 5720 - DNA, 700 bp, Nannochloropsis_gaditana
acgacaaatcaaatgtgcttgtgcgattatgtaaagactatgacatcaggtaaacaaaactaagcagtctaagacataagtgggctgctgttcgcgcataagaataatggacacagatgctaggtatggctgtgacccttttttcgtaaaactacacgttcgcatattaagttgtatgaagagtaaaactaaccaaatggaaggtggcaccttcaatcaataatcgagatagcgatattcacatcaaagaaagaagcaacttgatggttactttatgcgcagccaacctagtagccggtcgggccattggctgactccctccagcgtgcttcaacaaaatgcaatataattgtttcttgatatgattatcaatcttggtccgtcgactctgcgcaaaagtttgctccgcgcgtgtcgaaaacctgtccagggcacttatcgcacgtgtcgctaattctggttcaagaatcttgagcgctttccctcccacgtaccctcccgaatccccccatcaaacctcaaaaccttactgtctatttggtccatggaatcgtacgcatcaggccttttctaataactattgtttgcagtaattctcagacattcgatccgctcgcatcgcaggggaagaagccaggggcctattcgcatctgcgtgcaaagtttcacttcagtttgtgggtcaatgcttttgccaatg

SEQ ID NO: 5721 - DNA, 700 bp, Nannochloropsis_gaditana
aggaattctagttataaatataaaatgaagagcttagacgacttgaaatatacatgaaagtcgaaaaggtctcattgcagcattatctcgttactcgataaataggatcagtgcgtgttgagggctgtgcttagaattgcattcaaagtgcgatcctgctgatttacaagtgtccattagactttaactctttcaaaataggcaatgaaggaatggaagatgtatgttaatcggcaaacgttggactctccgcttatcgctgcaatacgaggagcgacgaagtgccgacctcaagaatacccggagggtacgcgtaacgtttatgctatgtaccacacggagtccttattgcatcggacagattcacgctataaagcatctcgactcattattttggtgatccactctcatacagacggtttgtgaggatattattcgcgcggtggagtttttccttcctaaaaccgcattgcagaacaccagatgacaggggtcgagacggcgatgttgcagccgctgttcgtcatgaacactacatattcaaaaaaaagacccgtgcagctttgctctggatacctaagtggaaggatacacggagggatatcgggagctcgtcatgtctgccatccatcccaaggtcgtcatcttttctatgccctgcgttttctagtcctgctgatgtctctccctgtgaccaatg

SEQ ID NO: 5722 - DNA, 700 bp, Nannochloropsis_gaditana
ttttgatttcaattcaacggcttgcaacggtccggtcatgaaagcgaaacggtacccagggtttgttctttgtgcgaattgtacgatgcatcatggtttcgcattctcatcatggtttcgcattctcattacatagactactcttacttgtctatacagactatatgttgtgcgctgactcaattcaacttcaaccatgtctgccgctatcagagcatatggtttgccagcgcattacctgtgtttgccatcatcttgcataatagcgacgaaaaagcatacagcaaacctttcactgcacattttagcttattttggacttctgactctcgctggatatctttcgagtgaactacttggccgagagacccaaaaattacctggagatgcaactgtctctcaacctcagactgcgcagatgcatccctttttctccatccttgtgcctatgacgctatttcctgggacttcgacgacattttatgtccttcaaagtctgaaaacagttggagtgatggttcctgggctagatttgctaacaatacgtcctttgggtgacatttgtccaagcgcttatgcaataggaaaatggattacttttctatttcgaatatctgaaaagttagcctatttattgatccttctgtcagcttgtggaatacttgctatagaattgagaattttacttggcaagcaaatg

SEQ ID NO: 5723 - DNA, 700 bp, Nannochloropsis_gaditana
tgttcgtgcaagcgtcgatttcgacctgttggcgtcttcaccctccctcgcgaccgccccaagccggaggggcatggcttgcacgctgcggacggtcgggaggagatgcgagagcttggagtccacataaactccacgctttactcggagacatcgcctcgacagattatagaaaccctcagggccgtcacctgcagctgtttgagccaccctgcccttcacatcgctgggactggcttcgtttgcgctccggcttctctgcttcgcctacttgctagcttcggtgcccgtgacgtgtctctcctagctcaaccttcccaagccatgttcggatttataattggcacgcctacacagccagctgatttcgccagacactcgcaggcgttactgtcccaagatgagactgttggaattttgcagattgcgtgcatttctttctttgcttatgtccggtcctgtcgctcctccggtctgtgggtgaactcgccttccctctacacccccgtatacttccttgcttctccctcaccgacgtacgctcttccattatttcctccttttcaccacatgttcatgtaggggccattaaattacgttggatgcgcttcgtaggcttgccgttcgacttgcagggcctgagacaatttactgaggcatcgcggcgttcctccgcaggcgcctttgacgcacacatatg

SEQ ID NO: 5724 - DNA, 700 bp, Nannochloropsis_gaditana
atgcggtctctagacactagctgtgcatgtaattgatgttcatgggattcttcatttgttgtaccgaagtgtttgtacgggaaggggttgctgtctaagccgctgtctcggagcttcttcgtggccacctactaaacatcaaccccccccattccctaaataccagtggatttcggccgcgcctaccgcgcgctgggtagacagacggcaaacaaccacactcaaggaaggaagtcagcgcaattgacgttaaatgagtctatcagacgaagcagagctggccgacaacaattgcagatcgacagcacagcaactcagccaggcccaacagcaaccacatcctcagaccagtggcatcactcccgcggacagttcctcgggtttcagcagtaaaagacaaagacacaaaggaatgaagagaatattaatcttgggagcctgttatctcgtgactttggcctcctgcggcagtgtgtcttccttcgtggtgcccaatcatggccttgcagggagtagcatttccaacgcaaggcgcacgtcattaccgagcagtatctaccatcctccaaatttccgcaccgtcctggaacaacagagaataggtgaagcttcacctttcttgctttccctcgcctctacgcagagcaacaaccctgcgatcggcgccacaaacgatcctgcttccaacacgggacccatg

SEQ ID NO: 5725 - DNA, 700 bp, Nannochloropsis_gaditana
gcagagtggtctgaaattgtgtttggattgaggatctgttatacatttgggggaatttaatgtaaatagcagcaacagtagacagtttctggtatttttcttgacagacttgttgcaaatgcgcggaaaactgtatgacatgtgagggcacaaagcatgtaaaatgaaagccgtattgattaataatattagacgcctattgttgatgcacgctactatagaccctcatccggagaaggcgcaactctgggagaaaacatgcgtgtatcaaaaaatatgccaacaagaaactgcacgaaggtcctccaaattggtgacctccattggccccagttacctcctcccccttgccctcgggcgtttccccgcctccagggcggacgggagaagccagaacacttttcttgccgccgtgaaggctgccattcccaataagtcacccgccaccacttaggcatttgtgtagcggcttgtgcgcaaggcttattttgatcttgaatcttttcggagctgagagacatgcgtttgcatatcggatgacagtaagcaacgaccagcccgctataagcaagccatctatctcttgacactgacaagttttctcgtataagtaaaaaggcacgcaattgagcgactccacgatttatcttctcttaattgcgtggttttaaaaagaacagaacacaggcgggacgccatg

SEQ ID NO: 5726 - DNA, 700 bp, Nannochloropsis_gaditana
cttcctggccgcgtcggtacatcctgcggtggttatcttcacggaagagcacgaggacagggcgggctcgggcgccctggagcgcttgctgaccaggccattgctgcaggcgaagggcgtgcgccagatccacataaaccccgccaccgacggtagggagggctgttgggaggggcgtggaagcctgcaaaagactgaaaaggtcgggcgacagacataccaggagtcaccttcatcgatttttgcctcccgtcacaggaggtgtcgccactcatatctcagcaacgcaatcacgctctctgccttcctttcccccttttacccttcccacgcctgtactcctcgggcgccagccaacatgcgcaggatcctgacccacatcgcctcagccgagggcctgggcccgtccaggtccgaggtggaggctatcgttgcctgcagccggggagacctccggcatgccatcctcacactccagctgcagcttcaagggagccgggctgcccctaacgctcccccacgggccctggccaggtccaacgcttcagcttcctcctcgcacctgttgcgacaatgcgcgggggggcgaaagggggaagggggccgagggggggaagacaaggggggagagggaaggggaggaaggagagtggggagaaggagggagggagaggaggcggagaggaaggacacgtacatg

SEQ ID NO: 5727 - DNA, 700 bp, Nannochloropsis_gaditana
tttcgcgaagagaatataacgtgcttgcagatttaatgcaggtccgcagaaatctcgaattttcgtgggggaaaatgtcgctcacacgacttgggttcactgccgtgatgagtgtagcggagtccttcagcagtaacacgcacactcctttgcacacgattcccgtcgctagaattgcaggtacgtaagcagctccagacttatgctagttataatgctaccgcggcgaagcatgcgtgcgcgcacgagtaaggatgcctgacgggacaatttttcagcatgggggtaataacacagcgaggttggctttctttatgagggggccgactcataaacttttaagacggagggcgagggaccaggacacgaatcgtcacacgatccgcggcataacgcacttttcggctgttgtaggataacttcattatcccgggtgtatccccagaacgtactttttccttggacggccttcaagatctgcttcatgatttcttaaaaaaatgttacgtcctcgaagcgagaaagcgttgccctctgcctccctgggcaatgcttttgggctgactaaacttatctcaagcagcactgtgacgacaagaggactttgtcaagcactccaatgatccatgttgtcgatcccattaagtattggcccgcatgaaaaaatatggggtggcgtgtggtgaagggtgatgcgccg

SEQ ID NO: 5728 - DNA, 700 bp, Nannochloropsis_gaditana
gtacagccccagcgaggagatgcccggcaatgtaaaatatcgtgcagagagagcacggtacccaatcaacaccttcatctcaagccaaatttctagccatgaagccttgcacttgcaggaaatgtctagaaactctccagagggcgtgtttctggatttaacttcctgcggctggggcctacttagcgtgtcaggagaggataggctgcgctttttgcacaatcaactcacgaattcgttcgcaaacgcacaagtcggtgatgtaatagaatcatcttatacatcttcggtgggaagagccatagacttggtgactgcgtacgtactggaggatgaggtcctgcttttgtcctcaccaccacggcacgcgcacgtcttcgagtccttccacaagtatatcttccccttagacaggtagggaagcgacgttgtcggacctttacccccggttatcccagggagctatccatggtgcctgacctcgttgacattccctctcggccatctttccagggtccaggtacacaagaaggaattgcagggttttttcatatacatgggcccagaggcggccttgacgaagctctccaatctgttggaacacaaggtcccgcctccacaagctcatcgttgccataccttaccttcaggcctggtgatggccgaggggtctggcctggcccttcctggcctcaccatg

SEQ ID NO: 5729 - DNA, 700 bp, Nannochloropsis_gaditana
tctaccactacagccgcaggcactctcattctcgctgcgggcgccacaagaagaaggcagccgtactagcagcggctgtcgtcaagcgtggcgcacagcggaaggtccaggctgggcaagcgaccggcaactggtgcgcagatgagagccggggggcctgtcagcaagcgcggtggaccctctcggagcacgtagcttcctctctcgagacggcgacttccctgtcacgcccgttcgtcggctcgctcacgcggcgcgcgagcaaaatgtactctatctggcgtgtatgggcgaggaggaggcaccaatgcacgggaaggtcgaaagcacaacccgagtcgaataaggccaaggcgcaaatgctgtcgccgactccaaaagaacattctaccaagaaaatcaaaggagaatatagcaaatcagggactcgcgatggcagcggtagccgccgtcgaaggtgtcctggcaagagaagcgaacttgagcttgttcagaagccgccacattacgggcacgagaaacagcaaccagcggcgcaggcattcgtctctacaccacccgtctttccttcgcccatgtctaggcaagggatagcaggacaagagctgcgaatggtatcggtgacgcctgggtttgtggaggggtctgttgtgggcgacgcgttcgagtgggtggggacaggcgggtcgcactgtcccaa

SEQ ID NO: 5730 - DNA, 700 bp, Nannochloropsis_gaditana
aggcaggactgcccgaaactctggttgcagcacgtcatgaagacagagcaaagattttcgatgcaaaggatgttgctgtcaggaaagtggggcgaaagtgcactttaccaaacgacgaccgatattgcttggtctggtgtgaatgagaaatattcatcgcaacttgcactcatgataaaacacgttcactttcatagttcgctcaggaacgctattttctggtggaaagatgctttggcaccgtcgacgcggattttcatacaagtcttccgtactaaatttctttgtcgtcgctccgtgctttctcatacctcctctcgccctgctggcctccgcgtggcaaccaaaattttccttttgcgtgcagtacacgggcaatcgaaggctttttttggaaaccgtagcgacattacacggtcgtaaatccccacgcatggtcaccgccaccgtcggaccgacatctcccctcgcctctgcatctttcccctcccttgctccgtcgcccgcgtcccccacctcagggaaatcagcttcttcacagtcagggggagagcccatcgtcaaacgcgtgtatgcgtatgctcatggcttcctttccgatgaaagctctttcaaaggaaggcaccttcaacaattgttggcattccgcaacgcgcacctccatctgctcaaccttaatggcggcatcggggaggggatg

SEQ ID NO: 5731 - DNA, 700 bp, Nannochloropsis_gaditana
ttttcatggagcgcaaagcattttgtttttgtaaacttttgtcgcccttatcggaaagaccggagggacaggcagaggaccggcggggatgataccgcatgggccgatgacgccacttatttaaatcgacggttgaaggacgccggcggcgcaagggcaggggctgactgggcggggccgtgtgagtgggagtgcagctttgcgggcgtgactgtggtcttttttgttccctgtgctccaagcgcatgcgataagaagcacattatgctattgtggacatgtgacgctttttgaggcttcgtcatttgcggctgaagcctcctcttctgctgcttgggatgagtcaggcaagatactgggccggtcaggacctgacctcgcctttccattccaaaaagcatgcgagctctctacgtgtgtgaaggattgtggatttgagcaggcagtgacacgctcgatgaataagtgtgtcaagcgtggctcttttgtcatgcacgcacgggaggcaccattcgttgtcctgacgaagtgctgcttcacaggctaatgcatgcagagattgtgggccgcccgtcgcccgtgttattttatagtgcacgccccatttttttggactttttgatcaggatcatcagaatatgtcataatataacaattcacaacacataaaaagccggcatctcagacaccagtcgtcatg

SEQ ID NO: 5732 - DNA, 700 bp, Nannochloropsis_gaditana
ctcccgaaaacgagatgaggaatgccgtgaggtcatgagagcttttgagctacagcctctgctcaaggggcctggcaaaaagcacaaaccagataccaaattcacgcaggtgtttagaccaaagacgtggatgatagtggggctgtttagcatgaaggcaagctggacaggcagagtcaggagggcaaggagcatggagaggtaccgaggcctgatgctgtctgcaaagactaccttttacttccagtttcgcaatttcccccccgccccgatagtacctccgtgttgcaatccagttgcagtcctctgtttcaaccgtgttggcaaggaaaaaacgcacgtgagccccgcgaagaagtgttccggctcgcgaggcgtggggaggaaggcagcgagtgccgggggagaaacatctttgctgcatttcaagagagccaaacgccgacgccgcgagcactcgagaacttgcccgccccgcttcctgtttcctccgcgaaccgaggcatgcactgatcgtgggaggacgaggacgacgggatggtcggggcagatgccatcgtaaacaagactatggttggaaaccagcagctcttacgccgagccctcagtcctctcgcacccaaagcatctccgtcatgccctacggactccgcgcctcacgccccccctcccatgccgcattcccccataggacaccatg

SEQ ID NO: 5733 - DNA, 700 bp, Nannochloropsis_gaditana
ttgtacactcttccttctctgatgagttcgcatgattattgtttttagggccgcttgttgcaatcgcacgtttgctttgttcttgctcctgctcgcctctcggctgatcgccaggagccacagcgacggctagacccaggtacaccgcttgttaccaagtctcgcggaaggcagcttcttttcaaattttttatcacttgtaaaggtcgacttgctctgatctgacgacgaagagtgatcgtacgggcgaatgcctgctttgagaccgttgaatacctcggacaactggagttagaagaagcacgttcagtgtgacgtgcattattcagtaaaccccggattcaagatggcgggcatggcaatttcgaacattgtgttggtcgtatccttcgattccgggcacaaattagttatcacccatgagaaattacttgtcaattttctggtcatttgaatgaagcctcggtcggcacacggaatggtctctggtaaggctggctaccgggaagcccgttgtatgaacgacctaatatatttctcgcacgaacttggtaactttcacgattcacgcgtcacaatagaagctcaaattgcctgtccgtcctacccgtagctatccatcattcgtctcgctgacagcacttttaagtcaagttgatgttaaccttatcaatgatgaaaggaagagcgctctagcatg

SEQ ID NO: 5734 - DNA, 700 bp, Nannochloropsis_gaditana
ttggcatcgccgcgggagacggatggagccattgtagggtgggaaatcgaggtgaaggcccgcccgcttgtgggcaccataaaagccgaagcgaaagaggccatgctaaaggccagaaacattaaaatgcgcatagctggacgaaaagtgtctgtcaacttaggggatcctggcggtatagagaaaagagacatgtgacacaggaaagtgtagcaccactggcaaggtgatagcttagttgatgtaagagtaagatactttcccctgcaccatactatttcccttgtgagccataacaattggcgtgatgacgacatgatgtcacttacgtgactttgaaacacgatttgtcgacgtgagaaatgcgaatgactccgtaaaccggggtggtgcagttggagagagaaagcaatgcatcctgatcgccctccccgcacgccgctatcaggcatcacaatatccctaccccgggtacttctgtcctatccgcatccaccgccgcgttgcgtacatgctttcctcatcgatccttcgtctgctgtcacactttttgactttgacaggtgtgcaattttgaccttctgttggctctacttgtttctctctaggtcggcattctaacttgctcgctttcttcgtctgcgtgcaaaggcaacatcctgaagctgcgagtcaaggacactggaaactgagaaaaatg

SEQ ID NO: 5735 - DNA, 700 bp, Nannochloropsis_gaditana
aagggtctatttgacttggcgagatgtgaggtgcccacgaagtggactactcttcgacaggtatgtcaaaggttcaaaagaaaaaaatatctgcgaagtttgcccaattttgatgcattcagtgcgcgcatgataccccatggggtccaggcccgtcagacggggatttgcagtgtggcgatggtccactggcgaaagtcaccacaagaagtgtggatgagccaaggactcatttagggcgcacgggcgccgttgtaataaatacacatatcttatgtaaagggcaaagcaaggttgcccccgcgaggaaatggagtgccggacatgaggcgcgaggcaaggcagggacggggtaaggaatttgatttcagtttgaacggacagggagcttgcgccggcaggagggaggggggagctgtgagcggccagcgccacccacaatgcatcacgcgtatagattaagactagaattttgtagtcgaattaggaccattgttttcttgagcgcaaatggaggtaggcgttgaagtgggtttaaaacaggtggtggctggcaacgtgttccaggtgaacggcacaaaaaccgttagctactactgactagtcgtagaacatacgatgtgtgcgcattgcgatttcacgccaagcttttcacagtaccgcgtaaaagaaatccactatgtgttgaaagccaaagttc

SEQ ID NO: 5736 - DNA, 700 bp, Nannochloropsis_gaditana
ctgctggaaaatccatttcatcatcgtcgctcacatcaggtagtgatgaagggggtgttttccagtttttgggatgcttatcgccttgaactttctgggagtgtctccgccgtcgtgccattattcagaggatcttcctgtcacgccaagcacgaatcaaaaataagatcagttaccgcgctacattaatctacaattccgacaggatttgttccaaggagattttttcccccatttgcgtcgtgtaatattatttagcaggaacttggtagtggggaggtcgacacgttaagagttgttgcccctggcgaggcggcgatgatggggatatgatgtattaggtacccggccctcgccgactggggcgggcgaagccggaagaaggccctgcaacctctgattttgtttttgacctgaaagtggatcaatacatccttctgagactttttcacccgaaacaagcacgtagagcggctttgcctgccgtgcactacaccgacccttgcgatgacattctgtactcacagcccgcttgaacatttgccggcttgcgcttccagcgaagtcgtccatctcaacacatttgtcccttccccatcaaacccatcaaacaggccagcgtcagacgtgtgctcttccggtacgacaaaaaaagaaaattcgtactcttttgctgaaaatctgactcgcgagattcatg

SEQ ID NO: 5737 - DNA, 700 bp, Nannochloropsis_gaditana
tatggaaaacgtgaacgggacacgatggcgtgaacacgagatgagcacttcctcatcaattgaggatcattcagcacgatttgaggcgtcaactgttatccctttgtcttatccacgtttttgatccaacagcttttttgttcatctcgttaaaatggccaaaattggttgtacaggaagcacatttctgaagggactgagttatcccctagacaaactatctttgtagaggaaatgctaagatatcagaaaactgctggacagttttaacaactgccaaagaagcattttctttctactgaacacctttcgtataaaacggtagtaaattcccttcaaactgccctctttgcattcacatttgccggtggtggtgggctatcgcttggattgcagggcgcatcgctcgttgctttgaactttttgttactttctgaccgtgtttttggttcgtatccgatgaaccgactgctccgtatgaaccccaggccttggctttggtcgttcttgtgaatcgttgtagatgacatatgtatcattgtttccaagtcgtcggtgagcagtcttggatagtttgttgagtcctttctttgattttttttggcttgcttgctttctctttcttcttcccgtcgaaattgctgctgcttcaacgtcaacctttccattctcttcctctcccttgtctgcaggactcatg

SEQ ID NO: 5738 - DNA, 700 bp, Nannochloropsis_gaditana
tttgaggagatcctcgttcatgacttccacgcgtgatgttgctgttggtttctcagaccacgtcggagggccgtacgtttcttgccatgaatgtgtccggaagctgaatgatcccatacgcgacacatccaaagcattttcgtcgcaccattatcagcttctccgccatggtcaggctttgattccgattcatatgaagtcgccgtcgccgtcggaggcggggtgcatgccggttcacgtataacggaacagcgtgcacgatatgagatgcgacggccccgtggccgcacgagggagaacgggaatgtgacctccctggacaatttattgccaccctcgtgtcgattgtacacaccgtatggaagacgacggcatacgtggtgttgagatttgttgcacaaggcgtggtcttgcacgtcgagagagggacggtggaacaaatggcggtgactgcatgcctgcacgacaaccgctgaggtcggggtcccgtgatatctttaagcctgcccgctcaggaattttctagtttcctcgtgtgaaggacgttgaagagcgatgttgacagcctcgtgacttcgataacgcaattctgcggatgtgggatttatacgaagaggatctgagcaaggtgctgtctcatgtcgactgaaattcactttttgtcctttgtatgtcctttctcccccttccgcttcgcatg

SEQ ID NO: 5739 - DNA, 700 bp, Nannochloropsis_gaditana
tgccttacgagggaccatccctctccttcaagttttctgtgaggccaatgggggggaatataaggaaacctaccgaggttttccacccggctatgcccaactgattgcctcccccgcctatttctggccaattcagcttcattttatcaataccagggcctctatacctcgctccctcgtccctgcctcgtcccgcgccgaccccacccgggactcatggaacggactgatcgaatgcccctgctccaacaggcggaccttcgacctgagggcgaatttggtggatgggaagcccccatacccggtccactgtcaaggtgaggtgctggcccagagcaatcccgtctgctcccttgccacctaccaaggtggcctccgctgctgtgagcctggcatggtcttgctggacagggagcagctgcagccagtggaggaggacacctacctactgaaggcgcgcttctggtacgaggagtaccgcgaggagggggccgggcaagggcggggggacgcagtggagggcattgtgggcaaagggccgagaatggttcaggagggggggagagcggttgtatctgggcatgagaaagggaaagtaacggtggggagggaggaaaagggggagccgcccgaaggagaaattaccgacgacagagtggagggagttcggaggcttgctgctgtcaaagacagcaagatg

SEQ ID NO: 5740 - DNA, 700 bp, Nannochloropsis_gaditana
ccacttcctccaaaatcccctattatgtcttataatgatttttatcacctacaggcaaggctttcggtggagtcaatcgtcgtcatggcttcgcatttgcggccgtcaaggttttgcctttccctcctgctccttgtggggggcctcggggttcgagcaagcattcacatgtccgtcctctcgccggggacgccacaagcgtgcttggaggttcattttgagccgcaggaggtggtatctccctcactgcacatcgatgctcgggcccttgtttccaggtctgctactctttccctttcgtcctcgtcctcttcctcctcctcctcccagcccgcgtggcgcccaggcaagcccccaccgctaaagaacccttattctacagcatcgccctcttcagcaatggctcgcatttctctgcgaagaggaagcaagggggggaatgccatattggctccagaggcgcccggtgacgtgatcgtttgcgacctatcctcttcccccccctcagccaaccctgtcccatcgccaaatttttcttctttaccaatttcggcattggtagtggtgcgaggagcgcatgtcctagctcgggaagggggcgtacaagtgggagaagtcgtagacaggcagctcctgagaaatttccagttttccagcaggatacaagacgcaagaccggctggggcgtcggacatggatg

SEQ ID NO: 5741 - DNA, 700 bp, Nannochloropsis_gaditana
aacccatcggatttgggaaggacgtcggcaagggtccttgaaaatagtctcgcaatctttgcttttaaatctaacaatagaaagaatccagcgatggcgtcatagcaggtacgaagatttgacaagaaaatcagcttgctcacgtgaagcagcctacaatcttaaggagaccgctcaagctgcgcaggcgtgtcgatccagtagcatgtgtatgagcaacaacatgacgaaatcatgcgatgggctatgttcaattccttcactctataaccctatcaatgtcccagtcaaatgatatcgcccgataaacttattcctggacagaggtgttgtctcttaacatgcaactgaatgtccacttgtcaaggctttgaggtaatggcgggctttctcatgcggagggaagcgttggtagaaccaaacacttcgacacgcattagttgatagggacatcttcacacaggcaaaagggatcgaacggacatgctttcgtagtcaagactgaaaatcataccgtggaatccatacgggatagatttgcgcccactggtgcttcttttctgtttaatgctagcgccttggggggtagggacagggcgccgccgctcgttacttcaagtgctacactgcgctttcacaaaactcagaggttgcctcacccacattaaagaatcacgtaccgttccgtacttcacgtgca

SEQ ID NO: 5742 - DNA, 700 bp, Nannochloropsis_gaditana
acgcagggcgtgatcaacgggaggggtacgcttttcatcgccaacggggacagatacacgggcgagtggcaggacgggaagatgaatggtacgtgaaaaggggggaaattggtgggaggggaaaggagattgatacgatgagaaatactatgtgtactttaggcttctgctcacttatgaaagaaagacatggttatggcatgcggtccagaggcactgaggatcgtctcaagatggctttggccacgccacgagagatactctggacaggctcacctacacgcgctcgatcttcacaatttggccatgatcatcatcacaggcgtcggcgtgtatacctgcgttgacggggacacgtacgaggggggatggatgtgtggtaagttagggatctgtcactctcccgcatataggcctcctcctgacttcctaagctattcaaacctcttgtctctcgccctttcctcatcttttcccctctcttggcccctcattatttccagacaagcggcacgggcagggtgttatgctctatctctccgaagacggggctacgaaggagaagtacgagggagagtgggaggaaggtgagaactacgccggtttccaaggggttgagaccctcgaggcctgggtcttggcggccttgcgctaagccacctctccccccttttttcgcccctccctcccagacaaaatg

SEQ ID NO: 5743 - DNA, 700 bp, Nannochloropsis_gaditana
ggaaagcccggaggccccgatgagagaaaggaggacgaagacagataaaagaggccacatcgtaggcttgggctcgcggttgagggatctggttgaaaatgaattattgaggaagtcaggaggtgaccaagcgggatgtaaggtggcctagtccgaccacaaaatttaagaggctttgcaaacctgccaacacggcgcgcaggcatttaattactctcaaactttacaaagtttacacatagcactttttaatgacggcacgactcaatcgggggcaaaattgcaaggtggttgctcctcttccatgggaaagggatcgatccgagccgctgcctcgcgctccatgggcgcgtctctttttcgcgtaacaacatccaaaagacgacaaacagatatctgatcaagggtctttacgcagacatgattttaatgccatcgtgcgcgagatgggtgtatattacattcaatttccgtagtcacgggcaggcctgcctcgctcgcctcttctttgaagcactttcagcgacactcgggactaaacttgctttgacaagccagccctgacagcgttaaaatcacctaccgacatgcaggcttgaatcgtatatacttccgacggtattggcagcgttgcatacttttcgagagacggcgagttgctttcagcagagctagcagcaggggtcgattagccatgatg

SEQ ID NO: 5744 - DNA, 700 bp, Nannochloropsis_gaditana
gggaaaccgcaggaaagaaaaggacgggccattgtagaaaaagaagacgggcaggagacgaaaagcggtacggagcgaggctattttcatgattggaacctctcaaattgcatcggtcgttctatcctcccacgcacccaatccttttcacagcttaccttcgggaggaggccgcgggggaaaagaaaagattatcaatacccaacgaagcgccgtctgttccagcacagtatggcgtggatgatttgggcggtggcagcatcggcacagaggagggaggaaaggaggagggtttgagacggttgccgtcttactacgtgcccccccagccaacctttccccccaccgccgtggcagtctatctccgagtctcgatggagtaagttggtgcgccagaatgccttggctttcaaaccacatttcatctttttatcctttcgaaggagttacctttggaaggaccctggaagagaataggtctgggtagccccttgcttctggggtttaaaaatatgtgtatatttccgcgcgtctcattcattcatatgctctttcgatttggaacatatggttatcaaaaaggactccgcccgttgcggcagaaatgcatctcgcttcttctttgtcgtcgtcctccgccccctccttgtcctcctcctcttctcccctacgccacccactacctacccctgccgacatg

SEQ ID NO: 5745 - DNA, 700 bp, Nannochloropsis_gaditana
tttttccatcgattttgctccattccatcctccctgacctgtttttcttttcccctttttcaactaggtctctgtcggccgaattcgtttcgctcgtcctgctgatggacgcggtatgacctacgtcaccatcgcttacgctcctcacggcgtcgatccgcaggtgcggtcctccttttctttgcgtcttccatgcccttttcggtaccatttgctcaccagcattgccattattaatgcattttgtcaatgtcacccagttctgatgcatttttttcttttgtttgattctagttgtcctgttttgcattccgggcatctccttccaaccttcttcctccttcccttcctttgccctttctttcctttccttttccttgcacctcaccatcctccttccaggacgcggacagcgatttattgattggttgttgttcagggctgcaaggggacgaaggttcctacgggatgctcaaggtaggagtcctccctagtttctctcccttagccatattccatatcgtcatccatgacattcagtcttttctaaaaatttaccataagactggtccgctccatgtatgggaagccgacatgactctatttgtcttctcttcttctatttacctcgccctccatccctatgctccaggcccttgatctggactttgctttacccttcacggccgcgtcccaaatg

SEQ ID NO: 5746 - DNA, 700 bp, Nannochloropsis_gaditana
gcttgtcttcggacgttccaggcccactacgcctccataatgaactgggagcacccccccaccacccttcttttcctccttctctttctctacctctgtctctgcactgaggcggagaaggtaaggagtaaagcggaaaattttcgatgtgcggattatcatcatttctcattcaaatccatccaccctcctcttggctttccctcctgcaggcgggggctctgcttgtcttctctgtcctcaccttcatgacctatgccctctattgccgaagctctggacggtacgtcttcctcctcctttgctgcttccccaagtcgctttcacattcccctccctctccgtatatcctttcctcgcccatattcgatcctgtcctcaattctctttctcacaggtactcgcaactttggatcgagcacgaccccgaggatgatacccttggggagggcgacgcaggtagtagcgcaatggaacggtcttcggcccctatttcgacctcacttttgagtaaagccagaccataccgtgccgttgccaagctcaaggtacggggctgcctttacctagatttccagacgttttttccatcgattttgctccattccatcctccctgacctgtttttcttttcccctttttcaactaggtctctgtcggccgaattcgtttcgctcgtcctgctgatggacgcggtatg

SEQ ID NO: 5747 - DNA, 700 bp, Nannochloropsis_gaditana
ttgatctctccgagtcgagagaaggtgtcgacgatgtgaagaaaccgaagatagcacctcttgttccccatgtgatgcatctacctcttaaattttcggtttccaaaattcttgatgaggtttattccttgttaatgacttacttgcaaaatatatgagacctcttttcaaaaagctttcagacggtgctgttgttgccgtggcaggtagcttcacgtaaaatggtccacccgtccgctccttgttaggtaccataaacatccagcttatgcaatcatcttgaatctgtagatacaaatgctacacactgagcgttgatggcgacggagcttagtctccataaattgaattatgcttgagaaaagcagggaggcagctgcagcccactttgcgttgaagacgcgactgtcaccgcacaaaacaacccaaacaacttctttctgcgttttctagcagaattgatcatagttgtgatgagtttcaacttatatactcgaaaggcgcgtgcgaatagcgtgaaaggcaatgtttcctttcacgcatacgtggggacgtacagccttcttttatgttcctgcagtagccctgttatcgtctcgctagcatcatgacggtgcctccgtgcggcacgcctggttatctttctctttgacaaatgcttggcggccctttctcccggctaacacacctttcattcata

SEQ ID NO: 5748 - DNA, 700 bp, Nannochloropsis_gaditana
cgccctctatcatatcttgtcccttcctccctccctccctccctcccttccaggttgacctgaaggaggccctgtccctctactgccacctccccaacagctgtacgctcctcgtctgcgggggagacggcacggcctcccgtgtgttcgaggtcgtggacggcatggagtggaagcacggtacggagggagggagggaagggaggaaggaagggagggcggggggggagaacgcagccccgttgctcaccaggcgtccctcgttctccctacaggccctcccaaaatcgccatcgtccccctgggcaccggcaacgatatcgcccgagtcttggactggaatcttggtacgccccctccttcttcccgcccactgagccgctcttgcccttgttcctcctcacgtgccgatctttccctctcccgtcctccctccctccctccctccctgcttccttcctctttctctcactccctctcttcctccaggtcacgattggtcgggcggttacttcccatggagtaacgatgccgccgatgccaacctcctaagtacgcgttttccacacgcttctttctcctctcccaccttttggcacctcccttgtgatttaatattacatgcactgtgtgactattttgacgcgttcaatcctttctcttccctccaggcgtcttttcggacttgacccgcgccatg

SEQ ID NO: 5749 - DNA, 700 bp, Nannochloropsis_gaditana
acgaaaaaggtaccaccgccctagtagaacgtccctgcaacaggttacggggtatctcactatatacatgttatacacggtcacccaaaacactattacacactgcaattcgaaaaaaaacgagaagcgaatactctcagtgctacacccatgtataatttttggttcgagtggtccaaattttgcttgtgccgatcacggggtcgtacggcccattctcgcccctgagcgcgacaacctgatggcgccaacaagcagcttgcacttcgattaacttcccagcttgatcgagaaagcgcagtaaaacctcaaaaagtcagcgctctctttccttacacattcagccatcgtggcgttcattacttgcctcccgtctaactccctgcgtactccttggcggcctcctcagcagcatccaagctcgcacgcctcctcccgtgccattttgtccttgtcccctcttcacgcgccggtggtgccgctatcggcaaccttttctccacaacgcgcgattagaatgaagctgattcagtacttcggcacggccctctgcgttgtcatcctaagctgcgtcaccaacattataccaggtacaataaaaagggacaggagcggggtggttgaaggcaatgcaacgtaaattggagccgatttatagacatttagttttgtgcgcgccggtttcccattttaattcatg

SEQ ID NO: 5750 - DNA, 700 bp, Nannochloropsis_gaditana
accccacgacaacagcaacagcaacagcagcagtcaccgcaaaagcagctacagccaccacagcagcagattcagcaaccaccccatgtcccggcgccgacatcgcggtctgcaccccaaccagggctacagcctccgcagctacccccaccgtcaccccccggacaacccgcgcatcagcctccacctttaccaccccaggaatcttccaaaaagacctcacaagtcaagagggaagtagaggcagggtcaacagcaaagtcagcaagcgagtctcagtcatcaagtcaaccatctcccactgcccctaccgtgagccagctaccctccgctcccgcgacgaccaagctccctcaaggacatggcggacccatgcatggcgatgccaaagaagcgacgtttccgaacgctacagcttcgagcgtggacagtggaaactccaccgctccgaccttgacttcaccacctggctcggtaccagtcgagagcaaggcatcatccaccggcacgaccacgaccccttcagggccaccttcccccccacccccacctccaaaggctcgagtagaacgagtcagctatgtgccgcctccgcgccctgcatacgcgagagtcttgggcggcatgcacgagcgaccagggcttctttctaaagtcgattcctatgtggtcaaagttagctctgcgcctagtgatgcgg

SEQ ID NO: 5751 - DNA, 700 bp, Nannochloropsis_gaditana
gagttgtccgtaggttagctgccgttgcttcctcgcgggacatcctcactcacctcttcattattatcgaccctggtcgcaaaaattgtgttcaaaccttcgattacgcgctatcatagcatgaacaaagatgatatccatcatttttttcatgcatgggatagttggggacgctttgggtcgcatgcaaaggaatgggtgctccatcatgatgcctgaggcacgctggcgacggcgaaaggcgccttttgttcttcactccgtataagaagtgcttaatactacactcagtggtcatttccttcccgaaaatacaactttgcataaaatgacagatttcctgggatctggcagggtcttgagcttgaaatcggcaatacatcgcgggcgactagtattcatagcgcggaggaggactgccgcgagagggcgtctctctctgtctgatgtaccgaccacattgaggaaaaattagagtgatattgcccctaaattgcttcaggaaggtgttgacgagtaaggtaagacatcgggaaagtgccgtccagttatctggaagctgttcgatatgtatgtcaaaaaagggaccgtccctgtcgaaagtggctgcccggaactgttcaccgacattttgcaaccttctagattcaaatagcccttttcatccccacgcccctcctgtagagttccagaaatcatg

SEQ ID NO: 5752 - DNA, 700 bp, Nannochloropsis_gaditana
tggcgctagtcgtctcgtccaagtcgtcaaaatcatcgtcgaaatcatccatggctgagcgagcctcgtgatcacaacctaacaaaagaccggtggctaacacggcctgaatgcaagcgcaggttccgtgcttgttctcctgtttttcctgagaagtcgttaaaaaaatcaaacgtagaacggtcagtagaagtcgtctcagcaagtgcgctgaagaagcgaggaagaagggtgtgcctcgacttgctcgttggagccaatggaccgtcagactaaaaatacagaggagcaacggtcacacacgtagttggcagtctgtagatatgtcagccagggtatacttgggtcattacgcactactgttcacgtagtacaaacatatacatacgttgcccaaatgcttgtggctcccgccaggaggcccaactctcttctacttgttgcgattcaggctcggaaacaacccatgtaaggtcttggctcacacgaacacgtgtacagtgtacatattataattttataaccatattgggagaaatgtttcctgcgaccgggaaggaagagggtgttttgatgtcttgagggaaaagggagtcatgcctgcccttaggacgacgcactatacgacctcccccccccctttgctgctttttgcggcgggctgtttacacgctattcctcatctacccaaatagagatg

SEQ ID NO: 5753 - DNA, 700 bp, Nannochloropsis_gaditana
attaacgtacctcccacgactttgccttttttgttacggatgggcttccctccccggtacatttggagacgattgatggtagcgcggtctcgcagcttcccgcctttgtgttttacatctgaagctttgcggttcgggttgtcgctgcttttggaggagctcaaagagcttcctttcggcttccccatggttgaatggataggagcgaggacgggaggttgactcggccggggctagcacaagcttggaagtaaagctgccgacaaccgcgtgccacctggtcaggaatcatgagcgtgaattgagtacgaagacgtgagtctagctcgggtcgacgcgaatgactgttgcgacgaaggcgttggacacgacttcagcctgtaggacgcgcttcttgcagtctccagcacaaccggcaccgttcctcgccgtctctctcgctcgactgcggcgtaaaattttgacgaagtccgcgcccgaattcatgcatagcccacacacagacagtggccattaggtgcatcatcgtggatttttgtaaaacgagtggacgcgcgccattgttttgaaaatatgccgcctacacgccttctcggcttcctcgccgtctggttcatttctgcgaacacagcgcctgcatttcacggaccacgaccgctgctgtcagcgtcactttaccgttcattcttacgtgtcaatg

SEQ ID NO: 5754 - DNA, 700 bp, Nannochloropsis_gaditana
ttgaaaaagttaattcatgttgctgagggagcaactggccatggcagagcgtggaaaccttctgagattcgacctatatcaagcatgccgctcagtcggccgcgcgtcaaatctttgcaggtcgctttcacatcgtcatccctgtcgctcatgcaagagcttgttccggccgtgcagtgccttttgttaaaaggtgaccgagccagagggtttggaatgttcctgtccacgtcgaccccagctcgttcccgatccacccactctgggcaaaacccttttaattcccgtccacttaccgggcaaactggcgcacggtgttagcaatcatggtcgaggaaatgttgaggctgtgaacgaagtccgttggacgaataaatggtaatttatgagcaagaggaaagcgaggggtacactttgtctttgcaggggactcagggcgagggggcgcgcgagagttgcgaaatggcgtcgccggataccacaaaaagagcttttgcgcgcagtgccatcgcaagaacatggcttgttaaaggtgatagtcggattgcgtgtctgattgttgttattttttcttaccacagtcggtgacggcagctggttggtacgcggctgcgtgcgaatgggtgggtaaggagggatcgacgacctcctctacacacaggcaggggaacgcagctcagaaggcttcaacaccgtgatg

SEQ ID NO: 5755 - DNA, 700 bp, Nannochloropsis_gaditana
tttcctctcttttttacctccttggaggaagaaatagctctcggcagagatgacacgcatgttgacaaataaaaaagttaaatcactcagtcaatcacgcgtagccttgggttgacgacagtgaatatgttgtgcgttttattttcagcccttttacgcggagacttttaagagttaagagaaaatttacatggcacatgacgctttgtgggtgctcgtatcgatactactactagtcgagaagcgctttccccttgtcagggtgacgaccatcacgcctagacaaaaaacagcagcacatgaaacccataaaattaggccttttctcacatacgccccacaattggaagcctgcgtgcatgggcgtaatcttttttctgctttcgtgcgttccaaaatgtatgccgtccgccctttttgagggcctccttggatcgccgtccaggaaggcggcgacgaggaagacaccccgtcgtcattttctgaccgaaacgagagttagacaagagggagcggccaaagccggcctctcacttgagcacgaacgcattggtctcattctcgacgaatcccacacacaaaggctgccgtatgtgtatatgaccgcgacttggcagacgggcagctggagtcctggaaactgttggtgccttgagctgtgatcgcttttcgtccagttctgtgacccacttccagcatg

SEQ ID NO: 5756 - DNA, 700 bp, Nannochloropsis_gaditana
gcagcatcttgaaaacgtcgctggcttgggtaattgcattgtattttttgaaatgcctgctcgggcgtgcccaagcgctggggtaggttggccgacctgtcctttgtcgtgattatagattttcacatcgatgcgctcgtggtcgcgatgggtgaagcatttattatgccggacaggagatggactgcgactcgtgcttatgctgaccacaatcttatccttgtcatcccttgcgtcatggcggcgttggcagtgagcttgttctatttcgttgtagatgggccaacgtcgaagccgtgttggggacggcttccggacagtgtagacgtgaaaaggctggtcgggcatggcaagcaagtctgttacactagcttctgttgacaagtgggaaggaacattttagatcgatgaaaatggaccggacgaaaaaaggaaaaaggacgtgaaagcacgtaacgggcggcactgggtgagaccgtaaatttgaaaaaatgaaggccccgggctggtcatcatcatgcctttgtttcgaaattctgcctcgtcttttcctccagcttggtgcgcgcatataatgcatacatgttttcatgtcaaaaagctgtttatatctacacaggtttcagcaaattatattcgaggaacggtctctagcagctctcagcttgaatggtagcatcaccgtggtttcacagacatg

SEQ ID NO: 5757 - DNA, 700 bp, Nannochloropsis_gaditana
ttggctggaacaccgacagacattacaatgagcagatccttgcttggattcagcccagaaaaatgcagccagcaactgcatgctataccaagagcgcctaccaagcatgataaagagcaaattggcttccgaaagacccactccatcatcgcgttgactcgtgggcgctatcgttgggaggttgtttacgaacatcttcgccaagaccgaccttgcgcgtgaccgcgatgcaccgagacattcgtatggaattgtacacgtacccgtaatcgtcaagagcgtgcagtctctcttgcatgcgcctattgtttgcgaccttcaagaaaatgtggttttggattgaaggaggacggacaacttattttattgtccctgtccgatttcgacttcggaaactcgttcacgtgcagctcaaaaccgttactgttgactttctgacaagcaactgggtatgacaaggaaaaattctccaagttgaaaaccttttcagacaatgtcctgcgcacttgaggcaaatgtcacggctcgagacacttctgtccatatgcgtgccttcattctttatgcatccgtgtgtaaaatgcgtatcgctggcgggcgtccatgctggttgttgcagcagttgttccatgcacgacatatatccaacacagaaacacgtttactcgtccacgtccatcaaatatccccgcgctccatg

SEQ ID NO: 5758 - DNA, 700 bp, Nannochloropsis_gaditana
cagtggccgtaccggtgcaaatgaaggtattaaatgtaagattgacatattgaggcagcttttcggtgcaatcagcgcaccgcttgtttccgggaagtttgctcaagtctttgactgctctaagcaagcgctcctcctttcgtttgtccagcccggtcattaagcaggccgtgtacttcccttgcgccctagagagtacgtcccgatttcgtggcctgtgtgttgcgaaaagcaatggaaggtttccaattaaagaacttcaattatgacggtcctgcagatgacgacatgcgtctctacccgcctgggccggaccacatgcctttcctttgcttgactccgcgcagcccaagcagtttccgtgcagtatcaaacgcgttagcttgcagcttcgtgtgtgttgcagaccaaggatgtgcatgacaggcggtattttggtcaagaaaaggggtccgggttagagatagccgggaaagacaacggccagccgcctgtccgacgccggcctcccccccgggcccaggcccgcgattaaatggcatacatttgtcgagtcactaccatgggaccatctatagagtgtgtagtagtggaatgtatggaaaagggtgcgtcgtcatggcgcgagatttcgtttttggttttatcttttgccagcactcaagccgcccgccacacaacactttggcagggcctcatg

SEQ ID NO: 5759 - DNA, 700 bp, Nannochloropsis_gaditana
tcgaaaaaagggacatttaacatcagagaaagaccgtgtttttactcaactcggcctcgataaaggaagctcgccgagagggtatggcggagaaggagacgccgcaagccctcgggcgcttctcacgcactaatccgcttgccttttagtcacagccctttctcaaaccgcgtggtattcctgcgcgttgtatcaaaggctctgttttgccttggctgcattcgcatcaccatcctctcggcttagcgcctgcactcttacccgttgccccggaatcctcgcgtggtacctgcaagacactacttgccgtacaacaccaccacttcaactcaccccctgcataccaggccgctcgcacaggttcacacaaatatcctcacgcattttttcatacgtcagccaacagccgcagcgtgttgcgtccgtgtgaaagctgccgccgccccgctccaccgtatcctctacgaatcgcccctttccttcctcgcgttgcccgcgcgtcttccactttctcctctccacctttttcatcaggcaccacatcaccagagtcgtcgccgctgcggcgtcgcctacagtggtagcggccgcgttgccaaaagcttctcgcaggtccacgtttgtcctccccgtgtcacaggcgcttgcctcagtgcgcacggaaacgccttcgcgggaattgcgcagcccttttacaatg

SEQ ID NO: 5760 - DNA, 700 bp, Nannochloropsis_gaditana
tctctttgctcttatcaatgggacagctccttccacagcatgctacacactttttgctcccctcgacagtgcgttctcggatgcggtcaacgcggctacttgtcccaaaggcgatcatgagtctgcaacagcaatcatatcttacctgctgtccaaccagacctccccagtaccatacttaaatcaaccctttgccttgccgtttgtgcaagaaaaaaatcgtaaagtgaacgacgcagcgctttacgtgtatagcatcaataaagacgccgtgacacgggaatcgcttgcgcctatactgtacgtaaacaacgccgaggcaaagagttgggaagacctaccggcgtcaccgggcggaagtcactacttggtaacacttgcccgttatttggagccccccccggggaaaggcagtctgtgggatgtgctccaggcccacgagaatttttccactacagccacactaatcggtacgaagctacccgaattccaaagagctttggaagcaagccctgatgtggccggccatacagggtaccacacgatttttgtgccgaccgacgcggcctgggacaaggtgtcagctgaccgactggcgcgtttgcagggggatccacaggctttgcaaacactcttaagctatcatacattatctggcaaccagcccgggggcgattaccctcggtcgaccacgggcatg

SEQ ID NO: 5761 - DNA, 700 bp, Nannochloropsis_gaditana
atctgaaagtagtcggatctgcgagttctcagtactaccctattccttgcttattggatttaactttttactagctatcaaagtttgaaaattttctcttgtaatttttaacgctttctcatagaatactggagaccgcgtttgttcatcgagaagaaaagcgaggtagtctctcacagccccatgagcaaccgcatggtttgaaaatcgagatgtgaaaggttagaaaagcatcctccatctacattctttcagaacttaatgccacagcgaaatcgccactcaaaagtaattcctcccccaagcgggccttcgccagcgaaacaacggtatcacgtgggacgcgaaaagtgagctccacatttaattgttgctcagtgctcgtcgacaagcgcatccaaagagattcacataagtgacagattccaaacgcttgagcggtacaagtattttgctgcgatggcgaataaatagggaaaggaaggcgagtacaagtcgcagaagttcccgagtgtccggaatcggaatccactttgtccgtcagtcgccggacgaggctcgctccttgatggcgacgtgtcgcattacttgcgctcgccaggtcttgcagcgcagaacagaaatacaagtgagagtgctcttcttggactcacctgcgtgatcacggatatctttagacatctcaatcgccaagggtatg

SEQ ID NO: 5762 - DNA, 700 bp, Nannochloropsis_gaditana
tactctgcgtgcccaagtcgccaacgacggaaaatacttcgtccccacaatacatcaaggcgctgccagtttcaggaagtattgaaagaagctgtgggaggaaagtgagaaagtgcatgtttatgttttaatgtagtgtaccttccccgaattgtttctcgtcgctttgcttctgtcatattcatcgctttgagaacggcttactttctaataggatacatgatagaaatgaagtctaaggctgtcaagtatactcgctctttcccaacgctgaatttatttgggcagcatgaatagagggaaaagcatgtgtccacatggggtacatttgggacagtatgatcctaacccttcttgctttccagcaaactggcaggcattgacaccccctgttgaaagtaacttaaaatgccaacggtgagtttacatctttgtaaaatcgttatgattatgtcggtcatggatgcataagcaactttgactggttgcctttaatttcggtgcaccgtcttggaccgcgtagcctcgcggccttactcgcgcgctctcagtcctcgccaaaatgtgctctgtgacaagagaggtcatcggcaacggtgtggggcctggccaatgtaaccttgtcaacaaaccacgaacacaaatcaggaggtaaggggccactgagcttttcgcaagcagcagtgcgcgccaagccatg

SEQ ID NO: 5763 - DNA, 700 bp, Nannochloropsis_gaditana
gtatgtcgacgctactcgagagcgagacttcctaacgcaatccgggctcggggttgtaacgcaaggtgacgtctcaacggactcgcccatggcctttgcaaagagcctgggacagcatagaatgacataacaattacagccatacactacacgcattatgcgtatctatcagcaagaatggtcgatccgaatcccaacatcgagggcaatggcaaactcttgtagaccaaacggaaggctcgtacgcgacacccacactgcaaaaaatgcacctcttgccatttagtactcctctatattgcaatgaagcgttcgagaatgaaatggcgtgtaggtaatcgtgtttgtgtgcatgtgtgtcttccatgaatttggttttcaatccagggtggtagaagtgtgtaattcgccgatgtgagaaatgcgtcatatttcgaatgacaggtaataacacacacggcggacacattacccctcgtattaaatgctcatatctttgcgaataatcaggttttactcagggcaaacaagtgtaacgcacaggaaagagacttgttccaagctgggtggtagcagaaggaggtcggtagcagcagagctctacattcttacgtcaagtgatatttaaatagcggtatacaagcgtccttgtctatattttttatgaatatatgatgttcctactttggcaaatgcaatg

SEQ ID NO: 5764 - DNA, 700 bp, Nannochloropsis_gaditana
aatacatgaatttttgttttgaagacaccactatgtaggaaactgcttttgaccaggttcgtctctttttctactaaaaaaggcgcaccatagagcaaagcccaagtcatttacacgctcttctaaaccactgctatccacttgtggccacgcacttttgttcacggcttgaaaagtaacttcctatctatcatgaggggaggttagagaagccgagaccgcatatgaataaaatatccattgagaagaagccagcatttgggtgcatagtgaatgtaggacacccttgaggaatggtggtagaccggagtcaggcgaacccctctgtcacgctagagtgtgcgaggggcggggtccaaggcacctcttggcgggtcggctttcgcgccaaggtttggaaacttggacggcgaggtgcgtgcaagcacagagcgaggagcacagacattagggaagatatcggggtcttgtctcctgtgattctcccgatggccgactcagatgtagtcaggctcgcataaattgggtaacaggttgtttcgcgcagactttggctgctaaatacgatgtcgttgtagatcttgccttcactgtccttgcctgagctcgtagacgcgtcgcgcatcatcttaagagggttaatacaagaaaatgtccccacaggaagccgcaatccttttcattggaccaaaatattatg

SEQ ID NO: 5765 - DNA, 29 bp, Nannochloropsis_gaditana
ccgacatctccatttcccgcaaagtcatg

SEQ ID NO: 5766 - DNA, 700 bp, Nannochloropsis_gaditana
tgcacaccaaaaagaatgcccaggatccgtgatgtgacgggaagtaacgaaccgcccaccttaacccgtgtgcaatgatcgcagatggtgacaagcgctaaggggtgcaaggcgacgtgacgtccgctcttattgcctgcctcttcctcaagcaccacgctcctctcctcttgagcggcagcggtgggagcgtttaggccagagccccctgtcgtgctagtattcccactttcttctgtctcccctacttccatcgccgttgcctccgtcgaagaagacatgatgagcccgtgatgctcgagtggatcctgtcagggcagacacgtgcgcttatcaaatgaaagagcacttcgtgaacaaaacaaagcaccgcacccttctgacgtacagctcagaagttgtcaagtccaggggcgaaccccgccggcgagaaagtgacttacaccgattcgggcacctctcctactagttagtaaccccttccgcgtcgctcaagcgagagcgcgaattcagcgacctacgtgggagagatggtattggggaatataatacaggcatgagaaaatgattatgcttgattcgtggcttagtgctgtagagcgtccgcactcgacttttggcatttctgtgctcttgctggacacactgcatgcactaacctcccgccctctttttcatcatcacaaagcccgtgcgcatg

SEQ ID NO: 5767 - DNA, 700 bp, Nannochloropsis_gaditana
acttcttgctaccgcgcatgccaaaagtacctctaacgtcgaaatatttctgtccacggatatttaaaaacataaattcagaatgtgtgagaggactcttgaaatttaggctccgtgatatacctatacaggctcaagcggacgagtcatgataccaaattttcttttcaaaatccacaattttgactacttttcgtaccctctatcatgatccttttacacatgaacgcatggcgaaaagcaataggaagagcaccgtcgcaaatcaccgtgtttccgccgtgcgaccggaccccccgtctgaagaggaaagggaagactgtcgaaagcctgtgcgactggcggcgtcccacccccggccccgccctcctccctttcaagctactgaccacgcggtgccaggaaaaggacgcaggcgccttccccagtggacactagcagacgaaccaacaattctgcgggatgaaaaacaattcgaaaagcggccgcggactggaaaaatctgcccgggccgggttttcctcaggcctcgcccccgacctcgccgtctcgagtgagactcccagtccgagacatgccctcccaggaggagggcggaccgggcacaggcacggtccggtcatggcccggttgcttgacataggtgttccatgcatgactttctggacgacctgctcatgatgcgcgtacctttcctagg

SEQ ID NO: 5768 - DNA, 700 bp, Nannochloropsis_gaditana
tcaaacttgctgcagcgggccttcaacgccgttgtggctgatctgcgtgccagccccgcccccccccccccgagaaccctggccgtgttgcgccgcgtgatcggctccttcgtggcgctgggcacgaccctggagccctcgcaccctgtgggcttctacaaagagcaacttgaggaccatgtcttgagggaagtctacctgcactacgtgtacaaggccgggctttttgcggcggaggtgtcagcggggcatgcagacgaagctgctgtggcaaagtacatccgaacggtcgagggctgcgtggccgcggaaaaggcaatttgggagcccgtctacccctctacctcgcgaggggctgtgcgtgtggtccgaaagtcgatgctggagagccagccgcaccatcaaatccttatggccttcgccaacgccgcactcgccttccatgcagagcggctcgcagacttggaactgctgtatcggctcctggacaacgaggacgtggagcctacgaaaggcatcgaggcactccgcaacatcttcttcggtttcgtcaaggaggtgggggcgtcgggaggtgaagcgcgcgaacgaggaggcccgtcatcggcaatcatcgccgctgaggcctgacatgtcgcacatgctcgctcgctcctcactcccccccgactacgtgtgctcggacacgatccagacgatg

SEQ ID NO: 5769 - DNA, 700 bp, Nannochloropsis_gaditana
agcatgagagccaggagccccggacgcatgaaagacacccgcgcagtccaaagacgggcgtgcggggcgcactcttgtccacgcaggtctcccatcgcccccgggcgcctgggatggaaaagccaagtcgccgcccgggtgcaactagcgaactgcgcatgtccgctcttgcatggacaagcacgggttctggcactagctgacagtgcatcggcagcgtcctgttctgaatcgcagtgtccgagtggcaagaagggcgtcatgggctcaatatctttggctcgtagcctctgagaggacggacctaggagagggatggcgtgggacagagcccttcctccaggggcgtctttttcttggcaagtgaagtccacaatcccgatcccccgtacatccgcgctatttgattatgcctcacgttgttcatgggcgaggccatcgtcactatcatgactaaatgctcaagaaaggagacgaagcgcgtgcgtcctcgtgacggagctcagcattgatgggtcgtgtctggcgagggactttccatgggcacatgtcttgcctggccgcgtctttaatgctccacagttgtaatgattgattccacgcgcgaaactatgctatcattgtcctcctttcggggagcgtgcggaatggaaaaggatgctcatatttctcggtctaacactgtattctaaattttagg

SEQ ID NO: 5770 - DNA, 700 bp, Nannochloropsis_gaditana
tctttccctgccatcccttgcccctggctcgactttataaagcttacctgcaacagcaggaatgacagcgagggccacaagaatgcgtcggccacccatcctgaacttgtgtgggttatcaaaatggttgatggtcggttagaaggacgccgtaacaagggcaactaggagggtaaagtgccagggtagatacacttgcgtgtccattccagtagggccgggcgacagcgagctacaagcagaatgtctgaggaaaaaaaaaacacagccgcggggacgccctgcctctctctgtaacgaattgggcaaagagacatacgtgtatcataccacaacaccttcgtacttgggtatccatcctttaaggtggtgttgccagggcaaggggaaggacacgggcgagtgggtggccaggagcggttttccacacaaagtatatattcgcatttttcggacacatacacgtaaactacctttttgacctcctgccccggacctgcccttgccgtgcaagccttccctggcttcttttttcttggtcgctatgctgcttattatgagttggcttattgataaacgtggtgtgtcctttatttgcttcgtaccctacgtagcgggaatacttccactcaacaccgcaatctggtgtcgacaattgctaacggcacatgcaacgtattatacccacatataatgtaca

SEQ ID NO: 5771 - DNA, 700 bp, Nannochloropsis_gaditana
gggatcaccacgctttacgaaaaggcattcagggactacggatatgttaaaaaaacgcgcgcccgatggaagctgccgatgaaagaaacaatacggaggtatggaacccgtacgtcgttcactttctgcgggtattctacgagatttaattatctaacaaaaactttatttgaaacgaggataagcaggtccgaggaaagcccacgacacaccagctggcacacaatcaaattatgagatttaatttcaagcattgattgagtctccatggtagtcacccgcatgttcgtggaaaatatcgaggtgcgtgtcatcacgttcaggaaggctcaggaacttccaagccggcttccgagctagcctacccggaggaaggaggcggacgttagcacttgtagttgccttaaacgcacaacacgggcaggatgcaatgtggtacactgcacgagcaagagtagtctagaagtgcgtagacaaatacttcgggtggcaggttcatgagatttttgtggacgaggcaatcaaaaagaggcctctggggtgcaagtgcgagccagagagcagaggaaagcagcgacgtgggcgagtgaaacgacgcacacgccacattttattctttcacacagtttgtcgtcacgtttacattcattcttcctctgtttgttccacttttacccactgaacagataggcttagtatg

SEQ ID NO: 5772 - DNA, 700 bp, Nannochloropsis_gaditana
tgatttgattcgattgacccagtcatcggacctgagcaaagaggatcgtcaaagggtgatggtatgcatcacaatggatgcccactcccgggacatcgtagaaatgctgtgtcgtgagcagatcagtgacgttaattctttcaaatggcagacccaactcaaacacaaataccgtcagccacctctccacgcgtctttccaaacgcgagatcgacatttacgaggcgagattcacaacgagcgtgcggaggtagcaatttgcgatgcagttcttccgtacgactatgaatatcttggcaacggtcctcgacttgtaatcacagccctgacggatcgtatttatgtcactgccactcaggcactaaatctcaaaatgggctgcgctcccgcgggccccgcaggcaccggcaagacagagacgacaaaggatttggccaatgctttagcgaaatgttgctatgtgtttaattgctcccctgagatggactacatggggctcggtaacatattcaaaggcttagcatcttcaggtgcatggggatgttttgatgaattcaatcgtctagttccagaggtcctttctgtttgctctgttcagtttaagtctatctgtgatggtatcaaagcagacacttccagaattatgattgaaggtgatgagatcagacttgatccgacttgcggcgccttcattactatg

SEQ ID NO: 5773 - DNA, 700 bp, Nannochloropsis_gaditana
actaccaaggcaatgcggagaataccgggccggacgttgagaggtgtgccgcgaatgtggcgagtcatgacgaacgaaattcaggccctatggaggaaaaggaaaaagacttttgtcagagaaatcgactactggattattgaaacatgcacaatgggctctctgagatctcttttctacagttggatgcattaatggtgtttgcaagtgggtttaagtgataactcgcagtcaaccagcatccatacaccatcaaaaaattgcgcgaaaggaaaatcggaaggcaggcgagatggcccatatattgttcttttttttttcactttttggagccactctgttccacacgcaagcaatatggaacgattttcttctgaataaagcaattcatttcaatttcatgacagaaaggatctggacaaaatatcccaaattctaataaaccacttatccaaaaaagttgtgcccggcaagtagggatttcaggttgtcttatttctgcttccggcaccattccacaacagccatggtacgtccgatttgctttccaaatacacatttgaagttattcgtctcaaatactttctctatttccgagcagcagcgacccgcggaagtggaatggtcacagccgcgttgcattggtgacctaccaacaaagaggtctggccattctcttacgatagtcaagagtggaatg

SEQ ID NO: 5774 - DNA, 700 bp, Nannochloropsis_gaditana
gattgagaggagtatattatggtggaagaatatatatgggaggtattgttggtttttaatctttataagatttgtctttttagtatgaaagcgctgttgtgcaaacatctctgttcacattgcgttctaggaagtctttcctgacttcaaaagtcctttcccggaacaatgacggaaaatcggagtctcgcacgcaagaaacgaagtgaagatactttatggcagaccgtactacccctttaaatcaacaaaatgaatgaacgttgtgatcaaatacatgaatatctacgtgtcttaatctctattcaacagttgatcgttcgcttcgtgttctattatcttgtcaaaatccctttgttttgggtggtacatgattacctcgcccaccctccactcactggcactcgtttctcgaccgtcgagtatcccgcccttggtttatgctcggggtatcataaaaacaaaagcttaaacattaccttcttaagttcattccatatggctggcgttttggtccgattgaggtccttgtcgacatgtttctcgtctctggcggccctattatttcagttacttgaacatttccgcatgccgggtgttgagctgtattcgtcatcttatcacactcatgttttttaaaacggtacaccatccttctcctgcctcaggttcttcaccgcattcacgaagtacgaccatg

SEQ ID NO: 5775 - DNA, 700 bp, Nannochloropsis_gaditana
tcatcgttacaaatagtaccgtgatttttctcacaagtgcttcgagcgtcaaaagaagacgagttgcgaattatttatgttcgtgtgtggggtaaagcttaatttctcgcacaaaaagggcaactttcaattcagtgtatccccaaggggaaattaggcatgaatacgaccctatttagtccagtaccttttaagtgggttgaacaaaagcaagacttgtgtgcgcgaacggccacagcttgatggcgtcaggatttcagtttgaatctgcaaccgtcgggggacgaataacacttcattcccgccctccgcctcgtgagtggcgagtcgtcagggtggacgtgtcggaggtacctcttttcttttctgtctgtccccccttaggccccgcctccgtccctccaagttccactctgcatctgcatactcaaaacttgatgatgagtgccgtgcggtatttctttttgtccatgaccaaggagggctcttctgacatgaagcaaccggagacgaggctccttcagtgatctctctattgctacccattgaaagattcctcgtcagcctcttaatgtgtatagagtagtgtaggaggcatgaaaactgactgtaaaattaatggtggcgccctcgaattatgctctgagtctgacgtgctcatatcacgccattatccaacacagctttaactccagcaatg

SEQ ID NO: 5776 - DNA, 700 bp, Nannochloropsis_gaditana
ccttaattccaggtacggagagtgaccatccatacccatgcgacatccatcccaaaatacctcaaaccacatacgccaattctgaaaactgctggcatttctcagaaactcttggccaaggtaacgtcagcacgtctccgcgcaaacgtcagcaggcctccgcgctcatgtccgtgcgggtgcccacgtcagccttttcagcgatccgaagaccacgtcgtccacacgaccacgtcgcctcggaggttgggaggtaaggactggaaaagcacacgttgcgaacgcgcgcgtgggagccccggggggatggccatgcgtcgataactccacacacgaggcatgatgaatgactggaggcggggacgtgggggggcctctcgatcgacccaactctgaaactccgaccggggggaggttgcaacgtcagccgctgactcgcccaccgcctgccccagcgtgttttccgtcgcgacacgtcgagcgggacccttgcttgggtttgggtttttggtcgctgtgcttctgttctatctacatgtagtttacatcctgatcaacgtaataaaccatctgaacagatcaaagccgcatctacacacgaagtaggtggatttgtttcgtgagacacgtatcgttattcgccgccacatttttctgaagtaggtggatactttgcctcgttttaccaaagctaagcatg

SEQ ID NO: 5777 - DNA, 700 bp, Nannochloropsis_gaditana
tggtcacgtcatgacccgcgaagccgccgtacaccccatcggggccgtaaaaatctcgcgctgatgagacatcgtacacgtctccctgcaatgccacatagattggatcgtcttcttttgttcctgtaaattctcgaagttgcgtggccgtaaaattgcgcgggggctcaggctcctcgtcgggagcctttcccccgggcccttttggtaagggggggtcttttgtcacccagtagaaaacagtgaccgtcacagccaccgtcgctgctagcatagccgctgctgtcttatcttgacgaaaagcctccagagtttgtaaaaagctctcgaacattttttatagggaactaaccaagattataacctgcatgaaaagtgagaaggggagttttcctgactttttgtcgattgtggagtccttcagccttctctataagaaccctccatgctaggtatccgtgctcagtagtagctgcttcaggtatacatgctccggtaccaatgacaccgcttggccccttgtcaccacaatcacgtgatatgtgctcgattgctcctagtttctcacgccggtgcccctccgcctccgtcctttcccagggcttttggcgaggcaccggatcgagcaaagtgaaggaagtgatctaccctaaaaagaattattacggctttctttgggcacataggagcacttaaaatg

SEQ ID NO: 5778 - DNA, 700 bp, Nannochloropsis_gaditana
tttttaagagcccgggcttcatgcagatcattgtggatgcaaagcttatgctggtcagcgcagcgtctgaatgcttcagcagggaggaggttggttggagcgtttaagcttccatcaaatgtttaacttagccatgatataccaggactttcgcattaccaccaggctcggagaaagacgtcttttttatgcaaacgattggcagaacctgtgagactcttcgaaaaaccctcgagaggaaactgccagtgaaagcaagcgattttagcgactgggttctcactagccccgcatctactctcataacctttccccaaatgtttcacagtgtcttgtccccggagaacgaaattacagaagattttggcagcgttattacgcctattgaaagtcaaagtcgtccgaaatggtattgtgggctgtcgaaaataggctggggctgatatataccaagtaatcaaattaaaactttttttggtatatacattattcatacgtggaatagtatgaagtccagttatatccatttcatatctttttcacgccttcaaaatatgcaaaggcgagtgtcgccgcgaaacagggtagccgtcctcgttggctgtacttgttcgacctggacggcactctttactccaacgaaaatggttaccgcgacaacatcctcaaaaacctatgggaatacatgcacgagcatatg

SEQ ID NO: 5779 - DNA, 700 bp, Nannochloropsis_gaditana
aacgcgacgaatatggatttggcagaagctaggacgagtgcgagagcagaagcctgagtcgacgcccgaggctgccgtagcgcccttctcacaagcttggctccacacaccgcgcgtaagaccggccgtgcagacgtcccgtctttaagaagttaaggcaaattatgaagaagaagggactgtgagaactcctagacacccacgctcacttagtggtaatcggccttgacgggctcggtcagaaaagcttttttgcaggaagaggcgacttcatccatgtacacaaagcatgcgtgtaaagagccgttgatcacaacatgtatttgataaagaggagacgatgctgctgcctttaagccgagcatgtgcaacgccgtcaggcatttggcacttgttggtctatatcctctggcacgccgaggggacgccggggggctcgagatcagcatcgctgtgcttcactactcgcccctttcactgacttcctgcgcaattcgaggttcaaggcctacctgcaagcacacaagtggccttcacacttccttttacactagattcttgtgacagacagttttttggttggagcgactggtcgcctgcgcctaggatatttttctgacctcccccagtcgtagcgcacatgcaatcgcataatgtcgtctctttatctacagttgttgcaggcaccttatcaaacatg

SEQ ID NO: 5780 - DNA, 700 bp, Nannochloropsis_gaditana
ctagcgcggtaggaaaggagcaagagcacgtgcagctcgtgcctgccaaagtggcggaggtcgtgccggggggcgtgggcgacagggtctgcttggacctggtgcagcttctcaaggtcggggaaggctgtcttgtgggttcgtcggccaagggactgatcctggtgcaagccgaggtcctggcgaccacctacataaaccctcggcccttccggatcaacgccgggcccgtgcactcctacgtgttgatggaggatgggagcgccaagtacctgtccgagatcgaagcgggagaccgagtcagagtggtcagtgcggacgggcactcacggggagtgacggtgggccgctgcaagattgaaagccgaccgctcttgaaggtgtcgtttcaatggccggctgggggcgagggcgggaacgagggagggacgcgaacagcgcagatctttttgcagcaggcagagacagtctgtctggtgcgcgggacggcggaggggggcggttgcacgagcgtgacgaggctgcgggcaggagacatggtggtggtgagggcgcggagccaggggactcacctgggaaacgccataaaggctcatgtggaggagaaatgacatatttaggatatttgaacgaacagaaggggggggggggagcaatagtacataatgagatagttctacagtcctgagacgcgacgcgt

SEQ ID NO: 5781 - DNA, 700 bp, Nannochloropsis_gaditana
agaggtgcgcagcttggtttggtgggagcgaaaggggaggtcgggatggaggttgtggagcgcggcggctgtggctgcgacccaggaaacgatcggacgacgtagggacaaagaaaagcaagtaaaatgatgcatgcatcggttttgaccgttgccatgctcctgtggcggtgtgtaggagtgagacatggggtgaggggcggtctttgccggcgaaaaaccaggtcacgagacgtatgtgccggggctgtcctaaccctccctccccatcaccctgcgtcctccccgtgtaaaccctgtgcatgcctgacactacgcgcttctcgccgcttacgaccacctaaacgctatgcaccgagtgtttgaatgggcctgcgcactgacgtgtcccagagggcaaggaaatggcatggacgttgtcaggcacgtggaaaggccgccaggggggcttctttttccgccccccgccccctcgtcccccgggacctcgctagcccaacggaatgcaaccgagccctttccacccaccctcattcgttccttgccccgttccatgctttgacacagctgcacgactattttctatcgacatcgccaagaaagatcctattccttcgcaccgcgtggttgacgccagcactttgccacccaaacctgtgaatcaatatcaaaattgctctcccccccccaaagtacgatg

SEQ ID NO: 5782 - DNA, 700 bp, Nannochloropsis_gaditana
ttcgtacgtgcaacaaaattttaaggttccttcgaaacggggtcatcgcctcactgttcccgatcatgtcgctagtagatggtccgttccgccctttcccgcgtccaacaaggaactcacccgtattctggaggcctccgattcaatcacaggctctgctcggatcttaatgccaccccgccttgccaataatcgtgatatcgaggcggggtccatggtggaggcggcgtaggaggagggagggtgggaggcggcgggaagagggggaagatcactgattccaagtgcccttcccgcgagaacacctgccaagagaaaggccacggccacacggccggtccccatgatgcgtctctgcagccacctgactacagagagtacctgaacgtgtgtgggatgcgatgagtggggcgacacgtcgcggcgcgtagcaacagaagcgaaggtcctgtctcgaggcgggcaaatcgctggcatcgtgtttccctttcttgagagagacggcggtgccgcctctttttggaaggccgaattgccagggcacatttctgaccatgtttcatttatcaacactgcagcacgcttcatgctgaggagactgaccgcatgccgcccctcttgaatggctcggaggaactcttcgtgcaaaggcaccggacgtgacaaattgcgctagcgggggggaggttgctgcgatatg

SEQ ID NO: 5783 - DNA, 700 bp, Nannochloropsis_gaditana
cccgacggtaatgcgagcgtgccgccgagaaacgctagggtctcccgtcgccatgatatcgcaatctcgacgacccaccaggaattcacccgcgaccaggtggtaggtacctttcttcctccgcgagcccgtctgggtgctaccctgtgtctccaccccggcaatcgagtggttttgagtatccgcgccgggcactggcaagaattccaggacccacatggcctgtttcgagaagaaagtaacaacattgtgtgaatcggttgtcaagaaagagttgtcgggagcgcgaaaaccttgcggctgcgtgcctgtcatggaacaaagccctcgtcgccccgggtcgcctcttggggcccgtgcggcgctctcgagtaccagaaacgtccgcgatagtggggttatgctaagacgctggaccagtccccatcaattaggctgtcgcattcaaacgaaggtatttcacgcctggtgtcttgtgcttacgtgccggcccctgtctgatcgctcttggcggcgatacccacctgagagggaggcctcacattgtctgctcccaggctcgagaacctctgtcagcttccacaccacagcggaaatacaactttcaaacctcaaccctcacagacattcagggatcagtatgcatgggtttttcgaaccaagctaaggcaagaggtccgtacaacaacatcgcattatg

SEQ ID NO: 5784 - DNA, 700 bp, Nannochloropsis_gaditana
tgagtgggtatgccagcgtcaaaaatggtcaatatttggcctctttccggctcaagcgttacacagtccacctttgcagctggaagtagctcaattgaagcggaaaattgctgccatggcagatgaaatgggaccaaggtgatgaagtgtaccgaatataaatcagtgagataggtaatagaaacgcagtatcgatatgggtcaagtaaagaagctcgactgtgatgcaatgtgtggaacgtatcctgtccctctttcctgcgtttccacacacagaacaggaaaaactatgaaattgtgcttttcgttcgagtcttttaaccacacccactcgcaccaacaccaccaccctaatatctgagtatctatcattgcttcccatgaagtagctagaataacctcctcacccccctctcctattctcgaacgccgcaagccctccgcctaccaaatctgtacaaagcaaatatcatgaaatgtgcacgagccaagctacttctttctgcctcaccctaagatgtatatctgcacaatttaaataggctatcgccggccctttacgattgcttcgagcactgccttgtagtggactgcacagggcaacgcatctcctacgaaacatcgcaccctcatacattcgtagctccttcctctcctgtcccccagagaagtcaaagtttacgtattaccttcttaaatg

SEQ ID NO: 5785 - DNA, 700 bp, Nannochloropsis_gaditana
attggccgcccgggctgaaaccagtatcgcccagcataagctcatgttgaaggactgatggcagccgcaaagggtctttcttcctcatgctgtacgtacgattcgaacacgcacgaaaccaaaaagaatcacagcgcttagaatatcggaagtgagagtcggggctgcgcagcgagttcaaaaatggtcgggaaggtgcttgtcacaatccctaacaacagatgagagattaccaagagattaggtatcaaacgagcgaaagcatgcaccgcatattccgtgatgcacaatgtcacaaaatgccattgagtccttcgacctcaagggggggctgaggaacaatctgtggatacgaaagcagggcggcgcctatgtcttatggcacacgacagcactcgcacacgccatggcacgcgctccccctgcatccctttttttgtcttttatgttttctctgcttgcgcgcaacggcacataagctgtacgcgatcctgatatgtctttcactctcttgtccatctctcaggggcgcttttaaaacctcccttcggccccttcgccttttccacgcacaggcccttcctcttgcgaccatatcgcgccaggtttcatgaatcccttgcatggttttcggagagtcgtagcccttggctcaacaaagcatccagctttgagatgcttgcgctgcttggctagcatg

SEQ ID NO: 5786 - DNA, 700 bp, Nannochloropsis_gaditana
tacttttcaagttgtgaacaaaaattcttgagcacagacggataacagtgtttcgagggatggtgtgaatggcggaggcttttctaaatggtcaaggagtttgaaaggtggtcaagcattccgagtacatttcaagctttcacaattaaaatcaacagcaggcttgtacttttttgcatttcatacctgttggtggtcactggagtcgcagctttttatggaacaacgtaacggctccaaaaaatggcgtcaggctcatattttaaccgtcaatgatggattttataaggggcgctccgaagttattcatcaatacaagggattctaacgagcatttaaccaatcagtcactcatttttaatcttcagaccgtccactagcttttgatatgattgttagatatatgttgaatttgctttcacacgaaatgcgtggtttggtcatgagcacgaagttagatgaggccagtagttcaaaatgcgcgggaaagcgaaaatggacactttgttctccgagccatgtcgtcatggaccgacgcatttccgaatccgccgtgtacatgttaccaaagcctggtattgataagcttagcaacgttaaaagaattcatgtctaccttttcttgctagcactctttgttcaatttgtctccacctcaccgcgtttcttttccgttatttccatgcgatggcgcagcatg

SEQ ID NO: 5787 - DNA, 700 bp, Nannochloropsis_gaditana
tgtgccaacaaccttgtccgcgacgcgatacgagaggggctgccggagctcggtgggagtagggcttattggaggtacttccaaagatgggctggacgacattacgataggcttgggacggaaagcttgcacacacgcgttaaagacaatcactagccatgctagttgctttaagggcacttttgataaatgcattgttgcggaaagtgcagcgcttgtaggaagctgaaggaaggcggattcgcgttgcgcaggaggaagggatctgggaaatgctactgtgaaatggaaacggagaccacagtgggaatcagtccgatgaatgcccaattaggttcatgcgatggaagcactcaagcagaggtggcctcaagaatcaccttgtcatttgaggttctccccgcacgccttgcgagaggggaactctcgcggcgatactggcaagtctgtgcacggcctaccgcgagatcattttgagagggcccccccgcgcatcaccgtcattctgcgcttttttgaagaaaaaagcatgcatgacgccttcggtacactttcttcgtgtcctggctgcatgcattgtccatggctgcggagaacagctactaagcagatctatcttaccctccaccgtacacgctcgcacagcggagcaaaacagctttccccgcccctctgcgagtttttcctgcaagttttaatg

SEQ ID NO: 5788 - DNA, 700 bp, Nannochloropsis_gaditana
ctccatatctacaaccgtatcataattgcttcaaagtgcttgcgatgcttcgtgcacgttcaaagaacatcaagtagcgagtaaacagtaaaacaaattagggtgggggctgttgtttcacggaactttttgctcgcagccgcacatggggagatcctacagtgtttctattacattcacgtaccttttcgccttgttccaacgccatttcaagatgtccactgtgttatacgcctttctttggtgggtgcgggccgtcgggcggtgcagcaacggcagctaatcgagctgtctgtcagtggtttctgatatctgatacgaaacaaaaattatgtcaagaaaactatgcatagccaatttacaaactcagtcgatgaaaaacgtgcacgcgtgcacgcgaccgcaataaccgtgttcctctgtacgcccctgggaagaagaagggcgccgacttcgtttccgcgagtaccttccccttgcccccagggaggttttggcctcgaacgagcggcctccgccgcgcggcccgcgaaaacttgacgtccggattcactcaaacgcacgtttcattcttcgacgtttatttacctggggacagggcacaagctggtcttttttcttcgtcgttacaggcaccaggccaatttgaagccttcggcgacgggctgagtcgcacctacgacggccgaaggaagtcatg

SEQ ID NO: 5789 - DNA, 700 bp, Nannochloropsis_gaditana
tcaccggaagtcgcgcacgatgaacgggaaccttcccgcatgtcataagatggtattttttcgccctcataccacatgatgctgccacatttttggcattgtccatggtacccctaaccctgtacctaatgcaaccccaaacattcaggtagacgatgaaacgcataaaatgattaaggaagaaccgagcgcaggaaaaagcaggaggggggaccaaaataatccagtcacaattgagttggaagctgtggcggcgacggtcgcacaagcccctcctgcttcaacgacagcattagaaaacacttcctcctcgaccaatccgcaaagtacccctcctcctgcggcaatggctccaccccagcgccagtcccttggcaagcttttaattgccacggttgtaaatcttggtgtacaagtagattgggctgtccaggcggctttgctgatgccgtacttgctggtgattggggtgccgtacaagtattattcagtcgtttgtctctgcggccccatttccggattgatcgcacaaccatatatgggcgtggtttcagatcactgccactctcgtttcggtcgtcgacgtcctttcatatttggaagtgtccttttaattgtgttgggattcatgctcatagggaatgccacgtatctgggggcattacttcccgattcagcgtcgcagcgtggaggtgccatg

SEQ ID NO: 5790 - DNA, 700 bp, Nannochloropsis_gaditana
ggcttatcaacttctgagagagcgagatacaacaatacttcgtctttctaagaagtaaatgtcgtgctcaaatggcgcacaaaaagtaagtataacatgtgtagataagaaacccagaatcgcctgaactggttcccaaagtgaaatattgtagacgattactcatatctatttcgggatctttttcttctgttgatttcaccttcttcatgatagtcgcacacataattttctcctttaaaaagactttgcaaattcattcgtgcgtcgagacgtgccattcgatacgaagaaatgtgattctcacgcgagacgcttgaggtggtgaggcccctgtagttcttcccgctcggtcccatgtcacacgttcgagcgagcggcacaaaaagcggaaaggacttgcttagaaatcgatagacgcccgaattcttgatttgaaaatgtatcaaagttcacctgtttgtcggcagaggcaacctcaccatgcccatcgcccaaataagccagcgagcgtgcacagcatcataaaatgatcacagctcagggtgtttgttgacctgttccaactggtgtttcgcgtcacgtgattgggcgaatgtttgtttcttcttacaacactgcacccttattatttccttttcctcacagtcccgctctgacctggatctggccaatgggagggagtgagcagacggccatg

SEQ ID NO: 5791 - DNA, 700 bp, Nannochloropsis_gaditana
tgtaacatcaaatgggaaaaattattaatttcgttagcgtgacagtagggttagtcagagtaacactgttgtgtccaagaagagcgtgaacacggagtagaaggacagcttgtgtagaatgcgtgagaatggaaggcggtaatcgctgcatgaaaattcaccatcgcgcaacgcagatgacgtacgccccaaaaattgcttgagtagcatttgatttatcgtttctgtctgtgacagtcaacgttttgacaggatgactgcaaagctaccagtagaaaaggaggggaggaaacaggcgttttcaggaaaagaaacgcatcataagtagtacagattgtgcaaagaagacttaccatccaacgatgggcattgagaaaattgacactgcaaaaatggaagctgggtgattgatgtcatttaagttccttgaaagccagtggagtgaacgcctgcaccgggaggttaagagctcttgttcgtcattcgttccgcttgtcaaccaacggttcctaaacgctggccctccttccattattcctcaagcacatgccgagcatcagacactgacttcctggacacaaacgcatgtatagtaaaggtgtacaggatcaaagcgggcctcaccgggttgacccgttgccttctgttttcaagtctctactcctgttcatcacacggcgtgctaagctaatttgccatg

SEQ ID NO: 5792 - DNA, 700 bp, Nannochloropsis_gaditana
gggggggagcaacagcggcagtaccagtaactcctacagcaaccttgtcatcagtccgctcccccgggcggccctacggaaatccagcctgtacgagttgcaagctgccttagacgagttgagcagagctctggcagacatggagacgactgcgaagaagcgtgcacgggtgcgtagtcaggcatatttaatcaaatttgaggccgaatacgcggatttggtgcgtgtgaaggaccgcgccatcaagcgcctcgacgccttgctgcgaaggcgaacgggggggcggcagagtaaagaggagggcaaccaccaatacccgtcggaaagcgaggaaaaggagcagcagcggcaggtccagccagagggggccttccctgcggactcgaaacacgcccagctactggcgcacgtgctgatggtagtgatggatttggacgacgaactgttgatgctcatgggggaggagcacggaacctgggaggagctaaaacgcctccgcggtgacattcggtcgcacctgaaggaattggaggcggagctagggagggggccgggcccgggcgaggggagtcccaaggtgggggaaagagatttgcctgccaccgcccccatctctcgatccctgtcatcgcactcgggggggaggcccagtgggggaaagagtgacgcgcgctctccccttgccgtctccttctcgatg

SEQ ID NO: 5793 - DNA, 700 bp, Nannochloropsis_gaditana
tcattcaatggttgtcggccgggctggatatttacggtgactcggtggtgtcttctcctcatcaggcattttgttctctcccgtcgcttttcatccagacgttcttcattttatcgtgccacctaaaacgactgtacctcagttttgttgcatggagatagactgcacttgctattgaccactttgcataccggcaaatatgtcggcttccaagccaggaaaaatctcgagtctgcagtctcaacattgcgccctacctgtgctccaccgtcgattgaagagctcaagcctccgccgggactcctgcgatgacggggaggtcgtgtgatggaaaaagaccccaaaagcttcctgcgcggataagagcggtatcgatgacgatgatggaaaagacctcaacagggtcgaggcgaccacatgatgcgcttctgtgcaggccttcgttgctgcgctacgtttacctcatcgcctcgttttctgccgtacaggagcacttggtccccatagcaagaactcgaaagccgcggagctagattggcgcccggaaaggtgattgaaggctgtaattttggtataaaattctgccctcaagtgtcccgctaggcgtaacgattggaggataccaaggcctccatacatcggcgtcactagcctgcccatcaagtcactggttcatcagtaccttcgcagtaaatacatg

SEQ ID NO: 5794 - DNA, 700 bp, Nannochloropsis_gaditana
gcagctgacaaggtccttgatgaacgcctccgggcacgcccacctgatctctctggatgccaagatccgagagatctcactaagcaaccagccaggccaaggagggggaggatgggagcatgacgtgatggtgctgccgagtgcgtacggtgaagtgttccgcggaaagcaaaaaactgggtctcttccctttccttccgatccggctcccggggcgggccctcccatcccgctcccactctctcccccactgacattgcctgccatgccgccgcccgccctcgtcatccccccttctcagcctcttgccgcgttcacggggaaaagcagtgccggtgtcgagagggaagaagggccgaggccaattgaaagctgggacaaggacacagaagagcatatatggaagggtcggccgcaggtctctgggcacgtcggaggcaacgggaccgacagcccccgagcccagagccctggcaagcagacgggtcagaaggcgacaaaaacccgcacagaagaagcgttggaagggtcgccgagacgttctgcgggtggttttcggtctatgacccctacgggtcggggcacacgacgcactactcttctatcaaggctcggctcagatgtctcggcagcgacgccagcggcacccgctccttctctttcgtgttctcactcctccccttccttgcccctggccatg

SEQ ID NO: 5795 - DNA, 700 bp, Nannochloropsis_gaditana
ggctctggacgacctctggtccgacgccgacctccggccgagacaaggcctgccgccgcccacggagaacgcgcgcggcgatacggtcggggaggaggacgaggagaaggcatttctgcggcggactttgctgacccctctgttggtagctttgtacacgggcaatggacaagtgacggcggttgcgctgagggggctcgtgggtgtggcgactcgacatctgggtgccgaggctgacggacacagacagagagagaggagcgcctgtccgctccaagccttcgtcatcgagtccttgtgtttcttcgtccatcgcgtgcaagtggagcactttgacaccgtggtccagtaccttcgtcacgtaatccaagcggcctccgtgggggacgtcgacctttcctcccaatcgttgcagcagatatttaccacttgcgtctttttgtgcaattttgaggcattcagagcgttggaaaatgaacgtcacgctcgatatgctgcagtgtctgcctcaaaaggtaatagtaaggcgatgttagacgccatgggggttaccacgggggcgatagcgacgaaggtgtcaagccactggggcttcggaagagagatgcccgttctcggggtagattgcagcgcctttcttacccttaggctcctgattgagtgcatcctgcgtcgagtggaggtcagagcttgcggtatg

SEQ ID NO: 5796 - DNA, 700 bp, Nannochloropsis_gaditana
gaagagctctaccgactgttggctcacaacgaaaagacctcgcttgcatcgggggaaacggacgcgcccgatgctctactgcccctacaagacttatgccacgacacactacgcgtcgtaaatgctgtgccgggatacagcggagcttcatcgaccctgccgacggtcagcgacgaggatcatcatgaagccaatgtccgcgaggcctgtgcaggctctaccatgacaccagggtatgccccgctgtcgcctcagtcttgcgaccagggtggaaccgcctttttggatgacaacgagcatcacgaacgaagtccactgaaagccggaaatggtcacagtagcagggcgcctttatcgggtcgacggcgcttctcaaaaaccccaccaattcctgctcgtcgacctccctcttggctcagtgcccttctcgtcttctcgcatggaaatcgtcagcggaaaacgtcggtcgaacaggaaagtgcatcgcctggagcgcccttggtggagatccaagcagtctttggaagcgacgccgttccagagggtttcaagcgcgtgagcaatactccctgtgggcgcaaggcggacttgaatgccggcgccggtgggcactacatctacctggcggttagaaaggacaaccctggcaggcgtcggccacccgtggtggcgctggcggtgattttccccgaccgacaag

SEQ ID NO: 5797 - DNA, 700 bp, Nannochloropsis_gaditana
aatagtagacagtgtatataatcctttctgaccatgtcgttctccccttaaacacatgccacagatttcgttccgcccatgcgcgagcgataagcaacgcgctcaggttggcagctccaaatgtctgccatataactacaaaaattgtgcagagctcaccaaacaaacttcacacggtgcagcacacctatagatttacagaggtatgaggaaaatggatcatgtaacacagcgatgcacgtttcgaaggcctttgaatatataacatattttcgttcattccttcgcaacctgtgctcatagcgaccccgtccaggatggagaggcaggaaggcaagcatgatccgatggttgtagacgcgctgcattcagtggaagagctctaccgactgttggctcacaacgaaaagacctcgcttgcatcgggggaaacggacgcgcccgatgctctactgcccctacaagacttatgccacgacacactacgcgtcgtaaatgctgtgccgggatacagcggagcttcatcgaccctgccgacggtcagcgacgaggatcatcatgaagccaatgtccgcgaggcctgtgcaggctctaccatgacaccagggtatgccccgctgtcgcctcagtcttgcgaccagggtggaaccgcctttttggatgacaacgagcatcacgaacgaagtccactgaaagccgg

SEQ ID NO: 5798 - DNA, 700 bp, Nannochloropsis_gaditana
cttttgtttcctgggcgacgccccaaatccttgcgtcgtgcgagggaacaagagcaacaggagcagcacacaatagaccatgccattgcttcctaccctggataccatccccgtgctaatgtatctttgaaaggaagaaaatatgtgagcgtccacgatcgcacagcgatttcatacctgcctgatcactggggcaacgcgtctgttgagacctgagactgtaattttttcctattaccagggcctgaaatgaacccgggtgctcgcatgccccgccgagtcgctgagaaacttgaacgagtgctcgcgctgccgagtcctgtgcttgcttttccaatttgccgcgagccccaacaaaaaccatttcccacagtagtgcaaatagtagacagtgtatataatcctttctgaccatgtcgttctccccttaaacacatgccacagatttcgttccgcccatgcgcgagcgataagcaacgcgctcaggttggcagctccaaatgtctgccatataactacaaaaattgtgcagagctcaccaaacaaacttcacacggtgcagcacacctatagatttacagaggtatgaggaaaatggatcatgtaacacagcgatgcacgtttcgaaggcctttgaatatataacatattttcgttcattccttcgcaacctgtgctcatagcgaccccgtccaggatg

SEQ ID NO: 5799 - DNA, 700 bp, Nannochloropsis_gaditana
tggtttgtggtaccacacagctgcatcttgcgtacttcctgatcccgctgctctcctatcttttcaccacaattgcggcatttcggccccctgcttctccatggcacgggcgatcatttcttacgcttcctcgcgcggtcgcggacagaaacgtgccagcttcatcgggagaggagatctggaaaagcaagtacgggacgacgtccgccgccgcgtcacgtccccgctcttccttccccccggctgcccatcattttttcgcttcacctgaccgacgacgctccggtcgaaatgacaggagcaaaaaggaatgggaaaggtcagcaccagaagagtttcttctgattttgacgcgactacgcgcggaggaaaattccgggcgagccccgctcctggacgaggagaccgagagagacataggacatgttatcaagctggttcgggcattggcaaaccgacagtgggagcaagctgaagaatctgcggcattgctgtgtcgcagtcccctcttggacacggtgctgtcgcggatggtcgtgtatgcagcaacgcaacggaatgaacctgacctggccctggagatattggggggaatgcgcgagaagcgcatcgacgtagacgcgttcatggcttctctggtcgccaaggccgcagcaacagaccggcgttggatgcctgtggtggaggtgatccgcgctca

SEQ ID NO: 5800 - DNA, 700 bp, Nannochloropsis_gaditana
tttgaacgtcatcatgcctttttgtttcagctcctccgccagcgcagcgacagccttagtgttgctgctgttgctactcatcttttaatttctattctgtatactttttggttgtggaaatagaaactgcaaggagaaagcgagaaggaaggccgggtcagtcagggccaaagagcaaagaatggtgcgaggaaaaaaatatgttgaaaggtcctgccaacatgcattcaatgaagcatgtgcacggctataagaatcgcaccaggcagtatgttttgtgacgatttggcacactcccctgcatacttgcttccattcgcttccactgcctgtctggtgcggcacagtttgtgtccgccttcgaagctgctactagcacggataggccaggctctcgcagcccggtcagtcatcttgcgccacgcaagacgtgtgcttgcatattactggaagaaagctcttattttatctatttgcccagcatgattgaagcgtgcacgggtcgctcctacactgcggcataggcatcctaggacagggccagaccagatgcgccgtactaagtgggagaagggcaactaatgcaagacttctgagggacttcaggcacactcacttttcatataccttcacatgaatattgcaggagagcaagagtggcaggggattcaaatttgtgtagttgagcgacacaattatg

SEQ ID NO: 5801 - DNA, 700 bp, Nannochloropsis_gaditana
gaacatcaagtgccgcagcaacacaatgaggtccctgcgctgaagaagttgccaccctctagtgtagctcaggacatcccacagtccgatccagcaaagtatatccatggacgactggccgatcaaggcatggcagtagccgcaccaaaagaaaaaagcggtaataacgcgaatttttgtgatgacaatagcgaacaacaggcggtggatggccggaaaatgcagggatgtgaagaagtgaaagcaaactctaatgactgtgaagcggtcgactgcggcaatggagtggaaagacatgctattgaggggaagatgccttgaatatgatacttgtacaaatcgaatacattaagaaagcaacgaaaaaacatttttgatcgttttatcgtttgttagtcatgagtttgattagcatgggccggcctgcgcccgggacccgtttcaccaaccagcgcaggtcgatgtacccaaccagtcagaacataactgataaaaacatttgtgatcctttctatccatctattctatgtatatttgtgtggccttcataatttgtcacacattggattcggggacgaaaaatgcaaggaaacaaaccgaggaagggggcaggcgagagggggggggaggttccccattcaccacttttaccctttttggcctcaacaaatgaccggatacaggagaagcgagctttatg

SEQ ID NO: 5802 - DNA, 700 bp, Nannochloropsis_gaditana
aacgggtcctgggggcgggcggctcgcgtacaagccccttgagacccagccgccgtgtttcaaaggagggaactggcacgactaccagttgattgggatcaacttccttaggaacgcctggcacgcggggaacaacgtgatcctcgccgacgagatgggccttggaaaaaccattcagaccctggggttcctcaggtgcctggcggtggagcagcggctggcccgggcggggggaagcggaggggagacggaggggaagttcttgcccttcctggtggtgtgccccttggcggtagtggacaactgggagcgggaatgctcggtctggtgccccgacctggacgtcgtcgtctacaaaggctcgcaaaggtcccgagagatgatccagcggtacgaagcacggccaatccgggctaccatgggagtggagggaaatgggtctaccagtcgggcgcggaagaagcggaagctgggcgacggcagagcacagggaggggatggagagccgccagggggagaggggggaactaaggagggggcagggggcaatcatgtggaggaaggggaagtgaaggccctcggagggaaagtccggtcaaacgcgttgtcccaactgagtaagcatgcgagcgccgccttgaaacggcgccgatgtgggaattctgaggaacggcgactggatgtcaagttccacgtgatg

SEQ ID NO: 5803 - DNA, 700 bp, Nannochloropsis_gaditana
cgtttcctccctgcacgccaaccctctaccgttttcgcaacaaagggacgcaaatcattataagttccataccattcgaaagcccgctgtttgcgttcccggaagaaagcgtcccaatacgcccggtcctggaactgctgaaaatgttgggggagcaagtcgaggtcatcccggggagagtcctgaggcttcgacggggcactcggagacttaagagcctcgatgctggcctttttaaggcttttgagcacactggctgatactgggggaggcattctggcgcggcttttccccctgtgtgtatgcttgcgtcagttttttgttcttgaaggcgtcgcaggcggcagcagggtatgataccttggtaggggacacgctgcggctggaatggtatcgcgatgagtacccctcactctcatttagcttggcacatgcccagcaaagaatcgtggttaccagacaaaaaaatctgacggcgaccggctcgtcctccgtcgatcaatctgaaatgccgcgcgctatgggtgttgtctttccatatttccaagcctcctaggggtagcggcctttcagtggggacataccagcttctcatccgtcggcatccacgtgttacagagcctccaactcctcatcacttacttactgctggtggcgggaaagtcttactgtgaaagagggcatcacgacattggcaatg

SEQ ID NO: 5804 - DNA, 700 bp, Nannochloropsis_gaditana
ttggctgcgaagtcagagagagtctcatacaaagtaaatagggcctggcggggaggaaacggagatggagagtcgtcgctggcttctccccttctctgcaagccccgcttcacctgccttgcttgccacagacacgtgcgaaaagtggacaaggggcaattcaagagcatgaatttgtacattgtagtgcaattagactcaatcatctgcactgcatccttttttccacagttgtgagcgcaagtcgccagtaatgcctcggtccgtctccagtgatgaggaggacgactggatgtatgaagaggaggaggaggaagaaaccgcggcggaaccgcagggcgaggagggagaggaggaggacgacgataacgaggagtgtgaaatatgtcacgacattggagagctcatcttgtgcgactactgccccaaggcgttgcatgctaaatgcgcaggactcgtggaggcaccgcacggaaacgccatcttcacgtgtcacgagtgcggcacggacacctgcgatatctgtaaaagccgagtggctactgtccggtgccaatactgccggcgtgcctaccatggggagtgtctgcaccgtgtacctgctcctgaggacatatggctgtgtcccagttgtgtcaaagaggcagcggaacaaaacggagtggagaagattcttgcgacgcgtccgtaccggaagatg

SEQ ID NO: 5805 - DNA, 700 bp, Nannochloropsis_gaditana
gcatcttcaatgtcagtaatgcatccgcgagatttatttgtcggtctggaactcctatcggttttttaatttttttcgctatttaatttcttccttgcatggcgtatcatgtatgatatggagattcgtcctacaagtaaattgattccttaatgtttatggattaagagatacattgcgagcagcaatctgaccatctttgattgaaattccttactcatggcgtgttataagcaaacgttgtcgtgtctatagacattttttgcgatggcttgaggacggcgtttgctcctgaatcgtcttctcaggggcttccttacctcctgcctccctggacgccaaagacttatttcggaaaatcaggcctctcacaacgatcgtatgatcaggttgttgaataataagtgagcttactgcacgctatcattggtgtcgtgcatcatggccccttggtttgcgttcgcccggactcacgtccgtgtgaccgccagtccggtcttcccacggctgtgtcggagaggcgagaagcttcaattaccgcgtggggcatgcacgaggtgtacagatcggcggtcgttatgcgcggtacatgcaatttgcactggtcaaaacaattgcgtccttcgttctctgacacaggctttacggtcctgaaaccatattttcacagtaggacctcccctccccctcaaggctaatg

SEQ ID NO: 5806 - DNA, 700 bp, Nannochloropsis_gaditana
accagagcaggccaatcctgaagatgcgggaagtccatagacctgggccatactgccactgccgcgcacgtctcgcggcgtggtccactccacttccgtgcatgttggtgtacagcctcggacggcttcaagtcctagaaaaaagcgaacagtgcgccatcccccagcacaaagaggagcggatgcgggcgccggaccccgcccgtcgaaaccaccgccgcattgggccctgtgcctccgctgtccatccacgcgaagcacatccaatacgtgcgaagactttctagcatcgatgcttgggtcacggtaacggcagtgcggctgcgttggtcgtgtgacttcccttctgccttccgagacgagcgaggagagggctgagctactgagctcggcgcagtggccgcagatttctgtgcttgaacgcgtttttgtcatgtgcaaccttttttcaaacaatcccatgccctgttgatagattagagcgataacatgccagacatgggctcacgtgggacacgtctgcgcagaaagcgtcacgacaggagtggaagacctgtcccatgattatctttggcttgagcctctcgataaaacggaggagtctggtatgccgacatcagtcccacgagtttcgtacttttcctcacacgaaaacagtggtaggtcatgctgcgggcactagcacgtccatttcggaatg

SEQ ID NO: 5807 - DNA, 700 bp, Nannochloropsis_gaditana
acacgaccaggcggcgcctgtccatgccgggcctgccttttcgagccacccctcgcagcaccggcagcaaggctcccgtcacggctagcgcaaggggcacttgtattctctcgctggactcgattcgagtcaagttggccacaggcttgaccccccggagcaccctctccgagtacgtccctgtccacctttcccccacgctcgccaaagcccaggagcaggagcacgtggacgcgccggacggggaggatatcctgctggtacagtctgcccaccggctcggcctcgacatcaccggcttgcgcaaagccctccttgtgcgcatactaggcgttgagccgacccccccggtcctacgtctcccccctctcctccccccctctcccccgcgacacttctctttggatccgctcggaagcagactatcgcgcatacattttctgactctgttagtccggcccggcctacaaccaagcgcacacgcagtgtctcggccggcgtcatgcccacaggatggctgaggcgcgctgccggtgggcaaagccacctcggtgaggggcgcgggggaaagacggggaagagggtctcggagacgtatcaattcgttttgtgggtactggatctggagagcggggaggagtggcgcgtccgcaaaggcccttcggaaatgttggcgttacatgaggctgtgtccgcgatg

SEQ ID NO: 5808 - DNA, 700 bp, Nannochloropsis_gaditana
tggagaaaggcctcccgcaggaggccctgtcttcgaagtccctctcctcttccccgtcttatgccgggagctcccactgtttccgctgctcccagagcgtggacgattgccggtagacgcagaagccttcccttgtggcggaggtgctggctgccggtgtgacgcttgttgctgattatggtgtcgatgcggttgctgttggtggggaacgggcgcgggggcgggcgcgggagcgtgcgtttgctcgttttccccttcattcccggcgccacggccaaagaaagaggcgaagcggctcatcatttgcgtcgaccctgaatctacctgtggtcgccaaatgtgtttagaaggtgaccgactctgcacttccttcgacagccatgtcactccacgcatgttttacacccaccggcgctcgcattttggcggcgcgcagtcgtgtttgttcgattaagttgcgcccttcccactcgccgctcgccgcggtgtcgctcaggccctgcccctgtcgaaccccgttatcaagggacggctctcacttgtggacaaatcggtagcgcgcgatgcgagacgtgtgcaaatgtcttggaatctttcgatttcaattttgccatatcgttggactctgagccagggtccgtcggtggacagaagttaacttcatcgatgctttgattccaggtacaggtcgagcacgatg

SEQ ID NO: 5809 - DNA, 700 bp, Nannochloropsis_gaditana
gacgggcaggggggcgcgatcatcttcatcgacgagctggacgcgattggcacgaaacgctttgggggggagcagtcaggggacagagaggtgcagcgcaccatgctggaactcctcaaccagttggatggcttcacggtaaacgagaacatcaaagtcatcgcggccacgaacagaccggatgtgttggaccccgccttgctgcgttcggggcgcttggatcgaaagatcgagctcccgcaccccacagaagaggcgcgagcccgaatcatggagatccactcccggaaaatgaatgttgacaaggaggatgtgaacttcgatgagttggcacggtgctgcgacgatttcaacggggcgcagttgaaggcggtgtgtgtggaggcgggcatgctggccctgcggcgagaggcggtggagatcaagcacgaggacttcatggaggccatcagcgtggtgcaggccaagaagaaggggagtttggccatgtatgcctagatgatgaggagggggaacgagcgcgaatgtggcgtagggtgtagagggggatcgattgggggccaggggcgggaggctgagcgggagcgactaaggtcggacccgcaggaaaagaatgttgtcgagccgtttcagaacaaaaataagttgaaagaaaaaacagccagagaaacctaaataccgcggtcatcacttggctcgg

SEQ ID NO: 5810 - DNA, 700 bp, Nannochloropsis_gaditana
caaaagcaggagcgagctcgggacgagcaaactggtgggtttcatcgtttttactgtggtgtgagtacaggataatacagaatacgttttagcgcagtccttgctaacgcaatgtgtggttttcgagacaggctttggactgacgtttaacctcctggctggacatggtggaggagctcccagacgcctcccaagcacgggcgccgatagtcgacactttaaaaactgcttatggggctaaacgcgcatgaaacggagtgccgtttgaagcggctgcatcttttggcgctttgttgccttttggtaatcgcggcttgtcggggggcgatggtgtggcatagcccctgcaggatgtctttatcaggagattatacacccagagcctggtggaaaaatcctactgttcctatgacgcgctttgtagcccgacttgcttacgatgggacgcacttcaatggttggcaattccaagtgaagagtagaacggtgcaactcgaggtcgaacgcgccatcaactcaaccctcgccgcctgcccggactccgacttgcttgaaaaggtgtgcattcgggccgtcgcagccggtcgaacggatgctggtgtccatgcacgaggacaggtcatccattttgactacccggcggtggctgcaggacggtttactgttcaagaatttgaaacgaagctgaacgagggactgg

SEQ ID NO: 5811 - DNA, 700 bp, Nannochloropsis_gaditana
ataaggaccgagagcgagagcgcccgcgaggctgtgttatgtggaaagggtcggggacgagtggtgatggtgagagaggcggtgagcatctttgagcgcgcatcggtagcagaagagacttaccatctccgtagggtgattgacagacggcacaagagggatttcgaaattttagacttcctgcgcgccctctgcaactaactctagttcagaagagatgaaactgcccttttccaaaacgatttctcgtttcactagccgagaaagatccttgaaaatcccacgttccctagaaacgcgctctttgagccaagacaagagataagtgcaccatgaagacagaaaatgatgaaaataatggtgagtgagcccggaaaactaatcggcttagcattaaacaacgttggtgggcaagacgccgagactgtcgagtgcacggcgaccgagcctagcgatcacggcctgattgttcttctagttcggagacgtcttacaggggcaaagcacaatcgtcgccattagatccagccaaactctggcactagacaagcgtggttactcctctcgcctggagaggtctggcaatgggtatacgtagtgctggacgagcaaaagggggaagacgacgagtatcatacatcaacaacctcccctccctgccgccgagactcagacccctccttgatcacggtcaggcatg

SEQ ID NO: 5812 - DNA, 700 bp, Nannochloropsis_gaditana
cactagctgtgcgtccacgacgcctgcccctctgcccatgcccctcacctgatttgacgggaaaaagcaatgcctgacgtccttgccacccttcccatcctgacactcaggctaccagccagctttcctgtgctcacttagtggatggatttcaatctacagggcgtaagggtgggtgttgctgttgaagaccgccgtctttcagcggcttgagcgacgactcggagtagccgattgcaagggaaagtctttctttaaccacctaacagttctttctcacacatagcagcatccatgacgacagtccgatccgcgaaaaaggcccaagacacagtcttgattgcgactagaattcatggcagagagaccacggcggctctctccttcgacagcgctaaattacgggactttttacataatactgtagcgtacgctgatgcggtggcggttgctgtcgaggtggcagatccattccatccccgactgctggtagctgcgcaagatgtcgtcaaagagtttaagggctgtcgcatcaacgtcctgcccgtcacaccgtggggtcattttgtgcctgcattaaacgcagctttatcatttgccatgcaggaggacttctcatacatcctgtacctctccttagagatggacctgaccccaatggctttccgtgcgctccttgacaactttgacccggcagagg

SEQ ID NO: 5813 - DNA, 700 bp, Nannochloropsis_gaditana
aatttatcggtgtagcttgtccgaccgagagcttgtccctgaggaaaaggcccttgtcgacccactcctgcgcggatgggaggttggctgggttttgctcggaaaagcatttgtcatagatcggactttggcctgtatgatgatgtatgtaggatccattaaacgtatgtttggctggatcgaaggtccaggggttggatcaacgagacacttgaggttggtatgcttgtcacctacgtgcaaaagctagtacgtcatccctctcttgccagtcaccccggccgccagaagcaaagccacacgatcctgcatacatagggtttctgattggagtgttttcagagtaatgagaggtgcgactctctaggcgcacgtttaatctcaaagtattcagcactttccgcactagctgtgcgtccacgacgcctgcccctctgcccatgcccctcacctgatttgacgggaaaaagcaatgcctgacgtccttgccacccttcccatcctgacactcaggctaccagccagctttcctgtgctcacttagtggatggatttcaatctacagggcgtaagggtgggtgttgctgttgaagaccgccgtctttcagcggcttgagcgacgactcggagtagccgattgcaagggaaagtctttctttaaccacctaacagttctttctcacacatagcagcatccatg

SEQ ID NO: 5814 - DNA, 700 bp, Nannochloropsis_gaditana
cgttcggctcagttttcagcgcacagaaatccacacagcatttgtaccttcgacaatgcaaaacgtaagctatggtgtctagccggaacggagtgtcccctctcctcgttagtgaataacaagttgaggcagacgcacagctagaagtcccacggccctgtggtctcagatcacgtgggatgccattttgcgtccattcagctccaagccccgaacgctgaccaattgaggctcgtacagtagcttaggattaggtgcaaatgctatcgggaatcaaataagcgttccaatggttcggcggagtggcagaggggaaaggggctacagcgccaaacaaggaacaggccatccgggatggacacgcccgcctgcttgtaacgctcttacgggcgaacaatacatcaccgtgttgatttattgttcttatattgtgacccgcgttttgcgtcaaattaagcagtcagtgcatcatatgaaaagccatgtcgtgcaggcagggctaaaaatttccggcgttgaggactcctgacgcccgtcggcgaggccctgcctttatggcatttgccagctcgatttgcaccaaggcggctatcaggtgggaaagcagcgtgagtcacgacccccagcatgcgacatacactcacaggacgtgcacggtatagcagagcatctcccgttacaggcattgtatacaagcatg

SEQ ID NO: 5815 - DNA, 700 bp, Nannochloropsis_gaditana
gccgacaagtccagggcgtgaagagattcagtggttggaacatgaccggctccgtgcgctcggaggagtggagactttgtcaagtataggaaggaattcctgtgaatttgattataactggaagccggggcctgatgcttgacgtagacttggttaccccccccccaatttttgtcctgatcccgtcttctgccctggttctcgtagacgggctcagaaattttcagttgaagcggtacatgaagaaaagacatggcaggagtcgtgcaaaaaataaggtccaaagctgcgataaaacgccaaagctttggtgtcgtcatcaccttttcagccaagtttacatctatgtgttctgtacatttcgtgtgacttatcaatctctgtcttttatcacgctccgcgccctgcggagaagtacgtggtggtccctgcggccgggaggttaaagccagtaagtaaggaagttaaagtcagtcagtgtctgttgcgtcggacagtcgtgtcgttttcccctagaattggagcaagcgaatcaggatctgtgttttggtcgcgatagattactattttggacggtatcattgtaaaatatgtaccactatgctaccctttcacttcgcaagagctcaacttgatacttccgcatagaatcatcgaatgcatagtctcatgtccctctaatgccccttcactgtctagt

SEQ ID NO: 5816 - DNA, 700 bp, Nannochloropsis_gaditana
agctttgtgtgtggccacgaccgcctggctgagattctcggctatccccttttcgtaggcagcgtgctccgccacaaggaccttgctgacacctggaacctgggcagcctgctgagccactgcgttgacgcccttccctccagctaccaggaccgtcacaggattctgcagttgacccgcggccgtgatggtgcacagcgtgctggggctcagagtccccttggactcggagtgttcggccaccaccaacgttgaggcatcgcgcgtgccaaatctggacatcagtactcccacaaagcgtcgtggctgagccgagaccgtcaggagaggccgtcgcagcatagtgttgaggtgagtaagatcgacgggtcgccccacaggttgagacgggcagacaggataggaagcgatttcgtctccgggggcctgaaccctgtactcgtttgccaaaaaatgcgtgccggtagagaccaaaaagtgagtccacgcgtattcatgtgtgtgcgaattccgagtgcgtctctcggcggcgcccattgtgtggccgcccctcccgccgcaagtgtacgtgccacgggggtgaagaagccgaagaagccgcccgtcgttggggggaaacgggcttttaatttttttttttcacgatacttattgcgcacaaaggtttgtacacaggttcgagcaccgcacacatactatg

SEQ ID NO: 5817 - DNA, 700 bp, Nannochloropsis_gaditana
tttgacattctgtggattcgtagaagtagtaaggctgatgatgaatatacggtgaataaacgaagggaaagagggtcacattcttcggcgactcgcccaaggtttgcaccatccttcccacgcatgtcctcggtgataccaacattccattgctcctgctctgttgaggtatttcggtgcattgtgtgcactttctcaccctcaatgaagtcgtggaactgtgtaaaatggccgccaaaatggaaagggccaaaaaggtgcgcaccttgtcaccactgcagctttcaaggcgcgtcatttgctggcgtcaggcacgaaaccgacggcacgggcacttactttgtctcacaagcccttcttaggcaccaggcgcgagcattgcgccttttctttcgagatggcatgagccatctccgcgtcgacgtagctttcacacgttattggcgtgcatgtcgactcttccggtgcaacacgagatgttgagtaacagattttaattttgtcgggggagcttctcacacggtgtcctgctactttgatgtcgaatgccctctgctatagcttttcgtcgcataagaaatgtagtagagagcgcgagagatattgagaagtgagaggaacatacattgtgccccaaaattgattttgcaagctgtctctacacatacaccccggacaccgactacgcaggtttggaatg

SEQ ID NO: 5818 - DNA, 700 bp, Nannochloropsis_gaditana
aattgttcctgggggcctgaaatatccgtgttaacgataaaggtcaatcgacgttcacagagacccttgtgcagacgactcgtgtgcgcacgacgcgaccccagcgtgacgacacttgacctctacacccatccatggacacaaaatccaaccaaatatttttgcatggaggtcttcttttcatcaccttcgcgtaaacctcaagcggacgaagacacctactacattcgacttacatacgaccctcttcaagggcgagcttcgttgccggaaccgtgtagagtgccagtcggctgttggtcccccccacatccccgccaatgacttggtagctcatgcctaaaatacttgtgtgttttcgacgaggagggagaacgaagaaagatggagcgcggtgagggggctgcagggggcagggaggcagaacaacgggggcgaatccgggcctggcgagtcggcgggcctgcgggcaggggggcgggcgggaggaaaccttgctcctatcaggtgggcagcgttttcaaaattgatgaaagtgaccgtggatgctgactggtcccgacttacgttcgatcaccgcggtcctgacgcgggcgtcgttccgcctaacactctcgacattttgccgcaccgcacccatacctaaaacacagaaaagtcctgcaacttgcaccagcgtctacctgcaatctccaccatg

SEQ ID NO: 5819 - DNA, 700 bp, Nannochloropsis_gaditana
gaatgattttccgctgcaagtcccatgaatcaactgagaacgaatgagttggagaacatgtatgtggtcaggggctgatatcaacaagttcccacggaaagagtgccacggtgtggcggcgaaaagcccattgctgctcctcaagcatcccccacctgcacttccgtaggcatgaagggccctttaaaatcaagcacaaacgtattggagacgaggaggttttttgctgcttgcgggcccgctcaaaagcccatggaagagacccccgagtcttgaggcggacgtgcggccagcggcccctgtctgcccctttctcggcgagtgaagataccatcacccgcccccggcccgctaatgaggcagccgcccggcagggatctttgccgcgttagggacatccatcattgtcattttgtggattgacgtcgtgtacgagaagcgggttcgtgggatcgatggcaagccagcttcctgcggctgcgtggttgcgcttatcgtcatcaatctggggttaggcgggcgtcacagcagcaccctacctttttgtcaaaccgagattcccagataccgttgccacgtaatcttgaaatagaacatggcctaatgtccaattttgcttcaaaacaccccttgttgactttccccatccgagcagcagcactagatcgaggagcacttcaacaggcacccggacaggatg

SEQ ID NO: 5820 - DNA, 700 bp, Nannochloropsis_gaditana
atgcaggtgcaccgtcgtttgccgttggggcatgatgccagaggtcactcctacctgaacccgctctgttgcacgcgttttttccctaggtcacaggccttgccacaaggcctcttctagccgtcgatcaggacatgtgctggcgcgattgctttcctctctgtatatgcacgtgtttgtaatgcttgagaggttgagcagatgataaaatgccaggaacaagcgcaaacaggcaaccgtgcccaattgattgcacaagctgaagcgccacggaacgccgtgtgtgactcctacgtcgtgaacgccgtgtgcatttccccccaacatgggatcgagtcaaattagcgaagaagctggccgagcgcggcaagcgggatggagctcgtccacctatgccctctcttgagaatagtgccgagaaacctaatctgggcgacactctttgtctagggctgcataaagttgtcttcagcatgtcgaggagatgttttttacgctagccgctgggacaaatttgacctgacgaaatcgagccgaaggcagagatttgtcgagatcccttgatagccgccgcgctcagacatcacgcttttttttcgcttgtgcggcatcgccgtctcgggtatgtttacgttcattggctcatctgtttaatgcaaccgtgctactccaagaattacgtgacagcttctaggtgatg

SEQ ID NO: 5821 - DNA, 700 bp, Nannochloropsis_gaditana
ccgatgtgtacgatttacgtggcgggtttggcttccgccatgtcgtcacgcccgaggtctcgctgccgggtgttctccttgccgggggggcagaacgcacgcctgcgcctacaaaagagcacaccggttgaacgaaacattggcttccaagcgatcgagttgcatatgcaaccatctatcggcactgtgagcgtgcatcgcggttttgcggtgctgtgcgcaggagtcagtgattgaaagctctcataaagcgtcgctcacgcgcttggactgatctgcttcccattccgcccgtatcaattcattagtcgcccttatgcaccgcgggtgccgtgagcgagggcatgtggatgagtgaccagctagtttcaaaaacaaagcgtcttgctggtcaggcttgatgcgggacaggatgtcgctggtgaccattgccttcatcttttttctttcacttgcgggtcatgatttcccccgtcacgtttacatcacgacgctcgtatgcaacagatttagtgcacgcaaatgccaaggcctttacattttttgggttgccaaagtgatttgttgccgggcgcagcatagagaaaagtcatgcgtgaaaaacaagaataaggagccaaactccctcctcgcggcctgaatcgagagcaccaacgtgggttccgtgaagatcttttttcttcacaacggggcagccatg

SEQ ID NO: 5822 - DNA, 158 bp, Nannochloropsis_gaditana
acaccacgactcggtgcccttgcgtccgcgaggcctcctgcgccgatccatgatggtgaatccacgcctatgggcggcggcagttactgtcatcgagcgtgtcaaagcggtcctgaccaccgctctaagggagacttgccccggctacgcgcttcatg

SEQ ID NO: 5823 - DNA, 700 bp, Nannochloropsis_gaditana
gcgcggctttccccccggccggttactcagcttgcgattggtgccaaaggaggggcggagtactttgctaggcatgacgatgtcatccttgcctaccgcttcttccttgcccttcctttcagcttcaacttcttcccaggaatggacgtggagcgtttctcggacaaagcatgaagcgggagactacttcatcgaggtgacgtcgcaaactcaagatgcgttcgcttacacgcaggcattcgccttacttgagttttcgaccaggaaatagtgttaaagcgttacgtgaataagtgtgtaataggggtgttcgatcgttaaataataatagaaatatagtcatgcgtgtgaaaaaggaaagcataatgtcacgtctctctagtagtcaacaggggaactaaatatgcaaataaaggaacactttttgaatgatcgtccaaactttgaagtccgaacttcacattaatagccaaacttgggtttttcctgctttagcaacattccatttcacaacacactttgaccgcaatggacagcaagcctgtgaccttttcaggagactttttatatgacgtcactcctgcggctcggaacagagtgcccctcgcccctctcacttatgttccagaaatgtggccatgccggatgatagtcggacactgtttctcacctttccttgtattctgttcatttaggaatg

SEQ ID NO: 5824 - DNA, 700 bp, Nannochloropsis_gaditana
gcgggactgagaacaataggtactggcgaacggggcgtggtcttggacggactttgtatcgcagtttgtgaatcacgtacaggcggtacggtagtcgatgcgtttgtggcaaatgcaatgggagaaatgagaggtcggaccatcttatttcggcgtacactcgatcttgctatgactttaatgcctctgtgttgcaccacagcaatcgaaggaaagcgacgtggggtccctcggggagctgctgtgcgttcctgtgtttacgattggaatgtgtgcgggttacgttactggcgtggaaaaatagtcacaaatccagggagaaaagaaagagcttacatttgtccattttcaaacagcgccgatatgtagacgacatgggggcgaattgtccagagcctaagaacgtgcccggacgggctcccaggtccaagcccgtggaagaaaagaaacgttcggccagccgttaagaaacggatgaagcgtggaaatgacagacctccgtgggaggagagcccctttctacacatggctgctttccatgaatgctcacctattcctaattatcactatttcttacaggatacgattgcatgtgcacagtcacgcggggatcggtgcgtgatcaacgaacaaaatcctcgagatagtgcatacatcaaaccgaagctacgaacaaggcatatcagctacatttggcatg

SEQ ID NO: 5825 - DNA, 700 bp, Nannochloropsis_gaditana
tttgttacacaaccagtatttttcttcctcctggcctgggagctggagacgcacacataggtatggacatcgtgagggacaaggcaaaaaggccatcttgacggtactttgggacctattccacacacctgtcatcctgatacgggttgtgaagttcaatattcaccacaacacccgtttctgccactttaattggcaagacagcccttggcatggcctatccaaccctgcggggcgggagcttgctgttgaggtgaaagaagatgagaaggaatgagtcaacaagcgaaacgcgcagcgggcccccacaaaagtggctgcgcccccgggaccattgtaagatcgatgcacacggcaggcaagggactgcatctctgaacgggtcgggtataaaggggtctgtatggtcaggggtctgagtccccgtgaccgcctccgcctaacgccagcgagaccccgccgggcccattcctattccatgtgccggtcgcagacctgacacagccaacactgcgtctcatacccggtgccaatgtgcctcccacacgcgttgccgattcttgatgggaaggtatcggcggttctggtcatctctttcccttttcctcactcccttcactcgacacgattccaccattttcccccttccacagacacgaactggtcgcatcagtctgacctgatcgtgcccgttctcatg

SEQ ID NO: 5826 - DNA, 700 bp, Nannochloropsis_gaditana
ccgtcattttatttcttcattgatttgtgttaaatcgagtacaatgtattatcattttccttttatgtgagagaaagctcttcaaaactttgaccgaaccggctgcggatacgtcacagagcaagacgctctagtgcttcgaagtccttcgcgcggggaaagtttttttcctttcgcagcgttcattttaaaaaaaaagtcgagacaaaagatgatcagaaagtcatgagccggtacacggaaatgcaagaatgcctagaattcatgtccaatattcgacctttaggaggttggcccatgctacagcccgaattgcatgtaccccgtggatttttggagtatttggaaagccctgtgatcacataaatgatctaccgcgctctaaagtaagcaccgggatgaaaagagagaggaagcacgaaaagaaatgccccgtctaaatgttctgcgtggccagcgcgcgcgaggtacacaaatggaccccctccccaagagagaacaggaatccgcgacgtggcgttcggaaactctgaggtggtggcagccggggtttaagggtgctggagtgagcaggtgcttgttggaaaagcaattgttggcgggatatctcacgcatttcattacctttaccatattcattaggtgtgctgaactggattttcgccagagtaggtgtattcgacgttgtccaatcagcatg

SEQ ID NO: 5827 - DNA, 700 bp, Nannochloropsis_gaditana
ggctgcaaggcatccgctactcgtcctgcttgcaccagcacctagcaatggctttgggagaagagctgaggacataaatcgcatccacggccatttcaaagctcttatagccatctgtgtacatgtgatcgagagcgtaaggcctttgatttgtcgaaaagcgtgagacaatgccgagccacgggacatgaggggggggagggtgaaagggatggaagagaaacttcccatcccagacgacacgtccttgacagttttcgatctgcaaggcagcaaagccacagaaacaacactatctctgtcacattgcccgctttctttcttttagatgcaggctccccctgaatgtctccgtattttcccttgtcccgggcgtgccgtggcctgcctactcgatgtgatggaagacgacctctcggtggctaggggggctctcctttcgggctgtgctcctcttttggccttcacgacccggtcccattgtatgtggagtaaacgccaagctaaaacgcttgaaaaggcttaaggagggggcgcgttccagtcgttatgctcgatggattattttacacaggagagagaaggaaaaagaacaagcggggttgcttcagtggaaaagaatggacattatagcacaactgaaggtcaaggccctgtgcttactcttgaccctcaaattttctaaataggcaagggcatg

SEQ ID NO: 5828 - DNA, 700 bp, Nannochloropsis_gaditana
ccagtaccacgggagcaacaatgaagccgcccatccaaactctactgccactcttcgttttccaggtccatgcaaagggccagaaccccatcccttatattacagcgacaatcgtttgctggttgacgagaagggggggtaggaggttaaatcacaaggctggaagcaaaagtatcattataaccttttttgaatgccgcaattcatcagtaaacccatacgtgagcccgagtctgatattttctctcaaagaggatgtgaacgttataatatgtaatatgttgttcgcatcgcgcgagtatgaaaagtcggcattccctcaagagcacaaaacagcagcgtacgaataggaatgctaagaaaagatttgagacagtaaaagctggtgaagacggcttggaagacgcttaggaccgctccatgcatactcatcctttacttttgtgttctggaggagatgatacacttaagtatttggcgagaatttgatcgcctagccatcccggtgaaagcccgcctattttatcacctagtatgatgttccattttagaggaatgcattggcccttacaatgaactcagctatttccaacgtcaaatacgaatcccgcgatggtcgtcggtgcgggggaaacaaccataccatttttaaatcgagctttgcccctctccctggctcttcctctcgtctccttctcag

SEQ ID NO: 5829 - DNA, 700 bp, Nannochloropsis_gaditana
gccatagccatacatttagaaggatgatcttcatcacatgagcctcaacaaccgatttttcagctagatcgcccagtcctttcgcggtatggacacgggtaaaagaatcttcttgacctcctcctataatttgaaaaataacggaaagtaacggcggagagtcgtttcgtttcaaaaacgagcaatccctcctgcttggtaccgaagcaggtttgtaagtgcaagacttcacgttcctcaacaataaaatttgctggtctttcaagatcttgatatatttggaatcgtcgaagtacgtgaccgggacctttatctttcactcatgaaacgggtccaagcggctcgacatcctcaactttcctcgctacctctcaatgcaacgggcaattttatcgagcacgaagcagagggacactgtgtacccaatccagcccgacatgaagcattgatgatggcaactgttataatcgaaatttgtgttcactctcaagtgttctctggaagcatggatacagtgaacatgcgatgacccttcgaataaacaattgaagtggcttggttctaagttgtaccgcaatagcaaagacgactctcataaagtatggtaggtattcaaaatgacatttagtctcatctccaatatacaggttcaagtttacggtcgggcctgtaccgacctggtttgtctgtaacaaaaatg

SEQ ID NO: 5830 - DNA, 700 bp, Nannochloropsis_gaditana
acgggagattacggactggtacgtccctcttttttcttcgatccctctctccctccctccctccctccctccctcccttccttccttccttcctcccggacatgaataatgtgccagatagaggggaaatgacccttctgaagcctaaagacgccgatccaagagagccccaccacattatagttcccatttaacagctgttggtcaacgggagtgggaacgtaaagggatcacgcagtttgttcagttttgaagccgcaagagcgcggtttccacagactaaaaaggccgcagggctgtcaatgccgtggattaagccctactattatcaagtttaggcttagaacaatcattttacggtgcatgtcaactgagtgttgctcgcacggcgcagtggcgtggtgcgtttccggaagcgaacgtactcgtgttccactacccgagattcttaacccgggtcatatgccatcttaagtggcacgtgcatcgtgcccccaagttaaagcggccccatgactgtgcgatgcatttcaagactgctcaaagtcagctgcacatgcccggtgtccaagagcggatgtttgcacaatactctcgtgaccttctgcagccttgggagacggtaaagcccgcctcacattcgggaacactcacgtacgaattttttcaccacaggaacagttgcacactttaagccatg

SEQ ID NO: 5831 - DNA, 700 bp, Nannochloropsis_gaditana
tacatccgtttcttaggtccctccttattattcattcacgacattacgacgcggaaacatttataagtacctgcagataatctttctgggtgcactgcacagtcgatttccaggcgtttcatcgagtaggactctgccggaaaacctaggagaagaaagatctcgaactcgcggcaagctccctgacattacgtaagaacgcaagtacccataaatcccccacataatctcaccaccacagtacaatttacgaatttgtacattaaaaaaattctatgcaagtttagcaagatatttttggacgcattactgtatatgtagccctatctaccggtctgagtacaaataattcgaaacgaagtaccatagtatgcgaaaagacatcggttttgcataatataagatgctctatcaatgttgataatatcttgcaattgagacgattccggccacagcaaaccacccacttaatgcgcaggggctatacatctcttctgtttcctctttcttcaggcgagatctatggcacgagctgaacgtgacgaagtcgaccaccatgtgcatggggtagacaatgaagagaataagagccttgcaatttcaaagaaggatttccctgatgctgatgctgaagttggcggactggacatgcttcagcaccaggccagtcgtctgcatgcgaactcccaagaagttgtac

SEQ ID NO: 5832 - DNA, 700 bp, Nannochloropsis_gaditana
ctactctagcgccgcttctctcactttaatagatcttcgaagctatgaacaatctatttcaaaattatggcatttcgtttgaaatgtgatagtcatgacggtgttttggtgcaatgcaagccgtgtcagcaagatcgcaatttttttttcttcctgcacctggttgctcgttctctacatccgtttcttaggtccctccttattattcattcacgacattacgacgcggaaacatttataagtacctgcagataatctttctgggtgcactgcacagtcgatttccaggcgtttcatcgagtaggactctgccggaaaacctaggagaagaaagatctcgaactcgcggcaagctccctgacattacgtaagaacgcaagtacccataaatcccccacataatctcaccaccacagtacaatttacgaatttgtacattaaaaaaattctatgcaagtttagcaagatatttttggacgcattactgtatatgtagccctatctaccggtctgagtacaaataattcgaaacgaagtaccatagtatgcgaaaagacatcggttttgcataatataagatgctctatcaatgttgataatatcttgcaattgagacgattccggccacagcaaaccacccacttaatgcgcaggggctatacatctcttctgtttcctctttcttcaggcgagatctatg

SEQ ID NO: 5833 - DNA, 700 bp, Nannochloropsis_gaditana
gtcttaagcatgtccgactcccgaaatgtgccctcgtccagaagcaaggagagacgctcgcgcgcggtcagcttgccttttgcgtgctgcttggccacgcgtttttcgccacctccttgtaaagctttggcgcgttcgtcttcgagtcgcacacggaaagcattcttcaacgttacaacactaggctgatggttcaccgccttgaccttggacgaaagaggacgcaatacctgctgtaaatgcacccgtgtgcgtacttgacgcaatgtttgatgggtcgacggaaagcgcgacaagattgtggcggcggagactgccgtttgcatggtgcggtgccctgagcttgttcttgccggggctcttcagtccgagctcgtgcccgccccctcgtgcacgtctgctgaaggtatagaaaggcgagcgacggacagaaaccgagtcctccacggatacactgtctgtgagtgcacctaggggcctgtgggagggccagagtggattcgaggaggcagcctcagtgtggggtcgggttgattgaacttgtcgcggaagcgagcgagtcgttgtcgtccacgtcgcggggctacgaaattggaaagtctcgtgatatggccaaagctgcaagaattttagcgggccacggcatcacatgtgcacaatattgttattcataccaatggacaggatcttttatcgaaac

SEQ ID NO: 5834 - DNA, 700 bp, Nannochloropsis_gaditana
aagaacagagtagcagcaaatcaaggtctctagttctcttttcagtgaaaacaaggagacactgtgatacctttgacaactaagaaaaatgaaacctggtgaaaattttaactgttgacctttacatgaagcaagcaattacagcaattttcaaaattatcgcgctaaggaagctgtatagtaaagtctaaattcaaacgtgctttcaacatcccgccgcgaatttgttaattgcgagaggttagcttctaaggcgtcaaagctcataagctgtcaaattcagactttagaagtgtacttgatgcttatcgcggagactttgaatgtaatttgaagtcaagaaaatacgagaaatactttagtgatactttttttaataggatcacaggagggtgcacttagcagccgtccatgcgtcgaaacgtagagaaaatagagatgttaaatatagatatgttcagtgagtggtacgaagctctcgcggcatattaaagcaggatgatatttcatcgaaagtatcgacaaacacaaagtagatcactgaaaaaaaaagaggtgtccggtgtccgctcaacggctgagttcaacttgaggatattaggtggcgaacagagggcggcgtaagcgaccataggcatgtcgatgaaggcttgtatagttataagatctcatcgaccttcaaccaatcttctagtaaatg

SEQ ID NO: 5835 - DNA, 700 bp, Nannochloropsis_gaditana
ttcagtagtggcttgaaggcgtgacaaggcgctttggtgaggtggggcgcgggagcagcgacgccacgacgccctcgcggcgtctcttctgcttgtacttgggctagtggagaggggaaagatgaaagaaacggcatgctcagctgcaaggagcatcagcaggagtaggaaaaacaccctccgtaggtttttcatagtttttccgatgacttgtgagcgcgatggctccagaggctggggatttgcgcggcagtggtgccgtagcgtcaggggagacagggatgataccgccacaccgcccagagccgctccttgctgagaatgtcgagattggcctccgttgtctgcgagctctgaatggacgcagtgaatcccgaagcctgtgtcgattgtatgcatggcaggttattgcggtgggaaaatgcgggtgacaggcgggcacgacgtcctctaaagggctgattccgagatagcacgggccgcggccaccgatcttcccacgtcgcccagtctacgtttgcttcaggatcgaacattgaccgcattttcccgcccacacacatcaatagggactgcacgattgggggatatcatgactactgtatggcctagcgggagacaacgagtccgacgttgtcgtacatgcaagacatccccgtctctgttcacgccaccctcaacttcgtcgccctccttgatg

SEQ ID NO: 5836 - DNA, 700 bp, Nannochloropsis_gaditana
ttggcccctttgtactgacgccggtaccaggggacagcctcttgctgtgtcgtcttcctcgtggtgacattcagtggaagcgcaactgttttcatcagcaacagagtgcgacgcattgttcgcgacagatgacagggcaaataaaatgggaaattccctttgttccgagcgtttgctgtcagtcttcgggcaagacacctgacctggcgaaatgggaattacaataggttttgcggggaggatatgaagaatgaatgagtaggggaaaataaactggaacgcacagttcggacggcacatcgattgtccttgccaccagatcaaaaatctcaaaaaagtagaactggcacaaactccgtgtcgggtgcctgtggtgcgtcgagacgggggaggtatggtagggctgccgcacgcaagggaggcatgttcgctgctttctgcattttatatgacgggctcgtccggcgtcgagcacccttcacaaggctaggttcatgggcaagtgggcacaagattctaggtatctcgatcttggtgccgatgtaagcactcacatcgtttttaaagaatatgaggctgttggacacactcaaacaattttgtcttccctttgcttgaaagtcgtcccccggctgttcaaacctcgcaatatcacacgctaactatcaataacacccaataccatgccagggatttgatg

SEQ ID NO: 5837 - DNA, 700 bp, Nannochloropsis_gaditana
ggctctgtattgctccagcaactgacttcgatctacatccatgatatcttactgagtgaacgtataaaatagttagaaaagacgataagaagcacgggcgatcgctaaggaaattgaggaacacgctgaagtcgtcatcgggcttctcactctttttccgacgagataaaatttatcaaagcaagtccaaatgtgtgcgatggccctctgatgctcgagtggaaaagggattcgaaaattttcttgccaagaaaatgtgctgtttattgatgtcgcatgggagccgggcgacactcgggagagggcaggggagcgggcgagacggcggaggcacaaaacatcacatgcggaccgtcatcgtcatcctcagcccgcgacgagggcagctgcgaccttcttgaagcacgccacatctctgaatcagctcacaattgcaaagtccagcctgccgaactgtgcgtcgcccatcggatgacggcaaggggagtgaacaaaaagatcacggggtttgttcgtcagtttgtgacgccttgacatggtgaagatttagttcgctggctgactcagacgagggcaggtttagatttcttgttccgtccattgtgctgcatgcatattgcggtcccgcacctgtcctcagtcctcaaattctaacatccttcatcacagtagcttccagcaccttactcgtctaacaatg

SEQ ID NO: 5838 - DNA, 700 bp, Nannochloropsis_gaditana
atttaagccgtgtcggcagatatttggaaaggccaacgcagcaccccccacatctgacgggaagacttagtcgttgctggcagatatcggttttggaagggaccgctttttcagcggtaaagcttttattgcgattctgtgcatggtctagaagcagcttgtatggaatgcaacctcattctctccagacttgcgtccgaatactcttgatgggagaagatgtcatcgcaagcgcgaccaggttgtgcgcttgctcagcgcctgaggtggccacggaggcacggggaggccagcgaggcggaacaatgaatgtttccccatcccgtccttcacacggtgacttgtatgatcccctgtagatcccaaaatgggcagcgcaaattggtaatctatcgtacacccatagtgcacgatctgcgccttgatgtggccggatccggtttggtaattgggaaattgtgcgcctcataatgaatgctcacctgtcggatcgcgacgacaaccacccgtagtaagcgaagtttgatgacgcgcgaactacatttgtcataagatgcagtgagaaagcacttgatttcctatctcgtgcagtgctgtctctcctcattatagtggtctctcttttccctattcgtaggtcgagcacctggtggtagcaagtaggtcagtcaaacggtgatagcatcaagacatcagtatg

SEQ ID NO: 5839 - DNA, 284 bp, Nannochloropsis_gaditana
ggtccgtccccggtcatgaacatgatgcagccgccgcagcaacaacaacaagcaccgccacaacacccgccacgttccgaccggggggggccggaagtgcaacaggtgacgggtcaattctcgcagatgggcttgcgtccgccccaccaactccccccccgccgacgcacccaccgtccccctactcccaaccctcccacgcccaacaacatccagacttggcgggaccccaaggagggtcgggtccagcgggctacccggggcactaccgacctccctcgatg

SEQ ID NO: 5840 - DNA, 700 bp, Nannochloropsis_gaditana
catccgatgattaaggaagaatgaaacttgtgtctgcgacgcagaaaaggtcgttttgttggcatggtcactctcggcttctcttgtactctcctttgcaaccatcgttcaggccttgggaggctgcaatgtttccaacgatctttgcgaggaaagaggggtcaagatgaatactaattgcaggaagaggagagaagaagatgatgagaaatgagcgatgtaggcgctgaagttagcgaagtgattgacgtaagaaattgaagttgagaggcagggtgtttctatgtagcaataaggaaaagatgagagaggtaggatgttgtacgaggaaggagttgcttttgtatcatcaaatccaaaggaggggtacgccgctttcgtatcaaggtgaaggctgacaattgtgcccctgagatgttggcggtggacgctttcgcttacctagtgaatgctacagacgcctcatgcatcacgccgctggccaaccgccatcgtagaagtgcgatactcgaaactcaaaaaagccgcgacttgcgcgccaacttcagcacctaccgtcaatcctactcagccttttgtgctccttggtgagggccagcggttctctcaaggggggtgcctggcccccttcaggaccgtcgtctgtcggtgcatccgggaatcaacaggcatggaggcatcatagctctcagccaagatg

SEQ ID NO: 5841 - DNA, 700 bp, Nannochloropsis_gaditana
ttgcgggctcttctctcttttttttgacgggaagctaaaataataggtctccgtgggggatactacggctagtcttccctcccgccctcccctcctttccttcccctcgcccttctctcttttccctcctggaatggagggagatcgagagggcctcaaaaagaagagagggatgcataagaaaaggaaccgagacgtttttatggagttgcacgctcgatctggctcccaggggagagatcaagcgactatcttttcaaggtacgcattttggctctgcttgcatccgatgattaaggaagaatgaaacttgtgtctgcgacgcagaaaaggtcgttttgttggcatggtcactctcggcttctcttgtactctcctttgcaaccatcgttcaggccttgggaggctgcaatgtttccaacgatctttgcgaggaaagaggggtcaagatgaatactaattgcaggaagaggagagaagaagatgatgagaaatgagcgatgtaggcgctgaagttagcgaagtgattgacgtaagaaattgaagttgagaggcagggtgtttctatgtagcaataaggaaaagatgagagaggtaggatgttgtacgaggaaggagttgcttttgtatcatcaaatccaaaggaggggtacgccgctttcgtatcaaggtgaaggctgacaattgtgcccctgagatg

SEQ ID NO: 5842 - DNA, 700 bp, Nannochloropsis_gaditana
aaacgacgaaatagtaggtcgtggtacgcatttttgcttgcattttgctggcgtcgggcttggactcgctcttcagactctcgcgtggggacaggcgagccaggaaagccttccgatcccacggtgccgcgaaatgtccaaaggacgatgagacgcgtgacaatcgcaaggacgctttcttcgacaatgccgcggtgtgtttgcaggcaggctggacaaccgtggaggcggtttgtggacgtgtctggtgatgctgcggctcggcgagaggagacgcgaagcagcgacgtcgtcgactgggaaggggaaatgagatattacgcatcttggacggaggacttgagggaagacatttcttcacatagttatgcctagcactcagagtctcgtcttccttccctgtggccgggatggagtttagggtggaagtctctgtcgtgaatcggggccacggtcattgtatccatggccgaagcacgcatgaggcatccccgttatcacgtggttacctgcctccctttctatccgacctccggctcctcaactggtgcatgcctcatggcgcgacagacaccggcttggtcacacattagctactcacatcgatgtcaagccctctgcattgtcgagtcccctcacgctatttattttcctacttgcactcttaggtctcggttcgcggcaactagccttcatcatg

SEQ ID NO: 5843 - DNA, 700 bp, Nannochloropsis_gaditana
aaagggagaggcacctgagaggaaatttggaggattaaatggtagacaaccggggagcatggggagagaggaaaaagggcagatgcgggagcaaggagggaaggtgagaagggaaaatgtgaggatacaagtcttagaagcacctctcttcgtcccttccttcacccagatgccaaggccagacggcgttcccgatgacttggggcgcaaggtaaagggactgcttccttctccacctcatgtactccttcccctttcttttattgcgccaactttctctctttgtgtcttttaaccattcttctctaaatctcacgctttttactatcttttttctctttttcgccgatttaccgcccccatataggttattgacgagcctgctcctcgacagtcccacccctccattataggtaatgtaatacattgccctcctctcttttttctcatttcctttgtgttccgtgtactagacatcccttaaaacgccattttttcctccgaaggcattctcacttgaccagtcaccttccctattgcatcgtttcttccagagcttcgtcaggcggccttggccaaggtcagcactcggagggcagaaagccttgttcaggtgagcagaatgggttgaagggatggtcgaaaggaaatacgagagagagggaacgacctcggtgtaaatttggttaaagtgaaaatg

SEQ ID NO: 5844 - DNA, 700 bp, Nannochloropsis_gaditana
ctgcaataccagggaaagaagggggaaaggcggggtgagagacatatagagtcgatgtcaggggacgaggagggtggaaggaggggtgcggtcgaagagagggaagatggacagagaggagatgaagggcaagaagaaggagaaggtgcacagctccctttccccctgaagcaacaacagctgacgacgggtatcccggagaaagcgccggcgaattcaggggctgtgggacacgtggaagggtaagtagggagaggatcctgaaagaggacttttaagggggcggggagatgcaggcaaccggagggatgctgtgtttctggggagcggggacatttgccctggcacataacttcggcctattatccactaattctttcccttctttttcttgttcaattgtcacgtcacttcctctctcctcaccagcgcctatgaccctcaggagtatgcctacatgctgccctctttacccttagaagtacgagaggttctggcattcgtgacacggtaagcgatgtgtgtatcaagcaggccacctctttctctccctctcactttcttcataagatcgaggactacgagtgagggttgaaccattcgactcagatcttttgctctcttttctttcgccgcttacgcttctgtcagctatcaacctcacgattgcgaactagaaacccccttgaaatgttttatc

SEQ ID NO: 5845 - DNA, 700 bp, Nannochloropsis_gaditana
cagcccctggtttttgcatctccaccacgcccccggttcgaaggaatggaggagcatgacttcgcaccgctcgcggatggaggaaagaacatggaaactggcaaggtaaagcttttcccccgccccttatctggtgtcgcttcccgtccatggcccccgccttcaggtttcaggaaaaggatgattgtgttcgcaaggcctcgctcggctctaatctttgtcctacctatggctacctctggtaatccctacctataggagcacccctggcaagggatggaccgcccgcaggcgaagctcgaaggacctgctgcccgtcttccctccaccctcccacctttctcccctccctccacctcttcctccccgtccacccgcctgcgagcgcgaagcgatcgagaactctcgccttccatctctgccccgcaacaacagcggcgacggccacagaacaggcaagggatggacctgcccacagatggaaagagcgagaggagcaaggagacgtattctagtggggcaggaagaggggaaagggaggcagaggggccaggggagctgccaacggaggaggagaagaagggtggtgggctgcaataccagggaaagaagggggaaaggcggggtgagagacatatagagtcgatgtcaggggacgaggagggtggaaggaggggtgcggtcgaagagagggaagatg

SEQ ID NO: 5846 - DNA, 700 bp, Nannochloropsis_gaditana
tctgcacctagcaccggaatcgtcgatgcctacactcactatgcgccactagctttggctaaatacctgcaagaagactgcaacgacgggatgcctttggtatttgccaagttattcgaacgtacggaagatgagggaggaaggacattataggattactccccgtagcattgtggtataaaattgtgatacaggaatcatgaagggcgaggagcattcgactagggagagactataaatacatatgagttggtcatctctttgtattccgtttatcggctccgccctctctgccctcgaagtcatttaagtaacaactcctttgccaactgtaaccctactatcagggattcccctgctgacggatgtatcggccaggcttgctttcatggacactcataagatagacgtccacgttcttgttcctcttccttggctggaagtcgtacctgcctgtcacacaaataaggagaggtatgtcttgaaggaatcggggaaatggtaagcacaagggcatgtcagagcctgtaggtctcttgtagcagaattaaatggcaaaaatgtaagatatgtatcttactatgaagctcacggaacatggcatcaaacaagaaataatcgaggtcggccgcatatgagctcatccaccaatgcctaccacagagctctagaggcatgcaaacgtgcgaacaatgagatg

SEQ ID NO: 5847 - DNA, 700 bp, Nannochloropsis_gaditana
aggaattagtacaataaagcgtcacgggcgaaaatatacgtgtcataatagacgatgcttgcgtaccacgtctttgttctgtcctaaatcattgaagagggcctgacgtagggtgagaagggactcgttgatcgatgcctagcgtgttttggagaaaggagtgaagggcattgagtttaatggaaacattggagcacttctaacttgaaagctctacggcgaaagtttatagttatatcaaatgctaggaaaggtatcatcattcccgtgccggaaaggactcgcgcactcattctgcactgacgtaccgtaaccctgtccttgctcctcttgatatcaatcgtaccaccacctgagcaactcttgcccccaccctttgcttttccacctttgccacctttccctgcttgcgattgagcggaaggggtcagctatcgaagacaaaaactcagcaagctatcaagcgaacggtgcgagaatatcagcaagtgccctacctttcattgacataatgcttcgattggagctttgacgaggatctgcattatgtttttgatgtagaagctcatactttttttttcatcccaattagtttgtgtgccaaggcttcacaagcagggtttccgtgcctgtcagtggggaatttttcatattcccccaaagcgcgcgaaaacccgcccccgtgtcgaagcccgtcatg

SEQ ID NO: 5848 - DNA, 700 bp, Nannochloropsis_gaditana
taattatcatattcgtttagcttcttttctagcatagtgttaggcaggatgcaacgaataagcatcaaacactcccatcataaacctggtgccagcccgccacagtcttttatggacagccttcatggaatattattttgctttaaggtttgaaaaatttggcaggacttaccatcagtaggtgctcgacgccaagacaaagagttaaagtaatcaaaaagaagggggggacgtctttctctatattcagataacggcctcggagcgtgcacaaaatcgaattagacaagctttacagcgtaagtgagcgatgctatgtcgaaattatgatgtatgatacaagcagcagcatttaaccccaaagccagataaatatttacccccacggccaccgggagggcaagtcacgaatacccccgagtaacggaaacacgaatttccaccgttaggccgccttggccggctactccagtacctttgagtccacttaccctttctttaccacgaacaacatgatggagggcaggttagggtccttagatacgtacagcatcgtttacgaggaatgagcgcatgtctttgtgagtgaggatcaggtttttcggtcgcatacttgccgtggggataatactacaacagacgggacttatctgaagacccctcgagtctcgacggaggaaataggattccttggacaatg

SEQ ID NO: 5849 - DNA, 700 bp, Nannochloropsis_gaditana
aagcgcggctggttgctgcccttgagaattaatgagtaaagtgactgagtgagtgtgcgcccgaacgcttaagattgcatgagcgtcatgaccggcctgcgtcccctgactctaccctgcccctacatctgcctcgagagtcacgtcaaagtcacgcccccgcacccgcatacccacatggccctccgctttatggatcccatgctccgtacttcctgccacattgtcgttcacgacaagcgatcatgctcttcacaccgcggggtcgcacaagactgcggtgatatgccgggtgatagcctccccccgcgcccaaaaccaccggggagacctcagacacccatccgattaatacactgacaggcagcggccagcgcctcgctcaagtcaccaaataacagcgaagatgcccgccaaattggtttcaaccccctcctgacaacattcgcgcactttggaccgcgtaggacgtggacgtggggatggaatggacaacgcaatggctgagaacgggatgtaatggaatgattcgccctctcggcatgtccccacggggtcgggcggagaataacgtgaccttcagcagcagtcaaatcagcagctccttgagcagtacccacgacacgaagcggtactagttttgttaggtcttgcccttgcagggctctgtctcacgttgctgcttgcattgccccatatg

SEQ ID NO: 5850 - DNA, 700 bp, Nannochloropsis_gaditana
caaagcactatgctccctctcccgtcacagcacccgcttacactgataaaccacacgcggattacttttcgatgcaagtgcaggaatttgtggagaaggggcacacggcagcggaggcggagaaagctttgcacgaagcccggtacgatgtggctgtcgcggcggcgatactggaaggaaggaggccgtccgtggggaaggcaacctccgagtcgcatactatcctcgagagggagcaaaggacgccaccaacagaaaataccgccgtggaaacgtcccctaccgattcattccgtgcgggcccagtggtacggggacgtcgcccccccccccccctcccgtccctcccttcggtaccctcgcctgcacccccaccacccccactccctccattcccgatgaagcacaagcgcctctgcattctctggaggtcagtccagaagccgccactccttctccaggcacggtctccgcctcccccactccttcttcgcccccccctccccccgaggcacctcccactcccgcccccgccccctcccctgctccagaagaagacaccgccatcccccccgcctacgtggacggcgtgaatgccctgattggcaaagggctgagtcgggaggatgccctcgagcttctgactctggctaagggggatctccccactgccttggagatcctcgaccaggacgcgatg

SEQ ID NO: 5851 - DNA, 700 bp, Nannochloropsis_gaditana
aagaaaggaggggcaatgaacggcaaagagaaggaagaggcagtagaggagcgagaggaggaatgggaagacattttgtaagttttaaaaagcaagtaatgtaaaaagaccggaacgcaagcgttattgaaaaccatctagggagaggggtgtttactttggaatagacaatggacgaatgatggacattcgacagcaaccgcaaaggaccaaaaactgcctcaaacgaccaccgcatcatttcaaaacgcgaccgcttttcaaacgatgatttacccttccgaagtgggtatgcctcgaaaacccataaaaaggggaaaaaaagccaaggaaaagtccgttaggtcgcctccgccaggtgtatcttgtgtccaaccccgtcatgccccttctccccttccgtatagcaccatgtcttggcagtaaattgcccattattccaccgtacagcttctggatagtgcggatatattattaaatcacgcatcttatgttggacccttttgtgtcgtaggcaggtgtgtgaattgcctcaatgcatgtcacgaggtttcagctgagcgtccacccgatccatgaagccctgctgaagttggcaacgtaccatcacacaggtctcaacaaattacatgattattcgcgcacagagcacagttgtcaatttttctgcaaatttctttcttccacatttccaaggatg

SEQ ID NO: 5852 - DNA, 700 bp, Nannochloropsis_gaditana
gggagggaaggagggtacaaagaagggaagggctggcagaggaatggaccgggggggggagggttttggaaaggagtggacgtacggggctgacctttgcgctcattcacggtcctttttccctcctgatttcccgcccggggaacccagcaaggacgtctcggcggagggcgtgagggttcaagtctgcgtctttgcctttgacctcctcttcctcaacggccaatcttacgtgaaggagccgctctcctcgcgccgggctcgtctctattccttgtttgggccgttgttggagggaggggagggagggagtgagggaggctttgaaggccgctttgcgtttgctgcacacacggagacgaatgaccccgagaaggtccaggaatttttcaccgaggcactggaggctggctgcgaggggatcatggtcagaagcgagggagtttgagatggaggggaggagggaaggcggaagtagaatgtgcacgactcaagatatgggaaaacatccactgtgagaagagtgggagtaaaagtaggagcgaactaggctggggtccagaggactttacggaccccccctcctcctccctccccgtatcgcctccttcatccctccgtcctcatccctcctctccgctagaggcaactcgagcttgtcagggaatctaatgtcgtgctactgccacatgagccctca

SEQ ID NO: 5853 - DNA, 700 bp, Nannochloropsis_gaditana
gccgtgagaagcccgaggtagagaatgtccgacttccgcagctcgacacggaggacagagcagtccaggatcaagcgcaggcccaaaatcttacagaggccatggaggacctaccagatctagaaaatacagaaggaaacaggtcgagtccgggggacgaaggcatcgttgccccaccgcctgcttccacggccccctcctcgccctccgccagtgccctcaccggcagccccgtcgatcttccctgcacgcgttacgacgccgtgtccgacgcctgctggagcgagaagacacccgcgccgtacctgcacctagcctgggcgttcgagctcctgtgctcgaccaccaaacggctgacaaaagccgacgtgctcgtgaacaccttccggtccctgatcgccttggcgccttccgacctcctcccagcggtctacctctccagcaacaagctgagctcctcctttcaaggtatcgacatcaatgtgggcggatccaccgtctcggcagccgtggttcaagccacgggcacgtcgtcggagaaactcaaacagctgtacatcgagctcgggtaaggggcccagaggggaaggacagaagaatcacaagcgcgggggatgcagtaaatacgagattcctctttttagcgacgtgaagccatggggtgggggtggaaagggagggcgggacgtttccattcatg

SEQ ID NO: 5854 - DNA, 700 bp, Nannochloropsis_gaditana
tgatggtgccaggctgtgtcacgaggcagaaaaccctgtcccgggggaggaatgtatgtctttcgggggtttgctaggataatatactggtcttcctcgcgatcgttccatttagtccgcgccacgtgcttgacggctgcgagtgctcccctctcaagcttgtacttcacgattccaactccaacctggaaaaatgaagattttttttgaagacttacgatggtacatattagaatagggggaaagctggtagaacgaaccttattcgcactgccctcaatgcccagaaagtactgggaaggcaacagatcctcgcgcggcagggggaggttaccctctatgccgctaatcccctccccccccgaatccatccagcgtctttcgaacgaaatatggtgctgtctacgcggctctgtgcattgaaagtgccgcctcatccatgaaacactttctctatatgtgtcctaccacatcgccttgtttcgtttcgccccctcgcgctctgcgtcctcctcgggtctccctcggacttcgaagactcgcctgaaccggcggaggtatgcccggcgattcaagagccgtgtgtgcactctgctttacatcgtattccgcttctcttttgtacatctactccctgtagaaccagccagtgattgatatctcactagtctcgctggacatgactcctgccgcgtcagct

SEQ ID NO: 5855 - DNA, 700 bp, Nannochloropsis_gaditana
cctgaggacgagccttgtaggttgtggtgcgtggtggttttatgtgggccgttcgaccgccggactttgacggcgctttcatttttattttcgaggcttggaaacatcatttcccagcaacaagtaatatatatacatatgatagacaagttgcagcggcgtctaggacggattttttgttgctttccaaagcctgtcactcaaagacagcattacccagtgacatcataaaagcactttcctattcggtgatgttatcactgggctgtagctcagcccacaccttgtgcacccgcacggcatcacggacttcaacgtgctatgacatggccgcatttgacagcacgcaacacatgcaccacactttaagacaaagagccatagcagtgattgacaaattgcgagagtcatattttatgagactgattgagctgtcgggaatctacgttcttcgtgtacaccattccagggctgaggtgcatcacattgtgactgtcggttagaagtgagtgtgcttctctgcttctggtttaagtaagttttactccgcaacggaaagtttgttcgtaaagcattatttacacctttgtgtcacatcgaaataaatatggcttcttttgatgcgatcttcttcttcatagtgctcaacgggttcgtaacgatgtcttctcaaggtttcctgtcttccattctcatcaca

SEQ ID NO: 5856 - DNA, 700 bp, Nannochloropsis_gaditana
tgtgtgcgtagatcagatttttgatagctttcctttccctgtagaagggtaaggtgggtagtcagtcgcgaggtagatggcacaacacgaaggacgaggacccctgcctgttcgggagcgctcgctccctcggccgctgggggtggccggaaatggcgcgaaaggaggagggtcgagggcaaggacagtagcagaaatgctccgaacagccgcaaggcggcgcctgaggacgagccttgtaggttgtggtgcgtggtggttttatgtgggccgttcgaccgccggactttgacggcgctttcatttttattttcgaggcttggaaacatcatttcccagcaacaagtaatatatatacatatgatagacaagttgcagcggcgtctaggacggattttttgttgctttccaaagcctgtcactcaaagacagcattacccagtgacatcataaaagcactttcctattcggtgatgttatcactgggctgtagctcagcccacaccttgtgcacccgcacggcatcacggacttcaacgtgctatgacatggccgcatttgacagcacgcaacacatgcaccacactttaagacaaagagccatagcagtgattgacaaattgcgagagtcatattttatgagactgattgagctgtcgggaatctacgttcttcgtgtacaccattccagggctgaggt

SEQ ID NO: 5857 - DNA, 700 bp, Nannochloropsis_gaditana
cgatctgcttccgatagaggcgttgcgtgtcgaggacggcgacgcagagcgaacattcccagtatgcgcgcccgacactggcctagaagatacgttcaacgccgtagtgggtcttaaaaaaggtatcggaggcgtgttcattccctagcacgtaaatacaactagatttagttcagtttttggtccccacgcgaggttgagagcagtcacctcacccgtgggccctctttaaaataatgtcacgggatttgctcgaccctgctgtatctccgctgcgtgaacctagagatcgacaacaacaatatggagtcgagaatctgctgtaatgttatctacccggtaatgacatgcgtgagaggggtgtctaggggacatggccggtcgctgggagagtttggcgagagactcggatgagcgagacggaggcgaggacgagacacgcatttcgacagacggacagggagggacccagaacgagttggccacaacggtcactcttcggatctcattagggacatatatttttctgcgctgtaagatgttgatactcatggccactgacattttacatgccgctcgcaaagctgacaagcgcgagcttacttcgtgtagtctgaagatggaagactcatcaacgaataaatttgtgtgatctttcaaggtgcaagcttaaccagttctcgacttggtaaatattatg

SEQ ID NO: 5858 - DNA, 700 bp, Nannochloropsis_gaditana
actggtggaaaggtttacctgaagctatgtgcacaaggccaacctcggcgcttcatgacctttcaatgaaaaaagttgtagatattgtctctctcagaggtttacatgtcgcatcgcagacataattctttatttcagggtttagactgactttttatttgtgaacctccccatataagaattagatatgcctcgatgctgccagctcgttatggggccagccggtgttggaaaatcgacctattgtaagcttttgcaagagcattgtgccgcacagcaaggcccagggacccagcgccgagctgtacatataataaatcttgatccagcagcagaagggccattcgcctatgcagcgcctgaggttgatgtgcgggagctcattacagcggacgatgtaatggagatgatggatctgggtccgaacggtgcactcgttcattgtatggaatatttattagaaaatctagaatggttggaggagcgtttggaggtctttgcagagggggattatctggtcttcgactgcccgggtcaagtagagctttactcacatatacctgtcatgaagcaccttgttgatttccttgtcaagggtccattgagcctctcagtttgtggcgtttatttaatagacgcacatttcatggtggatccaagcaaatttgtagctggcgcgttactgtgcctttctacgatg

SEQ ID NO: 5859 - DNA, 700 bp, Nannochloropsis_gaditana
acaagtaaatgtaggcagtggttggtcccgaggggtcaagggtcaaggcctgcgaatagcattctaacgctgccctgaactttttttcacgataaaactgatttccctcttccttccaatctaatgccgtcttcttcggcctctcagatggtggacggtgatcagaaggagatggtgaaatagttggtgacgccatcataaggctgaccggcaaaagcacctttgaagataagttaagcaaagctcacatacctgtagttccaccatcctatccaagtagaagaggaaaaaagttcaacaaataaaagtagacgtgaagggatatgatttcaaaaaagcgtaacaagatggcagactgctggggctctgggcttctcgggcttcctcgtaaattgcgcgcaatgtatcgcgttagcaattagaactgttgctgtcctacggctcatgacgagaaagcctccagtctgttacattcacatgcgccgccaaaaggcgggacagacttcaaactgtgggcgatgtgtccgcaggacgagcagggaggggcgagagccgtcatggggtagtgggggggcgtatccttccgtcaaggagcacttctacttggcccgacgcgcgcggttcctctccatgccgcaaaagcaacactcacgcgcgcgcctactccccaccgaatacagctagcaagggaacggcaatg

SEQ ID NO: 5860 - DNA, 700 bp, Nannochloropsis_gaditana
gcattggagctgcacaactaaatcgcaagaggcccacgacgccgccttgaccgcgaaacatactcagcgattatgcctacgacaaatttgagaagtggatagaataattgtgagtttttcccgaaagcgtgcgactttttccccttagagccttgattagctagagcgtgcgtggccggtctcaaaaagcttctttggggggaaggaaacagagccgcgcccatggtagagcatacttcgtcatcatttaaaaaaacgaagatgaagaataataagaaacaaccttgatggctacttgtagtcttgccctgtccggcgaatgatgcctggcaagtgttgaggaggccaagaacatggggcgtgaatctcgacgacgcgtattgtcccaatctcgccgccgccgcctactcgctcacaagccttggcgcggggatgaagaagaggaaatgacaagcttgttcaatccgcctggtatgagtgatcgtcttaggattgtttcgatgcacaatcaagattgcaccatatccaatgaaagtaagtcataaaagcatagcattggacacagcgacgtagaaaaaaaacctcccgattaccaacaagcttgacccatacatacgtcaacaggtagaacaaggtctattattcgtttggtgttcgatcttcaaggcctttcccgaacataagggtagacgaggttatg

SEQ ID NO: 5861 - DNA, 700 bp, Nannochloropsis_gaditana
aacgcaactctggaatgcatagagcggacaggcgggatctttagctgttgtagcgtcaattgcctgatgtgaatttcaggggtaaaatgtccaactatgcgtccggaaatatcccggccacacccaccttcccgccagtatgctggtaacaaacggggatgcaggtaatctagacatgatcttgtctcgcgtttttcaaatgccctgtatgattttcatgagctctaggtgtgtgagaccgtgagaaagatggaccgcacaagactgattgattgacaggattactcaacatgtagtttcttaaagtagacgtcaggcccccaaaacattgcaatgacagccgcctggtgtgctgtttgcatcttgagttgacgcgaaagagggtcaactccgcctagtccacgggggggaagtacacctcccacgtctggcgagtgacccccctgcgagagcgtccacttcctccctaagcatgctcccaattttacggacgatcagaatcgaatctgtggactcttcaattcgcatggacagatcttatttgaaccgcgtgccatgtctacaacagtctccaattgtcaatctctaactaacaagttgtaagcccgagcatcgcccggtataccatcttgagcctgaagttttaacaccatcataacacctatgctcgcacgcaatcatctcttacggaacaggcatg

SEQ ID NO: 5862 - DNA, 700 bp, Nannochloropsis_gaditana
aatggatgaaacacttctcattaacgtgggaagagcagggtcgattataccgtactcgcatacgagccataatccgtcttctcttgcttgtcggcgatgagaagcggcaaaaaaaatgtgatctcccgatcgaatgcagccactcttctctaggataaacgatggccggcatctcgcaagtcgttcagaaaaacaggaggcgagcatggccggagtctgctggcgagagacggcgagggcgagtggaatgagcgagttccgactcggacgtttcggggcttgtgacacggaaagcgattttatgtttgacgcgaaacctatgaatgcataacaatcacagcgcggacaaagctaggcgctgcagagaactcgagaacatcacgtatgacagcttactcatattcgtcgggggcatggcgaagaagcatttttcgcatcgaacagctactccgcgccactattgtgaccatcattgtacttacaaagtcacgcgtggacgctgaggacgtgctgagactcggaggtaacagagaaacgtgtttcggtagatcgcgggtccaatgggttgcagtgaaagggaaaaacaggaatctccatcacacacaaacctcccccatcaaattgatgttttattactacgcagatgaaattgatcatcggaacgtgccaccaatggggaaattttttaatctgagccatg

SEQ ID NO: 5863 - DNA, 700 bp, Nannochloropsis_gaditana
ggacacgtattttccttttacagacccctcgtttgagcttgagatcttctacaacgacgagtggttggaggttttaggctgtggagtgatgcagcaagaaatcgtccgacgagcggggaagggagagacgctgggatgggcctttgggctggggttggagcgtctggccatggttttgttccaaattcctgatatccgactgttctggtcgacagatgaacgcttcactaaacagttcgaggcgggaaagatcactacattcgctcctttcagcaagtatcctccctgctataaagacgtgtctttttggatagataaggtggcaggattcaacaacaatgatttttttgagatcgtcaggggagtgggcggagatttggtcgagtccgttgtgctagtggatgagttcgtgcatccgaaaacggggcgggcgagcaaatgctttagggtcaactaccggtcgatggagcgttctttgacgaacgaggagatagatgtcttacaggaggaggttcgcactcaaatgtcagatgcgttgaaagtcgagttacggtaaaacggtggtgacatgcagtccccatcatcaggagcggctattggctgtggccagtattgtccgctccttagtttggcatcgtggccctcgtcaggtctgagagatggtctgcggggacatgccggggttggaagcgagctcatg

SEQ ID NO: 5864 - DNA, 700 bp, Nannochloropsis_gaditana
tgctgctgcgtgcttgaagtccctgttcaggtctcgttctcgggcttcagatttcgccttctctatgcccgtgccacgccttttttttcgctctgattttccccagtgttttctaagtgttgaaacgaacaaataggtagtccaatagggcacttgatgagtttcacgcgattgaatagcttaggacgacgcgtagttaggtgggagtgctcgcctgcgctcgccgtcgtgcccctgcgtgagccaccgcccccgcctcggaggatacctgcctgcgagacacgtaccccctagacggaaggcggcgccgatgcgcctggacgacctgcataaaccatacaaagtacagtgacgcacagagtggcttatctttaagtaagtcgcactgccggaatgctgtgttgatcattcattttcctcttctcttacgtctctcaatccggccgaagtcagaccccgggaaatgaaggccatggctccaatactactcgcatgctgcatgtctggggctagcgctgccgctgcagctgacggcttcatgacccgttgtacccgtgcctttgtttggccaatggctcccaaaatgacgtcgttcgcggctcgtcgtacattttgtacaagacatgccctgatatcggcggcttcgactgtagctgaaggcaaagcacttgatggacgtgtgcacacggagcatccaatg

SEQ ID NO: 5865 - DNA, 700 bp, Nannochloropsis_gaditana
tgggttcggaggagcgatgatgcccacccacccacgcggagctcaggagtggcttcctccacctgccctaaacaccatgacggtccccaatgttgaattttttcttcttacttctttaaagcttcaggctctggaggcgacaaaagtcttctcgagttccgagatgtctcctgcaagaaggccgcgacgagtgagaaccccggcacggctcagcacgctgataactctctggggtttcgctctgttgatggcgcggtccaccgacctgatcgcagatgctgtctcccctgcacgacttctgaagacctttgtggagcagcagcagcagcatcgcgaaggtttgataaagacgaagtgggacggcaattattgttctggaccggcgtctttgtctaccaggtcagcactgcgagccagaaacgggatgatttctgcgtccacgtgcgcaagttctgtcaaaaaaggtgtagagagaccgattcgcattgtggaaaggagggcttttattgggggaggcgacggtggaggtttgacagacgtttggggtgtaagtaacgggaatagggggctctcaaggcaggtcagctgcttggccagtgatatgggtctgagtggacttggaggcatggcagcaggctatgcagccaaaagatttgggagattgttaagttttgcgtgtggcttcgtgctggtgtccatg

SEQ ID NO: 5866 - DNA, 700 bp, Nannochloropsis_gaditana
atgcacttgacggtaccttggccttgaactttgtgcacaaagtcgtatgcacccacgcgaaatctcgaaaggcttgcggtttatccgcagacgggtccttttttgggtctatatctgcttttttacgtgtaatttacatggcatggctttcttattgcgggctggtgtcaaagcacgaaaagagtacctgtggcatgacagtatacctcagctctctagcggtgggcttaaaagtagatgcttgtgtgcagggcctcaccgggaaggcggcaagaaggaatacaccgacatacacgcattacaggacggtaatgaggccttgtgcgcggaggactcgattgaaaatggcgggatgcggtcagagcaaaacaagacactgtcatctcgtgctggtgcaaagtgagtggtgctccaggtcgtcttcaccgtattttggacatcgcgatcgtgtaatatttgataatcccacgagttgctcagtccacttcaaactcttaccactaaatcttttcccaggaaaaaattgagggccatccggcagcatgtcaacccgctatcctcgctctatcagagacctgcgaatatatctgcgaaatgggtcgaggacgcttttgcgaaccccagtctcccgtttcatatcgacattggctcggctcgaggccgattttgtatatatatggcaagagaacaccctgacatg

SEQ ID NO: 5867 - DNA, 700 bp, Nannochloropsis_gaditana
cggtcgcgtctttagtccaacttattacgttgatgtggcttcgcaccaccatgcaataccaatacagatatgggttgccgtttgcagccactgttcagcaactttacaaggagggcggcataactcgcttttatcaaggcttgcccgtcgcccttttccaacttccactttcccgattcgctgatgttgctgctaatgcgtttatgattgctgctctcgattcgtttgaatcaacgcgcggcctacctttacctctaaagtccgcttttggaagcatcgcggcgggtacctggcgattggtattgacacctttggacgtggtaaagacaacattgcaggtattattcgttatgtgatacggacctgaactacggctgggacgcatgaattgattgaatagcggtgtaaaatctcttcaaagagctcactcactaacgcatacacaggtccaaggctcaaaagctttgccgcagctcgcagcgcggctaagaagagagggaattccttcactttatcaaggagctgttattcaagcagttgccacggctgcgggacactggccgtactttctaaccttcaattatttatcgtcgattatccccgtaccaccttcaggtgaaatttttccgcgtctgggtagaaatgccttcttaggtaattttgtggtgtgccaaagaaaaagctttcgggttaatactac

SEQ ID NO: 5868 - DNA, 700 bp, Nannochloropsis_gaditana
gatgtcaggcaacatcgatggcagcggcccggtcggggactggacagtactagctgacgaggtaaaggccagcatcccaaggaataaccctaatatggagaggcgtgccgagacaacaaaatcaagccgtcccgatgtaatcatgccctgcagtgaaaggtttcgtaacacagaatatgcgtgaccttgaccagttatccgggaatgatcagggaagacacgtgcaaccacccccctgacagagtgctgccagaggctgctcgctctcatcgctgaagtgcaagggaagcgcggacgatgtgcggccgcaagctgatgaggagtgcgtttccaagatgaaaaaacgataggtcatcgattatttagtatcctgatttcgtgaaagaattgctgtaaaggaggaaaaacgtcaagcaacaaaacaaaaagagccttccctaacctttagctagttcacttcaggcctgtagaacgggctgacatgaatccccgaatcccacatcattgacaacacagtactttaataatgcctttggcaaggagactcatggaatttttgttcatgcttttgcttgtggaaggcgacgggctggtcgcgaagatctttttccacaataaattgcctactcagctcccgtgttccacgatggcgtgttgtcgcagaaatccagcgaagaatcaaggtcgaaagggagggggg

SEQ ID NO: 5869 - DNA, 700 bp, Nannochloropsis_gaditana
attgtcctttgcacctatttgaacctctcacagattgattgattttttctttaattcaaagttgaagatacgttgtagggttgggtggaaaatcggagagtttgggtggaaggggtcatatcggtaatttacaatattaatagacggcataaatctcacagtctgtttgagagcaaataagagacgtccacaactcttcagtaggccgcgagcaacgtgttgtggggggatgtgagcgaagccattactatgttttgcaccggattcttccctttatatctgacaggaggtacaagatgtacttgagcttcacacacaaaattaaatgaaattcagatgagataccatgaatcaggcttgcaaaataacggtgctatttgatgtgtatcttcgcaataggcagactcaagattcattgattaccatcatatgcaagtgtacgcttccttgggactggaaattgaaagaaacctgtaaccgatgagcgaagagaaaaggcgaggctacccaattttctttttttcggctttgcatttatttttcctcttcaccgcatgactaacaatagaaatgtttcatgttgtgatacatttggaaaaaggtggaaattatctagttcgtagctctctccatcttggtactcatttatggcaactatcatattttgggggggggggtatgtagaacattgcaaaacatg

SEQ ID NO: 5870 - DNA, 700 bp, Nannochloropsis_gaditana
gcgcgcaccttcctcacaccgccgcagaaacgccatctgtgcttcatgtctttgattttttcgttgttctctgcgctgctttcgcagtagttgatcgttcttgctttctgaggttgcagcctgtaagttgagattgtcgtcctgaccaacctccccactctgcctgtttgtctcctgtcgtgcagccctcttggctgctttcttggtcgcttttttcaccttccacatctcttgtcgccacaactttttcgctacgcttttagaaacatctttcacgcgagacggttttcgaaataagaagaggttgccgcccttaactggtgttgaagaggacggagccgaggctgacggcggtgcggggatggataacgtgtcttcactcgcgtcgcgcacagcttccgctgcagagttggcagacctcttaggctccatttcacctagtgtaggttgcttggcgagatgttttggtcgttaatgagtccatgtagtgtgagtgcgtgtcgacagaggtcgagtgcgaggttgagcgaacgggaggcaaccctgtcgctggcgaggccccacattggaagacgataagcacccaagccctgaccagattttttgaagtaagacttgtttagctcgtgtccccgaccttccagagactgcatgataaatggaaggcagacgtgttatttagctcacaccactgattgcg

SEQ ID NO: 5871 - DNA, 700 bp, Nannochloropsis_gaditana
ttaagtattacgcgataggaagacagcacatcgaaatatgcagcccacgaccagagccacatccagtctagccgtgtccgatgattacaaataataagaacgttgtccttcttcgtgaaggtgtcgcctgaaatgatcaactttacccccccaaaattttcaagaagccatgctccgaaggataaccaataagcagctatcgttgcctcccatagtctcaatacccgtctcacaggtgcatatggcataatcagcaacgcgatggcaggtggaagcattaaaaagtggcagaaacagaaagcactcaggagtagcggaaaaaggattgcgattcctacatgaattcgattaggacaagtcttgcaggatttgttacttctcatctagccatggagtgtagggggagtggtcggcgcattgtcagtttcaaggcatcccatgcagagtgtcacacatggacaatgagcgagggcggcgggctgggggcagtcttagtagggcaaggtagggcggcatcacggtgctcttccgcgcttcctcccagacggctctcattcttgctatgcaagtttgtgcctgcgaggggtaatggagagaggtgtaagagtttacggttcatctgatgttgtatttttcacgtacaaaacggatatttattgaaaaaatagcaacagattgcttgctccctttctcgtagcct

SEQ ID NO: 5872 - DNA, 700 bp, Nannochloropsis_gaditana
aaagcgctctggctcgaccgcacttttctcgcggcactcgacgtgcatgatactagagctggctacctgcgagagaaagacaacccgctagctcccatccgtatacttccccgcccaacgacccattggaaccctgctttcccacggttgtgcgcataaattctgtcttgaccatagcgcacgtctttacgcgctcatttagcagtgcatgcgttcgtctaattgccttttcagcgtcacctcctggaggagggagaaggccatcgcccctaggcggactcaagatcatggattgttccatggtcattctaacagcctgccctttcctcgatactcacagagcaccacgctcggtggcggcattgtatcagttctggcgcttgtcacggacgctcgtgacgggcataactggtacgttcttctaatacgaggaaagatcgtattcgagtccgcctgcataaccgcttttaaaagctgcttcgacgtagttgacctgaaagccccccttgcccgcacggcttgatcatcgttgcagtgcagagaagcatctgagtgtgaagctaggtgcttgtcttctctgccgcaatatgccgctggtctgctcccattcccataccatcgacgcaagccccggtggtcgggccgtagagcaattcttcctcgctctcacatgtttcatcatcacgaccacagatcaatg

SEQ ID NO: 5873 - DNA, 700 bp, Nannochloropsis_gaditana
actgagcgcgtgtgcaggactatggcagacttgggggagggcaaggacgaagacggcaaagtgcaggaaggacgacaagctgcaaaaatggacaaaaagtttgcagcgtgccccacggctttggttcggtggtgcctcgtgtactttggcgttctgccgaacgagggcgagagatcattcacgcagatcgatcagtcatgccatgaccaggcagaggccgatggtgcttcgcgaggaaaggagcggctttcgaccttgcttgctcagcacgtcggcggtggcctccgcgtcgagacatggtccatgctgccaacaggctccggtctgggaaccagcagcatcctggtaggcaccgtgctcgcggctctgggtcgggcgtgcggacgggcgtacagcgtgtgcgccctcaaccacgctgtattggaggttgaacaactcatggacgttggcggcgggtggcaggatcaagtcggaggactggtcgggggcgcgaagcgggcgtactcggcacctggccttccactgcgtgtgaagtatgagacactgcccctctgtcccgccgtacgcgcgcgctgggagaggcatcttctgctaatctacaccggtcgggcacgcttggcttcaaatattgtacggtctgtcgtgcgacggtactatgcgcaaagccctgaagtactcgtcaccctccagggccttgtcc

SEQ ID NO: 5874 - DNA, 700 bp, Nannochloropsis_gaditana
gaagttgacggtcgggggaacaggggcggttgaaagccggcgggaggctttcaaggaaatgagggcaatgcgggttgcttggatggcgggcgagaaatggcgcgtgcgggaggtggccgctcattacgataagaccaccttcgcgctaatcaagcggcaagttgcatccgtgcatcgggctgtctcttgcggctctgcttccaagatgcaggtgggaagaagcgtcgtagccgaggctcctgcccggatcgatctgagcggcgggtggtcagacaccccgcccatctccttcgagctgggaggggaggttaccaatctcgccgttcaattgaagggacagcggcctataggagcccgcgtgacgatcttgaaggaccatgtgctggtgctgcaggctcggcaggccgacggggacgtgactgagcgcgtgtgcaggactatggcagacttgggggagggcaaggacgaagacggcaaagtgcaggaaggacgacaagctgcaaaaatggacaaaaagtttgcagcgtgccccacggctttggttcggtggtgcctcgtgtactttggcgttctgccgaacgagggcgagagatcattcacgcagatcgatcagtcatgccatgaccaggcagaggccgatggtgcttcgcgaggaaaggagcggctttcgaccttgcttgctcagcacgtcggcggtggc

SEQ ID NO: 5875 - DNA, 700 bp, Nannochloropsis_gaditana
aagaaaagaagttgcaccttaaatttaaggaacattgcgagataagtcgaataggcggatgcatgagagagaagggacgtaaggagtgcatgcgtagctgagcctttcctttctcatacccggatcgaagaccgtttacgagccgtagatttctcgttttgcatcctgtcctcccctttgttcctcaataccgcagctgagttggcctcagatacctgtgcaaattttctacacaattgttaaaggtgtcggtactttggccggagtagagtcgaggacttacattagtcttcacagccagtagctttaatcgtgaaactcgctcgtctccggctgtggatcggtggcacaaggcacacgtactcgtaccagtcgaacctaccatccggttgttcacgtgtttgatggtcttgatcgcgacagtatgtctgcatggtaatacggttgcaagatctctctggtccgagtttgatggtatcttttcgagtagtcagccctgtgtcgctctgacctcccctctcaaccctactcgctggcccagaccttactctgttataattagtgacgacgtacgcccgttgcgaataagactttgataaccacaccagcaaatggtactactgacgtgtatttttcactcataaatatgttgctgtacactatgaatccgcttacagaaccatttcgctgccgaatcatg

SEQ ID NO: 5876 - DNA, 700 bp, Nannochloropsis_gaditana
tgagtaataaccgaccgccccgacgcatcgaacgagggaacagtgtcgtgtccgtccacttttcccaagtaaacggggcaggaatttgacgctgtgtgtgtgcagtggatcggactccgtgagcactttttccaaggatcccatccacgccccaccacgagtcctcaccaggacgtatctgtgcggttccttccgctctgtgccacaaacccagcaacggacagccagccttacacccctctggtctctgtctttctttgagtgccgacatgtcttgtcttgctgttcaggtgttttgcccgcggtaggactcaggctccggagactacccctgcaccacgggctaagatcctcggcgcattgttcttattcccgtgtgccacatctcctcgcttacctacgcttccttccttggcgttactacttcctttcaacatttcgacgtgtcctcttcgtacacgttcgcaccaaaatgtgcctctgtacttgtcttgtctgcatggcaggaacaaggatgcgaccatgtccatgtggcgttccgttttttttataagctgcgcaagggtgggtgcgccgagcgctttgccacgcacaagcatgtatcaacaaacagcgcccctttgatttcatacaccaaagtccgtattctctcagtttaatactaaattgtgccattgtttcctctctctctgcacacgaa

SEQ ID NO: 5877 - DNA, 700 bp, Nannochloropsis_gaditana
gcgacaggttccggcatgtgaccgccactgtccagatacagctctaaagctcgttcaacattcccgcttcccgcgtccagaaagttctgagccacatgagggtcgacaccgtccccagccaccatcagaaacctgtccagcccgctttggtctggctgtgggtctgccataacaggcgttttttggtgctgctatgcgcgttgccttgtgaattcaagccccccgaaatgctttatgtcagctcaggatgcctcgccgcgctttgatctgtgctctttctcacttcttcccttatagtcgtccgggaaatttgtgtttcttgagtgaagtaattgaatgatggcgtgatacgggacatcatctcgagaaaagagttgttcctccctagtcacggccagtctcggcgacgcagcacactctggagggaggccgagagatactacgagcgaggtcacgcggggaactagggacgaatctttgccaagcaagggtggcaaccctgccatgtatcctcttgtggaggaccactgatgacacagggggtcacaatataggatcaatggatgcaggaagcagtcaagccgatatgcattccgggcaaagcagggcgctgaagaccctccgacctcccctccctctgattacgctcgtctcatatattccacattagtgacgctacagacattcatcatcagccatg

SEQ ID NO: 5878 - DNA, 700 bp, Nannochloropsis_gaditana
atcttagtcaatagagtcataacacagagcaaagcgacaataagggagaaccttgaaatgtacatgaaggcgtgtcaagcaagcacatacgaagttgtcttgtggctcgcaaggccggtgagaccagaccgtcttaaaagaagcagagacggggtcggaccacgggattggacgtcatgctttcccttggggtcctgtctcatccaagtaatcctcagcttaagattcgacgacctcggaaccaagaaaaatcttcgacccccacatggtacaccgacaagtttgaagcggtccttttcctttggcccatattccggtccccggatcctgcggctcgccatcgcccatgatccttcctcgtcaccccctcgcctcgcctcatcatacgtacggcggctcggcccgcatcctgcagctgggcagctttgtcaccttacacgccaggacatacctgcctcccgcatgcagccctccttctccgaaagagaagacgaggcggaatggcctgatcaacaacgtcggtggcctgctctgtacggccggctcacgccagtatgcaccggcatggaagaaacatgcgtcgagttcctcgcccacaccgagctgtccctcgtggttttgaggacgggtgatctatggcctccctgtcgtaatttttcttcctgtctcattctcttccagtcacaccacagcaacgatg

SEQ ID NO: 5879 - DNA, 700 bp, Nannochloropsis_gaditana
gaagctctaagaaaccgcatccggtgcctccccttagctccctagcctcctcccctactgcttgccgtccatgtagttttccgcctccgtcagcaccgccagcatcgacagatattacatatttaaagtctttctatagacactcccactcgccaccacaacgcgtgtctcacgtccgcagcaatacacagactttgggaaaggtcctttctaccagtggggcacgcatgcaggcaaccttgtcggatcgagagaagatacggtcaaccacccgagtaataaatttagcaagccaatatcttagaagaaaaacgggcacttcattttcttctgatttgtcatcgaccctttcggggcaggaagcatccaaaggcaagccctcaacttccaatggcgccaggttcggcactattcgcccagtaccccgtcaatacctgaattaccacgtcagacagcgtgaaaatggcgcctggcaagcaacagtgtctttggtgcaaccttttgtgagaggtctctggacagacccgcaaggtacccggccgggctatatcactatggggttctacagtacagagcaaggagcactggctgcatgttgcaatcatgccccccccgtatgggcggagccccttaaggaatccatctgttacatgtgtctagagtatcggaaaaaaatgtacaggtcgccattgcattgcag

SEQ ID NO: 5880 - DNA, 700 bp, Nannochloropsis_gaditana
tcggaaccagaagcttcaccaccggcagggctcggtgacctcaggcgtttgccattatcttctcgctcccttgcagcaccgtcggccaccgaagctggatgggatggagagggcaatgcggaatcatatcgctgcctattttcgtcgtgctcggacttcgttgtaacatcttctaggttacctccgcgcgaagaaggggcgtgagtcgaagacgctgctgctgccgatgacgaagaggccgcagaagcttcggaacaggaccgcgaccgtgacatactaaatatatcatgggattaagggacgtgataatacactgagtttagtgccaaggattcggctcaaagcgtcatggaagatgaagtacggggggtcatcatcacatccgaagcaggcggtggccacgggccggggccaagatgaggaaaaaatgcgcgaaacgcggcgggtcgcggtcggatgcgacgcggcctgggtccctgcaaaccaccgtgatagtcacacgtccccccgcccaacatgtcctctaatgtttgtttcatacacaggtagtgatcagtctctgaatgtttaagtaactgatttccaataaatgtaaataggcgaaaatacacaagggtccgctgacgcctggcttgcaacaggcagcagaaggtcatcatctatcacacgtgtctcgagataggttgccctcggactgatg

SEQ ID NO: 5881 - DNA, 700 bp, Nannochloropsis_gaditana
ccaaaatgggcacgcaggccctcgctgcgctcgatattcctccaatatgaagtatagtcgcactcgtgacaccacttgacactagcttgccaattggacgcggtgatattggtctcgttgccgcgatgcctgcatttgcatctgcctccccaggctcctcgtcgttggactcggcccttcgacccgccggcacgctgcacggggtgggccctaaaaatctgagtttctctcgctctgcgaatgaaaatgtgggaaagtgcggtcgagaattttgctgtgatgtcctgtgcctgattttttgcctgagtggcggacctggaggcgtgcaaatgcaccgacgcaagggattggtgtcggtcctgcgtggcatgcaagccaggcgtgggctaggctcaggagcaacgagtgaacgaggagggggttgcaacacgatcaaaccaaatgtgattctgcttgtttcggtcaaactctgggaatcttgctgtgtgtttgtaccaacccacgtgtgggttgctttaatgcgagcataaagtcatctgatctcttccaccgctattctacatccgatcaggcacgagactgcagccctctgtgaagtgcgggcgcccaaggcgaccctcatcgagcacccgcaatcacacacacgtcttgaaactgtgtatcatcatcggcaactccagttgccgcactcgcagccatg

SEQ ID NO: 5882 - DNA, 700 bp, Nannochloropsis_gaditana
ttgtgacacagcattattacaaagctccctaggtgaggggcatggcaagatattccgccggaagagggttgaagggtgaggaggttaaccgaaaataggaccatgaccacaatggacacatgttgtggatggcaacaggagttgaagaagtagtgaatagcacagaagtgtagaaaatgggctacggagatgtgacaaatgttatacatctcgttgtgacagaaaaggaaccgtcactttattgcgtttgatcccttggctttctcctggctcccagcgcccggaggccctctcccttgttcttcagggcctctgagctaccaaaaacttgcagctttgaatagcacaaatggatgttttcaacaaatttgacaccaacgtatttagcgtagccgcccacttctcacgcgtgccgactgactggggaattaatattgctctgcagaccctgacgacacgggaaataccgtgttgtctgagccgtcctgtatctccctctgcgtccgttcacttctgccgaccgctccaccttcatgttttgaaacacgactcaatcatatctcctggactaagaatagaaagcatccttcacactttcaatcaggcacagagttaaatctggatctctggcgcagacatgtctcctgtggaggaattacactctgccattttggccaaaggcaatgagataaaagaaatg

SEQ ID NO: 5883 - DNA, 700 bp, Nannochloropsis_gaditana
aacacagccccgtccaacaaaggacccttgacgcgggcgaaatcagtcagtccatcctttgattgcgacagaccgatgtgtccggacggtagattaatgaggtcggcagtcttattgaactctttcgacctcccgtaataccacatgttccacgagccatctctactttgccttaccaccgggcccgagactttgtagtcatcccaggccccgccgacgccaggacctagaatcttcccaacatcgggcctccccactggaaaggcatgaatcgtttgaataaacagaaggtaaaacataggaaacgacagcttgataacccgtctgaaaagagggcgttgatgcggcatgcttttagagcaaaataacagaaagcgagttggtgacgtcgttcgcgctgtgaccatagaattggaaaggaataagagaaaattaaaatgcgcttataaaatacgcacgatccaacaaaagagcccagtgaaatgtcgatgaatgcgatcgttcaaccagctactataatgtgaaagcgcaatattcggagatcgaagaatgcctgttgaaggcgttcaccgtatcctctaggtaaaaactgcacttccatgtccgagctcaagttttcccccgcgcttaccttccctcacgccacgtaggagtacctaacgctctcctcgagctttccttgatacacttacgaggtatg

SEQ ID NO: 5884 - DNA, 700 bp, Nannochloropsis_gaditana
caaaatgagttattcaaatggaaggaggactgaagaaccgcgcgtcagataccgagatggatctggaccttactttaaaatgttgaatgagagggtcagtcaaagatgaaagtcatgtgaatgaacgtcatagcttttttgcctcttgaccctccgcctggataacttttattcattttatcagcccaaggcaactttttctccatttagaatacggcttcttctgtacgtcatcgttttccattttaaaggatcgtttgcgggatcaaacaagccatttatcggtcgggggtcaggctttcattcaaaaaaatatgtttaatctatttcacaagtaaaatatcataacagcacgtctcctgcgactttgcgatcccaaagaaaaatgtggcgacctcctgctccatctcgggccctacgggggggtcgtcgtaacggttttttgaaaaatgtacgcatacacgggtgtgagctcatcttcacacttttagttataatgctccaagcgccttaatgattgcttgttctgtaattgctatgtgattcatgcgacaatcagaaatgagaaacgtgctgttcttcacttgtactgcgcgtgcacgtctaatcacgtagcaatttcgctcactcgcgctggcgtcactccttccgttttcgttgacacatacaggcaaggaacccaatccacattgaggacatg

SEQ ID NO: 5885 - DNA, 700 bp, Nannochloropsis_gaditana
actgagaagcctgctcgggcggcgcactgccgctagcggtggcacggctgtcgagctccgcgatcctttctgttaaggcgcttggaatgtccttacgctgcagtgcacgatactgccggacgtcgaggtagaattcccacacaaagacgatgaagctgaacaggatgagaagctccaaataaggcacatccgcctcgccagcccctttctgtctgtatacaggcaatgaaagcccagttccgaacgaccgtacgtgcgcccagcgatccgccgcgcccgcggctgatactgcaggcatcccaaagatcattgtcctgtgtgttgagttgtcgtgtgttgattcttactgaataccgtgtaaccagcactcgcccttggcgagtttcgggatcgcaggcaagtttaggatgtgcaccattacgacagagtccgcctgccctggttacagtcagatgcccttggcgcgagatggttatatcaatatgggtcctcgtgtaatcggaaatgaaagcggcgacaagttcatgggagataaggacaacaagtgtctcgaaccgacacgtccacttcttctgatctctttagcccttgctcactaccgcgcagtaggacagtgttccaacctcgtgaagaatccagaaggaaattttggcgtgcgttttcccacactcacttatctcgttattttttgttcaggatg

SEQ ID NO: 5886 - DNA, 700 bp, Nannochloropsis_gaditana
tgatcgcaacatccgtggctccgactcagatgagttccgcatgcatcgagaacatggtggagaagcttttcacaaagacgtacttcgacttcatagagcacattgatgggatcgacaatggaatagatgttgcggaaagtgatcttcggtataaaatacagacacacttgcccgggcgcgtggcaaagttaaattcggcctggaatcaagatggttcggctgactctttgaatactcgattttcccgcgccctctctatggtgactgctgagttcgtagatactttcatgtacctgtgcaattcatggtggccggctcggcggatagtcgctcaagcatttgaggagaggaatgcggtccacccaagcggcaaggtgctgcacctgtcctcgtactgcccgtggcaagatcatttgtttgaattggagcaggaggttggcctcccaggacacatcctttacgtcctgtacggcgacccgaagggaagctcggtgaggatacatgcggtccctgagaagataggatcttttctattgcgagcacccttgcccgagccctggcgagggttaagggatgaaatgttggatgacgcggttggaggagttcagggatgcacatttgtacatgctaatggcttcataggtggaaataaaaccctgaatggggctatgaagatggtgaacaaagcgctgtctccatg

SEQ ID NO: 5887 - DNA, 700 bp, Nannochloropsis_gaditana
cccgccgcgaagagggctaggccaccaagcacgcggtaggaagcgcgcttcgcagtgaaggctgtagcccttcccctatttgtgtgtgggagctgggatcagacaaagggctgcatttgacatgaaggatgagacttgtaaaaaaaatgatcgtgcagataagtccctgcctatagagttttgcatttttaatgtcgaacactcatctgcatcttgcttcatgatccttgggtatatccacgtttcctatcttctcactcacatggaggatgagaaggcgcgaattccagcagcccgtcgcagacaacgggtcattgtggtggcaaacatggtggatgtaattctagtggtggggctctatgatctattgcgtctggtcctgtaaacacgccgagagggggggaggttggtcgggcgttacatgtaccacgtagtagacatgaaaggaagtgttagtaatccagattgtccactcatcaacatcataatagctgtttgctcgcgtgaaggaaatattgcccctgcagattggctcacctccgcaataagacatgcgaggacgcgtgggagaagcatggttcgccaaaagctagcaggccgctgggagtggacggtctcggtcactttcttttgctcgccggccaagctacttccattcaggtctgttttatttccacatcaaaccacacatagggagatg

SEQ ID NO: 5888 - DNA, 700 bp, Nannochloropsis_gaditana
gccttcgaaacaaattcaacgccgtaatttgagtcataaaagttgtcgagctttgtgttgtccgttccgacaaggtatccatgcggaatagacctgctgaatccccctctatcgacggcttgctcctgcagagccctcatctcctcccgtgctgcctgagcagtatcaattgcttgcttcagcagcttccgggcggcatctccgggaagacactctcgaagttgggactgctccaccttttgtgccatattttacccataaagagcgagccactctgtgagtatgcggtgatgcgcgtcaaacaagcaagttgtcggaaatcgcttccaggcgcgttggcgacagctggaaattgaagacgcaagaggcggcaaccgacatcgttaattccaagactccagcacttaagtttacgacatgtgccatctgtaacagggtcattgtcgctactgtgcatggatccatgtcttcttcagccagaggctttttcgagtcccttgtccgccgacaaactcggcatcctcatgccacgataatacgtccctcgacccgcacatgctgcaagcaacttctcatggtgttagcgggcatgttggccatgagccaaagcttcatgctcaaatcaccgctacatgccgttttagacggcagcgttgctgtgtcggcacgtctggcccccgggggcatccgagtagtaatg

SEQ ID NO: 5889 - DNA, 700 bp, Nannochloropsis_gaditana
ccaagtgtctgcaattgtcgagccgaaagtaagcatcagtggcaggcaaggagagcacggtcaaaaaatagtttctgatacagaacagttggcggaaaacctgggtgagatgggcgtggaggatgtcgagaggaacagattagactagacgcacgatatcaatgcgtcgccctgagaattaatcaggagtattgacaaacaatctcgaaagcaaaaacaagaatttgacgatacagcgtaaaacttatttggctactatagaatcgaaaattattctatactggcttgtttcttcttggacttaagattgccttaagctcgagttatactcttcattgctttgttgaagctctttctttttacgttctggtaccaattttattcgctctttttaaaacacaaacctcccccccccctctcccgcgggccccgggagacaatctatgtcctactagttccgccatgctcaacatgtatcatatgtgtgcctgtacaaaaactctaacagactgggctcacgaatatggaagaggaatggaaacccttgcccaggagaggaacaaagaaaagacggcgtgtcaggcctgaaaatggcggggagggtgctccatgccaagatactcaagaggggcatgtgaaagcgacatgtctgggagaatctggccagccgccccagaaaccactagacacatcgcaaatg

SEQ ID NO: 5890 - DNA, 700 bp, Nannochloropsis_gaditana
gtcacgaagtgtagtgactcggtggcgggcgcgagcggtgctcggaaacctaaagctgaagcacggggcagagagtaagatcgagcgggcgacagaaaggcttgcgatgtggagagcgtagccagagatagacccagaattaagacagagtgcctcttgattttgcgttgctttgatgacgctgtccctgccttgaatgtcataggctatgactatattgcgtaagggaggaggctgaagtggttgagggcggtacaagagagaattagaaacaacacgcactcaaaacgcgatatcaaaatcacgtctgcgatatcttaggatgttatcaagggtatagaataaatctttgtaaattttattgggactcgggtgagaaattacggtctgggtagccaagtgaggcatcgacctcccctagcggcagccgagcgccctgagtggcctggcgagacctcacatacggtggtactgacagaaatgccacgcgacaagcaatacgttgacacagggcccctctgtccatcccactctatggtcacctccacacaccgcacaccactcgcgccttatctctatggctttctcatttccttccttgaggccgcgctcaagtcaacagacggacctttgtcctaccgcgactcacggacctctgccaatttgtttacacaaagttataggaacgttgcccatcatg

SEQ ID NO: 5891 - DNA, 700 bp, Nannochloropsis_gaditana
acagcaaatgctcgagggataaaatgccaagactcggcggattatcaatacaagcaggcaagggaggtaggtggaagacaaaatttgcactcgtcgcatcgtgcaaggagagctgttgcaaacgtcaagttcacttctctgccgaggctgagggcagcaagcaaatggacgcccgcaatgaaggagggcgggctacgcctgatgaacccaatgtctccagccttggatgaccatgacttgcactgcatgtaaagaaggggaaacaaggctgagaggtgctttttatttctaaatctcctgtgggtggcgctagggcggctggacaggttgtgcgaagcctcgcgaggtctcgacgaagaattcttagcgagcctttatgtctgcgatttccctgtccttggtgccgactccgacacacacacacgcactcagtcgcacggcttatgagctttcgctcctctttccgcatcgaatacgttcgctaggcatcttggcagccacggctgcatcaccaggcgcgcggacgtcttcgacgcggacgcattgagaacacaaacggcgagcactcacgcaggggacaacggaatgacggcggcggtgcggcatcaatccattcaacagcaagggccgcgagtgtgggagtggagcgtcgtgatttgaaggcaggcatatttatagcgtaggcgggacattcgaaatg

SEQ ID NO: 5892 - DNA, 700 bp, Nannochloropsis_gaditana
tccgtctcctgtaggcttaaaatgctgtcgtcccgctgtcgggcatgatggttcaaagatggtccagactcccccaagtaccaaggacgtttcgtgatgtattcggggttgtgcggatttatcatttttcccgacgccgcatcgatttcaggggcaaggttccccgcttgtcgcgccttcttttcctcctcccgctttttatattctgacagtccagatgccatggtttgctggaaagtgggacgggaaaaggcgtcaaagaaaggaatgtggaaaggcgtagagtgctgtgacctgtggtgtctcgcgagggggaggcgaggcgtgggaaggagcatggccagcgggttcactacgggagcggcatgttctatcatcagggtacgcattccatcataagggtacgcattccatcatatcgccaccgtcatcagcacgctccgtgggagctccaggcgagaggcatcgcccaaacccaacctcgctccggtcatcctcagaattccatcgagctgcttattccttcatgtcccgcgcatcccgtgcggggccttcataaaactgccctcatgtcttgacgatgactttaatttttgtaccgtctaaacgccaccccgctacccatcacgtctttgacgaacgtgggattgacctacagataccttcactctcagaaacgaggccacgagaagacaggatg

SEQ ID NO: 5893 - DNA, 700 bp, Nannochloropsis_gaditana
gtcgaattcctttaaatctttaacaaccacctggtaggctttttgaaaaaaaagaaaaagaaaaaaggaatgcattcaccatgtgataccaatctcaaatgacccgatgagaggtcgcaaactttcaggatgctctacggcatcgtgaagcactacgggcagtatatgcttgaactcaactttccaccttaatttttttctgacgcgatcgcgacgttaagtagtcacgtttgaaagtgttttcgggttatatatgcctggcgccggattcttgggccataattgcgcccgaaggaagaaatcaatcataaagatgcgtgtaggcacctaaaaagagtaagagattgggcacgacttgtaccgagcaacaagagcaaggctttgggagagggacgcttatccacggatatccacacattaaaaaaactcattacatgcatagatttacacttgcatcagtactttttatataacgacactaatttgaacgtccgtggcacctttgtctctcttgtatgtcgccaaagggcatccggcgagaccccaggagccccacaggcaggcaggacacgactggtccggccgcaaagcgtttgtctcgcgtcgtcaggagtgacttctgatcccactcgcatacgaatgtgcatattcagtgctcactcaagagagtcatttcttttgggtaggtcaaattgaaatg

SEQ ID NO: 5894 - DNA, 700 bp, Nannochloropsis_gaditana
aagcgggaacgaaagaatgatgaagaatctcatttaaggacagatgaaaccattttaaaggcgcgcacggcacgcgacggattggcttggaacttgatgcaacgaagatcgcgtgatcgtttacaggttccaaaacacgcattatgtgagatccattcataacccaccggtcgtcttgtaagatactcgttcgaaatgtgaaaagaatcgtctatcacgaaaggagaaggaacgcgaagtctacatcttgccgggatagcgactagaagtcgtgcgcaccccggtcccgtcgtccatgcctagttgcttcgatatcattttgaagtttccttagggttacacaccatccatctccccaaacccaaggcatacgaattcccagcaccaggcaagccggggtgtcctggattcagggcatgggtcgtgaaggacggcaatccttcccatgctcgtcgcctgcttcaactattccacttggggcgagcgctgcaaaaaggaagcccaacaaaacgcccgccggcccgaacattccggtggaaaatgtcgtgggccgacgcattcatcttcactgctgtctaccacaatacttgaccgaagtcgcacttcattgtttctcacaagcgcaggggtcaaggcggagaagatccctcaagcatcttgaaacctattcgtcacggtatcccttcgtcggcaaaccatg

SEQ ID NO: 5895 - DNA, 700 bp, Nannochloropsis_gaditana
gttttctgaacttcattgcacactcattgcaacatgtatgaatgtcgacaaggtatacgtagtctattttttctttctctgttagaaaatcacaagggaaaaaaaaagtctcttctggtaaaattaacgggacattcaataaggaagtcagcgcggggaaggagtgcgtgacattgcgccagcggatcgatcgtttgagcgagagggacgagaaacatcactactcaccttcctctaacatgaaatcaaaaaagggcaaatttgccgctttaacagattcaagcaaaggttttgtcgccaattctgcctgaatgctggacattaatagatcatgatcctcgggaaacaaaaacgactgcaattggaattaaaattaatctcatagcggcccgggctctcacctcgtaactcccccaacgacgagcgactgcgtgatcgctctccttcgtcttgcaagaagttgcatgtcatggttttggatttctcactttgcggagacagcgccgcagtggtaccacactgtttaaggattactttacgtgcaaaggttttgcgtatcgtaacacttgacctgtttccacaacttttgcaggctctcccccaaggcttgaatcccatttttaaccgctgctggttgttaacttccagtgatcatatcagaaaaccgtaagcgcataattcagtcaatatcgtggacatg

SEQ ID NO: 5896 - DNA, 700 bp, Nannochloropsis_gaditana
caaagccgacctccagcgataccggccgcactacctgatcgtcgtcccccgcctcctggagaacgtgcacaggtccatcaaagacaagctttccgccggttcccccgtccgccgacgccttgtcgccaccctttccctcctctccctcctctacacacgcgctctcaaacaggccttgggcctggtcgtccgccgtccggcctcccacccgcccaccgggtcccggcggcatctctttctcgcctcgttcgtctccacacttagacgcctcgcgtacaggcccgcggccgccctggccacgtgttttctcctccctggcgccctcctcgcagatttgttggtctggaaaaaagtgcggcaggcccttggggggcgtcagaagctggtggtgtccggcggctcggcactggcacgctacctagaggagttctacgacgccgcgggcatccccgtggtctcagggtacggtttgacggagaccagcccggtgattgccgtgcgacgggcggggcggctgcgaaacctggtagacgggggggtggtgggtttcccgcccaaggaggtggagctggagatccgggcattggaggatgagagggagggggctccagagaagagaagacaggagaggacgcggaaggaggtgggtagcgcggaaggaaaagtggggatagtgttcacgcggggccctcaggtgatg

SEQ ID NO: 5897 - DNA, 700 bp, Nannochloropsis_gaditana
gctttgcatgcgcacgggcacgagaccgagtacttgtgtcggtttggccttttccataatgctaaagcatgaaggatcctcattaaagggaggtcagaccgttatttccatcccacaaatgcaatcaaacttggacattatcccgggagactcgagtctcgtttggaaccctccacattcaaccaggcaaatgcggctttcttacaacgaagaccacaagtttgactaatttttttagctttatttttgtgatgatgtcaacattcccatgtatagttggctaaaattagagcgcgatgaaacttccaggggaagacgacggagattccgactgcaccagctcacatcaatcaaggacctctctgagctttttgccatagccatatcactactcattgtgcgcgatattttagagtttcttcaaaactttttgcggctcttttgcggcgttgtatcggacaacttgagaaacggtgcacgtttagggtccatgtgcctctctccccagacttgtccccaccctgagtcctcacgcacagtgtcgaaacccgccacaggatcatgtgatgtacattggaagcataattgtgcaacctgagagcccatatcgagcctttaacgtcaatctttcacatcgctccccccctctcccttttttcttgcccccatagtgtcccgtcgcgtgtgttcctcggaaatg

SEQ ID NO: 5898 - DNA, 700 bp, Nannochloropsis_gaditana
ccagaatgcaagattacccatcctcttctcattttaagaggcaatcactccacaactaacatttgaaatgaagtcttgacgacgccaatgcattcaaaaaggggatgcaatatcaaaactattattttgcggggaacgatgacatacccctgtccctgatatcattttctctttaccctcgctctattcccccttgctgtggccatgaaaggcgtgtcccataaaagacttgcaagtggcaccaagaataatgtgcctgtgcacacgaggacgcgcaggcatggccatgggatggacacgcgggcttgcggaagaccaagaaggcagtagggctagacaggaggttcccccatcccagctcggagggggtacgtctcgtgtcgcacggaaaagctgggagggctttgcatgcgcacgggcacgagaccgagtacttgtgtcggtttggccttttccataatgctaaagcatgaaggatcctcattaaagggaggtcagaccgttatttccatcccacaaatgcaatcaaacttggacattatcccgggagactcgagtctcgtttggaaccctccacattcaaccaggcaaatgcggctttcttacaacgaagaccacaagtttgactaatttttttagctttatttttgtgatgatgtcaacattcccatgtatagttggctaaaattagagcgcgatg

SEQ ID NO: 5899 - DNA, 700 bp, Nannochloropsis_gaditana
gctcgctgggatacgattctccgtgcctcctcggacggtaggcaccctggcactcctttgtcactgtgcaccttacctcatctacagaaagggcggccaacctctcgccagcctcgtccgcatccagatccacgtatcgtgagccccgcaacttttcatagacgggcaaggacgggacaggaaaaggcacataaggacaggccaggtcgtgagcaaaaataaagacaccccgtacttaaaatttattgccaagaccggccaaagcttacctccttcttgttcgacgccatagaccgccgagaataggattgctgggagaacttgtggatgttaaggtcgtgtattgagcttcagtagcgccaggcgtgaaaaagaacaagtcgggtcccgggggtgtatccagatcggagcccgctcaggcagaggccagcgcagtatttgctgctgcgactgcgcgacaaaggactctaaatgcatcccttacagtatgtgcattgtacgcatcgcatttgttgtggggtcttacttattccctcgcagtcaatcacctcgcgagcgaggcagtggtggctactcgcacgtcctcaatccattccagtccacttcaactccagcgaccgctactgtacttataatcatacacgtcgagatataattcacgtaaaaattgccatatacacccacgcaccagatgcctctg

SEQ ID NO: 5900 - DNA, 700 bp, Nannochloropsis_gaditana
ccgcacgctggtggaggtcgtgatcgctgctcgctcttgtctgccttgctgggccttaatcgcgctcgtctctcatttttgtcgttgcagacgtcccaaccccccatatgtgggaaattttaacctgccaagcctggtaccgggagtcgattgccaatctcgtttctaagtatctaattttcttcgcttttcttcttcaaccctctcaaattcaagcacaggaatccatcaaatggaacaaagttctgcctggctagactttcgccacaagcactaggcatcttcctagaagtttattcgatccatttttatggtggttgcattacgcgggggaacgcttcgtcccagctgctcgagctcttgtttctttccagcaagaaagaggcttctggcgagggttcttctccttttcatcctggcccctttcctgcaagcacacatgccttacggtataagtgtggctgcaggcagtagatggctgtcccttggtaatgcacaactgtctgtgcactctcgcaatgacctcacgacgcttatacttcgtagtagcggcaaagggggatattctcgccgggcttaccaccaagtttcaggagccttgtgcttcatttccgtaaggcctcgcccagctttcctgccgccatcgaccccacggcgaataaaggggtgcgtgtcccccattcatgtgcccggtgacatg

SEQ ID NO: 5901 - DNA, 700 bp, Nannochloropsis_gaditana
ggtgcattcagcacggaggaaaacagtttgtattttaggatggaagccgacacgtaggatgagaccacaacattgatgagattgtatacagtcaaaacttgcttaagttgatgcgctttctcccgacgtcgcatatgagcgtatagaccgcacgtaagaacgaggtatcccaggttcatccaaaccaaaagttgctcttggttctcgacaacgaagagatttattaaaggtgtcgtaggctggagacccccagctatacgatgttcgtatgcggtttgggcgatatgcaagctctctgtagcacgcctgtaaagggttcccataaatggtgcagcaagcactcccccaagggcaataggaaggagaggaatcatctctgtgatggagtcgtcgagctgcgaagcgctacaatggaagttttcccgacggcgctcaaggtaccgcaaaagagctcaaagacctaccctgtgagcagatgcatgggtcatattatcggtatgatgcggataccaggcccctaaaacaatgtttgtcaacacgacggggtcggcactcgggctcggacctctctcacttcaataacctcccgccccccggtccaggatgactagcttccgcgcatgatgccgcaattaattctgaaagctaatgcaaaatggaaatatctttcaaatttctcctacaattactaaggatcatg

SEQ ID NO: 5902 - DNA, 700 bp, Nannochloropsis_gaditana
cttgagtgcgaaggcctcccctgtacgtctgtcttgagcaaggaagacgtacccaaagcctccctccgcaagctgtttgacgatccgcaccttgcgccctccatccagaacaagtatttttgcccacagcaatccactcagccaagtgagcagtgctgtgagtgcttcgagtaatgcgtggatgtaggcaacaagagactgctgcatgctatgatgaccttcaggggcaagtgttgacacaacggctttgacgtggtcgcgtgagtccgcggggactggccaacgaggcaaaattaattggcggcagcgttgccgtcctcgtcacgcttcacagcacctgaaacctcagcctgtgcacgtgttggtgcgcataatagtgggtgaggtttgcttctattatcgccaagaaaccctcaagttgcgcatgctttatgcttcctttggcaatccataaagcccttggaaaggcagggcaaggtccactttcggcacgtcttttgacagctcttgccatggaattgcatgtgctttccgcgttttgacgtcaaaaagcgtgaacttttggagagtgatggccgagtaagacgcgagcgacggcgagtcgcagctgattgacatgccatccgtcgttcacctccaaggtcgatctatcatgccaacctctgacaacatcaaaacatacgaaaaataaggtgggatg

SEQ ID NO: 5903 - DNA, 700 bp, Nannochloropsis_gaditana
taataaatgattgattttaaattaattcgtagacaacattcgagttggcgtcgcttatttttggttattgtcctagctttgactttttggggcatacacggggaggatatggggaggttaaccgccttgtccaacacatacaaatgcttttacgccgtcaaaaagctcctaaaacgtgaaataataataaacactacacccattactaacgtttagcgttttgcttcgtttcgcgtcgcttcgtctcgtatcctgctccccgtcgcaaggcgtcttcggcagcagggtaggacctccctgagggggagtccctgagacagtctgtgctcccacccggggttggcgggtgggtggatggacgcccgacagcctccgtagagggctgcgtgcacggcgatgcgctgattcctcaagcccctggatctccttgcctgtgttatgtcgtgctctttctctcttgagcttgtgtgtgagttcaagcatgaggcttcgaccctgagggtcagattagtggtggggaatagaccggaagggtggaaggaaaagagcgaaggtgagaaatgctttcccacgcacatagtcatctctcttttgttacactgcacaaaaatacgctttgtaggacatcgacatccttgttgggttaagaggaaagagggactaaggagggacttcatagtaccagaagcttctcaagatg

SEQ ID NO: 5904 - DNA, 700 bp, Nannochloropsis_gaditana
tacccggatcctcctcgtttccacacacgtacgcccccccccctcctttgcctgcgctctagtgatttggtgcaagcaccttgcaggagacatcctgctcttctttcttcatgacgtatctgatcccagcgttgtcttgcggcccgttgggctgggtggacgtgccaacgacagaaagcaaagcgctgacgggcaagcgcaggcgatcatatctcgcggcattatggcattattatgagtacagctcaacacttgctctccctctctcattctttggccaattcatacacattcatcaggcgatgccatggcgtccgcgcatggcacgtccggcgcgaattttatgctcttgagcggtggcatgggagatggcaaagcatttcgggaggcctcttgcccttgtcctccgtttcaacactccagtccgacaaccaagctttaccaaaaccaaggtgggcgtggtgaacaaactatgcctgtaacacacctagatgtactgccgcctcgcgttcagaaggtgtccatattgtcgaacaatttcccccagttgcagccgaaggcgggctcctactgctgcaagtgcggttgtccacgggctgatgtcaggctgacatgttgcaatagtgtcgtccatggccgttgtgtatacccatggcccgtgactcgctgcccgagctgtagcatggacgggaaagagatg

SEQ ID NO: 5905 - DNA, 700 bp, Nannochloropsis_gaditana
gggatatcaggctttgttaggtcactttgcgcaaggaagtgcgaagactggcccactgggtggcttgcgctcggggtgccgagtgaaaaagccgtgcggtgatggggaggctgggcatgatcgtcattcgcgcattttctccctcccttgcgcttttgtgtgcgaccataccatgcatagccgtcgaatgcgaaggccgacagggcaagagcttttgtgctccagcgttaataggaggctttaattgaaagtgcgtatatgaggcattaaatacctgcacctggaacgttcttctttgtccccaaatttcgaaccactcatcgatctgaatcccatttgattcatacattcatgcgctaacatggcacaggaaaacaattgacttgaagtgcaacgaggcactcaacaaatgggaacggaagtgctacgatattgaaaatgttaggacattccctatctagcttgatattcgcattgaaggcactgggcagttagaactgagagcagcatctacttcactcttattccgaggattcagtggccttggaatagggccttggataaggggataaccatccacctcagatttttttgacaggagtacaacaacatctgtctctcctcacatagaagagcggcagtcgcgtaggaggatatcacttcctatcccctcgcgaaccagcttcaaccttgaagcatg

SEQ ID NO: 5906 - DNA, 700 bp, Nannochloropsis_gaditana
tatgcgcgacctggccgtgaaggcagccaccgcaggtgcttgggaggctggcctcattgtatgccaggaatatctgcggacggttccaggaggaacggtcggaaaaggggaaagatttttacctggaatgcggcagagaggccgtacgcctgcgcctgaggtgccgcggtggtctgcttccgtcgtcgaattagaggcagagatggtagaggcgacgattctggcctgtcagcgggacttgcgagaggcgcaccggatgaatgagcacgccctcctttcgcgcatgtgcacgcggctgtgggagctggtccaagagatgcaaagacggcggggccttgagcttggtcgtcgagcatgggactcccttgtgcatgtgtgttccaaggcgggcaatacccagctgatcagtcagatgatggacgccgtggcggtggacgagagggttgactcggggcattgggcgcagcgacacgcggctttgcgacgttgttgggttgaccgggactgggcccgggcacgcgcgcttctgggaagttttttggcctcgtgcgggagggaatccccgccggagtcagacgagctggtgacgatggtcttggactgtggccttcgaggtgacctggagcaggaggccctggccgtgtttaacgcctggtgggacgccgaccccagcttctccccgagctcgaggtgccgcgta

SEQ ID NO: 5907 - DNA, 700 bp, Nannochloropsis_gaditana
gccataatatacgctgtgtatatagtaaggtcaatcgttatgtggtcaaaacccgtgactttcactacaccaagtggtgattatttggcacggaaacgtctaggagagttatgccgtcaggcttcacaagtgtttcctatgaaactatcgtcaaaaccttaaaagagcagccatgccctctacctttttctgtgaagagattgcacgacgcgttgccagtaagcgagtaaaaacgttcttcccagggatggggaggttaacctcttagaacaagcttaatgcttcaggatgttttctacccaatgcaacgggtacacaatatttccgactcacgcgtcgcggttttcaacgtggcattttgtcagggcgctcgcctctttgaggatccaaaggttcatttccagccttgggatggagactcaatactgtcttcaaagtcgtgtcggccgaggagaccaaaagcccgagtatggcagtatttccacgaataaaatttcttctatccttcaaaaaggaaatgaaaatgaagaaatgaatgcgggggttccatcttcagcaggtgaagccgtggcaacctctgttgtagagcataagacaggttcatcttcgtcatcggatgcctcgggaggacatttttttttctgggtccccgggtgggcgtatctcgttctcttcgtccttctttactcagccaacaatg

SEQ ID NO: 5908 - DNA, 700 bp, Nannochloropsis_gaditana
ttgcgaccgtggtcgaggctaaacacggcaatttaaagctccacgaagagtggctcggggggcgactgagcgacgccagctcgagcgagcttttttctagtgcaatatcactcttactgtcttcaaggacataaaatgaagtggacatgctattttatgcgtgcgtgagagctgcttaacggtgtcggcacagccattgttgtgcgtgaccctggtcgtctgcctatggggcctcccatcacgtggatcatatcctttttatcctctactggaagccgcagaaaaagtgacgacacgatatatagtacgaaagctcccttccggccacgatgtaactttgtcgtgcatcgctaatactctcccttttcctctacaatggtcataattgatgcttgtttgcggttttctccatcataggagccatggtcggaaaatggacgagtcgcggtaattgacgggtgctcatgtttttggattttatttttacgtaaacctcccgcggtaacaatggctcgccgtgatgctggaaactccgccgcatctgcttgctttttctcggtgtaaatattctcttttcccctttgcgaaaaggggacggctctgttttgtgtggggacgaggcttacatcaaaacacacaagtagctgccttttcccgtcacaaatcgagacaacgcctcacacatcgcccaaccatcatg

SEQ ID NO: 5909 - DNA, 700 bp, Nannochloropsis_gaditana
tttttggggggttacgggggactggaaaagaattataggagtggaagggcggggcgggcaataattccctagactgggacaacactgccgcaatttcacgcataaacattcaacaaaaagcgaggcatcggtgacttccctctccacagtcccgtgctgggaaaaaccgggggaaatgtgccagttgaggtgcccgcctacccagtggtgtttgtagcgtcaatgtatgacccgaatcttacggcaagccgatgcgacggtcaggtcctggatgtgggctggctttccatcaccatggtcccacaccgccgtccgggtgctgaacgattggggtttccatcccacacacgacgcggagtgctggacaggcttgggattcgtggggttggtcactacgctgaggtcattttgaccgccgggtgcaagtgcgctgcccgtccactctgaagtttctttcctttttgatcagggtccacgccggtccagggaatggagacacctgcctacatttttcataggctaccacgcaacattatttttattactatttttgtggttgggatgtaattacgggtttctaggcgccgaaatttctacagggaaagaagcctgtttttttcttggttgccatcccttgactcctcatctgaagtgctcactttgctctttcctctcttctgccacgctctcaggcaccatg

SEQ ID NO: 5910 - DNA, 700 bp, Nannochloropsis_gaditana
tcaaggaacgcgctaaaccatcttcgaccgaaaagccccctttttccggggccctctcgacattaccagattatctatcacaccaaagctttccaaaagtttggtgtaacgtctaatgactcatttagtagctttaccccgttgcggttgtcgcgtagctggccacacctccgaccaggatcctagttgcaaaacaaaagtaataccagaggtgttcaagccaacgctctcgccggacggattaaattatagtttatgatcccctgcacaaaacatcatgaagcccccagaaataatagaaaccagggccaaaaatgtccagagcccgagggtgtgaagcacagcaatccaggggggagcaagcgggccctacaggcacgatagcaggaagcacacgcaccctgcatcgctcttccacgaccaggcaaagctcgtaccaggcagcaagtgccacgacatttgtaggtgtggcatagcatattgtggatgtcgtcggcttgctttgatgtcgtggcatgatgcggcagagttctggagttgtccactcttttcttacttcaagggctgtctgagaggccctctccagttacttccatgcaaatgacgactatgttcatccctgacgcattttttcctcctaccgtttgcaattatacacacagacgataacaagcaagagttatcgtctcgctcaacgatg

SEQ ID NO: 5911 - DNA, 562 bp, Nannochloropsis_gaditana
ccattttgtccttccctctctcacgttcaatgaaccgcttagtgctgttgtcttctagccgtcgctccagatgaagagcccagttgtcactgtgtgtggaactgacgcggtccggcctctcacttttccctccctccctccctccctccctccctccctccctccctttctttctccctcgcctccctccccactttttccaatcggggtcgcagcaagtggaggcgaaaatttctcaaaagcaacgggaatatttcctcatggagcagctcaaatacatcaagaaggtagacctcgtgcattctacgccacagccgttctcctccccctcctccctcctttttcctcacctttgtcgcatcttctattcttttttcgcgcctggatccttgtcgctctttttatggagctgtcgatcgcgccccttcttttgccgtctgcgttccctttttgcagtccttcatatctccctctcttcttcctcccccaccctccctccctcctcaatcccttcctgtcgggcaaacccttgctgctatcttttccgcaggaactgggcatg

SEQ ID NO: 5912 - DNA, 700 bp, Nannochloropsis_gaditana
aacaagtcaagcttcttcacctgtctggcagcttcacgaacactgtacacctcggaagaaacctccttcccttcgtcatccacccactctctgatctcaaacacatcctcctcttcaccggacgcggatgaagtgcttgctgccatcgtgcacccgcccctttttgtggtccccggaggcggcgatgatacgatggtagatttaaccagggggaaggaaaccccagtcccagatatgtgtgcgcttgctgcaagggacaaagagtagcgttcggatatgagtgatgttgtaatattaaatattttgagccgcatttgctttgtctgcattcgagacgtccaaaaagaaaggggtgggggatgatatcgtcgaggaagtgctagtgcaacctcctgacgcaaggcagcgagcatcttcacacactgacttgaaacctctctagcaggcacacgccagatttaccatggatagcaaaattcagaagagtatagtttgcgtgggcagcttaaatgtggatttgttttgctatttgcacgacaaattcccagaaccaggtagagtgcgacctcctcatcgccggctccgggagcccttccatgtcgaggttctcacgtcgtgctacccacgcataggcgagactctccaaggctcccactctgctacatgctgtgggggtaaaggaggcaatcaagcggtcatg

SEQ ID NO: 5913 - DNA, 700 bp, Nannochloropsis_gaditana
tgtacgatgaaaaattcatatgctggagcacctctgcgattgtgtttcttctatttccttgtgtctctgtaatcagctagacctgggctgatgtcttttgtatgtttcgtaacgagtagatagcctcattcctctccttctgtcaagcctgtcagtctcggatcacagctcatggactacaaagatcgccgccgacaacagcttctcaaactggccccaccacaatttgtcgtcccacccttgcttcaacatctatgctctatgaacaatggtcaaagtaagaggcgcataatacggtgaagaatgtaagtcacgtgaatttgataccgagccgccctgctcggggagccaggagggtatttagctcggaggggaggttaccgggaaacccctacccggatgttgtctcgttcctccgtacgctccgagggcaatcaacacacacattttactctgatttaacccacctctcgcgtatttgcagcgcggattggattcaataggttgatccatcatattgtacaacacgcaaaatccttcctcacgcacgcagaggctcattgcagaggaagagagcaggcggcactgcctgaaggggataggcacggcatcagaattttgtcaggagttaccgaaggctgtaattaaaatatttgataatgcctactcggcacatagaatagttagaaaattgagaatg

SEQ ID NO: 5914 - DNA, 248 bp, Nannochloropsis_gaditana
ctttaggacggccgccaggaagcctcctcggaaaaaatcgggtcgcagggtcgagcctcgcccggcgcgcgtgagaaagaggcggcggaggaacgagtcttcccccgacggaggtggccggtcccgccctctgggtgctcgttgcctgccactccctgatgacggtcgagggccgcgtggcaggcgatcccatggaatgcgcggctgtggagggcttggggtggatggtctcgggggagggcaacatg

SEQ ID NO: 5915 - DNA, 700 bp, Nannochloropsis_gaditana
ccgtccatgtttgagcttgcgagcggcaagagatcgcaaggaatggagcgctaagctcgagacatctaagggggatcgtacccacgtggcatcgaccaaaaccttgttgcagttttcttgacactccacactcgctcccaattttgtggacatgagctgagtcaatattttgatagtctgatgcgcatgtgaactgtcaccactctgctttccaattacagcaactgagcagcccgctagaggtggcacggcaaaatggtttcgagtgcctcgatccaagagcacaggagtgggaagtccaaactttgacaaccatggcctcaaaatattattctgggatagttttaggaaaaaatcgtccttaaatgcctgaaattgttgtcttggtggcatgaccggcagccgtctcctggtgttgcttaaaggacagggacgataagcggactaaaaggatgtttgccgttcgaagaaatcggctctgcgtgaaatgtcttggaaaaataacacagttgccgtcacaacgtgcaaggatgatcaattaaagttgaatatgtttcgggaaaggggtataagtataataacctcctgtccctaccgcgatcggttgttcgtcagcgggattcgacaaaagtaagtcagggccgaggcgaaaaccaaccgctcaagacctatgccttcttccatcattatttatcacaca

SEQ ID NO: 5916 - DNA, 700 bp, Nannochloropsis_gaditana
gaaatgctgaagataggaacactccctgttgtaaagccgccaacctgtcgagtttaccgccatcaactcggttttggctttgtttactcgcttgagcctgcatcagtgtagtcgcgctcctggcacaaggagcgagaaaaaagccctgggtgatcgcagcaaggatcagtacccaaattacgacgaaaaatgtcgagaagcgacgtatcgacatgtgtggttgctacggttgcgctgtgtacatgtgttcgtgtggacggtcggtcatagaatcacggaagcatgtaacttgacatgtgtccaaaccggtctctctgctcgacgccagtgcaatgaccagcacacaacgcgaggcggaagactgcatggaataaaacatcataaaagatcccaagtaatgtttcgaggtccgaggtgtgtcacgacgcgtggaaagtacttcgggaaagagtgctagacaattggccgtgaacagaaagccagatgaactaccgccatgggagacccctggtggtaacttggtaagatgcgttgaccatgtcttccttttggtctcccgagtacgtttcacactatcactgtacccacatcgttattcgaactgttttacagggacgcacgtgggtttcgaatgtggactctttgtggaaaatgtcgtatgatcaagctgcccgcatcgttgctgccttcaactttcatg

SEQ ID NO: 5917 - DNA, 700 bp, Nannochloropsis_gaditana
tggagcttcctcttgtgttcgagctgagtgagaggaggacaggagaaaaggagagcggccataataaaaacgtcataaagcgtcctcgtcctgataaagaaattgcatctgatcctagctgagtaagctggtcgaggtgtcatttgaaatgagacgattataaatctggcgatgtgatgtcacgaacgtaggtagcatagttctttttacgccgtaccgttttgctttatgattttcgcataatttcttcttctaggtctttaatgtttatttctcttccatcggcttaagcgaccgttgaaatggaattcaagatttcaggacacattttcgtcactggagatgttccgtattcagtgaagcctctaaaatagttcattggaaaaagtcctggcataagaaagggtaggaggttgaaagtcattccgaagaaatgtcctgtgagtgaaaaagggcacatcttggtcgaactaatcgcgcaagggtatcattgtgcattgtctacaacatgaatgcatggggaaattcgttttaagggtctcgaaatgtaccgatagagccagtgtaaggtcttgcccgtatgtcgccactcgctttcccgccgctctctcatcgctttcgagcagcgtgcccccagcttgatttcattgagctacaatacctctctacaatcattattaggcaccaagcgcaagtgatg

SEQ ID NO: 5918 - DNA, 700 bp, Nannochloropsis_gaditana
cgtcttggatgacatgcgttacacaccacgtttttattggaaaaaaggaaggacacttcaaaaacactacgaaaaaaatatggaccggaaaaggaaagcactgacgctgttggcgagcatctttgctgacctttcttctaagcgatcatgtccggggtagtgagctggtggagccctaccggtactacgcaatgcattccccgcaataattttggagatgtgatttctagtacggttccgtcaacgctgcgttccatggctagaaaaaagtgcttgatgcgcgtgtgcccattactctgtcacgaaaacaggtaacctggcgtaggacgatctttgcattatgtcgctccgtcgcgctctcggcatcagtcacatcgcacgcagtcaccgcgtggccctcgtcatgccagatgcatcgacagcgtcatatttccctgcctgtgcgagtggccggcgctctttctacagcactagcgggagaaagcagagcaaacgaagagactaccgagggcccttgctcgtgggtggctccttagtgggagcatccacgatccaatgttaccttcaccatcgcgcattcagtagccctactgtcctaggaccaaaccaagcacgcaatcaactcattgtatctgcttcgtcggtgacagcaataggggcagcggctgcagcagcccttgctttttcatcgacctcgatg

SEQ ID NO: 5919 - DNA, 700 bp, Nannochloropsis_gaditana
tgaaatggtcactcagcacgataatactgtcttgcgggaatgataaacccctgtccgcgttaggggggcgacacaggggaggctaactcaaacgcacaaaagctgaccaacctcatgcgtatatgcggacaccacttgcacatcggcgtcgcaactaaactcttatccgccgtttcagtaagtatcagacagcggactatcgtcatttacgacgtctagtggagggcgggagtcacgccacggtccttgcgggggaaatgggccgtgttcgccgggagcaaccctcccgctgagtctttccttccgtctcgagggccggactggcttaaatcgagtgccggaggcgcaatactaccgaactgaagtgggcctgatgctggtgtggaggacagaaatagtataccatgctccaatacgacttctttctcggacgcaacattaggcatttactgggtgcgcagacaagcttgtgccgggtgtccgggggcctcgagacttcgccatgtcgctgcgcttctacgctttggattcgcctgaacttcggtccatggaacaacatgggcacttcctaatgctgggcacgaaagttgctttggatttatgctgcccgaacctggctttctacgtaaaccgtgccgttaaggtctcctccctggacgccacaggctctgacccctccgcgcctctgcttagtgccatg

SEQ ID NO: 5920 - DNA, 700 bp, Nannochloropsis_gaditana
atgcacaggaaagcaagtgaacggggggggcatcctagtcatggtcagaaggaaaagtcgccttcgcttccaagccagaggctcgggaacgaaaatgaaggcccaactcacccggcaaagtttatgtccgggtgacttaatataatataatatatatggcacaacgatggaagcgcaagcctcccggattcgcgaggatgacgcacggttagagacaaagtcgcacggcagggagatatggtggggaatctgaagcacattgaacgcaagaaagggttttaatatctcgtcgtgcgggatatattcgcaccaaacgcaacctgggaaagagaatggagtttgcgtgcagcttaggttcctgacaccacagacttcattgcacaatcgtatggcatgtgacactcatgttgaaaagcaataagaaggctttgtcaggtgaggtggcagttctacgaatcaatttgactcttgtcccgtctgagacgatacttgagggtctcgctttgcatcggggaaatcctttttttttcaccttacatgtattcttgccacagcaaacttgccaacccaccgccagcttaaggtgttgaggctgttgttgtgcgtgcacatttcaatggaaataataagaccaattaagtccgggaaaaaaaactatatttcacccggaaaatacatcattcgtctcttcaaaatttta

SEQ ID NO: 5921 - DNA, 700 bp, Nannochloropsis_gaditana
gagatggggaaagccagcatcggtccactccctggtgggggggggggagggcaagccaagagaaagaggaggcgggggcccaggatagtcgaccgtggacacgggtagggtcacgaagggattggctgcatgtttgattatcttgaaagcacgacggaccaggtccccgaaaagaaacgtacagaagcacaggttaaagcaccccgaaaggtatccagaaatgagaaaatcaatatccgttgatgctgtcgtgtcttttcggtcacgtgcgtttgctcttttaatgactcaatggcaacatatgcagccacctttctacgaatattttcaaatgatgcgtgctttcctcgtgggggcaacgcggttgccattccatacgggcataagggacagaggaggttatttgacgcttgcacaagcctccctgcttcttgccctggcctccacaaaactgggataggtcatgacgtgaaattacttccaagatatgtatagccttgtgatacacgtttcatgcgtgaggtctgggaaagaaagtttctttctccatgtcatcgctagctcgtcaatgagtgccgttggcctttgacattgaagcgtaaccccgaccgcatcttgtaagtgttccgctactcattccactgttcccatccatatttacccgcggcaggctctatattgcattggagaatacgccatg

SEQ ID NO: 5922 - DNA, 700 bp, Nannochloropsis_gaditana
gatctgctttgttcggcatgggagggggcggggacagggccatacatagtgacttgaaagtggtcgttgcgctagctctgttgacggagggagaaaataaaggcgacgcgcgtcaatgaaagaagggactagcaaaaatgcacccacgcaaaaggcggagtcacactcagtcacgaggcctaccaatacgcgcacgacgagaggctccactgggaagggaggacagtgggccatgtgctttctttttttaagggccctcgccaagttccactcgctcacgacacgctttgcaatgaccagaccgtgtccttacacgaagcacccccccgggcacgtccaggcgtccaagagggtgcaggcgtgtgtgtgcagcaattggttttattttttcttgattcgatggcccctggctgtgcttggtgcgtcgaagcctggaaaggggcttgccggcatcgtttttcttttctccgtttccctccacagagctgagttcttcccaacgaagccttctttttccattgccataggcacaggacgaaatcaagccatgaaagatagcgagaatgatgccagggataatgcaggagttccggaaacaggcgcttgcgccgtggtgtcttcaatttcaccatcgatagcatcagccaggccggccgcagcagctgcagttcccgcagggggggaaatgagttcgacaatg

SEQ ID NO: 5923 - DNA, 700 bp, Nannochloropsis_gaditana
tcctaacctgcctttgactgagggaaataatcctgtgtgcccacatgagccttctttctccgacgcatctcctaccaattgaacataccacaggctatgacagattccttctcaatccatccctgcctgtcaagtcgccacctgcgagaagacggggatgggtttggcaacacccagtgtggtcgcacatctggaagagccaaagttgactgcgtcatgtaggaggatgcggtcgttgcggacgtgcgtgggccccggatctgggccggtcacgtttggacgatagacagccagcggtggaagctccagacagaggggccgtgggaaaagcgtcttctgcacgcttcgcagcagctcttacctgtgtgccctgggaggcccccaccctcttgaagacccgtggctgcactgcacagggctctccctggtgtgcgtcggctgcttttcctgtgactgtcgcctctttcaatcttgtgttgtgatcctgtggatctggttgaaacaaaggctagtctttctgtgcctggctacgtccataagggtgcccccaccccccgtggcagaggccacgtcgaacgcgcaaactgacaaccccaccctctgatccttcctttgtgacccctccccgtcttccctttccattcaacggctacagtccgcacgtggcaggaggaggaggagcaggaaccaagacagaatg

SEQ ID NO: 5924 - DNA, 700 bp, Nannochloropsis_gaditana
gttatcaggcgacaaggcaaatccgtgcagtcaggagccgcaagtgttgagtgatgattgctcgtttttaaccaatcacgacggtcttatgaaaaggaaaaacttcttgctgtttcgaagagaagagccttgaaatctgacgacatgccagcggggtctacgcacctagatacctttcgaaatttgtcagcagacctgtcacccaggctgcttgcaatcaccgcctgaacccgggtcatgctggacgtacccctcgttctcttactgtagcgactcagtgcgtggccacattttaccccccttagcatcctaaggtcgtccggacaagagcaagagcgcggaggcaagggaggaatgtgcggggtgacgtcagacgtgtggacaggtatggtggaaattagggcagtctggcgttgtttctcttggatcaagtcgaagcggaaccggtcgtgagggtggggtgacgggacgccaatggggaggcttcgtgtgatgctacactgttttatctgtcaatccactgaaaacacaacgtgtgtgagatcaaagcattatgaattccttcgctgatgaagccccctcctgtgaacgagcgcctgcgtcctaacctgcctttgactgagggaaataatcctgtgtgcccacatgagccttctttctccgacgcatctcctaccaattgaacataccacaggctatg

SEQ ID NO: 5925 - DNA, 700 bp, Nannochloropsis_gaditana
tcgactcattgtatgaaagtgcctggagctgttcaactcgcgcggtgagacagaggccaccctcagttcaatcaatgcaccgcaagtgaattacccgagatgcgcttctaaacacatgacaatcacctgattcttctcctcaactctcttaattattactgtacttgctaaaatcaggtagggtcgtcatttccaatcacggttgtcaggacacattgcacctcaagtctgcagctcaggcgcctcttcattttttttcccgtttccagccttgtcgggtctctggcacatttcgagcttcccaccagtcagttaagatttgcccactattcagctaggtatgaggaggattgcctgtcgcagaaacaggaatctccacattcgatctgcgtctgtcgttcttggcgccttcctcttgctcggagctgtggttggttctgcccgaagcatcgggcctcacggggagagcaacagctgcttatcgagaagccaaagccgcgatctaagtagtggaagaagagggcgtcgccctggaaatagacgcggcggagaagctgacaggattccaagccccagagaggcattcgactcccggaaaagcccccttgcccggatacagcaggcatcggaggtgcaaggaagaaaaacgagaatacctcattcagctcctgctcttaagcaagcgagaccaagaagcatg

SEQ ID NO: 5926 - DNA, 700 bp, Nannochloropsis_gaditana
gcagggggttgtctctcaattatttaagctctatgatgcattacccctaccttccaatgagatcaccagtgtgccgaccctattatgcttatttcccccccaatgacacaacaaagatcggcatcatgatttccatgagagtgaagtttggtccgcagatgtgaaggacagaattgcgaacgatgtcatgcgtgatatctcggtttaaagtttgatgaaatatgcatatttgactgggatccttacttacatcaagcaaagcgctgtagaggcttttaagggagcaagaaaagttcagagagcttcttaactctctaaatttaaaaattcaaagcgagcaaaatttcggagaaacctccgggactaaatgggcccagctgggaggctcgacgaaatgcccgggaaaatcaatacaggcctattctttagcaaactcgcatcgattttctcactttctttcatgcatattctgcattaaagtagttatctatttgtcgccccttaaatgtagcacttttcattgtttgagggctacaattaatgcagtaaggcgacggaggttcaagtctgagagtagcaactcgtttcataagcttgttccatgtcttattacatccaagacaggaaccacatctcagtagagattcagataagactacctttgagctcggcagcatattggtgccgtcatcacacgatg

SEQ ID NO: 5927 - DNA, 700 bp, Nannochloropsis_gaditana
cacacttcatccgggaaaaattccttatggaggggaaaaagatgcaagctgtcccatttacgttgtctgctcccctgtatcgttgtctgaagcccctttcattccccttcactttatttcacagcacctcacagcatccagcctttccgaaggcgcctccgccgagctcgcttgagcaaatattcactgaggcagtttgagatcatttcaaaaggatactcgagtgtccttgaaaaggacaacacaattacgtgtgtgataagctgctgggacaccacgttaatttcctggtgataagaattgcgcccgattgcttcgtacacgcggggtttgccgtgttggaaggggcgtttcctccctccgccgagcccgtgctgcggccccaaaaactccaattaataccgcttcaacttttatgacgcgggaacattcgaggtgcgaccgcatcatcggactcagtcattcgacaccctctcatctcaagtgtccaagctaagaaaatatttaaagggaaaatttgggagtatattctaattatgtgggcaatgcaagtcaaaaagtatccgattgagcatagctgcgtggccctggtttttattaccgtactctaatttccgcattcaacaaacttcattgccatactctatttacacaggcgcagtacgagagattcatacgaaatactcgtcttcaaaatatg

SEQ ID NO: 5928 - DNA, 700 bp, Nannochloropsis_gaditana
agcgtcatcgccggaggaggcacgcgcgtgggtgtcagccttgaagggcgctatgaaagcgcgccccacgtgtcggcgcgagaccctatctgggttgagtttctcgccccatggtcacaattacgacaaagaaccgcctttagtctcggtcgttacgctcaaaaagggtgaggctggagaggaagtggtcttagccaaagcgccgcagtatcagtacgggaaaaacttccggctgccccttgatccgatggcttcctctccgcctcccttctcccagacactgtgcatcttgttaagcaatggagattcggcagaggtaaacacagaggtactgaggaattgcgaggtgggcgataccttacccgcgcgagttagctgtctgagcgaccaggttgctatgctacctctcacgcttagagctagttttgaggcaaagaccggagcagcccccgcgacaccgatttctcggccagaagtatttcttgtttcctcattatctgccgtctttctggctttgtccatgggatggaaccttcaggatggacaagggatggcaaaaggtccgggatgcttccattacgtggaacgcctgcttttcctggtcccggtggctttcaccctgcttcgtgctctgtgtccacagctgcaggtatatctgcagaaccacaattcttggaacagtaatcacgggtacacaatg

SEQ ID NO: 5929 - DNA, 700 bp, Nannochloropsis_gaditana
atttttcatggagtgatcagagtctgcagaaatgtgcactttggaaggatttatcaaggacgaaaccacacaacaatcctcgcgccctgtctgcgttgattgcacatttcgtcccgaacagattacaccactagaaaacatagcacacgtatgatgggcgcgctagagccataagcgagagtggcagtgcgtctggtggcaatgccatacagagctcttccgcctgaaggtcaggcatgttcctggaaatatggttctcccgtcatgcacaacatatggcaatatccacgggcatgtgcacgtgcccaagaacgaaaatattcccctggaagaccctattatcgtgtgctagcctggcactgcgtgcttacgcggcccgtgtgctctatttgtcttgtggtgggcgggggacttaaaacatggcgcgaaaacgccgaccagaaaaaggagacacaggaggctcgatgcccgggcttccgtgtggtcttgccatggcatctatgcgagtctgacgtccgtcctggttgccccgtttgcgtcacgcttttttggaatgatagggaggccttgagatccgcttgcttgccactggacggcccctgcaccactccatcgtccagcgtgttctccatcctcgtgtcatcggcagaaaaaggcggcccgccgagcgtgcaccacagtcaaccaacactattccatg

SEQ ID NO: 5930 - DNA, 700 bp, Nannochloropsis_gaditana
gattggcagcaaggggactgggtgtctggcaacgccacctccaagcacccggcgcccgaaaacatgtggtcaaatcgcacctggcatcttacacatccgccgcgtcccgtccagagggctttgcgtaggagaatgcatgcatgtgtcgacaactcgtccgtgtggaaccattcctgtgcgtggtgtgcggcacgaggagccaaggaaaggcattgccgggacgttcgaaacgccaagcccggtccacctcaagtgcagcgcgttgaaaggtaaccactgccagctaccaagcccgtcccaccccgcaagacacgcatcccaagcccttgcatcacatggccagcacgtaggtgccccccgggttttcattcattgcgggggtcgctcccaggtggttgtcacgtgggacggccgtggcatcggcttcctcccttctggttgagtttgtccttcgccgagaggcccccaagactccgggggggcctggggcgcacacgaccagagcgtggtttgggacgcctccatgggggcgtggcccacgcggaacggcttatgggagtttatcggtcacctggactcattttgcattatttgattttagcgtgaagttggatagtttaatgcgcaaccctcaaatacactcgaacgccataatgatcaccattgcccatcagaagcccgtctacttctactcgctatg

SEQ ID NO: 5931 - DNA, 700 bp, Nannochloropsis_gaditana
gacgcatccacaattctctgatatcatgcaggcaagacactgcgctgccatgccgcgacgatcaagacataaaaacagttgcggtgccagcggggcgtcttgccctagaaggagagagggaccaattgcagccataccatcggcctttcccctccatgttgcttcctccctcctcctactcttttttgtgctccaatgcgtccatgcatgggtcgtaccagttaaatactataaacatgaatgtttgaatcccggtttaacgaagatcagtccgtcaagaagacggggaagcggcgtttctccattgacgacgtctcgagcgacagcagcctcctgggcgactactcgcgatggctacggtgcgggacacactgagggagaaggcgcagatgacaccgccagtggtatcaaaggcattggtggtgtgaatcgtcgtgccagatccaggcctggggcggcgatggaggaagtgcggccaccacgagaggcaaggaaaccatcttggaaaccgcgagggaagagccaggcgcatgcctcgaccgggccaagtcggagcaagccaaatatacagcggccttccaatccacggcagccttacaatgcggattatcatcgtcccagtggggaatggaatcgagggaaacaaataacgagctttttgcgcaacgcaggggacgagggcgggcatcacggaataatg

SEQ ID NO: 5932 - DNA, 700 bp, Nannochloropsis_gaditana
gccacaatctctgaattgaatctaaacttgctcaggtcaattccctcgtagatcctccgccagatgaagcctgttcctcctcgcagcgggaagcgaaaggtgtgattgggaccccaagtggtgtcgttggtaccgttccctttgtgctccttgatacgggtcaaatccacggtagcaacccgatcctccatccaggcagcgttcatctcacttggttcgtaaccccaaaccttgcggttatacggtgccataaaaaggttcacaatgcctcggccgaaattatttttaagccattcgagaaatgtatgtggcttagtcaggcgtgatatattctgctgctgcatttcaacgaggccgtctatgcactcgtgaaagtcttccgcggacaagcggtggatattgttctgaaaaggatagggaataaatcgacctttttgccagatatagctcacacgctctcgcttacaccagtctcttacaatgtggtccaacactttgtcaaagtaattatagtgagagaagatcacatggcctcctggacattaagttgcgtgatagggatgaggactcgatcgtgaattttaacattgaaaaatcaagaaagccatcgaattgacactttgatgcggatttactttattgatacgatatggaaagcaaacatttgaatgaacgaagtaaaggtagaagaaacttaccc

SEQ ID NO: 5933 - DNA, 700 bp, Nannochloropsis_gaditana
ggatgagacacatgtgtcaccctcttttgttctatgctatcatgcgtgtgcttctgttgagcgtctgctgtacacgacatattaaaaacagggcaaccatgcaaatttcgataatataatatgcatatgagttgctggtagaagctgccatctgccctgtccaatgatttcccattgcatggttcatagaggacaaggaccagaacagggggattgtaaagagtagctggcattgatttcgtaacaccttgatcttctccagacaacttttgtggcattaaggctaaagaaaagcgtacaagaagcgaaaagctctttcccggatcatactacgtctcctttgctgggtgcgtagcgcgtcaggaggctgtgaaccccacgcctccacacctccgttgatggcgcgaccattcttcttttgcgaacgctgatagcacatttttttgaagacgcggcgccagcgtcgcagcaaatgtgagctctttcccaggccagggaaaccatcgcccccttctcgcttcctgctttcgataacctcctccctcgcgcgggcgcttagtaatttgtcgaagaactcatcctcgcatatcccgtttaatgtttggacgaaggttgggcacgacttgcatgatgtgtgctgccgtaatggctgatgccgtcgcttctttcttgttttacgacttctcattattgttgtcca

SEQ ID NO: 5934 - DNA, 700 bp, Nannochloropsis_gaditana
ctatgtcattctcaaactgtcttccttacttcataccatcatcattacctcagcatgtttggagctggaagaaggatgaagtcggaaatagatggtgctgatcctattctggatactgctaaagaggacggaacgggcagcaccatcaatccgcaaaaccgatctcggattgctcgtctgagagggcctaatctgagagtagaagaaagtacgcacggcagcaatcaatataatagagaggggcaggccaaaatggcttcatttcaaagcataaggtaacaatcacccccaaaagagggggtgtatcctcgtcgcataccttttctcggtcaatgtgtcacctgttgctttccccttctctccatcgaacatagctacttgccgatccattccaaaatttaccttgaatggctcaagacgcattttacggcatctgtggtggcgaactgggtgatggtaagctttttaactttatctttccgatgatgggcgcgtcagcgtaagctgctcgtggttatatttacttatgcttggtatctcctaatcgtccatttctgatttgtgttgcataatctaaccgcgccgctatttctacgttcctccgtccgtatcttagatggccttaattggcgtagtcactggtctagttggcgcggccctcaagaacctcattcaattcttcaccaaagtcaaattcatg

SEQ ID NO: 5935 - DNA, 700 bp, Nannochloropsis_gaditana
ggtaggcagcttctttacgtgctttaatgggctgctgctcgacaggctagagtgcttttgcaacacctgcttccggatccgtgcaatctacgcctgctatgtcaagtaatgaagtgagggtggtgttcgcattgggtagtgcctgaaatcgacactgcccctcctcgtgctgtacgttcgccaagaaatcgcccgccttgccctgttccatgacaactcaccacaatattcatacacgttactcagtttccctcgatacagcatgtccacaagcacgttcgcgcagttgtgtgcgcggtcggaggcatttttctcttccgttgtgtcatcacccaaactcataccagaagcggcgcgcgcgacctctgctgccactcgcacgtcccgtccctcccccgctacaagcagtccttgcacggtagatgagcggaggtatttgtacgtgcttccggttctcttttttgaatacttggcgctcagtctcagccgtgccttgttgccaggcctgatgaattccgcttttggaaactacacgtaccatgtcttgggcatagttgagacggcgaaaggcatcctggcatttatggcatgccccttgtttgggaagctcagcgacgtcgtaggacgacggactgggctttttattactgtactaggtacaaccctgcccatttctagcttggccctgacgcagagcatg

SEQ ID NO: 5936 - DNA, 700 bp, Nannochloropsis_gaditana
gtacgttgatgcgatgtaggccatttaacggggaaagatgttgggtatcagcaggtcgcctgggtgttgggatgcggtctttcttctttcgctcgacgatttcttcgttcacattatatgcctgttgagaagttgttgacattatgattgagaaaagtaatacggtacagtacattctttcgggaagatcccagaagacaatgtcgcagtgtccgaaactgtctcctcatcgcacctctcggcccatattctctagcacaggatgcgggaagccccagccgtccacaccccggcctctgtggctggcgaggcctcagccttccccgagtcaaattgttttcatgtcgcctcgcaacgtgagagagaagacgacactacgacatgagtgcgttgaaattaaatcttaccggcggaaaagaagtcggaggtggtcgatgcaactggttgtgtctttccagtggctggccttcatcccttcttcgccatgcacctgttggctataccaaaagcaactgatttatacgccacttctttggaaaaaggcacgattgtttagcatgtgctgtgacagtatttggtcctacacgtatcttaatcgaccatgcctgtgtttgtggcttccatacccttcctcaccccagccttctccccaccacgttctcaccctcgcgtttcgccgccctaacataattagacgatg

SEQ ID NO: 5937 - DNA, 700 bp, Nannochloropsis_gaditana
gtaatgacatcaaagtacagtagaagaagttcgatctcacttttttagacaacacgtcaatgttgtcaccttgcagccgggaggttagcctcaccgaccgttacgccttatggggtggtacgtggtccgtcactgacagtgcgaggcactaaaattttagatcccaaaaaatgtcgccggaggtttctaagagtcctatttatttgtagccttgcatttttctgccagcatgttgacaacaggatgctcaacccatgcctttaaatcattttttgtgaactttaccgagaataaatgattcttcaactgtgtcgcgtgcaaattctccgaggagtcgtcaacgactcgtagacgacgtctcgggaaatattggattcgattcgttctgtcctcccctgtactgaagctgggaacaatttacagaaggagtgtttcaatatgccgagagaaaactaaacctacacgtggcaagaaagtaggaaagtgagttcttggcaattacgcaacgatattttccattgatccaatcaaaatgcatcaccctatcatcggcaagatcccacgatcagacttttgaaaacctggaagagtgtcatagcttcgagatgcacattgatctgtacaatttacaagtgtgtgtatgcataatttcgtgccaatcttgtgaaacgatggtacccgacattttatcaaatttagg

SEQ ID NO: 5938 - DNA, 700 bp, Nannochloropsis_gaditana
tgcgtgtggccacccgcgtccaaagcgctgctctccccgcactgcttcaatccgcccgccccaatgccctgatctgctctgaaacggggtctggtaaaacccttgcctacctgcttcctatcctgcagcacttgcaggcgctacagccacggccttcgagggcggaggggacgcgtgccatcattgtggcgccgacccgggagctcagtcaccagatatacgacgtcttgtctcttctcgtccgagctttcatttggatcgttccagggctggtgagtggtggagagaagcgcaaatcggagaaagcgcgcctgcggaaaggcgtgacggtcctggtggggacacccgggcggttgttggaccacctgcagaacagtcaagcctttcggcacgaggccacggagtggctggtgctggacgaggtcgaccggttgctggatttgggattcgaagcgcaggttcgtgaaattgtggaaaagttgcggacgggccgagaggggggaagcagtgggcgagaggaagccagggctagagtacaggtgctagccgcctccgccaccctgacggccgccttggacaagtttgggtgcgagctattgggtcagcatgtgcggatcgatgccaagactggaacggtggtagatgtcgatgtcgccgcgactcccggaggggggcaaatgggggcgacagacggagaggg

SEQ ID NO: 5939 - DNA, 700 bp, Nannochloropsis_gaditana
actatttcctccacctcctctagacggaagtgaagcttgccatcgattgtcttggtgggtagtcgctctttcaccaccctgtgcccaatgccgcgcgccgtattccatcctaatgtcgatgctttacgccgcatggacttctgttctatgggcacctcaacgccgccattgttgtcctcaggggcggtatgcgctcgcttgctttttccggccgaccccgcgggggtgggactccgaggatcagcgtcaagaaagctagcagcaaaactagagtgctcctcaacgaacgcacgatcttcctcgtgtatttccatggtgtcatcttcgtcattctcaatcgggagctgctcaggcatgggagtggcacttccggggccaccgggtctaggccccttccgcctcactagactgctttttttcgcgggcactgcacgtcccaatcgcccctggtcacgcgatgctgcttttgtcttcattgtacagctgtggacggtgcaaggggtgggaaagcgcgggatgaggcgggcataaagtatcatgtggagttggctttacggggaggtggcctgagtagtccagcctgaggctgaacggcccacaggcacaggaagctttcctcccgagggattaccgcccgattttcgaccactctcctgaccccatacccttctttgaccaatcgacgtgtcaatcatgtagt

SEQ ID NO: 5940 - DNA, 700 bp, Nannochloropsis_gaditana
  misc_feature (1)..(4): n is a, c, g, or t
nnnnccctaaccctaaccctaaccctaaccctaaccctaaccctaaccctaaccctaacggatcggatctgagccatcaattagactccctctttttgtttccgcccatggaagcggttctactgacgtgaggggttggcctccatggcgtcgcagctgtgtggtcacaatgatagaaagcgatcgatctctgacgttattcctgcggatgctctttgacgcttttggctgactacgtggagcaccccaaccagacttctgaagttttctcagtggagttgaactctcctcgacccatttaaatttctccacgctttctccagagagagtacctgtgcagtcttcacttcttaaattatcaatacccagcttataatactgcaaaacatgctaatctatgtgctgtccagctgaatatctatcggcgggaattgtggtcactctattcagtcgaaaggattgcgtaactgatggggaggcgtacaaacaatttgccatcttcacgcgtgactcgtgtatctcttcagtgcatcggctcattgtacgacaaatgtacttgttctcatgtagaggtgagggtgtcccttcaacaatgcacagcagtggacctctttctacggcgctttaagcggcaaaaattgagctgatgcagaccagaccagtcccattagtttcaccactcctttgagaaaattgcatg

SEQ ID NO: 5941 - DNA, 700 bp, Nannochloropsis_gaditana
tgggtgactcggtcggcggcgagcgagagcgctgctcgggcggacgaagggccgcctaggccacccgtgcagtgacacaaatataaatttttgtcgacataggacgattatgcatgaagggtggaaatgggtcgcgtcatgcgtttggcttctagggtgctgtttgaagttccaatgccgcgagaggcgtcggaggcggggggcttgccctctctctctcggcgctagccagcgcttagcatgctggattctcccctcatgcgtccatacattcttccgttgccgtccacgagcggcctcgcaggggactacgctgtccattgcttctcgtactttgagataatgtaccatgtatctatgggggtaatgtccatgagcgcttgacgaccgaaagcactcgaaagtgctagtgtaagtccggcctcgtacaccgcgcgttgttttgctctcactcaattccttgcaactcgtgtttatcgcatacacagatcttccagccaccattttcgatgactccctgcaattgtggggtaagaagagtcgtacttgattccagaactactacatacgggctgcgactcacgtcgtcggtccgattcttttaggaagcagcctagtgagcaggaaatgagagttctgagacgtactgacttgagacacgacaactgctacgcatacacacctcttgtgcgcggccatg

SEQ ID NO: 5942 - DNA, 700 bp, Nannochloropsis_gaditana
gtctcccttggcgcagtaattggtagcctggtgggtcttatgccattggtagggctgatgaaggggcgagggacgagaaaggcgtgcgtcgtcgagccaggaaagggctccagtacaagggagagggcgaatgcagataggcagaggatggaagtcggaagcatgagcttgtgactgccaatttttcggaaagcaatgggcttgatgtgatgatggggaaagtgacgggaggatgggagaggctttctcagctgagaacttcaaagcaggtgcaagcgttccggtggcagctgcacggtccttatatcatagtgtggacgaatcgttcatattacagatacaaaaatgtgttttgttatcggtgtgtcctcttcacttgtcggatcgttcatagtgtggcactgcctgtggtacgtcgctttcgagagggaggcgagtcggcgactgaggagtcgagtacggaagaaagaatacatctcataagcagggaagacattgcgtgactagtgcaaaattttgaaaaaataaccgtgacgcataagggctgtgaaagttcacattcctggaagagatgacgtgacggaaaggaaattgcacggttaaaaggaggggacgaatcccgcctccaaggggaagttgatacttctgtttacattttcgcatctcgtgctacacaaagaacaaaggtcagaatataatg

SEQ ID NO: 5943 - DNA, 700 bp, Nannochloropsis_gaditana
acggtgatacttgtaaaattgtaggttcgaagtcatgtaggccgcttaagtgtcatcatacttctggtctatcccctcccctttctcctcagccatagatacagggttcgcgggacgagatcaaagtaattgagttcactgcacccaagcaatcatggccgcacgcgtatatgtgggcaacttgcccatggacatccgagagcgcgacgtggaagacctttttaccagatatggcaacgtgacgaacgtggacctgaagactcccgcgcggtgaggagggaggagggaagaaatggcaaggagaagaagaagaggaaagggtgtgcggggactgtcagcgatcaacagcgtggaaggcatggataggaaaagcgtcaggagagagtatgccgtgtggactgcccgatgaagtggaagcctgcgccttcaaattctatatcacgatgcgcgcctcatagcccgccacatcctctacgcctctgccttcttccgcaggccccccgcctacgcctttgtcacttttgacgatcgccgtgacgctgaggatgctgtgagggcacgagacaactaccagctccaggaagggaacaggctccgcgtggagatggcgcggcggggggggcgggacggcgggaggggaggtgggttggggaggggaggggagggggggggtatgggcggagggaggagggtatggatg

SEQ ID NO: 5944 - DNA, 700 bp, Nannochloropsis_gaditana
tttttgcccatttttacgattttgagagggtgaaaatccattgcatctttgcaagcagcccaaggcggctataaatatgtaattgactaacgagagagccctcaaaaaaccactttaattcgcaaagaccttctgacaggcactcacgcgggtattactgtggccacgcacctcaaccacagccgtggcaaaccaaaggacgcattgtggcatactgccaagcttaccgggatagctgacgtaattttgcgtacatcgtcagaaacagaaaaggccgtatcgccgtgccacaggcatagctgcctgataaagattgtgctccggaagaaagtagatgcatcagccttcaccagacggtagtaacctgctccctgtgcctcttcttcttcatagtgcggcgcaatgggggcttgaaaagatagtcctatgtctattggaatcccattccgaggccatcgatgtgacggacgagcacggatggacgcccctgatgctggcggcctcccgaggacatagctccgtggtggggtgcctgctcgaccgcggcgccgacgtccacctgcgagacctggacgggatgacagccttgacacatgccgctgccgggcgactgggcaatgccaaggtggtacagctattgctggaaaaaggcggggcggaccctggggcggcctgtaagtgggggtcgaccccgctcatg

SEQ ID NO: 5945 - DNA, 700 bp, Nannochloropsis_gaditana
ttctcccgaaaagtgtgtgctctatattgttcagcattgtaaccattgttgttttaaggaatagccgtttgacaggaaattgcatttagatctgtgaatagttgctgccgctcgggcaagtttgtgaaaggctcaaattttggattactcaatttccccatgcattagtggtgggattctgcatcctctccgtccgacgtgaaaaagcgggccctaacggaagactacgctttggattctttcgagaacctcttgtactcgatatgtcgcttcaaggtgagaaaattaggaaaatgaagttaatttgtgagggcttcataaatctggtcacaagatctcacgtgcgacatactctgtctatatgtacaaaatggaagcagtggagggcataatatgtaataatgtgaaaaagctttgcagaaaaaatacattttttgcgggtgaagcgcccacccactaaatttacatgtatttaaagactcccctatccgtccatatatgtcattcagcacatccagagcattcccattgattcacatccatccaatttcgataaccctggcacataggagtatactgaccattatccgacacgcatttcagtcgtgtcttttgcctttaagcaaaaacgcttccgatttcatcatcgtgccgctttgcgttttcccgatagtcgctttgcctttgtgggcgtggaccc

SEQ ID NO: 5946 - DNA, 700 bp, Nannochloropsis_gaditana
gaagacatggcaggtggtaagtttgcaggcgcaggagatgcgggagcacaggcaagagaaaaagtcgacgaactccgacggaaaacggctatgtcgtggtctgtacggaaaaatatggcggaccggcagagaaagcaaggccgagacgagtgaaaagaaagaagtcctgcgatacgcgaatcgataaaagtagcaaataatgtcatggtttttggtcgaggggtgttcatcttgtttaatctttttatgagttcgaaggggaatggattatctcgaggtccgcaatactacttcgagcacacagggcttcgcataaaccatagatgaacacttgcttcttcacagacaattgatgaaggattatatcgcatgttaaaatctacgtctgcctagcttagtgagtcatctgcctttgaacgctcacacgtttggcgttcgtctgtgtttgtgcggcctctgcctcgtctctggaaagcgacccggaggttagcgctgctgacgccttgagaaccgcacatcacggattttcatattgatgctttttcgaccatttggccgtattggcgacagttggtcaccgtgtttattacgatagaggcgtgggaatggaagagaataacagcgtaggtgggcaggtgtagtcgcgagcatgtgtatcggaaatctttgcccgagcgccactccctggtggtgcgcttca

SEQ ID NO: 5947 - DNA, 700 bp, Nannochloropsis_gaditana
  misc_feature (1)..(667): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggatcaacgacattgaagagtccagccatg

SEQ ID NO: 5948 - DNA, 700 bp, Nannochloropsis_gaditana
cacaccaccgcagccgctgcactggcaggtaaccaaaggagcaagagtcagacagtgccgtcgaatcatagcatatcaagtaaaggaccgggggcagtaatggtgcctggtggtcgcccaaacgggatggaaggtcagcgccaagagcgcggctgtaactctcacgaagatagcatgacgagtgccgaggacggcgcgggcaagagtcatttcagcagcgtgccggcaggtcgggaggtttcgtacaacgtgtgcgggacgattttcaaagtcgacaaggcctaccaggacctcaagccagttggcaaaggctcgtacggcattgtatgttcggcgctgaatgtggaaacgaaagaaaacgtggccatcaagcgtgtctcgcccatttctacgcacgtcatcgatgccaaacacgtcctgcgcgagattcgtatgatgcggtacctgggtactcatgagaacatcatcacgcttaaggacctcgccctccgggacgcggacgacgagctttacatcgtcatggagctcttggactcggacctgcaccggatcatccaatccaagcaggctctttcggatgcccactttcgattcttcatgcaccaggtcttgaaaggcctcaaatttctccacgaccaccggatcatccatcgggacctcaagccggggaacctgttggtcacccgggcctgcgagcttc

SEQ ID NO: 5949 - DNA, 700 bp, Nannochloropsis_gaditana
acgggaataaaaaccttcttccggacgaaggaccttgtgagaaaaacgggcggcaatcgcgacgaatgcgtgtccctgtgacgttgctgaaggaccggagtgcgggcaggatggttatatcgtgcatgacgggggggctccctacctcggcttcgagccaagccggcgagtcaggggccctgccaccaattcgctgctttccgcaagacttaccatgaagtaaaaccgaacttatggcgcatgtgcgcctcaaacgagaagaacatttcttagatctgaattttctcacccggttgcgaggtattgtgcctttttgaaagcccggtagcgtcagaagttttccgtcttctgagacactctccttgacggcccttccgcttcctttcgtcactcttacatcccttttttcacatccggcagaaatcccaagggagaacccttgatcgtaaggagacggaaagcttctgatcatggccagagacggtaatcagctctgaaaggagttggaaggtcagtttatattcccagcattcaatctggttattcgccatactcattccatctctctcctgctctgggtttgcacctcgcgcagcgaaaatacacaggaggactagcagaaggccttggaaggcaaggcatctttgtataaggctggctgagaagaagacacagggacggagagggacgacgcaatatg

SEQ ID NO: 5950 - DNA, 700 bp, Nannochloropsis_gaditana
aaatcactgtacaatgtgtgacggcccgagacaatttggatgccgtagccagcattggcttctcgtgtctcctctgcagcgacctgcgtaggagaaccttttgcaaggcctcgaaaaggtatgatcaatcgactacggacaggcgacgacctagagagggcgaacgaggattgccgtaaagctgcgttggccagaatcatgggttgtgatgttgttgtatgatctgtatgagggagggaaagaggcaagaacgggaaacatatggaacggatcgaagggcatgtcccacttaatttaaagcggacgaatattccgttcatcacgcgcaaaagccacaccaggtgtcgacctcaaatttatgatctactttgaaccacttcgtataaaaaagcatgtttttacgaaggatgggacgaaaaaaatactgccacttggggcgccgcgacgtcatcgccgcctgatgttcgcggtgcggcggcagcacgaggttcgacaggggggttcctcctgcttttatgtcccctcgcttttcttttcaacgcctgctcgcgagtccgccgggacggtaacgtggttttgccacgtgatgaatgcaaaactacggcttgtcgtcgtgtgcactcattgatctgacttttgcctcacagggacacgaacaagaacacttcgatcggcagggtaagaggaccttctaaatatg

SEQ ID NO: 5951 - DNA, 700 bp, Nannochloropsis_gaditana
tggatcgcgtacctccgctattacctcgggaatggtccagaagtgttcggccaagcgtgccaggctgtagccttgcccttttataatcgccccagtgtccaaaaccaggtggcgacttttgctccggacaccgggaggagtctgaggggtaggagacgcggacatcttgaccggagtccgcgcgctatgggtggttgtgctgctcgtcaacttctctgttcctgggtctggtagtatcttgacggggggggggtcgcaaagggaaggactgttaagaccatcattgtcaaacaagggccagttacggtcatctcacaaactttcacagccctgcggattgccagtcgccctcatgcgacggtggactttgccaatcgttgcgtaatgcgtctcgaactaaacagcacctcgctaagccatcgcttcgagttgcatcgtcggtgctagcaggggtccaatataatagcataagataattgtcctcaatgtacgactgaagacgagtttttccgtcgaaagtgaatgaatgttgtctccatgttcagggaatgctctgtatggctcttttttcttccaaaaagacccaatttttcatttgctacctttccttatcgcattcaggcctccatagcttcgtgcgctccgtatggaagtagacaccacacaatcggcaagtttgccattaaaagggacagaaatg

SEQ ID NO: 5952 - DNA, 700 bp, Nannochloropsis_gaditana
tggcgatatattctcactgacatccgtagtctcttgctttgcaaacgagaagtgagctatggtagccagttgcacaaagcgagagtgcatatcggctttatttgcctcaagtgcattgttcagcgcgtggacccatggcggctgtgacgcggatgcgactgtctcgcggggatcggattggtcattcttgcttacgacacatgtaccgccgatatcacgtaatccctcattacttcccgcagtcggggtggcggcggccatcaggattagggattttgaagaccagcaacagaaaggaaaaccagcggtggtgccggaaatgagggtagcgacgagcaggaaaaatttacaaagcccgctgtaagatgggaggtacacatttaaaatctcaattagttctccatgccgttcacgtgcttgcgacgggccaaaacaaggcattgggaagcgatcgcgtgggggggaggttaaaggatttacctgccccggactgggtgtcgactataaattagatgaatgggcatgcaaaagcccgcttgcagactaaagacttagggtatggacatggtaatggtgtggttgttgatcatggaatgctactgcgctactgttggcgtcgacacatcgccggcgacgactgtcttttcagttagcttctgatttagaatagccactaatctgactatcttaacgcatgaaa

SEQ ID NO: 5953 - DNA, 700 bp, Nannochloropsis_gaditana
gaagcagccgcactggggagggagggagaggatggagaggctcctttgcgactcgagcgggtcgtcttggagtgtttcgacgaggacgaggaggaaagtgtggaggaagggggcgtccggtgtcgtttcttaagcagagaggccaacttggctttctgacgatccatgcctaggccaaacacatctacagtatgaaaggcatgttgagaagcacgggaagagatgaagtaagggttaaaatgctcgccaccaagatcgtcaaagcatatggccatgaaaccacaagcttgcgggagtgagagcgtggagcggatgacatggctttaggcaagcagtgtgatcaatttatgcatacacatgaaaacaaggtcttaggcccttgtggagtcccatttagatccagggatgaaggcgcgcgatgtatgtacccgtcgaagtcctgagtgaggtttgtgtctagtaaaagtagtggcatcgctcaagaggttgcacaggaaggcctttgctcagggcgagggttactcgtttgtgtgacttggcgggccaatacaacctgacaatcctttcctttactacaacggatgtaacaaacatgcgtgcgtgtgcagaggagggttgttacatggccgtccccctttttgattctcatgctctttgttccccctccggccagatctactacgtggctccgacatccatg

SEQ ID NO: 5954 - DNA, 700 bp, Nannochloropsis_gaditana
gaagtgggggatattctgcggcaggttgtcggtttgtcaggcgctttccgtgcgtggttacttgggcatgtgccttgacatcttccggtgtcaaggacaattcaaggtggaggaacctgcaggcacacggatgtgattcgcccctgaattccccaccttttgggcagtaaggacatgaacaacaatgcagacgaccccagggattcgatgcttgcgtgatgttgtcctggtggactttcaggggcgtgacatgactttgactttgccaactaaaccgcagagtagccagagggagggttccagatatgctatgacgatgccctagacctcctcgaccgcagccttttactttcgtcttcttttcaaccccgctcagtttctcttaccatgtcccttattttacatgtgcacagggcttggatgccccgcgggtgcgggtgatcaacgctacgtggattgttgtatcttcctgagattcttatttatcatcggcggttccaccttcattcgatcggcttgcacacctgaccgtgtcagcaacagcaacttgacaaatattctagctggacattagtttgaaggagctagcaagacggtagcgggaccatctccttgtcggtagaggtcgtttgcatcgtcgtatcaagccgtaagtgtaggcgtgccaacttcaaggtaggagaaggcagcccctgtcatg

SEQ ID NO: 5955 - DNA, 700 bp, Nannochloropsis_gaditana
acaatgtgctcaagtgcaccccgcggggttctgagccccgaatctttcagaaagtttcggggcaaccgtttaaaaaccgtttaaaccgtcgaatgactggacccgaggcatgacgagcatcacgcaacgaggatgcggcgctttcctgtggcctttattccccccctgctcacatagactatggaacggagtgaaggtgctggatggaccatgcagtttgaaaataaagtgtgccgatgtattcacgggagattcatcttcctgtccttgcctgcgggttggccgtcagcacagatcgcgaaatcgaacatggagcgattgcggactttgtgtgcttcgcttctcctggttgcggtcctaccggctgtgtttggcccaatggagggcgaagggcgagacggcagagcaacgatgtagtggcggagttgtggtgcatcatttgcaagaagccggaatactagcctctcaagccttacattcgagaccgaggaaagatttgtgggggaaaagtgccttcaccgcttttggttatgtttcgtgctgtgtgtggtggcgaggcatgtttcgtcccttcgcctcgcatgtcacgctcctcatttgtcttttatattacgacgactgacacgatcaccattttacgcacaggagtgctcctttcgtgtatagctagcttcataaaggcattccaatcgcagaaatg

SEQ ID NO: 5956 - DNA, 700 bp, Nannochloropsis_gaditana
agccaaagaagcatttgtctcaaatttgaacggctccggcttgtatgagatcattaaagtcaccatccccctgcccgtggctctttgggcatacacggaattgcgagccttccgcctggtctattcagctcctacccctggacttttgcttgcattttgctacgaattcgctgttctgatatttcctcaaattttagcccaatgttggcctgaatcgacaccgtgggtgctcgcggggctgttggtcattggtgtgagttgtcgtgccgtcgtgcaggcgactcgggagccgtccttgaagagccaatggcgccacgaccgagcggtccgtctcgtttcttcccaagcccgtaatttcctgataaattaccgggcaggagtgatgttgacctccgccattgcgatcctggcggtggacttcaccatcttcccgcggcgtttcgggaagacggagacctttggcacgagcctgatggacctgggcgtcggctgtttcattttttccagcggattctgctcacgggcagcacgactttttcaccatcacagcgaagcggccccaggggcggcggctgctgcgggcgtgagcggggtagtgtgcacggggggtgagggcagcgggtcagaggccaaggaggctcaaggcggttggactctagggagaggcgaccgggggggatgcggcacacccacaagtagc

SEQ ID NO: 5957 - DNA, 700 bp, Nannochloropsis_gaditana
tgtgtgtacagagcacgaattttaccgtgctgctgctatcaacttatgcacttccaaatgtcagactttctcagcaaaaaacgccaaaaggcatcgacacggggccagcgcaacctcgaaggcaggagcaagcggcggggggagcttgcagcacctgcaggcacaatacgagatctacgcagcccaagactcctgccgggagtacgccttctgaacaatcaacaccagtacggttgtctcgaccctccccgccccattgtactcaaatatcaggccgatcacttgcgtgagctcttccccaggggggcgtggaagaatgtgtggtgcggcgatcgtgccggcgggggcggagaatgaccctttccgcgcgcaagatgctgcgcgctacgaccaaaagaccaacgggacgaggacgagcgccaacacgggcatacaaatttgcttgtcgcgcgtgaccagtgcacgtatgccttgtggcgtatcacgatatgggactgagtgcgatcaccccggtcatgctatttccgcacgcgacttgccctatcagctagaacttgagacctaaccagacgaaaacacacgacataccaggtaataaagcggaaagcgtccgtccacacacgctagcacaacgatgaagatcagccagcgagtggcattgccttccatgttaggcacttcgccgtgaccagaaaggatg

SEQ ID NO: 5958 - DNA, 700 bp, Nannochloropsis_gaditana
ctccctgcaggtgactcgggaagttgagtcagtagacagcatcatctccccgtcgctacctctcccgcgccattgtcgcacagcatgctggagcccgctagaggggaatgagagaggaatttcaggtctatcaccatctcaccctcttcgcagcagctgctgcaagagacaaagagctgccatttcagccgcagcaactggagtagtgtcacttgagtgcgccagcaaatttgcaaataagagccgcttctacgctacaccgccttgtcactacgcggtctttgaggtgcggctggcaagacaagaaagagcatgcctgccatccagcctgccgactacaaggcagccaaagaagcatttgtctcaaatttgaacggctccggcttgtatgagatcattaaagtcaccatccccctgcccgtggctctttgggcatacacggaattgcgagccttccgcctggtctattcagctcctacccctggacttttgcttgcattttgctacgaattcgctgttctgatatttcctcaaattttagcccaatgttggcctgaatcgacaccgtgggtgctcgcggggctgttggtcattggtgtgagttgtcgtgccgtcgtgcaggcgactcgggagccgtccttgaagagccaatggcgccacgaccgagcggtccgtctcgtttcttcccaagcccgtaatt

SEQ ID NO: 5959 - DNA, 700 bp, Nannochloropsis_gaditana
acgtcatgaaggatttacaggacgctgttggattcacggctttaccgccttatgcgaagcgatccgtttttaattaataaaatttgaacaaagtacttagcattcagctttcaagtgagggtattctgagttgtagctcgattcttttacttgcagttgcagctgtgatgcctccaaccaaatgtatgcgagttggtccacacacggaggcaaggacacaccacttttaatttcgatcctccaattctggcatcagtcagagctacttgtctcattcgaaacacgatttcctcccctccgcaagcataccaccacatccaatcaggaacacgtgaagcccagggatcgggggatacgaggctggggctcgtggtagggccccaatgtaccccccgaccctcgcatctcttctgattcacgcccccatgccccggggtctggggattcagacggcacaggaagatatagactgtcccttttgggtgtaaataattggcctttatgtgacgctgatgaatgggatgggagcattgttttgtcggaaagtttgttctttcgatacaaccgatcctgatcctggtgcgtggtggctcgaatgtccgctattcgtcgtcgtgttcgctttgccttttgaccacgtccttactgaggggttacttaccatacattaccacccgcatatagaaatttgcgagcaatg

SEQ ID NO: 5960 - DNA, 700 bp, Nannochloropsis_gaditana
ctcctgcatgccctcatatatgtggatttggtcatgcttgggattcgaccagttcacgccgcgcacttcaaagaaaggcatctctgctcccggagatgggtaggagacgggtaagtacaccgtaagggtgacggtccgcgacgtctccccgtcaattgcctcgcccagcttgacctcgaccacgcagtcctgagggtggtttaggacattcaccaagtcgtcagtgtagatgagcttgatactctcgatctcctcgtcgcgttgggccttgattgcctcttgttccaaaagtgaggcctccatggcctgcactagaagtctctcctcctgtccgctcgagtgctcgacaaggacgcaaacctcataactgaaaattgagggaaatcatctaatcggaggtgtagaaagcttggctgtgtacaggtacgcaagcaggtgggcgattcaggaaattattacacgaaagtaaggggacaggggaggttgtcgcgtatgttgtggcgccggctcgccaggtgagcgatgccgggacaaaaaacaagaaaaaagcaggcaagcacaccaaaagctgacgtttctttctctgctcacgtgacgtgcagaactgtggcaaattgtgctgcagcgagtatcccagctcactcccgcccatccctccctcttcttgatgcaaagcagtcgaagcacgtgctgcaacatg

SEQ ID NO: 5961 - DNA, 3 bp, Nannochloropsis_gaditana
tcc

SEQ ID NO: 5962 - DNA, 700 bp, Nannochloropsis_gaditana
cagccggaagcgcctaaggcgggcctgccccacgctggagatgttctacctcctcgggcaccggatcgagcagtcgcggtgggagcatgtgcaggagctggagggggcggtgcgagccggggaggccctggccaggtcggcgaagagaggtaatggagagggggggggggaaggaggggaaggaggggaagggagcgacgacggggctccgcaccccacgtcccgcctcccgcctcccgaagccacgcccgcgtcctccgaggcccgcccctcctccgccgccagcacgggccgactccccctgtcggacctggtcaacctcctggggcccctgctcttcgcccgcgccgcccctgccagcgcctcccgcgagctcgacctcgatctgggtcagctccttcgcttcatccaccgccgcagtgtctccagtggcccctctttgcctgcttacgagagcccgacggatcccttggggagcagcaccgacgggggtgacggaagtctgcccccgtcccccctcttgtcgccctgcaccctggccgaggccaagagcgagatgcagttctacggcatgcagctggcgccccaccacgtggaggtcctcttcgtcctctgtgcgctcttgggcgggaggaagaagaagttctttcagacggtgcttctagaggagatggggctgctggaggccctgacagtcatg

SEQ ID NO: 5963 - DNA, 700 bp, Nannochloropsis_gaditana
acctgaacagaggtgcgttgaagagcagtcggaacttgcacgtggttcgaaaagagccctttatgaataaactaaccgaaccgatgcccgtcccccaacctccctgtctcagccctggatgcctacgtggaggccaagcacgctcaaacgccacattcagcatcaccgtacgccccattcaaccccgtatcggcaccgtccctcccgggaaacgcggagtggcaggaagtaacccaggctgtcctccatctccgcgaccggctgatccctctcgacgtctccctcatggacccaccgggtcgagtgcgcgcagacagcggccacgcggacgaccgggagatgttcgtgcgcgtgaatggtccagaggcagttttgcggctgctctcgccgccggtcttggtggcctcggaggtggaaaacttgaatgtgaacctcctgcacgcgagcctgggggaggtagtgaacgagtccatggccttgctccgggcggccgtgcacgtcgaccaggacaccggggcccgattggcctctgacgaggtggttgtcgtcttcttccagctcctgcggcaccggtgtttcttcgacggggctgcggccgtcctcgaggacctgctgggagaccgggcggagactttcttcatgggccgagtgccagacctgcgcggtatcctcctcagcctctccctccgacagctcgcgc

SEQ ID NO: 5964 - DNA, 700 bp, Nannochloropsis_gaditana
tgggatgatatatcttcaacggccatggtcgtacgcagtgatatccacccctgtgcttgtcatgcgtgcaaaaaatgagcaccagtgggggaaatgggcggtacgtgagaattcttcgagctctggtctctttcagcgacgcggtgggagagggtagcacacaggtacctggtcatttcagtgaccccggcgcacacgcaccaggagggcgtggctgcttgagtgtgacatgcgatgaaaggatgaggaggcagacatttttttggccacttacatggcgagcactacgaaagccatgcatgtttgggagtcaggagtgacggcaccctggccgcgatctgcctgcataacgatatgttgccatagtccgcggtgaaggcatcaagccatgttccgttgagaactcacggtacgcccctttattttgtaagcataaacattggagacggacaacgccatggactggcggcggcttttgtccgcaactgaggcctctgtgacgggctggacacgtaatctctggtctcgcacacggacgccggttcctgccccctcggactccgagcaggaaaaatcaggtgggcaagattcggacgtaggccgcgatgttgtagaaagcaaagcttacaggccgttggagcctgtgtatcagaacctagcccgcggcttgacccaccggcagacggtaggtcgccgcatg

SEQ ID NO: 5965 - DNA, 700 bp, Nannochloropsis_gaditana
gcaaccgccaacctcctccccctcctcagcggattgcttccaagacgcctgtccgatagttggatttcagccgtggtccagcctgcccagcactcaactcagcgacaggtacgttggagcaaggatagtgggcgatatattgcgacagagggatcttaaccttgaagtcgtgccgcgacatagtgagaccagtacaaccaatctgggtcccgatacacgacgtgtatgtcctatttccccaacaagattatcgagcctccattcattcatttcccagtgatcttttgcaaggcccgtgatacgtagttacgtacgccgtacgttcgacggaccgtgtgtcgcataaacggttttgttaccagactgagccgcattcagtacgttgtgtcttaagtaagatatgttgttttctctaatctaccttaccatagtggttgagagattgacctcaaactatccatttcatttgcctctgtcacgttcagcagcctaaaaaacttcacgcttgatggagtctagcagagatcgtcaatttcaggcatcttacggcgtttaaaaacccggtcgctcgcttgtggtgtctgtatttgttctccaaagcgaaatgcttttggcaaaggaagatatgttgtgaggtattttaaggccttcatcctcctcacacagcactgctgctctgcaataagcttctgcggacatg

SEQ ID NO: 5966 - DNA, 700 bp, Nannochloropsis_gaditana
gactggttgattagggtgcaatatcggcatgtccatggggcattaaggagccgcggagtttcacaggcccggcagcacgttgcaacgccatcatctcccccgtcattgatcaatgtacacacttggcattcccatcgtccataaaggtccaccaccaggtcatcctcctccattcccccgtcctcactgccaagtgtgcagttttcaagaggctgatgggaatgggtagggtggtaacctgagtggtatcggggggtaagcagggaggaggtcaaaggcaggaaattgcccagaagaaaattttaatccgtgcccatttggtcagggagtggagtggaattctgacatggaacgggaattcgttgcgtggaagtccgcaccgtcgctgccttgtccatttttgtgcggctttcatcgtgtagccagcgaagtcgccggagagacaatcgcttcaaagctatttgggttatggatgctgaatcatgtttgccacgacggactctcggagaccgcacctttcgcattcgccgtgatgtctcgaaagaagcatagtatgggtattcttgatacgctttcttattcattggtgtgttgtaacacctgcactaaaaaaccaattggggcaataccaggctagtctcctccgccgtcttacacacgtacttgacttcccttagggcacaaggaaaaattcaccatg

SEQ ID NO: 5967 - DNA, 700 bp, Nannochloropsis_gaditana
tgccactcacatagaaacggccaatccacgatcgttacatctccgctttcgtttccggcaacgacttgaataattggggcatctgctcacgctcgttttacccgaccgcaaaaaaaaatggagagtggccaccatgcttcaaggagaagctcggtatatgtccatcccgcgtgcctgcaaagacaaggtgaagatgcacccggcgaccatagtgtgtcatgtacctgtttgacgtttactacagggtgccatgctttattggctggaattgtggacgcttgttttctggaatacgaatatttccccgccctgtattaattcccttcaagcagcaagctatcttaacaaacgttgtgcggccaaaggaaaatagccgccgagtccataaggggtcttctgacttcaaaatctcgcgcattccaacgtgtaaatgtgcgatcgaaagagaaagcattgacacagggaataaaaactccatcaattggaaagatctctggaatcggtggcaccctgttccgtgaagaagcgaagctttgcttgcggccgtatgctcattactcacccactgactcgttcacataataaaagtcccgctaaaaccctacaatttcgcttccgacgctccatcattccatcatagaaattgacaggtctactgaaatcatagttccacccgttggtgcgtgtccttcctgcaatg

SEQ ID NO: 5968 - DNA, 700 bp, Nannochloropsis_gaditana
attttagaggtgtctcgtggtccaaggagaccaataaatggtacgcgcagattcgcgtggcaggacgtacgttcaacctaggatatttctcagacgtcaaagccgctgccttgcagtacgacatggcggcgcgcaaatatcatgggacatacgcgcgttgcaattttgatttacaaggaaatcgaacgcaggttcgaatgaagctcaacaactcggcagctgccaaggtcaaatatactgtgcgtgagaactcggacaaagaagacgagaacagttgacaacgaatgattgtgataagagtgtaatggaacacattcaagtatctgtgaatcatgatttgcaaatcattcgaaatagtttcttggcaggcacgaattcactgatcatgtagagggacttgcgtttcaagaactttttgaatgaagtacccgggctcaagttagccccattgtagttttcggaatcgtgctccgcattcctatacactgagaaaagacagtaccaaataatttgcattatttggaacgaaaagagtagtttgcggtgactcgagttgcttcctgcctcggcccatgcgtcgtcacgcgagccaacccggcgatcagcccaagggcaacttgaaggcataatcactgcacgtatgcctccatgcgcattcctcactcatcgcatcaaactgcacagctttccttcgacgatg

SEQ ID NO: 5969 - DNA, 700 bp, Nannochloropsis_gaditana
atgcttccacctgcttccacctgaggcttgtgtaagtccaggaacatccctttggtgctcactgcttcctgccgcccgcattttcggaacgaatgatgatacaggaggggccggaggaatgttgctgcgaacgacgatcactcgaaaggtgacacgcgcaccgctttgcttccctccttgtcctgtacttttctttatgacaacagctttttcatcgcagcgacaagtggaagagggcaggcctacgcaggtcctctcgcctgtcttttcttcacagtatatgggtgtaaactggaatggaaaaaacaaccgttggatcgctgaggtgcggcacaaaaagcagcgactgttgcacagggcattctctgatgaagaagaggcggcgcatgcaatcgaccgggtcttacgacagcacttcggagagacgattctgaccaattttcatcatccctccggcgtgttcttagatccgaagcatgcatttgtcacaaaggtgtcaacaggaagcagttcatcttgcagcgacaacacttttacttccacggcgacatgggctgtcacgtacgtcgaagggctccgtctctacaaggcggtgatcaaactgcgtgggcggccacatctcattggtctattctcctccagagatcaagcgattgcagttattaagaagaagacacagccgagggagaaggggggcatg

SEQ ID NO: 5970 - DNA, 700 bp, Nannochloropsis_gaditana
ttaccagcctcgcctccatgccatgtaatctgtggtgttgttattttcatcgtgctggtggtaggtgtaggcaagaaagctggtgtgcgtccttccgatttctgtaccctaggagggggggggagagagagattaccatccatttccttactcttttggtgacactcgtctacgccacattatcagacgccacacttaagacctcctccgagccttagaacaggacgcacaccttgggggaatgcacacgcaaggcaggagccaagctggaagtgaaattatcgcctagaaagaaggcttggcgaagcaaatgatatacgactttcccgcctcccaccgtcaacctacacgggagcagtgcccgaaactctgcgaggcgtcaaaccatgccacggcaggccctggaggcttggaagggtggtcgcagggtagcatgaacctcctaggacgtgtcatcaatggcgtgtccggcaactttggcagtattggtcatggttatggcctcaaagaagaggcagggacgtagtatccttgaacccgggccgctggtgctgttgctcgagctgcaggcacttgtcaggccactttatgagctgaaacacgacgcccgcgggaagaagttgacgtacgaaagtcttaagtgtcttattcgtgcccttttgttatttgtgccctcttaggcaaataaaaacgcatcatg

SEQ ID NO: 5971 - DNA, 700 bp, Nannochloropsis_gaditana
actggtgccctcacacattctttctccttcattcgacggcctggagcatgggaggggtggtacgtcgcgggtagagggtgacgtcgctttttgctcccacatgctttcggccgcgtgacagggcctgcttgcgcctcgcacatacgccgcgcctctcccccaggcagtccgactggatgtttcaatgatgtacctggatagttgtgggtagtggcgctgtataaaggttgtgagaggaggggcatgacccaaattgctttgacgcaggggtggaggataaagcgatcactttgtcatgggagagaccaccgaaatatatatgtgcaccacgtacagcggtccaaacgtcctttaaaatcctacaatgcgtcggcattatcttattgtgtaattagtgataactttcgctgcaaagcaaatttattgcgtcctttccattggctacaagctcaaccagactcggaggagtgacgagttttgtgacgcaaagcaccaaatatgtgacgattccatgcacgacacgacaggcttccaagtgcgaactttgtgtcccacaggaaacatgcacatgcaaacgatgccacttggccatcaactcacgtatgtgtgcatcactctttttggtttttccttcctgccacagggacaacgcatcacactttgatccaccggcctctaggacattcaggtttttcagatg

SEQ ID NO: 5972 - DNA, 700 bp, Nannochloropsis_gaditana
gtacgtaaggggcgatcttaaatttaacacttgttgatccgagatttgttgaaccttgtgtgacaagaagcatggagctacaaaatcctcaattccccttacattcaagtcgccacgaatttcatttctctttcatattcacatgtttgcccatttatcttgcgaattggaacctttttttttctatgtgtctttcttattaccccttcgactcacgacgtccctttcgactcgtcgattatgataaccaccgaaatagtctccagtcgacgcaaagacaaacaaaacggccaaattatcgtcagttgtaacacaattgaatgcatttttggcttcgaaaaacccgcaatgtcggatgtaaagggggggaggacgtcaacaggaaaagggatgacggtggcctggatacccgatggccgtgccatttgtttcacttccttatcgctctaaaccccatgtcctcgctacacggcaagccttctgacctcctccctatacatcctttgtaactatttaacatttcaaccaggtcttcgaaagttgagggctatcgtcagccatccaattcgccctttccctactcctaccctgcttaagtaactgttcttcccactccattcttggcaaaatacgggacaaccccccaccgtaaaattgccaacccttacatttcaagacctgtcacacgttacttatcatg

SEQ ID NO: 5973 - DNA, 700 bp, Nannochloropsis_gaditana
tgtacgtattactttccgagaaccaaatgttttgagctatagcctcctcgtccttcgctgccgcagtcgaggtcattttgttaccgacccaccccattgaagggaggcgtcaataacgaatgttttggagtgaaaaactcacacaaagtgacggacccgtaggaaagacgaatacgtgtaatgcagccaatgtaactgtattattactttgtggatgaaaaggagtcaataagaagttgggaaaaaaaaatggcgaacaagagagttgaagaaagcaccgaagcggatcgactccgtttccctgcgtgcgccattttatctctttatatcagaaagcattgactagtgtaccatacgtattcggaaaggaagtaaaatattgggtaaacgaggattcacaagtcaaaatgccacgaatggctcagaaaagccgtgccttttgtggaaaatcatactgagtacagcacgtcgccagaatataaacaacaatccagcagtccttattagctatctcttcacatttcggcatacagaacattcaagtgaatgttgatatccctcctgatctaatattgtggcttgggaattctttggcttatatacaacacgaataccccgctactcaagagatcgcttgccaggcagggtgttcagcttgtagccgtgactgacttgtatttcgcaaaacacctcaccaagc

SEQ ID NO: 5974 - DNA, 700 bp, Nannochloropsis_gaditana
acgcaggcacggaaggaaatggaggcccgaccaccacttatcctccgttcatattcaattaactcgctcgtcgctgctttgagatcattttgaattcccattattgtgaccgcacgactgctactcatcacatggaggagagtctgcacccctgctatagggacgggaacatttttctccaaatgacttcgaaagacggataaaagagggtcatccgacgatggagctgaggaatgggagggcaagtttgaagggggtattgaaggctcaagagctgcttccattacaggagcgttggctgtatcgaagtaaatggtgcatggcaaggaatacgataaagcatcagagtgataactgtaggcaaataggacggagggcatatgagcaggcatcagaatgagggagtatcaggggccgtcagggtgtcgctctcatcctagcgagtggccttttgtccgtacattttttcctctaactcccggcctgcacacatattatcgacaattgcattggcaggcacgtgaaacatatatctcatcataaagggagaatccttttgagagggtagaaaaggccttggagtcagcagacctcgacctcccgccactgcctaacgaagttgccctactgcaaactgcctctacttctggacaatttaaaacgatcagcgcctataatcgtaagcacaagggtataaatg

SEQ ID NO: 5975 - DNA, 700 bp, Nannochloropsis_gaditana
ctgagaagaggaataactttccaggaggaaaagataatatttaataaattttatgattatcttaaaaactctcatgagatgaaagagtttggtgtagcgtgggaacatgtgggattatttagaaactacgagatatatgtcaaacgagtaaatgcgtttgaatcttcatctcaatgcaagcttgaagtgtgatgatcaaatcgcacaaatgaaagataaagtgtggctcgtgggcacacgagacagtcggaagcagatattcggtgcgtggatggggatgaaatatgggccaaaatagttgcgccatattacccgacaggaaagaagagcaagcaagtaggtagcactgagcaatgatttcgtaagagcctgaaaacaacgtaccaagctcatctagcacaagtgtttcacagccagtgcaaagaaagttcttctctcctacttccctcgtagcacacgccttgccccgccattggcgataagatacttctgtcgtgggtgtctcaaaaccactcaaaaccaacgcgaacttcccgactcacgtcacacgacgaataacagagatggaaaactgatagccgtttgagtctatgtgggagtgggagatgatgacgactggggtgatgcgttggaatgaaggctcctgtctggccacaagagatgcgtaaaatccttcgcactgtcggccgaacttacgatg

SEQ ID NO: 5976 - DNA, 700 bp, Nannochloropsis_gaditana
gcgacaacagccaagtggacggggctcagggccgtcaagagtgacaagcaaaaagggagcagcagataggaagaggaaagttttaccctgtcgtgaaagtgctgatgaagataaactatcaagaaaataatcatgtgcattcacaaaaacagctcgttgttgtttttttgtttcctctttgatcagacctttggtgatattcgattctatttcttgcccgcatctcataggattgcgattgtaatctccgcaacagcgttcaaccagaaaacgtacaacgatctgagcaaaggatagatggctaactctgggaggtcttttgcttggtatttgtagccggaagatggctttgtggtccagggcttgtattttctggcccccacgactgatctacgtccagaggggtctgagggactccatgcaagccaccaagcacgtacatttcacacgctcgtacattacggcattttacgctccgatatcgcgccacgggaatgattggtcacgcccatcaaagcactcgccggttctttcatctctatactcaaatatccttacccttcctcgacagtcgacgcacgatgaacttcgcggacgctgccacgacgcactcagccgtggaaggccatgcctcccaggggaccgaaagggaggaccaagctggtggtgacgctggaaggacctccctagccatggcatg

SEQ ID NO: 5977 - DNA, 700 bp, Nannochloropsis_gaditana
ccggcttcctcccccccgacgtctacgagcggcttcaggcccagatgacggcgctgcgaccaggcgctccccgaaagccgaggccggagccccccccctctcgaagtcagcggcaggggcgctgcggaagaagacggagacgaggggggaagagggggatttgttccaaggcctgagcgcagaggaggaggtggaaatgcttttgtcgggcaagagccgtgaggagtttgaaatagagagagcggcggggagagggagggaggcccagggcggggaggtagatcttgacctcgacgaggaggggaaggaagagaaggagggagagggaagggaaggggaagaagggggggaaggggaggaggaggaggaagaatttcgtgcggtaatttgccagcggtgccacaagctgaagcactacggggacgtggaggacgccctgcgcccggggtggagcgcgaacgagctgttgacgccggagcgcttccgggagttggtgagcgtggtgcgacggaaacgctgcgccgtagtgtgtctggtggacatctttgacttccatgggtcccttctctacaacctgccccgcatcgtgggctccaacccggtgctggtggccgtgaacaaggctgacctcctccccgcggacttcagccaggaccgagtccggatctgggtcaagcaggaactggagaaggtggggatg

SEQ ID NO: 5978 - DNA, 700 bp, Nannochloropsis_gaditana
aagagttactcatttgctgtccttccttccattacctgacgacagcctccgaaggaaatatgcattgaagttcgcgtgttggccgattgcggggaaatcatgactgatcagggccctgttaatttggagagaggtacaaatcattttttgcggcgcgctgatgtcgaaggccttattcgacagggcttcctgcttcatatagccccgtcggcaaggcaaggctcttcctgaataaaactgtgttgacagaccagtaaatatcgccttcgcgaagcctgcaattgaaagctgaaatgtagatactggaaatttcggaagacaatcataacaactacaataaacgaaaagatgtaattggcgcaacaaatgtgtgcagtgctatcgtgtacatcgtttgctgcaccttttctttgccttttcaagcaccaccagttatttaatgtccatctcattgttctccgcatgagctcttgagagcattcaagagcttgatggagcacaatcatgaccctttgtctcgtagttccgtcatggcaattttcggacgacgtatgcctcgctcgccgccctcgctggggcttcggatggtattacaagaagggcgcaaccacgaagacatactaccgcgtcccttttggcgcctttttggtgccgcatggagcagtaaatttacgactaatactcttttctggcccacaca

SEQ ID NO: 5979 - DNA, 700 bp, Nannochloropsis_gaditana
cgggaaggggggaagcctcccttgctctcctccaggctctccccctgcgtcgggtaacaggccgcgggcttcctcaggggcgtttgcgggcgccagtgggagtggggtgggggtgaaggtgtcaacctcgaccccggggtcacaagctactttaacgactagcggcatagcgacggcggaagagggcaccccaagcacgcgggaggaccgggctgcttcgttctcgacctcctccaccggcacacaccgtctttcgaatgactgggcgacagcccttctctctgggagggagcagccacacgctcagggcgatcagcctctagaaaaggcgcaggagtcgggtccggggaacgctttgggcgcctcctgcgcatcggcgacctcagatccggatgacaaggaaggaggaagcgtccggcaggatttcgcatcgtcaggaaacatgcagtctggagaagagcagcgttggcaaagcctaatcgtgagtggaagcgatagcattaatttaagcaataagagcggcagcagttccaatagtaacggaagcgaaccaacgagcggaggttctgctagtcgcccgggcactcatgccacgggtgctggcgcctccacaagcggtccccggttgctcaatgtcttgctccaggcgcaagctggagagggagagcgggtggcagacgccgtggtcaaggcccagatg

SEQ ID NO: 5980 - DNA, 700 bp, Nannochloropsis_gaditana
tactgattgtaaggggtatgagcttccgaaaaaatgccaagacagatgagagattttctgatagaggaccgtacggcggaggacttgagggagggatgtcattgtacacgcgcatagatgtgtaaatgtgatcagtcatgcgccacacctgcttcacgtttcgttaaatagtcatgacgatgttacagagagtacttggaagggcctctcacctgtgtcaatccgaaagaatgtcgacaagggatgtggattggtgaaaggagttatcgggctaccagctggcaccgaacaacggttttttgaattttcaagcgacggaatgaaaacgaagaatggcgcgaagcgagcctccgacatagcagagcctgttagtattcttcacactatttagcgacgtatgaattgccattctgtcaactttacctctcatgatagagacagtcagatgagaggcttgcttccgcgtcgagatggccgctgaggagcgccaacgattatcatctattctttccgcattaacccctcaaaacagacttaagcccgtcttccttgcgattctcatcgacctacaacgacgcaagtaatggactttggactcaagggacgtgagcttttgcaagacttaaaacgaagtgattggttgcctttgtacaatgaagatgccgtgagccgctgcttgcaagagtgtcaagggcatatg

SEQ ID NO: 5981 - DNA, 700 bp, Nannochloropsis_gaditana
gcaagcgtcgctaagcacgacagatcgcggaaaggactcgcatgacgcagctgcagctcccgactccttgcctcctccttctatcaaagcactcgacccggccgagccgagttgttcaagcccccatgtcgtgatgtcctgttgcccgcaaaatgtacagtgcaggacattcaacgatgatcgatgcggaggcaacaccgagaagcgtgctggtgccacggttgtggtggttgcaacacccatcgggagcctgaccgcgtccataggcagggaccatggtactcctcgagcacgcccaccagcttttaagaagaaggagagatgtgagcaagcgaaggcgcgccacagattctctgcctctactctccgtcgcgtgtgcctgaccggactgcgtctctggcccctgctcctgggaggggccactagcgtcttcgcgagtcccactagttcccccttgcgtcccagcaccgggcccgcctccccccccgccgtcggcaatgccaaggtcactatctcggctgctgctcgagtgctaaccgcacctggagcgagtaccagcagcagcagtagcagcagcaatcctggcgtctcagtagcggcggcggccacagcagcggccaccagctcgacagcaaaggctcctcccaggatccctcttcctcccgcttcctccaaattgagggacagtgggcgcctgatg

SEQ ID NO: 5982 - DNA, 700 bp, Nannochloropsis_gaditana
ctgtgtaggccaagtgattttcatgtttgttttccgacttgcttccgtattgagagcgggcgaactcgtgtgaggaggaggcggaggaggatctggagggttgataggggtagatgggggttgtgcctgctgtgcgcttgcgacggttgacagcagcagcatggcaaatgaagcgctgaaatagtgctttcgttcccgcgagcgcaggcgatgcatggttgatggcgtgctggcagaagacgaaacgaaggaaatatagatgcggacggaggcgttgggcaccaagtcgttcgaagaagaaaagttaaatctgcccaatcttccggacggtctgtggcgagtgaatgtgtgtgcgcgtatcagcataatatcttcctccgagctttggccggacaaggcaagcttcagcggcgtccccttcgccaaggttgtggcttgtccaggcgctgcaatcgcttcttccctgcggccgcgtcgaagcccgtaacagagtcttctgggccgcaagtaagcgtgactgccgccgctgtcgggaacatgatgcttgtatgtgaacgatttctcaaccgttatccacatgcgtcgtattttatcttcttctttcaattaaggaccgtccaggacatcctagggacggagacgatcgcgttagggaagagggggacagcggatatcaatttaggcgtaccaagctatcatg

SEQ ID NO: 5983 - DNA, 700 bp, Nannochloropsis_gaditana
ggacatttctacctttcttaatctttacttcaggtaactaggaattcatccgcgaatcgacttctcaacggtcgccgagtcttccattttcttcttgcacatcctctagagactccgcgagtagtttatcagaaattgccttttggttctgtttttcaaataattttcataagcacgtgcgaggtgcatagagaccgggtcgtagctggtccgcattaattaaacgtgacgcatgggctttccgttatcgctggaagttgcgcaagggtggtgtgcgggttcttgcatttcggctcttgcgtgcggagggtgacaagcctgtctaactaggggcatggacttagtactgatcactcaccagttgtaacgctacttatttaagagagggggccgcagagagtgttctgaaaggtgcattcgtccgttatgacttgatggcgcagaacgcacagagctgcactcggatgccttgctccgcatcatgctctttctagtttgtgcaaaggcaaaggccctggactttctaaacatatgcattcattatttcatggcgtccgctttattctcacgattgacgcatccctttgcacaggtcctcaagagctggtcgtaactgttgtcgcgttgcgccagtcagatattgggagtgacttgccaagagccgttttaggcaaaagatcgtgcatctgaaataagtatg

SEQ ID NO: 5984 - DNA, 700 bp, Nannochloropsis_gaditana
tataccatattacaattagaggcacgcttctggtcagacactgacaaggccagaccgatcaagcccctagcctcttgtccaattgccagtgcaaagatatccttacggtcttacccttccccagtccgagtcaggcgttttgccctcggagcttgaggacaatgctgggggctgcagcacatgcctccgagcagagaaagtgctctggaggaaaagatatcttggcgcaaatcaacgcggacgacacatcaccatgtccggcctgagctacgtcatgaagatgcatgacatacatgcagccatgccaaatgggcacaagatgtcataaagcttgtgagtgctctttttgctcgctcgctcgccgcctgccgctgctctcccagacgacgtccgaatcgacggcagtcatactaacgggacattggcaccttgattcagctctaaaaatccacatcgtgtcaatcgagtcttctaatttccttcggcatttctttgtacctcgtcaaacccaggtttggaaggaacgagtgtaagagaggagaacacactagaagcagccagaggagtcgccgcaagtatccccgggcgctctgggactgtacgaggtctccaatcgagcacactccgcattaaaaaaagcagagaaacttcaaggaggcagcagattcactgagcctttttcgtctatcccgtggtcatg

SEQ ID NO: 5985 - DNA, 700 bp, Nannochloropsis_gaditana
cctgacgggaaaaggtcaagaggatccataatgatggaagtcacatgtgcgcatgttttcacggaaagaaagcatgatcaggcgtgataaaggcaaagcgcaggcgcgcctgcgggaacttctacgccgacgaggctccttcttctgattggcgcatttgaaaaacctagggcatttttggatgcatgcgcctagctttttcaacgacgttttagcgaacagttattgacggacacaatcgcatacataaatacaggtaggggctggcgcaagtggttgacactacctcgtttcatcgcctgttgtagcgtacggggctgcagcgttgtcatactatcgtgtgaaaagttcgtgcaccccgcatcgagcactaaaagttgtgatttcaaattaaacaataatcgaaaaggtaagtcagatacttgttgcgttgggtagaacgtatcgtgtggaggggacgagattgtctttgaatccacgagaggcctgtaccacccgtgggaggcgggtagagtccgtttccgctatggcttttaaagctcacgcaatggctgaaatagagccagcaaagatgctctaactatagcttcatataaaattatgaagtgtcatgcgcggggccgctggctgggatgatatacttcagcatcggcgtgcagattcactcgatctctcttgcagcccgccacctagcctcatg

SEQ ID NO: 5986 - DNA, 700 bp, Nannochloropsis_gaditana
gttggctctcaccatccgcgcagacgaggaagctttactcaagcagctcagtgaggaagcaaggcatacaaagcagcgccattcagcgtacagtacgaaaaaaatgcattcgcacaaattgtctcatccacgattgatggtgcataatttcaatggggtcgaaagtgtcttggtgtagaagggaatgtaggtattgtaaacaacatcaggacgcaattcgagtatgagtgacgcctggcctgcacgggtgtgaggctccgaaggggggggaaagtgtctcatggattattgttttctcaacttttacaagtacattctaagctggcgtgggtaagacaaaaactaaagaaattgggttactctggcaaagtcgtctatgggggcacagggggaggttggcttgattcttgctacaggcacgtgaaagagatgcagcaactttcaaaatgacacgtcttacccatcacgagtcctagaatgctatgacaatattgtccgaatcgatacacgggttcgtgcgagggagtccttgtgcttgcttctatacggcaaaggccaagcccgatcgctcgcacgaggaggcactttgccgccctcgcccctttttcgtggaaagcgaactgttggtcaagcttttaatttatgcaccgaacccatgagtgcatgtaagttattgatcctcttccgcatcgtctttaca

SEQ ID NO: 5987 - DNA, 700 bp, Nannochloropsis_gaditana
gagcaagggcccgaatcctcccaaactttcccctgtgcgttgtccggtaaaagtattaattagttgcccggcatgagccacaacctgccgcggtaccacctcaaaacatcgcacgcgccgactcgcaggggacggcgtggtgtgggcatcgagggtgtctctctcatcataagtgcccgcgaggctcgcctacagcggactgccatggcgatcctggtcaatgcatgagacgctgagacatacgcttcctacgtgtgcagggcgatggtggacacgatgcggtaccagtcgtacgtttgagggttattgtgcctctgtttgtgggattactcgggtaccaggtgtaggaaagaacgcgcgagcacggcaacaagaagatcttgtcctggtctcacccttcttctgcttcatgcatattacactcccacgcttgcgttccattttcggcatcataatgcacagactcaaccgcatacactggaacaatggtgacgacgatgttgaaggcgaccttgatggggggctgcctcttcttggccagtggatttcaggtaagtgtcgggctagctgggcatggggacggtgcaaattcaggacgggggagactatccctttatcaaacaaaatgctcctcctggcctgatcacgtcgcttttctttttccgcgtctcgatgtcagatgcctgcaccccgtgcaatg

SEQ ID NO: 5988 - DNA, 700 bp, Nannochloropsis_gaditana
actattttcagaagggatttacaaattctattttagaaaaactttactttcaaacaatagagatgacgatttttaccaaggtaattgatctaaaatgtgggacattggagacgcgaagaaagtgaggtaccgaatcaggaggggtgatgcctatcgatggtgactcttgagagcttcaacacattgagcatcaagtatagtcatttgacgagtttcatataaaaatatgatttcccttttacagacctgaatgctgtgagcggcaagaaggccgttgccgtggcaactgagcgggccggaaatgcccccgtaaaaacagtatagttctttgagcgaataaaacataaaaagatatcgtcacgaggatttatttatcagacgatccctgttctaagttgctcagaggcaaattcatgttagtcgagcgcaaccccacatcagctttccgctgctgtcgcactgtatttgttctgctatcacaatgcccgttgaacctgtcgatttcagaatcgtttattcagaagatcattaatatgcgcaaacgttcgtagtttgtttttgtgtagcaatcgagcaaaaaaatattccagagaaggagggaaaaaagcaccgtggggaggaggttgaaaacacttgtagctacattttcaattcatctcgacttacgcgctgaggtattttttttgctcaggaagcgatg

SEQ ID NO: 5989 - DNA, 700 bp, Nannochloropsis_gaditana
ttacgttacgcgcttacagaatatgtgtactcccgcctcacacttgcacagatgggatggccgcctggatgatctacagctcatattttctgcgtgtccagatctgcattgtcgttatttggggtgtcttcgtactctggaatgatgaggtgtatgagctatatcatgctgtgttgagtaacgggtgaagggttttgggtaaagaggtttcgaagcttacatgattggcaaaaatctaaagaagattaaaaagttgtgcaaattcagcaaagcttgtgctgttcatttatacaattgtatcgtagccaacacgtgtgggtctcggtgcgatattcgagctcgcctcccgtcatgagtatgcccaacggcccattcaaaaagacgttgagcgcggctgcttcctcaccagcagccgggtgcgacagtgtaattgtccaaagcaaacttcattggcagtgcgtagcttggagatacaaatccttttcctgtgtgtatttagcatcacgattcccttctctgatcgtccctttttgaagtacactgcaaagaacatgtgtcgttccaacatatccaacaccgggctaaaaagtgtggaagtcgtgcgactttctcccgcacaatacacccacattttcgccacattcaccacttttatgtcatgatgatgcttatccacaggccatatacgacggtatgaatg

SEQ ID NO: 5990 - DNA, 700 bp, Nannochloropsis_gaditana
gtcagtgcaaagatctttcgcatacgctattggtcccactgatcctgcgttattgaaaaggtagactttgccatacttatgcattgtcattgctgtcgattcttgctctgcagaaaattcgtcaacggtggcaaaaattctagcaaaattgggctccaacgtctctaggtttcccaaatcaaaaggccatgtccatacatgtacaccaattttactttggtctgataaagatacctcaatatcacgttttactgccgtgagtgcctccgcgtttcgtgcaataagatgcatgtccacagcagggccccatttgcgggcagcttcaagggctaagcatcttccaaaaccacggcttgcacccgtaataaacaccaggaaccgagtgcctgatgtcgcaaacattatgaagaggatcttgaggcctctggtgtttggttatagagattactggtgaattaaagccaacctacataatggaaggggataccgaaagggaggggaggttaaaggtaaagaaagagcagctcgacgtccccaacgtcctctttgcggagcgtttccattacacgccgcccttcttacacacgttagtatcataaataatcagtgttttcccatagacctaggtaaagctcacgtcttaattggagaaagaatacagtcttcgtatcgcacgatcgcctcgcttttttgtgacatg

SEQ ID NO: 5991 - DNA, 700 bp, Nannochloropsis_gaditana
gacacgctgctacgtgattcgcgggaagaagggcactctagacagggaaaatgtacatatactctcaactaaacataagatgggtcttgaaatgtggtaagacgttcgatccaagggaaaagtgcacacacttgctctgctaggccctggggacagggggactcaatcatattattcaccttggccaagaagagagaaccacctgtcaaaaagacgagcaacggcaagccagcgctcaattttttccatgctcgatgagatatcatggaaacaacgccgatgtccctgtacagagataacgtgacattgttggtgggaacgtgtgaggagggaggttatccgaggggaggtcgagataagccataagataacaagcagagtcagctcataagtcttgaactctgatcatgttatgaacgtgactggccgtccatatgtatcgtccaagctctcttatgcaatactttggcataaactacgtcgcggcgcggcgtcagcacttgtagcactactgattattacctggtacctcagtgaaagcagctctcagcaggcgatggagaagtaattatggggaattcaccagcaaaacataagacttgacacccacgtacacacgcacagagatattgtccacgtggtctgcatcatttgcgttccgtgtggcgtgcagtgagctcacggccttgcctgctctatg

SEQ ID NO: 5992 - DNA, 700 bp, Nannochloropsis_gaditana
aattgaaccgttgtcaaatcttcgtgtcagtcgagcactccgatagtcgcacgaaacgttgcactttatacgtatgctgttgattcagatagtatctgcgtggtttcctgcatggttcgatgctcgtgccatgaaatttttaggctacggtatgccggtggaaaataacagttgtaagaggcgaggatcgcggaggcgaccggcagcgtccttcccgttttttgataacctagagtaaatctttctaatacttgatatctctaactttgatgtttatacctttttaaaggaggccagatcgaaaggattcgggtgtcctatccatacaacgaaccaaacccgctccacaagctgttgcattaccctcctctcccttgggggggaattaggtgaacgtgtcgcgcgccgtttgagttttatatctgatacttttgtatcccctagctactactccagctactagaggttctcttcctcccataaggcgtcacacagcgaaaagcgttcatttgaggtccgtctaccgctatgtatttgtgggtgggtcgttcctaataagcacggctgtgggctttttagggacctctacgataaaaaaaatcgtaaacgcgtttgaagtctcacacttggcgtgtataactttcctgatacaattattttaacactaatgtgtttcaatgtcaatcgtagagtacaaatg

SEQ ID NO: 5993 - DNA, 700 bp, Nannochloropsis_gaditana
tatcctcgtgcaaaattccacatttcgaccacactttttttaggtttggatttctgttgtggaccggagtgttcttgagtgaatgctccatattatccgatactggaattttcttttggttgcttttgtcaggtgtttgtcctgtattagcgagtgtcaggggttgcgggttatagaagaaagtcgggagggagatagttcgccttgttttgtatatccggcacatgaactttcatgtcgtgatatttagcgtgattgactgaacaaaccaagatagaaaattgaaaatttcaaaacttcaaagtcggtgacgttaccctaccttagattcttggagtagtattaagtatgacacactcaacatcctataatactagacgattgtttggacacggtcctatcgtccatatctatgcctttcttgtttatatttgcgaacgaacgcgtgttgttccagtgagccttttcaatcaaatctactcaacgcattcagataaggacaaggaagcacgggccatctcgatgagcatgccttccttggctgatgcatatggcttgaagtactggagaaagtatttcccgtaaagaggaactctaaagtgagtgtaaatatattctgcttaccgtggacaatttacgatacacactcccaacgggtacattcacatctggcacacacagttccgaaggaacaaggatg

SEQ ID NO: 5994 - DNA, 700 bp, Nannochloropsis_gaditana
gctatcgtcggcgctaggtcagaaaaccatggagttgaatttgtgctgtccacaccgatagctggcgacgccaggtgcaatgcctgcgcgggcgcggctgtcacaggaagaggtggagatgcactttgagctggcaatatattcgattcaactcgtccatgtccagctattgccacttccttttgggcgttcctccttggtgaggtagatcgcactgtgttcgtcgttgaactcaaatttcccattgttccaaaatttgtgtctgcgccttgacaccaagaagacttgctgtcgccgtcctcccaacgcgttcttgaagcaatccctgagactgaaaaaggccttaaaattgctacgggaaagatgaaagaagattggagacggcctcgagttagcgcgttacgattaattgcaacaatgtcctcatgtaggcgatatcgcggtcaagaaaagttaaaaatcggttgtcgagtcgcccacaagccagccgttgaggcgacggggggccggagcgcggagacctactaattggggaagctcactgaggctcattttggtcctgttttcgtcactgcgatgtacaagatgattaattgaagggactctagtggaagggcacgtttttcaaatcatctattggtgggtttctgagaatttcaacgtaaggccccagaggtcaaagcaaccagacaacggcatg

SEQ ID NO: 5995 - DNA, 700 bp, Nannochloropsis_gaditana
tgtgcctctccgtgcttatcagcgcgtacttacacggtctacttaattcgtgtgcgctggaaggggcgccaatggattgtgcgtcgtcgattccgcgaatttattgaaatcaatgatctcatcgtggacaaagaattgcacgccatatttccgccccgctccttgtgggccaaaggtacgtggtgtattttcttattatatatcgatatgaaggcgtaaaattgttcgatacaatcctatcaagcattttctctgcaatcgttgtaaagcttgagatttacttaactagttgcttctatgccgtgcatagtagcaatattatcatctgtatgtttatattttatttatgtttcgtctatatttgacagctggactggcttgtgttctggagactcgccagagccggcttgcctactacatcaacgaactagcacataaagtggttaacgaaccccgcaagcgagatattcttgatttttttcaggccgtggatagctccaactgtgaactagaaactgtctccctttctttttcgcacgacgagaagggagagcgaggaagctctgtcgaagcaggaatgcgcacagatgtgagaatacaggctccggcagctggcatttttctgctcggaactagcgatcacttttttctacctgcatcgtttcccgctcaagaaaaggcagctcttgatcgtctaatg

SEQ ID NO: 5996 - DNA, 700 bp, Nannochloropsis_gaditana
cgtcctgaggttcgtcggaaggcacatcagtaggcaccgaggccgcctctgaggcgtgaattgagtcaagtggtcgtggtgagggcgttttcaactccatcttgtcgctactctgcacaatcgtctgtttttgtgcaaatacatgagacgaggacggcatggcagtctagcaagtgctgtgatgtgcgtcgtccgccccaaccggaggcaggcggagaggaacattccccctcgcgaacaagcgacaggcgtgcgagacgaccacccctgcgagtcgccatcttctgattgacccacctgtttcctcgtccccagggaaatcaggcgaattggggtatacaacgccatcagcgggcacccaacaatcaagttcgtccttgcttggcgtgatattggcctcctttaagacggcgccttccagggatcggtagcaggcgcgtctggaattgcattgtagctcacacgataaaaaatcccctcctcctcccgtgaagagcggatctgcatttcttaacttcttcaaaccatccttagtatggccggacgcctatgcgttgcgccggttatcatttttttggtagtggggatggcactcacaggtgaaggctttctcttcaagttgcccctactgacacgcagcgaaacccgcggtcacgccactagcggcggtacagggaatcgaatcatagcgtttaaaatg

SEQ ID NO: 5997 - DNA, 700 bp, Nannochloropsis_gaditana
tgacttgcactggcaaacgaccggggcattataatccaagtgccagtgcccgaaacaaagcaacatcctgccccacgagacaatcttaaaaagcgtctacgcatcatatcaaccaccaagccgagcatccatcatcaggacaccagcaatccaaataattcccccctgcccacggccggaggaaatttggcgtgggggtggtccgaacccgttggctcgctctttaccatacgatcttcccccccccccggcggtcactttctctggctgtgcaacctgattgcttggtacccagtacctgcacgccacgggcgcgacgcgtgtggcgtttgataggcagggagacgtgatgtccgaggtcatgcgaaggagtggcggatggggtggggaggagtcttttctcgagctcgatgcgtgcaatgagaccggcgataaggtgcctctaggacttcagcaaatgcacacaaattggctgttcatcggtctctcgaaaatctacccctcatctgttcatactacatgactgcaccagtacttattactgacggaagtggttcgtgtcgcccgatcctcacgaaagaagcagtgctcctctctcgcttatgttcagtctcatatcacgatgtcgtattcctaccacaaatcgttcaggatcttcgacgcactttttcgtgcattctctccaaaaaatttcacaatg

SEQ ID NO: 5998 - DNA, 700 bp, Nannochloropsis_gaditana
catgaccatgtctctgcgggagttctgtgtactggaccggagtttcgcttcccacgccgcgctgtcggaagtatcgataccacaattgcacaagacatacaaggaaaagggcgaagatggcgcctgctatacccaaatatacaaccggccacaagccatgcagttcaaacatgccgtgttgcggaatagggtccctgtggcctccagaccaccaaaggctttagccgtagaggcgacgggtggaatatggcttggcgtcaatgtcaaagtaatgtccccttgcctgtcgtacggatcgtatttctgtgtgagctcaagacaaggcctcgattgatggagtaccaatggtaagcactgaaataattgcattctagatcgccttggcacgttgcatacaaacgagactcctccttgacccaagttcatcctttcagagatgtagcgcgattaacgattgttattctcaaagtgtgcgagttttgagggacgagtacttcaaacgacgtgtctcctttgtatttcgtgtttcacaatacttccaatctcacccaggtgaattgcaggatcacactataaagagtgctcgctttggtcactcgacctcgggtaacctccccacccctgcaaagctttcattctgccacgggcttcgcacatcaataacgcagaactacagaataagtgcgtcggtctcaacatg

SEQ ID NO: 5999 - DNA, 700 bp, Nannochloropsis_gaditana
atgctggtgttcaacagtcgtgtcaagcaagttttgtattattccgggcgtctgtggacagggtatgttatcttgatgttggaaatatgtcgttaaacaaggaacttgaaatatcgggcggatgaagaaaaagggagacgcaaaaaggggaggtatcatggtaaagccacgcaagctcaagaaaggcgggcgttgagatggacacatggtacaatattgtctccagacatcattgtggaggataagcggtcgttatcagggtttcgtgaagacactggcaatcgtgaagatgaccgtggcggggatacgaacgagcagccagaggatcgagaggtgcaaagtgcgtgcaaaaatggtcattaaaaatgaccaaggggatccacgaataggagaaatcatccactgacttttcatacacgtcgttgatcatttttcattggaagcgcttgctacatgcatttaaaaatgactttcttcttgcaccacaacgaagcaggcggcttcaagttctctttccgttgcttgccatgaagcgaagcggggcaccagacgcgtgtgaccgggggggaaaaagaaaaaggaaatattattccttgtggggagcaataactattgtgtgtcgcatgatctgatgataccaatgcacatactccatccccacagggctgagaaaaggcggctttgtctgtcaggttacatc

SEQ ID NO: 6000 - DNA, 700 bp, Nannochloropsis_gaditana
tttgctcttgcgtccttctcggaatgccacaaaatgtccataacgcgccattctcctgcatcggaaaggaccgtgcatccacccatgctgattccatagcgatatgaccagcgttccgcccgttgacagcacggtcgtcgtcagaaaacggctcaagaattgttattaaatgtcgggggggggggcgtcggcgctcgcttagccacgatcttcgttgccggcatcgatgttgtgctgctggattatttctcgtttattttgaagttttcaagcgcatacactaatgtcttgaatggataccgtgcggatcctacctcgtgcataccgcacgtcatctctcctttggctcgtgttttttccgtgtgagttgctttggagttgcagctttgcagtaacagacagggaccaaaggaggacggcccgcacgacgtccttcaacccgcatccctcgcgccctcgaacccgagttttttttccctttttttatcttttttgcgcagtagtttgtaaatatatggatgaatgatattttaagtgagtggaggcacaaggtggagtcctgtaccacaattttcacaaaaattggcttttatttgttccatattctaaccccctggcaatcacagggccccagagtggttaagcggtgtaccgtcccattgtccaggacagacaccaggagaagtttccaggagctatg

SEQ ID NO: 6001 - DNA, 700 bp, Nannochloropsis_gaditana
acgcgccgtctcattgtggaagagggcggcttcctttacgattcagactgctacagtgacgacctgccattctggaatacggattacgggcggccgcacctcgtaattccgtacacactggacgtcaacgatatgcgcttcgccacgccccagggatttaattgcggagaccaatttttcacgtatctcaaggtaatttcagttgatagattcatttattgaaaatccataggctcgaatcacaagagtgtttaacctttgaaaaagattgattgtctaacgattctctacggacgtttctttgtgaaaaactcccgattaggacacgtttgactacttacgccaagagggtctgaacggagatcccaaaatgatgtctgttggattgcattgccgtattgtgggtcaccccgggcggactgcagctttggcacgctttttagactacgctaaaagcttcgacgatgtgtggatttgtcgccgcattgacatcgcaaatcactggcatgttaatcatcctgcttccacgggtataaagtctaaatattaaacatgttgttctgacgtcagatgtcttgcgccgccgaatggctccggacgttatgctttgactgaccattgctgtgaatttttgatattttttgtgcttcgggtattttcttttttggcagcaagaatttcactgggtaaaacaacaaca

SEQ ID NO: 6002 - DNA, 700 bp, Nannochloropsis_gaditana
ttgaaccggcaggatcccgccttttttccccctcagatgctggtcgatatgcgctgacaaaagctccattaagagatgatggtggacaatattatgtccacaatgacaggaaaagtcatttttattcatgaaagacaaaggaaagctcttacacgggaagatatgtcgtccggtccgacgcggcccatgtggtcgtgaagcacggctaacaaactacgggagatggccaattcggtcatactgtcttctaggccccctccacttactcaggcgacgcccgacactcgataagccgctcgtgtgagcgacaaggtggcgcagatgacaactagcacaactgatcgttcacaaaataagatgtgaagctgggatggtctcctatggcctcggcgcttgagtgcgggcaccctcgtagttacgagtaaggcatccgttaccgagctgctgggccctcgcctcctcgccgaagtctccgttgttcctttcttcgccgcctgcctgcttgcttgcaatgcgacggccgaacgcggcccacatgagaaggcaaggctgcaagactcgacgaaaatgcggtttgctaatgctgccgtgcgaatcacttacatgtcacgggagggcctcgcaagcagtgactatccttttcgctccgaacctcacctctcagagattaaacccttcgccaccccctaggaaaacgatg

SEQ ID NO: 6003 - DNA, 700 bp, Nannochloropsis_gaditana
gtatttcgtcttgtattacgcggtctaaatgtacaagctttgagggctttccgccaatacctaaaacgatggtaggtcgccccgtgccccccgctggctctccgtctttaaggaggcaccaattgcgtgtatcatgtctcaacaaggcttcctcaagccaaagttggtccttaatacccactgcgtttcttaagcgaagcaggtgaagagccggcctggtcgacatctagtctccgatcgagagaccggcattcggggttctgcaaagaggcttgaaataggttgtgaaatgcatttgatttgaacgtcatgtaatgtcgcctttctacatttgatcttgccactgtctggctgctgctgaagccttcttcaccatctctgtgtccgggctccccctcctgaacctctctgtccgaccccgatgggaaggagtacgtcataccctgcttgccaggcggtgactgtgcagggctatggacctctagcattcaccgcctcgagttcgagttgcattgtgttttttgaccttttcacatcatataatgtccaccctattccaaatcccgtcctcagcacaacgtcagtttgtttcctgtggttgtcaaggcctccgtcccctcaatcaggagttgcagaccctcggcactgttaccatagttctggccgtgaagcctggactcaaaagcacagttgacttatg

SEQ ID NO: 6004 - DNA, 700 bp, Nannochloropsis_gaditana
cacatcaagggactatggactgcgaagaaatcgcggcacattcttttctgttcatgtgtacattttattattgtgaccattgtgtccttgtttatcctgctactctctttgtaggatgctctctccaaacgttgtcgctctagggcccctacatccgacagcatggcgcttatcagcatgtcgttgtcttcattgtgggcgcagacgagttggaaacgtgcaggctgggagaaaaaacagagttacctggctacgtcgtgcgtcttttgtcatatacacccatgcttatatatacgaaaaatagcccttccggacgggaggagagaagcgtccggctctactcgcccatgtctatttttagtgacggatgggcaggaacctagcacggataatgcctagacgcttcgattcttctatggcactgtcatgggcgcgacaagcgtgtggacgttttttgctgcgtcgcggcgatatgttgtgctcttgtcgtcatagcgaaacgtgaccgcgttgtcaattgatactgccaccgtgatcttcttgttggtcgtgccgcccactatgtggccactgttcacatcttgtggcgccgcgcttgccacgagctaccgttgctccttgtagggatattctcactcttaccactcttggttttcatcatgacgcacagggcgcaaacctttctcccttatcagccatg

SEQ ID NO: 6005 - DNA, 700 bp, Nannochloropsis_gaditana
tggaagctttgaaattttctgtcgactttgcaaatgtggaaatcgaagggggggcatcagatgacaattcatggaaagggctccgccgacggtattggcatggccgcgatgagtactttctgccaggtaaatgcttgtttcactcttattttttactttcagccttttccagtttttgggggcctcaccaaaatcgtctttccttttctttattcccggcatgcacaagtggcagtttttgaagtcgaagaagatgaaagagcagaagtaactcgtgatgcgctcgtgcatcctgttgacagtattcatgggatcgatggactcgacagtggaaaagctgatgatacattgattggtgaagtcactagggaggacgggacgaaaaaagaggttttacttcatgcttctttagatccggaggcaggtggaattacatggcgaccctacacagacatggaagggcgtagtgattcattgtgtttattgaatcttcgatgttggtttcctccaatgctgcacgatttacatcgatacaatatcttcaagcgtgcgatttggaaatccattggaataatcaaagagcgggttgatgaagacaaagtggaaatgaaggaaaagggtgataaagatatcagaatcctagatatcgggaccggtactggcttattgagtctggaggctgtacgagctggagcgactc

SEQ ID NO: 6006 - DNA, 700 bp, Nannochloropsis_gaditana
tctacatcgccttctaatgatggattaaccagcacgactttccaacatatgcagctcggcttacctttgaagtcaagcttgatctcggtagactaggcagaaatcccagcacgagcaagggcaaagacaggaagaggaaggctgcaagaaggcgagtcatgatcctgacgggcttggaccacgctgttgagggaaacgtagagggtaaggggaacaggcgcgtttggaacgatgtaaccccgaaagtcacctgacaacacctcgagctccaacacaaaggtcattctcttccgcctctgataatgtgtcgtctgatgtactgcatttggacgtgcacggtgacaaggatcgccggcaagcgccggcttggcgacgcggtgggatacctggtggagtgccatggttgcatttcatcgggcaagttttgacttcttgccgtgcgaggctctgccgtagcccctttaaatgttgtacgggacttactacagctaggctacgtgcgaacttgacagtctaactcccagtgtcgtggtatttatatggtaaacaacaggtcgcggtgtcttgaggcatggtccgtcggctcttgcctgccattgcagtgtctacttcgaccgcgaaaacgagtcttcgatccggacgagtctcctctttcagcgtgcgttccacatcaattttgtgcagcttgcagggcggaatg

SEQ ID NO: 6007 - DNA, 700 bp, Nannochloropsis_gaditana
tgtgaaattgtgtctggcattgaacgacgaaaacatgaaatttgaaagaaaagcaaagttagacctagtgtcaagccgcataatgtcgcttttcacatgtggcgttcttcgctcctttctttcgagatacgaagttcttcattatccatccgtaaagttcacagcccttgtcaacaacttaagtgtattactgcctcgagattccacgacaagacacaaagtaactattcttctatgcttgtagggcagatattttacgacccgcggtccgaatgggccctttcggcgcgatcgatttgtcaggtcttggcaacgtctgcggcaggtaatacagctcatttatctcgaaagtgtagataggaggccacggattcaatgctacaggccaggcacccattttgaaacttccctcgagccatttcgacatgccccacgaagatcaacatcaactcgctcctgccgcgagagtgttcagcgacgatggccactttaggtgaaagcgcccagtctcaaaccatcctttcacagcgtagacaggcattatattcaaatctgttgttaaaaggtcgttgccggaaagcagcaaggcaaaagtcaatctttatagtcggatactgtcatatcttctatcagcacccgataaagtatctttgatatatgatccttatcattctacagggtgcacgagtgtggtaagatg

SEQ ID NO: 6008 - DNA, 700 bp, Nannochloropsis_gaditana
ctacttaaaccgtctggagtactcgtcaggtaagtgaacacttttctcacaagtttttttgggcctccctgccccctccttaagagctgtagcacaaagcgttgatgatgcccatatacattgacatgtaagcactgggttatgaaaatataacgtgattaccagggaccatcgagccctatctcctgaaacgctgctatttgtcaggtgccgtgcttttatccttcggcgttcatattctggtgcgcgcacatatctgatactctcacttctatgcactatatatttatacatatatacacgttgtgtcatccttgcttaaccgtaacaggatatatctgcttgtggcagtagttgtgacctgtttggctgggttcaggaatttgtagtttatcctgctgctaacctcgctaccgtccgcatccgagttttcaccaccttctccgcctttggtcgcctcattctcaatcagaaagcccagtcagcgcattattatcaccagcatatgcagtaagttgacgcctgctttttccgaagcatgcaaatcactagttgccttcccttacgatgatggcagcatctgccggctacacttgatttcaactttcggatcgaccgaaaaaaatggtacatgtatttgtaccatttgcgatgaccgggcgatcctgacgcatccctccgagccacgtcgacgacgatg

SEQ ID NO: 6009 - DNA, 700 bp, Nannochloropsis_gaditana
ctgacagggtccccgctttcgtagtttgttggggcgcgatcgtgtttattgtccgccaggtcataccacgagcataacataacgaggcaccatacattgagacgtcgattacaatctgttgaaatgggatgaacgtctgccggtcagttgaaacagtaaaccagcacacaccaatttcccgtccgatcctgttaagtcggcctctattagtattcttggtaagccttgcaccacagcttctgtcccgtttcgcaaacctttccccaaggttatcccgcctccgtcaccctgaggctgtgaggacaggtgggcagcaggctagttgccgtaggctaccaagtcgagacatacatgtctacagaaggtgtaaaaattagaaactcgcatgctacttatcaatgcaaaaccactcttaattcctcacgtttccgtcgtgggaaagttgtcttagttttgcgatacaattccccgtcgatgacaacaagcgtgttgggttcagcgcccgcgctgcctgctcggaattccgagcaacgccagcttgcgttcacacaaacctcacgtcctgtttcccaagagccctctggaacgcgcatttaccttctttatgtctcctattctgtcatacacatctatttctgaatgacacagcaggaccacttgcgaatcaaatgcggctggcgcgacaatctcttgcttgatg

SEQ ID NO: 6010 - DNA, 700 bp, Nannochloropsis_gaditana
tccatcgatggcctacgcagactttagtagccccctcgacgcgtaaagatacagcgaaattcacaagtacttttgtgtccctgtatggtatgcggtggatagataaagcgtaggacggaaagtgggagtgaggaggacaagcgggactggcgccatctcgagtggacggtgactccggtggcgatatggagttaaaaacagagtccggaaagtccatgcgcctcctacttcattcatgccgccacttaaatatattcgattcttggtcaagggtcacgcatcttgatctgtcgttctacggaagagcaaggctctgctatgatgtcgatcacttgtgtgctttcctttgtcaatttataagcgaattacgaagaacagaaaaccactgctcaacacaatactcattgcgacgtattctgagcaaccaatcccgatagcttggataacttgtctctacatatggtgccatgcatcgctgtcgttagtttcgcgtctactgggcctttcctttatgcatcatttaatctcaagtcagagtatagtaaagttgccttacgttcggcaggcgataggcgagataattatattgttagcatgtccggaggcatcttgtcattcacgttgatgtccctcctaaattgtaccttatccacttacagacattcctcccgtagcacctttcccgcgctgttaaaaaatg

SEQ ID NO: 6011 - DNA, 700 bp, Nannochloropsis_gaditana
agcggcggtccttgaagacattgtccttcttcgaggcacggtactccacaaggagagtcttttttcgacgctccacagccatttgccgcgctttgccgacatttcgtacttgaccttttgcgcgtttgtttaagactgtgaactttgctttgcggtttcccacagcatcgaacgggtttccactagcagtaggggacctagtggtggacctacttcctgggccgagaggacctagtcctctgaacttgcctcctccagcccattttctcatcttgcggtccccacggtcggcccctgattgtctacccaatgttgactctgagtacttctttttagtcgctcccatttctttctatataacctgggaggggtttgaaagtcatgatgcagtggaaggtaagcacaagcagtcgatactttgctcaccagagataccgttgaagcacgcttttgaagcatggagactcccatttataaaacatcaacactagtcgtggcccgaagtcgatagattggtttttgaaggcgaatgcacgctccctggctgaagatacttgctcgggggcatcgcttgttctcttctcgttcctcccggctttctgcagggacagttcgatgaggcggcgagatgtctgtcggtgagcttcacatttcttcttacggaacctatacacacattcttcagggtcagatttccatg

SEQ ID NO: 6012 - DNA, 700 bp, Nannochloropsis_gaditana
tcagcagtaaaaggggcagtaaatattacgctttcccctcgcccagcagacagaagcggaagggcctcgcctcgatccctccacgccttaaaatgtgtaatttcggattcattatccctcaaacatactgacagatactcacgtgcacggaagataaatgaaaattacatctgttgcggccgtccttgtgacaatgggtccggctgcggtccattcgtttcctttgtcttttcgtcccgtcagctctttctcaggtccggccctaccaccagtcacacggcaatgtctagcaagagaggggcgtcggcggccttttgacgggccccagccgctgcgttcaggaacatcatcccatagcgccgaagaaagagaagcctcctcacgtgatgacgttgattctcgcgcgactcctgtgccaaaaccgaaacccttcataagccgtcgcgtgcgccgcgggcccatcggcgctgcaacttcaggcattgatggtgcttcgaaatcatcgcgacaagtaaacggtagcaccgcaatacacaacaaatcagtgacgcctacgtctactcctgctgtcctcaaagtgagtaaaaaatgggcgtgcgtggccaattgtggagcatgctgttaccttgccccttccgagcgcccctacctccttgactacttcgacgatccaaaggacctagcagcatacaacagcatg

SEQ ID NO: 6013 - DNA, 700 bp, Nannochloropsis_gaditana
ttgttggtaccgtctctcttcaaggacactgtttcatgctttttgcatcaatttgacaggcaatgtcgggcctgaagacagtaatgcgtgtgtcgccccagttggccaaagtgcttggcggcgaccgcatggcccgtactgaggccgtcaagcgcatgtaagtcatcatctccctccatgaatttgaattattccacgacttagtttggcattgctttgttcaggttctttcatctatgccctcacaccaccgccgtgctctcaccgtctctactctccccctccagctggtcgtacattaaggacaataacctgcaaaacccctccaacaagcgagaaattgtatgtgacgactccctaaaagcggtctttgagaaggacagcgtcacgatgttcgagatgaataagctcatgagtaagcatttcagcaagcctatcggcacaccgtaggaggaacttgtggaggggcgagcactgcaagtggcccttcacaaatcttcatcatgtccatataaagcagctgcgtattgaacagtgtcttgaagcattcgcggacttaatagggcgatcacgcagacgcgactgtatacatgtacaatgtcgaaattgaggagcctgtactcgactccctttgcccttgtttttctgttactcgctttccgcggctagtatactctccatcaagtccgtttgatctatg

SEQ ID NO: 6014 - DNA, 700 bp, Nannochloropsis_gaditana
cgagggcaacttgccgtaaagagagctagtctggcgcgagcctctttgaatagcattttgtcactttggaccaagccatattgcctgtctgacattctccggtatctatgtcatgtggaacaccaatcaattctctgatgatagtgtcctggtatcgtctccaacgtcggcctgccctccttgcacagtatccctttttcgtgtcctgcccagctcccacctcacacctcctatccttgtcccaacaccatcaggacaggtatctggttgcacgcacggggtaagggaatcgattgtggattgagtcacacggtgagcacaggagtgaagaaggattatgggtgaggtaactcagcaccagcacaacgacggaggggaagcgacaagaagagggtggagccaaatggacagaagggacgtcagaagtttggcgcggagaaggtatagaacggtaacagcagaagcagctgttgttccggcagcggtgtcgagttttctctggagtacgacaagaagaagaagggatgcgagccgggaggaacgagcgcatcaagggattcgagagggcacgcgtccaagatggcgtggaggggctggtagtaaagccagagaagcattgtctggtcatcttatattcgtaggactgctaatggtagtggcggcgatgtcgtgggcccccttgccggccaccgccttcatg

SEQ ID NO: 6015 - DNA, 700 bp, Nannochloropsis_gaditana
ctttggtacagtttcaccgatctcaacgcttgcaagcaccaggtaattgtaggccaacatgaacctcatggaatggaacgacgtgatgaaagagcaaaatgtcgcacagcaagtatagttgtatcagccgagagtatgccaagggcgagctgtatgtacaggaaagtgaaaagggcctcatgctcaagcgtagagcgtgtgagatatggagatggaaaatggtcaaagaaagaaggaaactatatgaagaaatagtgctgaatcttatggtcaaatgtacactctcctacttttaaaaccctcgcttcatctgcctcctcgatccatcaagccagctgaccagtcgaaagcaagtccagctcacgaatttgacgtggttcggtaccccttgggatctgagcaactcttagtcggaaagacatgctgactcactgtcctgctgacgtgagaagccaaggcttgagggcgaaaggaggacatgggatgaggcgtgagacgaggtcgccgtcgtcaagttcttcgagatggcagagtgggttatttctggggaggcgtgcccttctctctcatttgttgccgtcgaacctcttcttgcctcatttgcccatacgatcgattctttaaagtacaccttagaccatatctaagctttctggtgcgagcggtcattgttttggccagtagaagtctcgacaggatg

SEQ ID NO: 6016 - DNA, 700 bp, Nannochloropsis_gaditana
atgcgtttggatgcgtgaggcaatcgaagcaaacatagttgaatcttgtctatggatgcagaggtaagataaggcataagaaggagagagtgacgtgcgtgcttcttgctttcgcgcaccctgacatggctctatcctgctacagcgcacgtctaccgctttattgtctgggcatgaaacaggttaagttctaaacagataatgcatagctcactcttgcttgggctatcatctttgggtcgcaacgcaagacttgatttttaaatttaagcgcccgagacggtagcgtttcctgaatcgtagcaagttcgacttttttcccatttaggtgattcgtttgcctattatgcgcaaaatacacacacatgtaaataaactgatcatttaaagggcagagatagattttagcgctaagatatttcgagctacgtcggctgtcctgtagctgccgggagccgagtcgcataatttagtccctcgcctactgacaatgctccttttttcctcgatctgttaatgtgtttttcgtaggcactttcctcgcaaggttttcttaacattgcttaatcgataagtattcggccgggcagttttcgagctcggtagacgaacccgtgcaagtgtcctaggagatgccgtaaacatcggggaactcttgtcgtgtccgtgtcgtgtgttagtggaaaaaataacgggtatg

SEQ ID NO: 6017 - DNA, 700 bp, Nannochloropsis_gaditana
cttgtctggctgctcggtttccgcatacaagcccgcagctgctgccaccaagggattctctaccaggccagtgcccttcccatcttgaggtcccggacacattatgcctggaaaaagaacctgtgccgtagtcacatgtgagaaagggaacctaagccgtggatggtgacgtgggttgggtgcatgtgaccagtgcgaaggtaacaggaacgcctgcgtgcgtggcggtagtatgggtagggggggtcggaggagcgaaagtgatctccacgggccgcccaggccgtcacaaaggcacagggaaccgatgtccattatccattcacatcatgtgttgcatgtgcttgccgccagtcactcgcacgacgcatcctgtcctggacatggtggggataggcatggctgggtttgggcgggcggggggcgttggaaatgttctgagacgttggatgaatttgactgcaaggaacaatttgggcggaggcacataacttgtctgtctttcatggttttttttccagagttcatccatttccatcttgatagaacgctgcagtcgtcctcattcggtattttcgtttgattgacacgcacagcattgtacgtttcgtttccgccctgggagtgaaggagtgaccgcggtcccaagtgatagacgtccttcccgcgtatcgtatcgcgggacttctgcgccaggatg

SEQ ID NO: 6018 - DNA, 700 bp, Nannochloropsis_gaditana
gaaagatggaaaaaaaaacttctggctatccagtacaccattaattgatgataatacgcatactaagcgataggagctgccctttgaccaataattctgcacattgcgtacactgaacgccaaaagcaccgacccaggatcacctgtcgacgattcgcccatgattgaggcactaccttacgatcgtgtggtgctggcaacaaactcggcacacagcaacaccaggtcctccacccgcacgtgtgggtaccttatcagcttcatcatgcttttgcttttatttcacacgaccacccgcgtggtttacgcgcatggagaaatgtgcttcgttgtcaatcagggtgcctgcgcgccggccgggcgttgttcttccgtcctcatcatccccttccctcgagcgagccccgggctggattaattccccctcaaattgacggaaaaggacgccagccatgtaacatacacatgcaagctcattcgcgtaggaaatttgtgccgcggaatgtgcacttggtgatttccatggcctgagattgagtgtatacgttgatccggcgcgctaagcaatggatatagatacaggaggtgatgttctcaatgcaagcgcaaaaaatgcctcgccttcccatatttcaagccaattcacaagccctgcttcctttcccaaccaaccttctcaatctagtgctgcatcgagatg

SEQ ID NO: 6019 - DNA, 700 bp, Nannochloropsis_gaditana
gcgtgcattttatctagagcttatactccgatgatgcttttcgttatcttttctcaggaaaaaaatggatgccccgggttggaaaataatgacatggtaatttagggataattacgattttttttcgctagttcctcgtttttacccctcacgctagaacaatgtagccgaaaaggggaaaataactctgagcgatattgcaatatttccgcgaaataagctcccatgtaggtagcggctttcgagcagaagctcccttttgtgcacaaattaatttatcataggtcactcgaaaacggagggcggtcaaatgctggtagtttaatgcgttcaaagcctatcagtggcgcgatgatgttttacgaaaaccatcatggttcacaacgtgcgttcttttctgatgtaggtggcaagcagcgtttgtcgaggacaaggttgtctgctcgcttcaaaacaaaataatgcgctcatctcacacgcccttcctgtttatcaaatacatacaaggtcccaagaatcccctcaaacaaggagaagaggcatagaaagagaacgtgcgcaatagagcacacaagggtatatgctgaaaccttcccttccgccgaggatgcctgcactccctcctacaatcgttccacccgccagctcgagccagcgttcgttaccgcctcccctccctcgtagcaagagaagaagaatg

SEQ ID NO: 6020 - DNA, 700 bp, Nannochloropsis_gaditana
tggcctcaaaagtattttatattctaccacttttgtttttaaattatttgcaccaagaaaaaccgtcatcaaggacttgcgtatttatttgatgttttttcctgaaagcaaccagaaaaacgctctccaaaaaagtggttctgtttaagcttgcaatcaatcactatcgaaactgattggttaaacttctcaaagctgtctcattttttatgcatgtttgtgcactgtgtccagacgctcgcgcgaaaagccaccgtactgaccatgcagtgcaccaaggcggagggcgatcagggcgggccgacaatcctcgggaagggcgctcgctcctcgccctcgtcgcctcgctcataaatggtttccgcccccgatgcccatgccacccacgttggccacgcctcggaggacctgtttgttacgtcagggaggacacgaatttgctcatttgtttgcctgatcggccgtcacctgcatgccagatctctgagttttctgtacatttttacttctctcaccctcacgttgatctccaacttcagggcccagtctctcatgtcaactgtacatataccttttatcactcaccagaaggggctgcaatgggtatattcatgaccaaaaaatggaagagctgtagccaaatctctgttctgatctccactggacgttagcagcaaacttgcagcgccccaaatccatg

SEQ ID NO: 6021 - DNA, 700 bp, Nannochloropsis_gaditana
ggggttgctcactgggagggaccaggtacgtcccacgcgtagccatccaagccccgcaattgagtcatgcagataaatttagctggaaagttctgttacgggacggttcttctctttttgtctcaatgttctattttttcccaagctgccgttaacccgatagaacaacctgacgcctacctttcgtgcttcggctgatgaggcatttttgaaaagtcgaagtatcgctctctatcactatgtcattgatgtgtattataagcttcttgggtgcattttaaagcgcttgaggaaatttgtgtgcctgacatagtgcctgacctgtctgtcactttttttcttgtcacgatccggcggtcaggatgctgggcttcccggggtcccccaagacgaaaaagagacatttcctccctacgatttccctcaagagcatcgacaatccaccagaagcgcggctgctttctataatgcgacaaactacacagctggcccatctgctgggtcagacaatcgcttgcgccgccgaagcgagacagggcaagcaatcctcgtacccgccgtcatgtgcgggtttttagggcccttatgttgggtatttggacgtcaaggctggtcatactcgtacgcgctatggtcgtcgaccctggttatctacgccgtctatggattgcgggagcgtttgcgtcgagctgccaggatg

SEQ ID NO: 6022 - DNA, 700 bp, Nannochloropsis_gaditana
ttggggttgaaagctactcatgttcacgagcatcgcaatacggtgatttgttgccccatcctggagcatttccgcgatactattttgcatgttagaaattgttgttttattccatagccatacatgcaatagtgtataggtgcatgaccctctttccccctgaaaaagaacatatttttgacttgggtcgtgacgtcacaacgaatgtcgccccatatcactttccgactgttggcttgctcctctgagccgtaggttgtttcctgtgcatgaacttaagaagggcgagacagacatagtacctatggattaatgccttgcattataataagtatgccgacagtaccgggacatctcaggaaagaaaatgtattcattgcggacgcgagcccgtccgttgcttgcacgcacaggcggagggggtcttgtgtcgtcgcgcagggaccgcacaggggcaggaaacggactttgacatgaaaatgctccattttcatccaccagaacctgcgtatgtttcagtgcagtgcaatttacatcacgtgaccgcgtgtcgggctatagaatgctttctttgtgccttcgctcaaggttcatgatagctgcgaactcaagaccctttccgtaccttatccctccgtcttccccttccaacacaattaaaattagattttgcgtctcctattaagaatttgataatatg

SEQ ID NO: 6023 - DNA, 700 bp, Nannochloropsis_gaditana
acgtcatatcatctgtaccccctagatcttcatctgcgtcgctttcgtaagtcgcggggctgtgagagacgggaagggaggacgactacacctggaacgggaaacctcgacagccgaaagttaaatgtacacaaaaattggataaaagaaaaaaagagaaaaggctaattatgagaagtggtaatgacaccgcgtcttgaccaaccgtgggcgtaggctcttagactcacttactctgaaaacactatgtaactggattgaacggatagattaggaagacatacaggactgcccgtgtggcggcactcagtgtcttggcacgtacggtagaatatagcttgtttctttacatgcttaatacggacggaaagtggcgtcggcataggcatcagtagcgctttctagtttacatgcgagtcaggatggggagcccgtggatggtaaccgtggtcgtgaccctgatacctgtcaaaagtctcgcgcggaactcgacgttgtccacgtcgcttcttcccacaccctcgctatgaccgatgtccacaacgaatagcggcacgtgttctcgattgtgtctccaaattttttccttcctgtgtcctgtgaattgagccatcgccagggaaagctcgcgacgtgcttgatcttgatccttagggggcttcttccccgacttttctgaccttaatcttctctttctagc

SEQ ID NO: 6024 - DNA, 700 bp, Nannochloropsis_gaditana
ttgcaagtatgggagggcagatctccaaagatgaaggagcagtcgcaacacgggacgacccagtagaacacccaaacggtaccaggcgtggagagccagccacgacgcacttaaagcctcacgaaggaggataattgccttttccgaaaacgtcagaaacagatttaaatttgcgttgaaccatggccatgtccaccattcatttgaaggaggagaggaaattgagtggccggatagaggagttgaggagtggggggacgcgaatgcttgaaggtcgttaggatcaatcgaagagggaaagctggacgaaacctgtgggaccatcttcacagagcacacttgatttacttctcttccatctggcgaagccgctctgtcaattggaggggaaaaaataatcgaaatacctcaattgatatgttttaaccatgcaaccttggcataatacacgaagcgtaggcctggagcaagtaagcgagtgagcgagtgagggatgatgacgatgacaatgtgatggaatatgaccccaattgcgatgacgatgtgattgaatagtaccccaacggcgatgacgctctcctccgcaggtacttgaccttcggccatgtattgagacatgcatggttctacctggtcgcccgcagagatgctttcaaaagattctcgaaagatcggttgattaattcgaacggtatgcatg

SEQ ID NO: 6025 - DNA, 700 bp, Nannochloropsis_gaditana
ttttgggtggcgcgaacgtgatgctgcagacagtaacgttccaccttaaaagtcaaagtagggccacgcggaaaacgagcgatatgcaagctcaaacttgccggtgtctgagacagtgacagaatgtgtgtcaaccctaaatgtcccgcaacggctgcaaagtctttcatgcgattagtacgtctctccttgaggcgagcagcagtctccggtcccatgagccttcgtaattctgtaaccaaagctcccgcctccggtgttgttcggccctttcgcaagaccatcgtcttgggtatccgttcctcctccgtcaagctctgctgttgctcggggttgacgggaacgtgcgttcggcgcttgcgtctcttgcccatggttaatgagaggctgggcgagagataacgaagagggggaaagggttaggcaatcgccatgcaaccagagaacttccacggcatcattcagaggacaggtaaaactaatcatcaatctaggaggccgcactctccgaacaacaagttttccatgcgacgggttttatccaggcccctatggaaaaagagggcagtatctttcctcttcgccctcgccgtcatcgcaactgccccggaaacttgctttgagaaattgctccgcttcacagtctttaacaaagcaacgtacatgcacaggcttaaacatttgaaacagtggcagcatg

SEQ ID NO: 6026 - DNA, 700 bp, Nannochloropsis_gaditana
accaaattgatacactagggcaaccgagccaagcgatgacacgaccaggagaaggagccattcacgaccttgccaggccgtccagcggcaggcttgggaagaactgcgcgagcttggatacacgcgaggtagtggtgaagtcaagctcaccatgagttgtattccggtccactttgctggtcgtaatgatgctcgccagtcacaaatgtgcttcccgaatagttgagatatcaaaatccttccatcactgaatgtatgaggaggtatgtatgttcacaaacgtaaggtacccatttgcttaagcctatcgccgcactacttgctcgtcagcccacatccagcttccagaacttttaagcctttagtcctgccccccgatcaaaaaagtcccagatgtcattccccgtaaatatgtttgaagtcctaaaccatacttttgtgcaaatggaggaactgggcgtgccttagcagcagaggagagatgggccgtccctgtcctgatgggaaccaactttcggcgcgactgagcgatagaaaacaatatacgacgattgccgcggccggaccaacaccgcgatgcggtcatatagactgtcgattgcatcattctgtgaacatggcctttcacgattgagcctcattgccatcttttcattcaattcgtcggtagggtcgtcggggaagaagacgtgggcaaatg

SEQ ID NO: 6027 - DNA, 700 bp, Nannochloropsis_gaditana
acagccccatgctagtgaatgaatgaggtggggaggttaatagcttgcgagactcaaagagcatgtcttgtgtacagttatctagaagaaaaaaatgacatttcgatcgattttacttcgttttgcttggttacgcaacccacaagctacacggaaaccggtcgtctcgagaaggagcatgggccacgggggcgggcgggcacattagaagggcaaatggatggactctgtagctgctggtgagcaggtcgtgtggaggcctacgcttttacactgcaaagtcacagcatgcccgctgtgtgtcgtgcctacgaacagccttcaccgccccaacctggtagcttggtgttgtggattgacatcattgacgttgcactcgaagggcacgacatcctcttcgcctccccggcagcgatgcctttgattgctctctttcctgtttgctcgaggcttccctctagcgtggccgccgtcacgcctcctcacaccaagcctattcaattcgtttcacctcaacacatttattcgttccaggaggcagggtaaagcatctttattcactccatcagagacggtgacggaaagcaagagccctgagcccggcgacaagagaaccaccaggagtgcagaagcaagcatttctgcatccctgcatcttccttttttcctcaagtaattttcgacaatttctacagccatg

SEQ ID NO: 6028 - DNA, 700 bp, Nannochloropsis_gaditana
atcatcgtcctcgccgcatttgaatgtgtacttgcgaatgcgacgacgcaaggcactttcctttgtccagttttctgtggccttccaatgctcggcttccggaatcccttgaatgatgacaggcttgctcgcctgctcgtattcccgtataaacgtctcgaggctcaagtcacgacaatgtacccggtccacacctcctcttcgatactctttatcctcgttatcacgttgtttcgatggcaaatgagccagtgcctcgaattcacttctgcgattatgcgcgaagccatcccgcgcccagtccttaagccgtggccgatgcttcccttttgcctcctcaagccgactccgccaccccatggaaggccctctgtagtactgtacgcaggcgtcaagatgtgaaagaaatgactaagcgggccatatgatcgtgtggccgggcatcgatctgagttgcgtcatcgcggaagaggcggaggggggaggtcggtcgcctccccaagtcactgcgtaattattgcagggcgcttgctaaaagaaggccagaattcctccttgctacaacgttgacaaaataattcacttttcatacatccacatccacggcacgacggatagcccaaggggtggtttctgagaaattgcctccgactacttgcctcctgcgccaccctcctcagcttgtctcatgcccatcgcc

SEQ ID NO: 6029 - DNA, 700 bp, Nannochloropsis_gaditana
tcacgccttcctctcagcttatctccgcgatcacgagtttcctctccatccgtcctctcccctcccctcgactacgtcgtcccctttagttgaagccaccttaaggagcatgccccccaaccccaccctctcccgcctccccgccgccctcgcctctgctcacgcctactacaaccagccccgcgccctggttctcttcgtcgtgcagcccggggagcgtaacctctttgaccagcggtttttggagctggccctgtgggagaagcacggcctgcaggttgtgcgactctctcttgaggaagtcgctcgccgctgccgcctggccccggggccgacgcaggcgctctggctggacggcaggcacgagctggcggttgtctacttccgagcgggctacaccccggccgacttcggttccccgcttgcgtgggatgccaggctactcatcgaggcctcggccgcggtcaagtgccccaccttgggctatcagctcgcggggaccaaaaaagtccaacagctcttgtgcgagccggcgggcctctcccgcttcctgagccctgcacagtgcctggcggccagacaacacttcacgagcatgtacggattgggggcggcagacttaaaggacaaagagggaggacccgcacgggcggtcgatgcggcgatcgcatccccggggggttacgtgttgaagccgcaa

SEQ ID NO: 6030 - DNA, 700 bp, Nannochloropsis_gaditana
tgccagcctctttccctgcccaagcatttgaagacgtggttgccgccgcccctatttttaacgagctcgtggaccgcatcagtcgcgacaaagactacctcggaagtgccttggccgaagtcagtgccagcgacgagttcactggccagcttctacgtatgtacgaggaaatctacccgtcaggggtctcagcggccgcccagcctgttgccttgggcctgcaccgctcggattatatgaccgatgacagcgcggactggcgtgatgggaacggagagggtgtcagcaggcaagctggcaagcctcgaccccaaaagcgcctcctacaagtggaactgaacacgattgcctcttctttcggctgcctgggcgctgtcactgccgacctccatcgataccttctcgatcgattcttcctcccctcggtcgcgctagctcctcacgacgctccctccccaccgtcccatgacgatcttcacgccttcctctcagcttatctccgcgatcacgagtttcctctccatccgtcctctcccctcccctcgactacgtcgtcccctttagttgaagccaccttaaggagcatgccccccaaccccaccctctcccgcctccccgccgccctcgcctctgctcacgcctactacaaccagccccgcgccctggttctcttcgtcgtgcagcccggggagcgtaacct

SEQ ID NO: 6031 - DNA, 700 bp, Nannochloropsis_gaditana
gcttgaccgtctcctatctagcgaatgtggcacggtagaggacgatccttctgttgaacgttgagacgggcaaaaaaatatttgaaatgatgttaatgtcttaaattgatttttgcaagactagaggcctgcagctacgaacagaagcgtcacgaaaaggcatggcacctaacgccaagtctcatacgagatggcatcgggcagcattagcatagtatcgcgggccacctcccccggaaagtcgagaattcaaagaatcaggcagccattatctgccataactatacgcgaactagtgcgctgttcttacgtacgtcaactttaggctcggacgagtactttctccagcatgtcccggctgcaggcgtcgtcggccgttgagggcccatatgagaatgtgatggaatagatacccacattttccacggtccctgtgccgtgcaggcggccctgtgaggctggtacaggacaattcccattgaacgatggcgtagaaggaggttctgtacaccaacaatttggaacaattgttacggtgggcgccgcagcgatccagatttcaccgcgccaacctccaattgagtaggagggttgacgggcgagcgtgcgcatcatcagtagccgtcgactttcttccacacgtcggcccctatctcagaaactatcaccatcacatgcgtaaaattttgtaggagccatg

SEQ ID NO: 6032 - DNA, 700 bp, Nannochloropsis_gaditana
cccaggaaacatgttgctgtcgtctcaattgtgcaagctcttgctttttcttggagctttcaaagtgggaggcgtataccctgttaactcgcagctaacaggagcgcgggatcagcttgtcagacaatctgttgacctgctggtcctctcttattcaccatgcacacgtagactaaaagcaagaaagtatggcaacgtttgtggcataaaaaactgttcacacaacgcttttaatccctcccgttaccttgtcgaaagcagcgtcctcatcccctgcggccccagcctcatcctcatcaaaaatttgctgcggtttgcgctccattttggctttttcacgagacaatttggccatgacgactgtgttgatatttataacgaaagacttttcaaatgaagaggttgcagattgccgtccacggggcagccacaatgttatactgcacaaccacacctcttaacctcccctgcccccattgattttcatagcagccagcaagagatctccgttgacaggagaaatgattcatggaaaagcccccatactagcatttatatatcgaaaaatgattttagagcacatgcgtgattaatagcgcgtaacaaattgcgtgcgcagtctctttgtaatgacatgcacatctacttttacctcccctgtcccctctgccagatccgggacacacacagaaataccatg

SEQ ID NO: 6033 - DNA, 700 bp, Nannochloropsis_gaditana
tgtgttcaatcactttctcttgccactcaccctaatctccctttaaatcctccgcagctggctcgggcagagccttcagcgccggacttcgcatggcgatgagcaacgacgggggcctgccccttggcgaagagccggaagggactcgtgtggaagaggcgctgcgcgtgacgacccgtcaaatcaaggccttgcaacgcttggtggatagcttccaagacgtaccgcctgcagatcagccacccgtgtttcccccggcggaggtgcggttgcccgtggcgacccgggagagcgtggagggcgacaaagcgcaggtcctcgagttgaacgccaagtactacgacgatctgaacggccgggatgtgaagagcattttgagcctatggaaggaggatggcgcggtgcagatgtacgcgaacgaggaccgcgtgatccgggggtaaggagctgaggagggaggaagagggggaagcgggcactgggacgagggctgggtccgcgctgtattggggcatgctctggcaaggcttgtcattccggtgtgggttgtaatgttcttgtgtagttttagcctccccgactgtcggcgcccgtcgtatcgacgcgggggggcaagatggtatgcgtggattgattgattgattgactcaacccctggcttcccctctgtcgcaggctggaggagatcgacaagcacatg

SEQ ID NO: 6034 - DNA, 700 bp, Nannochloropsis_gaditana; identical to SEQ ID NO: 4576

SEQ ID NO: 6035 - DNA, 700 bp, Nannochloropsis_gaditana
agaagcccaggtccacaactctcagattgcaacgcagcatagttcagcatagcctctcggagggcaaatatttggtaagaattctcgcaaaaggatatttattcgtcttttaacctcattactaccctgtatatgtaaaattaaagaagcaatctgtgttgctttgccgaggattggcacagagattcttctccttgaatacgttgcatgtcacaaaggaaaaacgtcgcagtaagtcatcgatcacgaatgatcttaactttttgatatatttgttgaatacacgagtagtgtctgtcatgttaatcctgtaggaggtgcttaaaatgagagacgtccaaatcctgaagcccgggctcgttgggctggggaggtttttgaaaaagcagggatttaagaaatgcccggggacatcagaagaatcaatcagaatgtttacaagcgaatgaagacttggatactggacagacatcatatccgtagtctacaacaatggtatgcatgcgccttgcacgcagtgtgtcacgccttcgtacctttctagccattgttgtttttttccttgatcttaacaatttgcaggtctgtcgcttccgttcctcttctcagattcgactaatcactattagtggagaaaaagtggtttttcactgggacaaccactcgcgtcgaccaccaaaataaagttggtttgccgatg

SEQ ID NO: 6036 - DNA, 700 bp, Nannochloropsis_gaditana
tcttggcgttaaagcgcacacctttaccaatgtgacgatcacattttaagcaccagctgttgtacggtagctcgaagcggataattccactttgcgtgtattggttgtgccctgcatgcgggaggagttagcggtaatcgagtgccccaggaagccttcttccatgttacacgcacctttagaccccgtgatttttttcaaagaggattttccatcccagtcaggtggacggtagtaaccatcggcttgcgcggctgccaaagaggacatgctctctggcgcctaagaatgttatcagccgacagacgacaacgggctcaggaccctgagaccaatcggggccaggatggtcgaccgtcgaacgatactccgatgttagatatcttccagcagtcctgtcttgtgagtcgtttgtgatgctgaagatgaaggcatggttctagggtttttcttgtcactaacggacttcttatcccgtgctctgctcgctcatctctgatgagatcagggatcaaaacacgctagcaacgtgtgtcttcaaaaaagaagcgagaatcaccaaaattcttacggctactaaaccctttaagactcgcttacttaattcagcatgtctctcacggtgcattaacttccatgaaagatcgacgctaacaacctactccacctccccccttgcagcacccggggcccgaccatg

SEQ ID NO: 6037 - DNA, 700 bp, Nannochloropsis_gaditana
tagccatatcctcctcttgcttgatgctgagctgactctgccacggcctcgtaccgccgttttttccccgaaacaacgtgctgaggcggcggccggtacgatttgaccacgatatagtcatcttgcacgaccatagcgcctgtacaggtgcacaattttcataagagggtttccagcctcggtatgcgaagggcaatgggaatgaagggaagtttgctcctacgcgacttcacgaagtttaggaattcaaattcgtcgtggtggccgcatacacttcaccacttagacaagttacaagaaataactgcatccatgacactaatttcatgccagcgggagagtcgaggagtacacaccatgccggaggactgagatgtgcattgcattagagcgcggtctgctttccctgttctggcgaggccggcgagggctgtctcgaccgtgacttaaaggaaaaaagaactcgaccagagaatgaaagtcgatcgcgagggtctccgtacttgcgctctagacttctactacagtcgtcttaatgaatacacgactctcactcacaattcccctcgcccgtggctcgttgctgtgacggtcccgaggggaggccactgagggcgatcgagggcaaggaggtgcacttggtagtcgctgtagacaagtccaaacaacccgtcaccatatatctccagacacagacatg

SEQ ID NO: 6038 - DNA, 700 bp, Nannochloropsis_gaditana
aactacggctacaaaccccaagttacccctcgtttgtgtctcaattgcgtatctcgccttcccctttcgcgccgtcatggtttagacggggagcgcttagtgcaggcctggagccaccactcgtacgcggtcgtgtcccacgtgttgggactgacatccttgctacatgtacagggcatggataaagggcattcctgtcctcgggacggcccggtcatgtttttcctgcgcgcacgggcctgaacctagtaactttctgactgcttgtcttgaggcttcgaagaagcagcaactaggaacaaccggtgaatcaatcaccggcacagtttgtaggtgaacccggcactggtgatcagtagacgctaaccatactttcacatgtattgcatgcaactgtatggaaatgcctgcactctgtttcgttgtctctgcttttcttggccgggctggaccacgccgctcgcctaatttcaaaattatgatgtgtggctggcacccctacaccatgacaaggtacctcaactcgaggaacgccgcccacgctgatccagtcgacatctttctcacacaggtagtacacatttgtgcgtgacctgttcagaggaggcggtgggaagtgagatcttcacgaccaaaccaatatttgcggaaagaagcggcagcagcagtcccctgaaaacagtctcctcgtcttatcatg

SEQ ID NO: 6039 - DNA, 700 bp, Nannochloropsis_gaditana
cagcaaagaggagagaattaaggtctttttggtacttcgtgcatgtgaagatatttcacccgccaacgtgaagaattgcgccggtctcactctagtgcttgcatttttttaaattttgaattcttgtcaaggcacaacatgtctaggaggggaggttacgaagaacgatgatggcgacatcacgttgtacgccaaaaacgtattagcattcccgcctccttgttcaacacgtaatgcacgccccctatccttgacgatgtatccttccccacagatacacccggacagagtggctcctcggggttcgcggatggatcagtcgacaagaagaaaaccaaggccaggcctgaagacaagtgctgaggctttcttcacgacaaccgcttcaaccgccacgcagagggagaatcctgccgccgcctccagcaccagcaaatcatcaggatggaaagacaggctcaaagaacgatgcttaaaccacgtgcatcgggagcggggccggttgattcaagagcttcgaggcctgaaatccccacctcctcgtgccctgtcctcgcacgttccgtcagaaccccctccgtcctcaacactttctccatcgcttgcactattgcggccctcagagagctccagtccatcgctatgttttaatccatcgttaatgggaagcacggtcatgtctatattacagagtgaaatg

SEQ ID NO: 6040 - DNA, 700 bp, Nannochloropsis_gaditana
catgactcctgtttgtgcgcgataactatttaattcggcttcaatgtattattttgcccggcgcaagacgccaatacccggggggggaagacggcaaagtctgatgatgtgatcgaaaagctacccgaaggctatggatgacgatggtggacgccggatgatgtgatggaaaaggtgcccgaggatcctcgatgacgacatgatgacggacaggaagcccgatatgcgacactcaggactcgaggcgctgtatgttcattgctagatcaagccatgaggtgatagttttcgccacctaccgccccgcgcttatgcgcacgtgccaaatactttccgtctttcgtcgctttattccatgttcttcgcgaaccagacgaaggtcaacgagcaccacacgacgtattcgtctccccgttctcacgcttgacccctagcaggccacatttgcttgcatcactacgctctcaaagccaattttcaaaagtaatgccattttccacctttgttggagtaaaagctgcttttatcacaccctttctgcatgttcaacccgacgaatatgctagatgccggctcttcaagtccatcctcatattcagatgtttgttcttcctcacctttcacatgaacagttgcagaggacgactcaatcgagttttgtgaagtcttcggatacgttcttttattgtaagaaagtatg

SEQ ID NO: 6041 - DNA, 700 bp, Nannochloropsis_gaditana
gccgaccacccgacgtcgggagtgatagcggttggagacacgctgttgaccgcctccgcggcacagccattcacgacttccagcattttgatcctctctcttaaccctttttcccctatacctttcagcggtaccgccctgcacgccgcccgctggggtcacaccgccaaccggggcgtggcctcagtgtcccgctacttgagcaggaccctgatcgcccgagctgccgccgccaccgtcacagaaatgagccggttcacagcagaccggacccgagaggtgcttgactatgccactttacagcttgtccagagcgggcacaaacctctgcctcctgagaacggttgggggacgtgggcaggcggctgggctcgatctccgcctacgatctgcagctgatcgacgaaaaagtccgggacgtgggactgtcggaatttgcagacatgctgggggttgcagaccctggagagctgctgcgggtggcggagctgcggctacaggcggcccaaggtgacgaggacgctcagtacgccctcgcggcgcgcttttgtcctcctcctttccgcaaacgggaccgttgcaagaaatgccacaaggccttcgggtgacccgctaccggcaccattgccggcattgcggggagagcttctgccaggagcacagcgctttcaggcacgccattcccaaggtcggttacatg

SEQ ID NO: 6042 - DNA, 700 bp, Nannochloropsis_gaditana
gggaacctgccgactcttttttcattcccggaagaagattaggcaagtaattgaggtgaatgatgccaaaagacggaaccctggccaacaagaaggggcaggacggagaaggggctaagtctgcacttgttgcagtcccaagcagagatcatgggagaagcgccagcatcaccagcaccagcagcgtcagcagcaccagcagcagtggcagtggggggaccgcggccgtcgctatggtcacaacagccctgacgcggtaagtcaggagggataagatatgtgcatgaccgggatatcaagtcgtactggcgtagagtgaaaggctttcagaccgggaagaccagccagagggccgaccacccgacgtcgggagtgatagcggttggagacacgctgttgaccgcctccgcggcacagccattcacgacttccagcattttgatcctctctcttaaccctttttcccctatacctttcagcggtaccgccctgcacgccgcccgctggggtcacaccgccaaccggggcgtggcctcagtgtcccgctacttgagcaggaccctgatcgcccgagctgccgccgccaccgtcacagaaatgagccggttcacagcagaccggacccgagaggtgcttgactatgccactttacagcttgtccagagcgggcacaaacctctgcctcctgagaacggttggg

SEQ ID NO: 6043 - DNA, 700 bp, Nannochloropsis_gaditana
gacagagagaagcaacaaatagtactgattctgagaagggggccacggtcgcccccaagcatttcctttacccgcggcggatcggaacgggcagcgttgtcggtttgtttcattcaggaaataccctgggagggcaaggcgggaggatgaatcgtcctatgaccctctcaagcctttgtgaagcttggtagcacagctgcaaggttgcctgaccacggacttgtagcttgtgcgcaggccccgtcttcgtagacgttgattttgaggggggatgatcttctgtccgggggggtcatcggaaggcatctcggaaaggagagcctggcgcgcatcgcattacgggctcgttgactatgcatggatggcttggtctcgttggacttccaactagacatgatttacgggcaagattgtccagcgcaccttgctcgcatgcctggacgtcaactcgaggagctggagcaacttcacgttgatttccccgcccgcgcgttggcactcatcctctttgtccaatgcaatacattttccatgccatttgacgcacagagagctgaagagcacgcaagagcatgcacacagactgattaaaggaccctcccaagattgggcccggtgattgctggcaccccgccatcgggaacctgccgactcttttttcattcccggaagaagattaggcaagtaattgaggtgaatg

SEQ ID NO: 6044 - DNA, 700 bp, Nannochloropsis_gaditana
ttgcgcatggcagaaagcagtgctcatatcataaatatcaccggatgcgaaggagcgagtcgctagtgttcagtgttccttcagcaagaagcaacaggcgtgggtggcctactgaggtttttataaggcaagaacatgtatactatcacttcacgtaaccgactaacatgcacgtgtactccgctcccaatcgcagccgcatgccgtcgacttcgtccgggggtgcaagcgcggaggagcttaccaggcggcatctcaaggagctggacaggcgcgtctgaacctaaattatgccccggacccctctctctcttctccgctcatctgttctgccatgttttctgcaggtatgttgacgtgcctagactcaacgacagcacccgcttgagtgtgtactacgggatgagcaaacaagtgctggcccaggcacaggaatttcggaggtctcacgacctcgagcgggtacgtggtcccaatggctcggagaatggtgtgcaaaacatgcaaaatgagatgaagaaccacaacaaccatccgagagattgaaaggcttaaaatatcagtggcctttcttgaaatggggcgccttttactgccttttcgcatatcgtcgttatcgcctgtgtcggctgaacttctcccttgctgatcctcacaggcttacattttctacaagcgcttcctgcgattggccctggat

SEQ ID NO: 6045 - DNA, 700 bp, Nannochloropsis_gaditana
ccccttttggcctatgaaaagaacggacccgagacagccaaaggaatgacctgtacgtcgtgcaggacctgcttgccgcttcaggtgcacgccacaagaagcatcaggaagctgtacacgaggataaagcatgttgcataaatttatatatgaactcgggcgacagaaatgttgctaatctttataaggggtcctacatttcgcatgcaaatactcaagcagcagcgcccccttgcaaggggacgggatcggacctaggcccgcaaagaacacttctcaacaagatggcgatatattaacactcacaaaccatacacgggtcatatagggggcttgtaagggctgtggtagcctgttacttcgtgccttactgtgaggggcctgggttcgagagcacaattaggtcgtagctatggcgccgtttttgggtagcccgccgcccactgtggttagggcggagaaggcagccgtggaggccggggtgcggcgaagtgaacgctttaacttgtttcgaatcgcgtctgggaggataagaaacaggggaacgccccgacatcttatccgtacaggggctttggacgatggaggggcgccccgcgtggggggtgcgcggggggagggagtctgcgggcctttcggacgacagtgtccggagatagatgcaagaggccttacacctgtgactcttaacatcggaatg

SEQ ID NO: 6046 - DNA, 700 bp, Nannochloropsis_gaditana
cttttttgctatttacatctcgcacatcctatctatgtaagccttaacagcaatcctatcaatcatgatgtatccataagcgccacctttccgttgtgtttgcgtgagggggtgaacgcatgcgacaaaggacaaaaagacttagaaaacgcaccagtgagcgtcctaatctgactaacagtaaaagtttaggtatcttgcgtgatgtactcggaaatgatcattccaactacagaaggcggacgcgcgggcggaacaccgaacaataggtcatgctgaccaaaaatcatgacacgcctcgagttgcaggtgcttccttcaagaggagaaggcttcgcgcaaagtagtcttttctatgatttagaagagtgcgtaagtgcagaatatacttttagggtaaaaaagcatgggtcaagacagtccgcccttcgagggtacctgtctgcgtcacgtcagcctacccggaggaagaccccaaaaggcgactctagcttgctccgacttgtaaacatcctgtcaggacacttctcacaaggcaccaatgtttcagtaactatccagtctactacttctttccaatcgcatcatggtagatcaggacaagacttgcgacaggctggcgttcctcatctgaagtggagcgcgtcctgcagcgatgactcgagtgtccttcctactgctgctttgcttatgcctcatg

SEQ ID NO: 6047 - DNA, 700 bp, Nannochloropsis_gaditana
ctgcaccaaaatcaagacgttgtcttttcagtccttggtttgccagcaccaggaccaaacgatgacctagatatgcttttggaagccgctgcagctgcgagagttgaaccaataaaaggaaagctagcggcggagtaaatagttagggaaattcatgcgatggccgggtttgatggaactcaaataaaaaaataagtaaaagaatagataaagtttcttcgtgccggcggagatgtcttcttccgcgaacaagaagggcgctgacaacgtgctgatactcagtttcacggctttctccgtgatgcagggcaaccactctatgcctggtgctgtccctcgccctggaggatggagggtccagcgaggcttctggaaagccgtggggtctccgagtcactcttccgttcacttgcgagtgcgccatgccccctgaacaatgacgtcaatactgaattctttggcactttgcaatgagcacgactcctgaagtatgtagggttacggaggctcttgttgtcattcttggacgagaagatacttccggttccaggaagcttccaaacctgcccccctcactcctttgttctttctcaaatctcacgcctttgcatcctgtattttctttgtacaatccgcatgctcatcacgtggaccgaaatgctccttttaaatccttttgcagtgaacacagatcatcatg

SEQ ID NO: 6048 - DNA, 700 bp, Nannochloropsis_gaditana
ataatgctatcgtcggtcacaggctgttcgattttgcgatcagcaaccaaataatggtgcagttccaactcttgtttgtttggctagccttatcctttggagctggggagcaccaacctaggccaccatcgactacgactgacaacactgtgctatcatccatgctgggacctacccctggcaaagaattgtttttccgagacttctggcaaattaaaccggccgttattcggaggcataatccaacatttttccaaccaatcatgcggcagagtgacttggatgctatactggtgcaaagctcaaccgcttcaatgttgagaggtttgagttctagcgaaccaaaatgcgatcaggcagaacatgacgcagaaagtaaaagctggacactagtcaaacgcataaagggcgtcgatggcgaatggtggtcgagcactcctgctaccgcagcgctacggcagatttttggtctcgacgatgattcgacggatgcagaggtcgcgcatgccgccttttcacgaggttattctctggtcataaacaatattgaggataagttgtacggcacatcccgcttggctcttgcttttgaaggggaactgggctaccgcacgtccatcaactgctactttacccctcctggcagccaggcttttgaggcacattttgattggatggatgcattcatccttcaagtaga

SEQ ID NO: 6049 - DNA, 700 bp, Nannochloropsis_gaditana
ctgcctcttaaactataatcatcattataatggtacgcatggcgaaatttagtgatcacaaatgagaaaatctctgtagcggcccatgctcgactcagctcaactttctgctttatcattcccaaactcgtttaaaatgcgagttccaactccttgactaaattgtatttttttcgatatttcccatgtgctttgacatggcgcgtgcgtgtcttcatgctgtactttcttgcaccgagagcgtgagccgggatctcgctggcatcctccgctgtgatgaagcaccacacgcgaaaaagcagagaccgtggaataaaatcaacgatccggtttaatagaatttcgtcaagaagaaaaaacccatcagatatatccacagagagacatgtgcagcaaagcccagctttatgtcgcatcgcctctttcgccggctactgattcgagcgactcacccgtaaagatgcagaatgatatcaacgaagagaactgccataggcgtcaagaccaggcgttctccaaagcaattaccaccatcacgatattaacacttccccgtctttctcctctcgtcactcgcactattcaggcaggaaaagacatctcgccacgtgttccagtgcgtgcatgccaggggaaacggcggacgccagtttttgggtctaggcgtgtagccgcgtgaacatttccaagtcgagccatg

SEQ ID NO: 6050 - DNA, 700 bp, Nannochloropsis_gaditana
accccatggacgtaggcttgttgtagacattactggcatggacgggagagggaggccgtcctgtcaggaggtatgtacgtgtattcaaccaatttcttagattgcggacgcccgcaaagtggacgaattttcctcaaggtcgcagttggttggaagaactaggtcttgtaatacgtaaactcgtatcccgtcagccgcgcatggctttgatctggtacaaaatgcgacaaccacaagtgcgaaatcgataggatgctcacgcaacacatttttcaacatttttcccgtgatgattttctcgcacaggacgaatattttgttcatcagttgactctccgactcgaaatcaatttcacctatctcacttcgtccttggcctcgtacgttccatatggacacaaattgtccctgtgcctgcgtagcggacgttgaagaatcttccaatcatcgtgcagccagcagagaaaaaaactctgccccaatagcggccttaccgccaacactacccgagcaagcacaagcatcaacgtccacctccgctcgcccccccttcaagcgtgcagactctgtggattccccgtctgtggcaaccagtaatcccgctgacgctgggtttgaggtttcttctgcatggtctgtggcaggtattggcacatgcatccaactccgtcatcgggcgttcgggctgcacatcgccatg

SEQ ID NO: 6051 - DNA, 700 bp, Nannochloropsis_gaditana
ttcttttgcagcaccttgaatttctggtttataggctttccacccttgcgtccattactgagccgtgagcaacgattcaactttttgagacaggttggcaatattcgtggatggaattgaggacatcaaacgtgcatgaaaaggagagggaaaaaacaaattagtttcgcctgatcggtatcagcgcatttgttcttccacgtgtttgccctcatacatcacatttacgaaaccttttactttctatataataaacaaaccagagaaccccactttagatacaaatacatgtcagtgtcatcttatctgtagcaaggcaagattgtctctacttgttggaacgtttttccgtagttggggggtaagcgcaagcgcaagctcgaaagtcctagcaattcataatgcatcacaacaaccccccgattgtcgaaaacgtgtacaacaagtctattcccatattcccacaaatttttgcctttggcctcacgcacgccccctcgcggtccgtctcctcccaaatctttggcacgtataaagcctctccgccctctgccagagccagccccaacggcctctcagcacgcgccgcgtcaacggaagcgcgactgctcgcagtgcaaaccacgaactctgagcctatgtcccgacccttgttttcaagcgtacattaacgtcatgtgttggtgcacaagggagcatg

SEQ ID NO: 6052 - DNA, 700 bp, Nannochloropsis_gaditana
ggctgtgctcgtgaacgatgacaggtcccggtccttcgtgacggtccctgtcgaggccgaaagggtagggcggctgggagagagcgtggacgaggtcctggtcaaataccggcggcccccctactgtcgcgggccttcccacatctccatggcctctgtggggggagacgtaacagagcgaaaaaatgcgaaagttgtcaaaacctgtacattgtctcgagataaatatttgatatcatttgtacgctgtagacggataattactttttcttcgttaattgttttcaaaattatttgtattgaatagtaaaggaggcatgggggggaggtttacttcctgcggccgaaggcgctgacaattgtaggccatgcgatattaccgaagcacaaaattgcattacgtgcggccagcatcatcatatctttgcgatttttatcatatgagccatagacgggttggttgtgtttcgggactgcagggtgagacattgctaccattttgggcccattccaagactcccgctcgctcccggcgagaaaagtcagacacaacaagaacaggaaggcaagtaagcacgggataagtgggcgataaagtgtgcaactgtttgcatggcaaacagggtcaaggtgctaagtatgctgctttgtaccgtgaataggaagtgaaccgcttacaaaaagtctcacattgccccaa

SEQ ID NO: 6053 - DNA, 700 bp, Nannochloropsis_gaditana
tcagcacgcccatctacgtctaaatctggcaaatactatgaaggacttgcgcctagataataacaaagtatcaatatcggaaaattgtacacgatactgcagtgttaacagcatgagagtttttttgttgtacagtacaattcgggtactcattgtaagcaggcccttttgacgtccaaaaagactgcccagtcccatcggaacatacatttttctttctcatgggaggggtttaccctttagttaatggcacagggatagtctctggtctccatgctttagggaccattcaacattgatagcgaaaggataacctcctggctccctggcccatgcggtcagtggccaccttgccttccgctccctgtcgccggcgcgccgccggttcggtggcaaatttgcatgacaagaggtcgtcgccgagtccagcaattctgttgcatggacaactgttagattgatacttcgtcatgatggaacgctactcttcgaacaactgcatcttgagtacaaaagcggcggggggcgtggaggcttttcccggagtcgaaacccttcgatatcatgttgaatggggcatttacatggctacgattggatactcatgctctcatgtcctcctcaaaaacatccgccacagagcgtagttcatacttatcatctgcgctttgctttttttttcgaacaaacagacaacatg

SEQ ID NO: 6054 - DNA, 700 bp, Nannochloropsis_gaditana
agtgatccgctccatgacccatcttgggttccgggtgcgggcatcgtagcatacgacgaagttttcacggaacatgtacgtggtttcgccgcctggtagacccacttgagaccatttatcaagatctcttgccataccaggggcttgggcttgtgcgaatctctttctgtcctcgcggtcagtagaaaggagtatcgctaagcttccgcccaccgaggtcataagagtctttacatgccgcttgccgatgaaggacctggcgaatcccattgacacttccacacgcctgtgtataaaagttaaatattactaccgatctggaaacgattaacttgccgtaggggtagacgtcttttgatatggtggaagcataacaagaaatgaggatggcacaaagagcacaaggaaggcgacccggagaacgcacgcctgtcgtttcgtctgtagaaatcggcgcgtatagcaccctcaagcccgttgaattgcttgatgagatcgaagtttagcatgaagagtctgccacctgagggtatagatgtttcatacccaagcattgacgttgtttttcgcgcggaggacaccgtcggtgccagaggctcggcgatcatcatcagcgcgaggacttaggccgcctcgcccattatttcctgccttttcaatttttgatgcccggctttatttccactgacaacagctcatg

SEQ ID NO: 6055 - DNA, 700 bp, Nannochloropsis_gaditana
atgcaggtgaagatcccccctgcacggttggggtgtatacatgaaaggcaaccccatggccatctcaaacctaccggtcaaaagttgcaagaggcggtccgacgtgacccagccgccgctacccattcttccactgcttggactcatatatctgtagcaataaatggagtcataaatcaaattgcgccgattggaggaaaatacagcccaagcaaaactcgcgctccgtgttcgtcgcgcgtacctttgaaaggcttcgtggcaatgcatcccacagaagtgaggagatgtattcaaattatattttgtctcagcaagcaaagcaccatcgtcataatcgaaacaggaacgccaccagcctgtgagcatgggtgtttttcctcgttgcaaaatttacgcggagatggagccttttgtagtggtaacctcccctcctctggaggcctcaatagcgccgtcgttaagctcttccaccgtgccaagagtcccaccatgcgacgtgaaattcattgtaaggggtcgtgtatgctctcgtcgaccttttgcaaagtgtatgcttttttttgatttggtggacgtctcgactactaacggaacgcgcggtgaccagatcattcgccttgagtgcctcctacgctctgagggcctcgcgaagcttcaaaaggcagaggctaaaagactgatgtacgacgtaagcatg

SEQ ID NO: 6056 - DNA, 700 bp, Nannochloropsis_gaditana
tgtagaaggtgccgcctgtgacgaaagcgcttaacacaagaatgaccgacacagcacccaaagtggtcactaatatagaattcaatgccatggcttgacgacgagatgcagtaaatgaggcaatggccagacccacactagacgacccaggaatgcgcgccgagcctgccgaaggagacacaggcgggcgcctgcgcgggcgcgacctcagatgcaggctgctctgaacaggatcggaaaaaatgtcccttgccgatgtgagatgagattgaggtgttcaatgcgttcttttaccatctacttcacatttaggcgtctaccggcgaaaatcccatggtttgccctccaccgaagaacacacgattcaaatttgaaagccgtttccggatcatcgctagcgaatccgagccgttaccccccacggagtacctcgcccttgcctaaagagaaaggtaaagcacgtcttgctgtaagcacttggtcaaggactctgaaaatcatggatcaagttccaattagtgagaggcgattgggctgttccgtctggtcgtgatcacagaaagcataattgtgtgatttactcacatccacttcctcaggaaaagtgtgtcattaagtgctaataccaagcatggcggagacaaatgacctccaggaagatataaacgaagaatttatcctaaaactcctacacaagatg

SEQ ID NO: 6057 - DNA, 700 bp, Nannochloropsis_gaditana
tttgatggagtgtcgcccaacgacctgttttcttgcaaactaaaacaagaaggaatcgaaagatgtcaaaaagacatatatgccagtcctataagcaaaaggattctcaacagacccaacagaccgaacagtcataatttccttagtcccgcatgatcacaaatacgatacagaggagcagtccacatgcttgtgcaattcacggtctcggaaaaacctcacgaagaagaagaaacttacgtgcagcatcacaaaatccttagcgtatacaaatcaccgcattactgtctatctgtggaaacacgagatttcagacttttcttctcctgaggaaaaaaaaagcgccaggttatccttttggtagcagctcggaacgcgacgtacccctcgacgcctcaacacgccccgctgcgtgcagggactcctttggtcgcattaatgtaactcagtcatttttccaaaccgcgtcgaaactttcatgtggacgtcacttttctcatttcatgttttacagtgcatcttggagcttgttggtgaatcgtcgaggattaaataatcattaaggctcaagagcaccactgaggtggtagtcctagctagctggtagtatcaggccaagtgaaagctcaattcatacgagacccgaaccccacccggcacgtcaacgcattttccaccaacgttttgcgcgtagagcatg

SEQ ID NO: 6058 - DNA, 700 bp, Nannochloropsis_gaditana
ccttgtggccttgtttttcacgcagtgcccttggtgtcttaccgcccaccccgtcaacccttttgatacacttgcaaacagttcatcccgacttctttcagcagcatccccgtgagcaaaatattaacagtgaaaatctcaaggtcctgaacaatttttttgagacttcgtcgcagcgaagttccagccttgcctcaactatcagccctcccttcgccggcattggggcaagcccacgtgacttggtattttacgtcaagacccgcgctttaccaccgcgcacgtcttccacgccaaattccatctcgcttccctccagagtggtggtgccattaaatgaccgggtctttcattccctccacgagatcctttcccgtcactgtgaattgggaagctccttgccttctccctcgccctccccagcgcctgcggggcccgaccaccggtcaagtatctgggatcatattcacgagcaagcacacgatgattggaggtgggcttggcgtcggccatgtgctgaagatgaagatgagggctgggccccttttctggacagatttgtggcccatctgcagcggagagagaccaagcgggggggagggcaaaaaggcaggagaggggacggattagggaaattacaggaccgaaaggaagcggccgagcacatggaggcaaccggcgcccgtatttgcgcgaaatg

SEQ ID NO: 6059 - DNA, 462 bp, Nannochloropsis_gaditana
cgacagagttttgtctgaagacccagtaaatcattcatatgtagtctaaaagcagtatgacaagccaaagcgtgtccatttggtagacgaaaatagccacacgcgccctgcgcctgtccttgatcttcgaggtaacgaggtttctctcttgaatcattttctcttcccctctctgccatctagagatatggagcgtgactttgtgtattcattggacaatgtccatgattcatgataaataatatttacgaaataggacttctgtactacttttgcaagctaaatttgtttcgaaacgaaattgcggacatatcacaagagtgatggcatggttaaaaagagctcaatgtgtgtaagtgacaggacagaagaagtgcaattaagagtactcacatacatatctcacattttcacgattttcatgcagtggtcaacgtttcgatcttctctatcaccaccatg

SEQ ID NO: 6060 - DNA, 700 bp, Nannochloropsis_gaditana
caaaaacacacgacgcgtgcctcgcgagggcgcccgcttcccagggctttggagcccggcgccgcgcctcatgcctcattcccgtgggcagtgacggcaattattaaggcgtagagtgcattttgcgggggggctctcgctcgacgggcgatgcccgaacctgaagcggcttcaggcaatcgaatcagcggccgcacgggcatgaatatgagacaaacgccgttcccgtacagagagtagcttgtgaaggttgttgccacccctagaatgggggcagaaagatgtccagttcttttttgggggaattagttaccgtgcaacagggccgctgccccgtcacgacaggcgcttaattgcttgaacgcgccaacgtaccgagtggcgtggcccagtcttgatttgtttctcatccggttgcatgaaaaccgcggcaaaccttactggttggcactagtctcaacaaagggcatggtctttttgaaaggacgtgcaatgtcgaatgtctttcttatggaggtgaccggcccttttatcggaggccgtcgctcactctctcccccacaacgccctaaagaaatgcccgtcgctcctgcctcgccacactcgtattagcctttccgtgcttaaccctccttccttcccccaaaccctcgcattctacaggcctacgcctgtgagggatatggtggagataacaatg

SEQ ID NO: 6061 - DNA, 700 bp, Nannochloropsis_gaditana
gccacgtggcgtccctatttggtcggtattcacacgctgaaaagctattcttggcctcgtcgcgcccagcagctgccgtggatttgcatcgagacctgctgcaatttcgacaagcattagaattggctcactctgtcgccccacaagatgttggtgcagtggccttggaatatgcagagcagctcgaaatgcaacagggggactatgagggggcccttcgtatttatgaaagagcagaaaaatggcttgctaatggctcaataacatgtcatcagtctctcatgaaatgtaaaattggaagtacccgatgcacactacgtattggccatgtaaaaaaagggatggacatggtgctatcattcacagatgaaaaaaacagaaaatacggcatgactgatggcagcgatcaatccgtaaaaaacttcatgtgcgagtgcgcacgtatcctggagagtacgaaagctactaagattgacgcagcagcgttatacctgcgtgcgggaaagaaaaggcgtgctgcttgtatttatattgaagaaaaggacttcgctcatgcggctccgcttgtggaagagcttaatgctcaaaagctgcatggcttgtatgcgaaagcatgcgaagaagacgggaaggacgcaaccgcaatccttgcttacgaaaaagcaggcgatcgtgacaacgtcattcgattatgtctgct

SEQ ID NO: 6062 - DNA, 700 bp, Nannochloropsis_gaditana
agatgccccgcagatcggccgcacgaaaaggaaaaatacgtacactagtcgaaaagatattttcaaattggagcgatggtttgataccggtacggcttactctttaataagctgcttcaattaggttgaaaaatttcctctctttttcatgtaacgcaacgtatcacgcgcaacaaaacagtctatcagacacccgagacgcatttttcgggaattgccatgacagatcatttcctatttctttacgatcatgattgtggaaaggtacgccttcctctgtctttttgtcaatcgtcgtcctcgcactcacttcaatcctttccttaaaactatatattcgtagatacaccttttttcactgcacgcatgggatttcgtgtcgactacagctgtccaacccctttttccgtccatcaaaagatttttcccgaacaacttgggtacacgtgtactgatatgtgaccgtagggaagtgtgctatttatacaatcccgcagcgtacactgcggactgcttatttcttcgtcttcccgactttcccacgggtataaaagtgtctcaagttgtctgggattcagtcgatcgtgacattttgcacatattggatgagacgagttacctccacacgtatgtgtacttggcggttagcatagcgggtccgagtcttgtaaaggtaggtcatctcgagatttctaaagaa

SEQ ID NO: 6063 - DNA, 700 bp, Nannochloropsis_gaditana
gacaatgaagctagcctggcggacagctcaacaagttccagagtaaagcctttcctgagcgagttgcggcgaagcagctccgagccgtcacggtagaagagaacctcctgcccctcgcttattcccaaaaattgagttatcaatttttgtcgagtcactgcgttgacagcaggacactgagacagtcatgtttcatttttttttaatctggataacgatgtatctgtgagaacctcttgtggtttcaaattatcgaacacatttttaactttttcacggtaggcccatgctttacgcgacgtgggggaatttcttggcttacatttcgacgaatgacagtatcattatactagccgtcaaagatggtgttgagagtccggaaacaatctttacgttgcccaatgtaaatcaagggtcgtgcgagagagattctttcgcgtctgcattaccacgtctctcactcctagctgttggcggacgtcacgtagctgtctgtcaggaagctcagagcgaaaggatatcattttactctttcgaacaaaaaggagcatcaaataaagattcttttaagataagttatcctgcgaatgtactgcaaatctgcctgaatgaccaatacgcggcagtacgctttgcaagctctccgcctcaagttatcctgcacgccctggatcaagatgccccgcagatcggccgcacg

SEQ ID NO: 6064 - DNA, 700 bp, Nannochloropsis_gaditana
tgaagcaacgagattcaattaaagcatctttctcttttacaagtttcgatacatttattctaaaacaattattttggtacgcatttgtgaggtgtgatgtgtaatggaagtataacaggtttaacgggctcatgattgtagctgctaccagttccgcatacttggcggcgtcttagaagctcttaggcatacagaaacatgtgaattcatatcaaatctaaatttgtactgttttccttacttcgattgtaccttcgcatgtccaaaaggagagcgtttttgtgtcgtatttgaagtttcttctcgtagtggtcatggtcacggccgcatcgcccgcccggccgccttgaagcttggcgacaagactagtgagcaacctcaggacatggagaggggagaaacatgccatatatgtaatgtttacatcgggaaagtatctctacttgtgcgaggtgcgttgacgtctcctcaacgaccttgaaatatacatggttgattcaaaagatgcctcccgccccgatttctttctcctcaaaacgttatgttcacattagggcctggcaggtcgaaagggatggcgtttgcccttaagaagcgtcggacatgcaacgtcgacgatcgcgttgcttcagaagcatgcgtgctggcattttcgaccccacgcgtctcgcgctgccgcttggcttgtcgaggcaggatg

SEQ ID NO: 6065 - DNA, 700 bp, Nannochloropsis_gaditana; identical to SEQ ID NO: 4612

SEQ ID NO: 6066 - DNA, 700 bp, Nannochloropsis_gaditana
accgtgggcatgttgtgccatttcctccgtgcacgcggcctggactgagacgtcgtgggtgtttgcatggctttatttctttaactcctcaacgaaagaggtggctctcttttcgacccggctggacactacatcgaaaaatgcgtcctcacgcacacagtgcgtacacacgtgcaacattttcatctgtggaagtatcatagaggacgtgatgactcctaatcgtgccttagtattggtctttggtgggcagatatggttgtaggaaggaccacgttttttggggggggacctgcgacacggtagcctattcacagtgtcataatatatccttcctgattatgccacaggcgtaggaacatcgtccatggccacaaccatcggcaggactttccccaccttgttatcaacagagactcaccggcacacgcgcaaaaccttgtggaaaagagccggggcttagaaggtaatacggaggaagcgaccacgacggacgcagagccgtccttggcacagtaatttgtgtcttggcagcgggagagcaagcacctgcgtgagcaagtccgatccttgaaggaggaagtggcgatgttgaagggggtggtgggcggccgaaggggcatggaggcatcaccgaggcgcaggggaaagaagccgaacgcgcttcagggatcgcccctccacccactcccgagaaatg

SEQ ID NO: 6067 - DNA, 700 bp, Nannochloropsis_gaditana; identical to SEQ ID NO: 4613

SEQ ID NO: 6068 - DNA, 700 bp, Nannochloropsis_gaditana
cctactgtaccacaattcatggtggcaaagctatgcaaacgttggtgtcgagtgagggagctgacgacaacggtccggccgcgcaacaccgcaggtcggagagggaagaagaaagctgtagttggggattgaagcatgccacagagaacggcacgtgccaatgaattggaaaggaagaggaagcaccacgtgaaataggtgatggaagatttgttgacggaaaagcgccgccttgtcatgtgaggactgacgacctgtttgtggcacagggtggtgaaagagtgacgttggtaggggggatagtagtgatcgaggatcgatccgcttttcttgatgcaggagcgaggaatgcttcgtctctacaacgtttttcacagaaatttcttcttcttttttacaatgccatgtacattttttctaccaaataatgtagataagaagacgtccgtttaaaactttcccatgagtatcaaacccacgtgggaagcattcgcggactgtccctcaaccctcttttcaccgcaaaaccgaagtgccagtatccttagaaaacgtgaaatatatggccaattgcgacgtcgggatgcgactgattcagcagcctactctccagcttttacccctttcgatgtgcgacgcctcggattcgtcggtcgggcatctcacaaacgaagttggctgaacagtgtgctgaaacatg

SEQ ID NO: 6069 - DNA, 700 bp, Nannochloropsis_gaditana
  misc_feature (154)..(163): n is a, c, g, or t
  misc_feature (258)..(267): n is a, c, g, or t
cggacttaaacaatctggacgaaactggcataagaagattgatggatggttccgaggatatggtttccatccttcttctgctgatccatgcttatacgtgaagtttggatctagtggtgaaatattggttatcgtcttatatgtggacgatttnnnnnnnnnnactggcgtcgaccagtgtctttggttgtctttgattgtctttggttatcttagtgcgagattcttgggtgaatcgttggtccacattctcagggnnnnnnnnnnaaagtgacgccaacgatgacgaccctaaccgtaccaggtatggtttagcatgcatttgtacgaagcgatcgagctgcccatcaatagattggagcatgtgacccgtgggtaatacatagtctggcacagacggggagcatgaagcacgtgggacagagggaaagcaccagtaccaataatactacttgcggcggcgattgactccctgcctcttggtcggtatatgcgtgcataaacacgaaataattacgaaatgtttccaaactttatcacttttcacagagcaaccactttgttaatccctcggtctcgtaccatgcctctgctccgctttggggggctattcacgcttactttattgtgtgttttatcgatgggcgagagctgcacgtgcttcattgtcacaccgggagcttctcaagttggggcgatg

SEQ ID NO: 6070 - DNA, 700 bp, Nannochloropsis_gaditana
cgagtacggctgcagcgattcgccgacaatatgaatcactgcaacgatgccgcatgcgaagaggtattgatgggcgttgcagtggaacgatgtgtgtgctgaagttgatgttgcgagaggaccaacgcagcgaaggctgagacactcggagccgccactgcaccagagcgagaaagcagcgacgcgcggagagcagagggagacgaggggaaaaccctgtgatgatagcgtgccggttttacaattgaaacgacaaaatcctcgcacgctattcattgatgctgttgtaagtgtgagtgactccgagggagagtacatgttaggtcaactagcacgctcgcgggtctccccacgactcgagactttcgtacaaaaaactccgtatcgctcgagccccgcctcgctgcgtcctactcaacagctgtagcgtctacgaacaatacttacccgctagctagaagtacaaacaatcttccgtgagacagccctcttgcttctggtgtattatctgtgcctaacggctagaaggcttgagagacggagacaatactgcggctcctggctgtttccacatttttcctttcccaggtatgaatgacctgtcgtgaaggggtgaactcagccaaagctatctaatctaactgtgttttcattcaaccttgtggcttctctcgcctcctaagaattgtaattcaacatg

SEQ ID NO: 6071 - DNA, 700 bp, Nannochloropsis_gaditana
gaagatgtaccagttcttgaaatttgctgtcgagtactagggcagttagcgattcatgagaaggataatcaggccctgctacgccggaatggagcatgcgagatgatatgcgactgcttgcgaaaaggattcagcaaatgggaggcgctgcaagcgacagctgatcttgcgtatgattgtcaagaaaaccgccatgagcttggtcagcgagattgtgtcgctcttcttattaagtgtattgaaaaggatccggaggactgggtggcactagacatcgccttaatggcgctctcaaatcttgtccaggatcatgaacaaaatgcttcctgtgcaggagctcaaatgattcatctttcaacagacaaagattgcactgtctccttctatgcattcttatctcatctgctcgaatcggatcgattagtattcggagagcgagcatgcattatcatgatggtcctttctgtcttatgtgcgaatgatccagcagctcagtcgaagattggaggtgttaatggttgttgggttgtcgtgcagaggcttcgaatatcagggataggacctgcgggtgactcaatggggcgtgaagatcaaccactaaggtatcctgacatgtctttactacgtcaaggagtccaattgatgtcagatcttgctacggctcattcagataatcagaagaggcttcagcaggcagatg

SEQ ID NO: 6072 - DNA, 700 bp, Nannochloropsis_gaditana
aaaatgagaaagctgtagcatgcacatgcactaggttcttatttgcttcctaagagagcgagggaatagttcgtacgcgtgcacgtagtatccatcgccaccatgcctcctactcagtttctgcttcaatccattcatcaatgtcaaagttgatgataatagggcatgtactgttcagtaaggtaaatgcagagagtatgctgcacagaacgacacgtcacaccgtgatatgctttccaagtggacctgacttaccttatggaacctgtcttctctgttggtgatgaagcgctaccagatgtgttgctcgtggaagattcaaatgcgaatggcaaaatctgctgttttctggacggcgccatacctatattcatggggatgattggagagataggattgaagtggatgagttcatggaggccgtggggcccttgtgctaggaaaagcgtggaaggcgggaaggcgggagagtgggcgaggcggcgaagaagaaggaagaagctcgcactggcgtcagcttcaactatggaggcagtcctagcgggatcgtcgggttggtgccacggactgaaagcctaatgacaattatgcatgttcttttcctctatatacagaaattatttataataagtttagtttgaaaaagaagcatttcgtcccccgcaactcgtcaatcatttttagaagcaaggagtacatg

SEQ ID NO: 6073 - DNA, 700 bp, Nannochloropsis_gaditana; identical to SEQ ID NO: 4608

SEQ ID NO: 6074 - DNA, 700 bp, Nannochloropsis_gaditana
gcatcccacctcctgtggccactgagaagcacaaaccgagaaattttgagtaaaaggcgcacttatattttatgctctcacacgcatttgaatgtcttacatgcattcatgactaaagatgttatggtgagaaatctgcaacggaaccagttgtgcaatcagggctcaccctgccaggataaggctatctttcttttcaaacacaagctgacaagttacacgcacgcgtctgactttaaacgttcttttttcccgcgtattgcacagaactcgtgggtttccctttaagttacaatcacgatcgaaaagcagaaattgagtccgatctgacgtcgcctgtcagcctgccaggaagaggagggggcagtcgacaagacggaacgcaaaacctggaacgctgtcattggtcctctttgatctttgagcagtgcgcgcgacgttcgtacctctcagccagcgagttcaccacgtgtcattacaaagaggggtgcaactttaattccacccagtagatctcggaggttgtagtttgttctccggagggtaaggaaccagggcagataacatttctccgcccggcgaagcctttgctagactgcagacgcagaattctccctcagactccatagctttctgcgtcaagaggacagaattcttccacactttgtgtcagcgtgcgttgtgctccgtcctacgaatg

SEQ ID NO: 6075 - DNA, 700 bp, Nannochloropsis_gaditana; identical to SEQ ID NO: 4609

SEQ ID NO: 6076 - DNA, 700 bp, Nannochloropsis_gaditana; identical to SEQ ID NO: 4610

SEQ ID NO: 6077 - DNA, 700 bp, Nannochloropsis_gaditana; identical to SEQ ID NO: 4611

SEQ ID NO: 6078 - DNA, 700 bp, Nannochloropsis_gaditana
acgtggacaccactgggacaacttctagtgtctataggacggtttccaggaggaatatgcagagatataaggagagcccgaggccaaaaaaagtcgtgcaaagaatgtacctgctccgatcgccatggctttcccgtgaatggcgtgagctccagcgggcggaagtctttccccgagaccaggggtccaccctttgaacgtaaagcaaacgaagtgatcgttgtttgtaggtgacagcatatcagcaatatcggatgcaagagtgacatgcgttcttaccttttgtgcagttggagtgaacgacgaagcctctaaatgttgggccgtacgcgctcttatccaacaaagaattcccaacgctgcgatggcaagaaagggttttagcaacgtactgcccctccagggccccgcgaccttctgaaaatgacgccgtcgaagcatggcgtatggtctatggaagcgaaatatcaagggtgtgggttcagaaagtcgatgcattgagtcttggaggtcgtagaattggcacgtacgtgttgttgtctctctaggcgaagcttaaatcctcgctgtaagtatcattgcctcgacatcttccttgtttcaattgatcacgtactacaccaagctcaagagtttttattttgtacaggaagatatggcaggcaggagtaatcacggtggaaacaggcttgtggtcatg

SEQ ID NO: 6079 - DNA, 700 bp, Nannochloropsis_gaditana
ttattacatcactacttcaaggcttttaaagctgttcgcggcggcgggcaggggcaaggggcatacaattgggccgttgcaaatgtcagttgataacaattttaaatttttcgaaatcaagataggcctggcctactaatttaactttgtccgaatatgcaaggatgtgctcgaggcttttggcccacatgcatagcaaataaggcacttgcacaagggaggcgcactgtatgacaggtttagaaggcacgctttacttcgtgttcaaagctttggagcttgtcctgtagagcgggtgaacggttcgagtcaacggatgagtaaagagacgttatcctcgtcgggacagaattggactgccacctttatgagagattcattttgctttgagaagaaaacgaggggaaacttctaatattgctataaaaccaagtcttagagcgccaaataagtgtagaatgctatgcatatatgataatagccaaattagctgcagaggcaatctgtagcgtccggacaatcgttctcgatgccatgcttgacgctcccataatcctcaaaaaatataaaaagactgtgaatctgatagaggaaaaaataacatattttcaaggaagctcgcagctcgagacacaagaggatttacagtacttaggcccgcagcggcgttctgaagatcagcatcacctctaaaattatg

SEQ ID NO: 6080 - DNA, 700 bp, Nannochloropsis_gaditana
tgcgtctggcgtgcctgggacgggggggggcggcgagaaggacgaggaggcgaacgaccctctcacgcacgagagcgcacctacaagcaccacaagtaccacgggcagcaatacaagctaccccgtgggcgggtcttccttcctaaacgcttcaaagccggcggggcgccctgcctgcgccgcaagccgagccccctccccctcgcccaagccctacatcgccggctctgtcccttttttctccctctcctcctctgcactaccccacgtatcggaccccgaccttgccctggacattcctccctccttcccagccgatattcgggttcccgaagagctcctctccacgcactgcatggcctcgacttcctccctcgagggaggggcctccgtccgctctctcgaccctgcgccctccatcctctcctttggagactccctggctacagacttgacggctgcgaatgacccgttcggtttggatgggggcagggacggcgtgggcttcttggggccgggactggggcgttcggatggggaggggggggggggcggagggaggaggatgggcaggacggccggggtgggaggcggagatagagaggggggaagggggggagaaagagggggtggcggagaagggatgcgcctgccagggctgggaagggcgttgagcttcccttggttgcgaggagggatg

SEQ ID NO: 6081 - DNA, 700 bp, Nannochloropsis_gaditana
tcgtgtagtcgtccgacttcaattgcccccacatgatattatgggtggagttgactttgttcaaagctctgatttttacctcttgaaactcctcggcttttcttttcccttcactctattcccatgaaataagtcaagagaaatacaaaagattatcaagaagcgccttacgcccgacgtctctgagctcgagtctatttccgagggcgctggcacgtaaggaggcaggaggaggttgacgacgtgcctagcactctaaaatcgcacgctgtcgctgccattgcatctcttggatcctcgtctgaaatgcatggagcttagctatgggcaagaacctctttgctaccactatgcctctgtaatgtgtagtgtgaattatgtggacagggcttatccattgggagggtcgtggaagctagggttgaggtggcttcaagatttctcgaaggctctcctcgcacgtctatttaatgccccgaaaaccacgtagcataacggtgctagaccggaacaaaatcgcggacacatagtactgacacattcatcgttggacggctgtagtcgtgtgtatctagtgcaattcaagagagattgtagaacccgtaaattacctcctctcttcttgcatgcacccgcatggacacgccgcaaattgcagcccgcctgacctatcctttgccacctgcacacagagattatg

SEQ ID NO: 6082 - DNA, 700 bp, Nannochloropsis_gaditana
aatacaaagtgtacaattaagaaattcgtgagtatgttatacgttaatataaattatatcgtgagtaggctaagtccgaacttgctttgagtatcattccttcctctgtgccaatgagcatgacttcaagctaaaattcagtcgtcgagagtaagatatacactgctctataaagctgaacttatctccaaagttctgcgatggtgaaccatgacatgttacacatgattcaaaatattttccaggagcaacccggttgattcttcgtgtagtgcgtgtagtttgtcaggaggttaagaaacaatgaatgtttgtgcactcctaatcaaccatatttcccgtcatcatcatattgtgccttacttttgataacattgatagtattcgtggaattgttgtactgaaaatcgacaaaacagctctcagcatgacgagcgactgtttcaccgccttttaagcttcatggttaagaaaatcgttgcccatgccttataaatgccaatgtccgtcccaacgtataaaaactcacaacctcaaagtgaggagcatgtttaaggcttgtgacggtcgaggaacgaccaaaatcttcttaagcatcatatataccaaaataccacatcaaatttgtcaacattcacagcattcgacgcctatctgccgtagtggcaagtgcgagatacaccggaagtgctcactcatg

SEQ ID NO: 6083 - DNA, 700 bp, Nannochloropsis_gaditana
agaagccgaggatggaggaaagcacgtcttgcaatgccgtgaggaaaggcgccttgtcgggagacaggaaagacgtctgggtgacccgcaacaggtaggcgtcatgggcagcgatcacagcgtccaggtcgctggccgccccgatgtccgcctccagctgcgtccaagaagcttctagaacttcgaaccacatgaaggaggacaagttggcgacaaaatggaccatctcgcgccgtgtcagattgcagcgttgcaagatgcaggccattctgctttcatcttctctcccacccccgccccttctgggaagttgacccaccatcatgtgctctttccaggacgtgcccaaggcccattccacccgcttgacgcggaacaagagctggaagatacgcgcgtatgtctccaaagcttttcggtgcacgacggccgacacgggcgcgtgcacgtggtaatccaacacgaacacttcccagccttcctctccccccgaagcaggcaagagccggacgcccactcggttcaaaatatccgtgtcttcgtactgcgcgttgctggtgcgcaaggcagcttccaattttcctgtcaagtcgtgccgatatagttggtcggcgctcttgctcaactcaggaccgaccgcatccaagagacaagtgacgaaatcgccctgggcaagggtgatgaatttcttcagcgcccg

SEQ ID NO: 6084 - DNA, 700 bp, Nannochloropsis_gaditana
gacggcccaaaactggttccccatttcccccccatcctgcaggcgacatcgcatccaacccagcgaatttcaaagccgtcttggcggccactagacgtcgatttcatgccacatttatcgtcgcgggcaaccacgacctgtgggtgagcaactccttggccgatcagggcgtggtcacctccatcgacaagctcgcctggatccaccaggtcgcggaggggaacggggacgagccagaaggggaggaggatacagggggtgtggtggaggggaaggaggaggagggggcatggagcgaggaagggaaggagggaggccccgggatgcctggaaggaggggcgagtccgagggagatggcagcgggacacctgaaccgtcggcgaatcctggcggttctcgtgccgcccaccttcccatttctccgtcctcgtcaacgtcccgacggggcaaagtcttcacagggcccgtgcggtttcataccccccggggagaacgcctcctgatcctccccctcctctcatggtaccacgcgtcttgggacactgaacccgacctccccgccgaggtcgttgccgatttgtacgaaggccgacccaccttcgagcaacgttgggcggatttccggtgttgcaagtggccggaggaggtgcttcaagaccgggaagacttcgtgtccctgcagacggagaagcaggaatt

SEQ ID NO: 6085 - DNA, 700 bp, Nannochloropsis_gaditana
cgtaaagttcgacctccaccctgccactgccggatagaaagacggaaaccaaggagactaagtctcgttgaacaccacacttgcaccgggcaacattcctcctttgaccgtacaccttatcctcgcagggtcccttaaaaccaatagagcctagggtggaagcggcctcctagaaatccagtctcgcatgctgggaagctctgtcggcgcgcggagactgctccaagtccggccatcccctgccattacacccgggtggtcatccgcgtctgcgtctatattacatcgaccgaagcttactttggcttcgaacctgtctcagcttctataccctgccagtttctgcacgtcgccatcaattttgcgtcagaaacaggcctgggtagcttttgcccccgacctcgggcctctgccccgtgcacggagacggcgtgcgccaccgacacccatcatggaacgttactgccgcccgttctcatcatcatcctctccatccgcctcctgctcctcctccgttagctccataccggagggaagtgccggcgcgccttcccctccaccgtccccggggggtcccactgccaagcagccttcgtcccgcaccagtcacccgggccacacctcccacgcccacagccgccgcgttggcaacaatcgtacactcaatgctgcacattgctgggaaaaggatgttacctcc

SEQ ID NO: 6086 - DNA, 700 bp, Nannochloropsis_gaditana
gctaattgcaaagactgaacagatagggtggaataggcaggtggatcaggctcgagagtaaaaatgttactatgattcaaatgcatgtgcttcgcaagtctacgtgtcgtcaccatctttatacaagcttcgtgtcatcgtgaatgggatgatcggacgttcaatgaggcaatagtttgaaaactaaaatcagagttttcagcggggggctgatgcagagcagccatgtatgatcaccgtggaacaaacaacaagctatttgaaactatacattgcacgatgatgctcaagaacttgcaccgtcttcctaacgtatttttttgggttcgagacatggcgtcgccttttcgttttacgaaatgctcatcatcgaggcgtggtaggcgaacaaagtcatgtcgatgacgcaattgatgttcgttggggttggaaccacaccattcttgaaaaatgcgctagttcactcattggagaagcacacgtgtgcgcatgctgcaaacgcatgcataagaaacttgtacatatggacacttcagttacgatggcccgcccgttcacaaaatttattggactgtggagatctcaggcgcgtgtcgagttcagccgttagctacttctcttcccatttacttgaacaaaatgttgcgccacacactgatcagagagcctcagtgagaaattctagggggagatttaaatg

SEQ ID NO: 6087 - DNA, 700 bp, Nannochloropsis_gaditana
acttccgccattgagagttccaatttcattcagtactcttgtcactgcacagtactttatagccgtgttccaatatgtacattgttgtgggaggagggaaacttacgcgttcctccttgactctagcaacttactccaccccttcatcgaatttatccgcctccgcctcttcttcctcctcatcatcatcgacgtacaaatgtgccttggccaggcgattcgtgtttacatggagatcgctgtaatcctcctcatcgctctcgtactgacttccagtgctatctccgtcctctacctggaatgcagatacgttgccatcaccctcccgaccgactctctccctagttgggttaccattttgacacttttcctgtcctcccccttccggctctactctctgatttgcaccgtgctccagttcactccttccctcacccttgtgagccggtccttgctctgcaggttccgagaaaacgaccggccacatcccttggtcttttaggtgcttcacttgctctttgtacaaaatgtgttcgaccatgaatttcaccttccctttctcgccggccgccgtctgaaaatcgtgggacgtgccagagacaatcacgaagtctccccgcttgacccaaatcagcttccgaaatttcgtaggaagcaaggccagagacccgctgttctcgtcctcaccgctttgtggatc

SEQ ID NO: 6088 - DNA, 700 bp, Nannochloropsis_gaditana
atcacatactatgacgcttacgacggatcgctgattcgcgtgttaaaaggcggggaaaatgctgtgcgagccttggacgtcgtggtaggcggtgaaatgtttgtctcgggcggggcagacaacctcgtgaaagtatgggcgtacgtagaaggggtggtgctgagtgtagggcatggccacagcggacccattcaggacgtcaaagtcagtcccgatgaacgtcgcatcgtgtccgtcggggaagagggaggaatattcatctggcgcatgccagaggaccggaaagagacgccgagtacgagctagaaaaggaatgccgaccgacgtaggccttagccttatgagcagtatttggtgcgagaatttacgcgaggtaaagaattatggggccaggtaccggaaattccaggaaaacgatactgaaaatcaacttccgcatagatgctttacatggcgagtctatgctttgtttcttgcccggttggacatgctgtacaggtcattttcttcacacatttcctgtcacttaatttaacatgaatatccggctggcaatgtccctgaccatccatccaactccgtgctcgagcccgtcgcccgtcatcgcactgcagcctacgatcgtccaatgccgtcctttcgcaaacgcctcgtcctccaatcccaatgtcagtgcgatctcgccggggggaagtgctcc

SEQ ID NO: 6089 - DNA, 700 bp, Nannochloropsis_gaditana
gcgagttcgtgagaaaggagaaagggaggaggaacaagaagaggctcaattggggaatggggtggctcttgggagttttgaggaggaagaggaatcaggggagcaggatgaggatgaaggagaggtggatgaggaagaggaggagggcgaggaggaggaggtgaacaacgacaacgtcgtaaatgagggacgccaggacagattggttgagggcatgtctttgcgagaacaagaagaggcggtgctccggagcttgcggggcggctagactgctcagcgcgttaaaaaagtggaaaacaatacatatccaatcaaatgatggttgtcaagcgcggagctcgagacgtgacgtgtacactgtctatagacggagactttcactgcactctgcttcctctcaggctttatttctaacatagcatcgagagtggaaccccagtaggttggcacatggtggcgacgcgtgacgtttttgagcgacgctgttttgaagccataaaggctcacgatacggtccgcctcggaaaacctcctgccggaggatcccggaatcttgatgccatctttcctcttcctacagcctgtgccatgcgtcactaagcattcactcacgtgcatcctcgtgcatgcatgcgcatctcttttcgcgcctatcacaggtcggtcccgtgcttcctttcgccccgggtgttccgagatg

SEQ ID NO: 6090 - DNA, 700 bp, Nannochloropsis_gaditana
aaaagggacgggtgttgttcgcgggcgacctcctccaggtcggggagagtacgctggcgttgcggcgggcgtaggcacacaggggagagagaaggaaaatacctgtaccgggtggtggaggatggtgtcgatatgaaggacttagtatcggctcattatcatctctacgtgcatctggaggctttcaagtcacgaagatgatgactccgagaactgcagtgcagaaaagaaagtccgccgtaatggcacggcctcttggatgtgtgtgaagctgtaggatacaacatcgtcactcgtaaggaactataggttcatattttttcattttgtccggggaaagaactaaatcaaaggacaaaccgatttaaattggggtatgtcgcggggggtattctgctcacagcgttccacaaccgtgacaatctcttcctcaaagcatagattaaatctagcatcctttgtctgataagaagcgtcaacgagagacttaagcccatggcacgcttccaatatgaataaacagcgggaaaagggtcgggaggttacgtgctcgcagtgaatttgggcgacaagtaccccctccaggggccactcaggagggatgcatattacccgtgtcattttcaagccccatgacccatacacgtccctcatgtcatcctgtgcaaataaaactgtaccacagagaaagagagcgatg

SEQ ID NO: 6091 - DNA, 700 bp, Nannochloropsis_gaditana
tgcgatagtttttggggaaagcatgatattcctgttctacgtcctagcttgcttcgcgagttgcctctcgttgttcgtcatcgcggaatcagcctcaagtggaagaagcggtcacaatccagtttactttgattgttcggacgaacaaccttgtcaccacacggatgtatgctgctggccacagcatttaattttgctgtgatcttgttcgcattgtttactttatatcctcgtcctcatttgtcatgcattccacctattttcaccatacctatcaaactgccaagatgccgcccccgcgtcaaaaagagaaaaacggaccggttctggaggaggaaaacagcagcaccgcccgcccgggtcttattctccgtggtcgttggaagttgggccgtcttcttggagagggtgcatgcgggcaggtgtttgctgttgaggacgtgacgggggcccaaaatgaacaggaatgggtaatcaaactagctccccttcccccacccgctgccgcaggggtggccaggaagaagaacaagaaagacgagagcctgaaacgaaacgcggacaccttgtatatggagcagctggtctataaaaactacttgatgggggtcccgcacgtgcctgcgttgcccgccctcctctcatacggtgaagacaaaggcttccggttcctcgtaatgcaacgcttaggtcaagatct

SEQ ID NO: 6092 - DNA, 700 bp, Nannochloropsis_gaditana
ccgcacacgccgtggtccagacctatgccgcgcattgcctggagcggatcttgaacgtgaaggatcggaacgagcgggggggaccgacgtgggtccgtcggctggggaaggaagcgttgcgtccctctttgaacggcctcttcacgggcttgttcgcggtggtggaccgagggggtgcagacgggcaggagaacgagtatgtgatgaaggcgatcatgcgcttgctcaccgttgtccaagacgagatcctccccgtcaccggcatcgtgctcgaacgactcacggcctccctggtccgggtctgccggaacccttccaaccccctcttcaaccatttccttttcgaatccttggccgccacggtcaaatttatctgccaggccaacccgcacgccacggcggactttgaggagcgcctgatgcccccttttgaaggcgtgttgagtttagacgtggccgagttcacgccctacgtcttccagatcctggcccaacttctgctctaccgacccgacggcctctccccggcctttgtcgggcttttcccccccttgctcactgcctcgctctgggaacggaaagccaacatccccggcctcgtcctcctcttgcaagcctacttgaagaagggaccggagacgttgtctccgcacattgaacctctcttgggcattttttccaacctgctctcctatcgtgt

SEQ ID NO: 6093 - DNA, 700 bp, Nannochloropsis_gaditana
atcgtaccacgagacgactgacagcagtgtggcccgtgattgtcgtctctttgtacgtcaatcggtcctcaaatatcttcctgtcaatcatggcctgatgcgggccgtgtgagcgaaaccgacgcgtaagaagtggaagcccagaataaggagagcgtacacgtcagcagcaacgagaagacgtgctgatcacgagatgtgtatgccaccgtagcaactacaccacaaaaggctaaaaccaggggaaagggaagggaggaggctatcaaaagctcttggcgtcagcagcttcctctcctgccgccgaaggtgcaagaaaatcccacaatgccgtccatcatacacgcgataagcttgaatctcgaatgtacccatcctttggggcattccgggatgcaagggaagcacagcgtgggcatgatagtctctgcagtgaccagacacccccgcatcgctcgagatgacgataccgttagcgacgggccaaaaggcttcccacgcccttacgcttaccaaacgcacggccagttgcaggcatttggaagctttgggcggcgtcgcatgaatcaaagacatgtcttctatggcctgacacatttctctgacagcggaatacaaagatcgcttcggttgacagctttctttcatcagtttgtctttcccaatccctcccccgaacccctttaaaatagcaaccatg

SEQ ID NO: 6094 - DNA, 700 bp, Nannochloropsis_gaditana
tagttttccctaaagagatagcgaaagcagcacttgtaccagcacggtctttcccctccgctgccgcccagaaacagcgaaataattactatatcagagacaagatttgattgaaaagatcaaaaagatgtcatttattgccttccaggatgataggacttttaaatcagttttgccggtggcaggcacatgctcgatcggatcacgcctatgggtagagaataggacggaggaggcgagtgtgcaacgacgacgtggccaaaggtagtgtgcgccaattgcctaagtgtatggtttgtggcatgtttcgcttgaggatcataatgtcatttttgaaagagatcggctgttttcgctgggagctctctccgtaaacctttattagtacttcctttgcgtgtgcttgaggtcaagaagcgagagaaaggcgataggccaagatatctaagcaaagtggcacgtttggtggggcaaggcaagcacaggttttccccacggcttcgaaaaaatgttgtgatcattgttcaagtaacgaaacgcatctttattgtaggtcacgttcgcagtccgaagaaaggcaagttgaaggcaagcaacgaggaaaaggacaaagggagcaagaccagggctcagccgaccctgctgccgcctcttcccctccccatggtcgaggtgcttcctaaggcgtggcggagaagaa

SEQ ID NO: 6095 - DNA, 700 bp, Nannochloropsis_gaditana
ggcacacatgtcagacgaattggtaccttgactcaaccggatatggcactattccgccgcactttctctatatgtgcagataaatcgcattcttcgacaatttcatcgaacacacatgttggggcctcatcctcaataaagcacactttacatatcactcttttcagttgttttggtgttctcgtttgcatgcgctttcgtgacttcgcagtcggccttttttctcctccaattaaggatcaagtatgattctcatataagtagcttcttcacatgcttctacgtatagaatggaccgaaacatcgataccgtgataagtgtttaatctctcatggaatatctggtgaaacggtgcaccacagtgccctttcgacttagacccgacattgagaaaatccctcctcctggcaatcggacgccaaaacgtttcataatcatttttacatgacacttatttatggtcactgtttgttcaaagaattacatcattccgctctcgacgggacggcaagagggagcgcatgctgtgaacaagagcaatgctgcccgtgacgtacacgaacagggctaatgcggctgcttggctgtgacaagcgagaagtcaaaatggtaaaacaatcaaaaatcgcgcactacttcaaacgtttgaatgtgtcttcggatgcgagcactcatacatatctttggatgcgctcccag

SEQ ID NO: 6096 - DNA, 700 bp, Nannochloropsis_gaditana
tcattcctcacgacgcccgtctgggcgatttcaatgcctcattgcccaaaaaaatgtgcctcaatttacttacttttcaatagaagtgatcgcagctccgattgaggtcactattttatggtttggagaagacaaaagcctctttgtgccttgaaagcccgcgaagtcgggggcatgccgttgtcggaggctggcagaagtgccagagtacccggccgctcccagcactgtggaagagaccaggagacaaattaaacgcctgctcacacatccgggcaggcaacacgacatgtgaccccgcttctgctgcttgagcatttcctgttgcgaaaaaaagggtgagagtgggctgttatgtcctgggccttgtccccctgcgcgttgcatctgtgcgggttcctcgctcgcgttcgactcgccagggtacaaccctctgccccgtcacttgaagtgaaagcgacaggcactcctggcaatcaacgacgaagaaaagttgttggcaaagatgtctcaacatgtcaagagtccttaccctttcccgcctcgtcgcgagaaacattgcccgccgccttccttcttgtgcagggaacaaactcgcttgtcttgtccgcccgattccacgtctccatggcacgtttacatcaatcaacatacgtgcaacggtctcacacttttcatgatgaacaaagcgtagggcatg

SEQ ID NO: 6097 - DNA, 700 bp, Nannochloropsis_gaditana
ttgacatcactgtgggactgagagggctgatatgcatatccttgtgtaaaagtagaaatgtcaatgctatgcaaataatcgagtgtggttcgagcttccagtctttgcgtcggggcctcaggggagaggccgcagaaagatactcccccgcaagctacccggcgcccgaagaagatcttgttcctgcggcctctggataagcgtcgcacacaagcacggagagagcctttcgtattataatgtaccagtacttctttgtgaacgattgtgctgttgcttttcgtgccttgtgtaggtcggtgcgcaccttgcctgtcgcaggacaggaacacctcctgtcccgatgcttctcgttcgcgtgaaggcagaggtctgtgagatggcacagacctgcaccatgtttccaaccaagctctgaaagtattcctgcttcagccaaaaactttgcctcatttatatctctgttttctctacttcctccataatgtagtcgtcggtgtcggattttgacgcagatagcgcaaggaggagtccgcctttcgttgcggagcctggtttgtcacttcggatcaattgtgcgaaagcagcagacaagttcggagatgctctagcgcaacataccgaaagcctcaaaagtactaattctgcgtcatttgtaattgacgcggaaggtatcatactttcgcgacaagtaccaatg

SEQ ID NO: 6098 - DNA, 700 bp, Nannochloropsis_gaditana
gaggaagatgggaggagtgtctggcactgttgcgagagcttagaagtaaagtaagcaaggaaaaagaaatggtattggatgctggcatgtatcagttggccatgtggggatgcataaatgcaggacgcgcggatgaggcggtggccttgatggaggaaatggtcgcgtgcgaggggctggtgccgacagctcggacttatgtgacgtacttgaaagcactccagcgccagaaaaactggcaaaagagcgtccgcgccttgatgcaagggcgccgggagaacgtactcgtgctgaaagagaatagtgacaggaccgcgagtcaggaactgcttgcctggacgactgttttgcagacatgtggccgcgatgggcaatggcaagaggtgttagatattttgtgcgagtcatcaaagacgactgttggcggttcagtgggctccgaggtcatttgtcgccgcggggtgcctctaacagttgtggaggtcttgcttggaacaggtcgactgcgggaagccatacaatttttggaaggactggcgaaagacgttggtgtgatcccgcctttaccggtgataaatcgactgctaggaggactgggagccgccggagaatggagtctctgtctggaactgctgcttggcgttgacggggcagaagacggcccagagggtaacagcatgaaagcgcgtttccatgtatc

SEQ ID NO: 6099 - DNA, 700 bp, Nannochloropsis_gaditana
agtggatgcaattacggtgatcactacattgctggagcgacattgcatcaatcatcaagtacacaaagacgcggagcaagccttccaagtggaaatgtagcgatctagcaattgaagtgggactgacatggattcctcagatatgttttcacatcgtgctatttgtgttaatgtataaggatgtatgtgacagtttcaatagttgagcaatcaacagctaggaagacactcttgtaccaaaataagagttgtcatctcttaaagaaaatgaagacaagcgagtccgttggcattttcttgcattactttcgcgctccggcaagtgggccatttccgtcattacaccgctgcaatgactcatattacagttgcgtttgtctatcagtttgttcaggtctcacattacgattgcatttacttgataggtatatacaggtctgcttctattgtaacagtcgagaacatgtgaggatttagaaagcatttctcgatggccatgatgagttaacaattttaagagcttctgctgaggcttgtcgtcctttaaagcttcgtcgtactgaggagaagggcgtgcgtaccatgaagctgaagtctgagctccgtcttgcccgtacccggatgtatatcggctgcgcggtactacgtgccccgatggctacctacatgagcaaagttcacgaataattatgatcatgaa

SEQ ID NO: 6100 - DNA, 700 bp, Nannochloropsis_gaditana
gaaaaagcatcatgcttctcgtggatgtttttcattatcaagtagcgattcccgcgtgtaagaaaatacgagttgcaagagtacgaaacggagaatgtacccgtcaaaaacaaaagttgtcatgaattttcatgtgcgtgctttaggaaagactctcagctctaccatatattttaaagcgtcaattgattatggcgctccccacgcctttaggtaaaaaatgatttacccacaccattgaccgcgtaaaacgcgagtaaaaaggtagagttcataaaagaggaacacattgtacccttcacatttatgaagctaaggtattgtggaattttctcggtcgggtcgagggtgagaaggctgtccctggacctcgttgacttctgcagatcggatcttgccggttactccaccatgacgtgggaatgtccttggaggtctgcacatatttcctacatgaaagagagtcgcaacccctgaaaagatcttctgaagagcgcagaattacaagtgtctgttatgctatgtgcgaggcatccttcgcatcgtcggttgcacaaccacgaatggcggggacttggaaactcgggagggctgaaagggcgcacggaaagcaacgtggacggtggcgaccactcgcacattcgtcagcttgaagctggtcagcaaggtattttttaactttccgcacgcgcattaaaca

SEQ ID NO: 6101 - DNA, 700 bp, Nannochloropsis_gaditana
caaccagtggacgtggacttgaacttggtccgtcatttgctggagtcggtggccgcacaaggcgctcttccagggcccgcctcgaatctcctgagggagctgtgggaaacctgaaagggtgacaggaaaaccaggtgggcgtggaaaaattcatcaagccaccgctggtgaaatgatagttgtcgattcacagagcaaagaaattgtaaaattttgtcggtaggagacctggcgtgtaatgcaaaagaaatgcccagggatagaggaggttgccccttcagctgtcgccatctcgcctgccggtggcctcgaagacaggccgctccccgtgggagtggcgtgaaaccacccgggcaatgcgagtccctatatgtcgtagttgctcacagctgctttttgtttgaaacccgtcaagagtagtgaactcacttttccagactcccattgccttggctttcgatccttatcacttcacccttgtcgctggtgtgggaagaaggtgggctgtttttggccccgaaacgctaccgtgtaagaatatcagtaactctgcaatgcatcattggcaggttgcaagtcatgctacgaggtatatcgttgcccggcttaagcgatcgaggtcctctccgttggacagcaggtacgaaattacttgttggatgcgtttgtccgcgtaatggtgctgacctcaaccctcatg

SEQ ID NO: 6102 - DNA, 700 bp, Nannochloropsis_gaditana
cacccacaagtgcttccagagcttaatttctaaagctcaaaactatcattctgcggtcgaaatgtgaccaccacgaggaaacatacctttcgcaataccatgatagcgttcaaaatctgcctttgaaaagaatgaatcaacttgcgcggtgacctgattcaaagttagggcaaccaggaagaatatggcgaggacgggaggtgacgacgaagaagccatgcctttcaagcgagcacttatcctaaaagagatcggtcgcgcgcgatcctggcccaggcgatgtgcagtataccctgtgatgaggcggtgcctagcccccgtgagtcgtgagtgccccgggagttgccagacgtttgtcgcgaggcctgtctggtggaagacggcgagatcgagcgaggctgtgggcgagcaaggaccccggcaacggaacccccgcccggttcctgggactctcacgcgattcgatgccgctgacacctccctccttcattcgccatcctgcacctgtcccatatgcacgcacagatagacaaggaacgggccgacgggggtccgcaccgacctttggagcccttcaccgtgttctgttcctccctcttccaggagaggatcgaatcggaatctccttccttacagcgccgctcacactatgtcgaacacctcttcggattatccagtgcgacagcaagctcatgcaatg

SEQ ID NO: 6103 - DNA, 700 bp, Nannochloropsis_gaditana
ctgctgtcgcagatgccaagcggaacttcatctcgccttgcccccaaagatttgattttttcccgatcgttgaggctaacactgcaatctcctatgtggaatgtggaaaggtggagtgcacgcgaatggtggagacatagtatgggcacaaggaggggagcattccggtggatgggccggcctgcctgctcgctcagtggtggaggagggggggaagtcttgacccgaggtcgggcagattataattgggcaccagccacccacaacagccatggggagcttggaagacgcgtatgtattgctgtcgccccattcacacccaaaagaaaagcgcgcgcttttcttcgagacgggcgtggctgtatgcccacagagagcaaagaggttggggcggggagccgcttgttgactttgacctgttgcagcaacatcttccgtcgcgaccttccaggccagacttttctcataaaattcaggtggccgaaggggtcattattcaatatgtcagctctttaattaacaacttgctgacttaattttttgctcatcctacggttcggtttgctgtagtgaaaaagacaaactaaagataccgtcaaggccgtcccctccttgatctcctacatattccttttgcctgccacatagtccaacaggtctatccacaggagctactttcattgtttacgtacaaataatg

SEQ ID NO: 6104 - DNA, 700 bp, Nannochloropsis_gaditana
gctcccggatgcacgtgcgcgtaacgttttgtccagtgatgctactgctgcaagggtcccgaatgcaaccaggaacccccctgatggctctgctagttgtcatagctatgatgcgtgcgcgactgagggccatagtgtcaaaagcaaattcgaagacttccgtgaacctaccaccgagatcggacctttctttgcagattaggagtgagattaactgtgcttgtgtgaatcgcgacgcatgagatggctacgagggtaaactcaagagagggcaaacgttcgttagcggttttgattcctcgtcagcaagtccagcacgaggtaatgattgctcacgaagcggaaaaccactgaagatagagagcctcaatttaccgataatcatacggttttgtggaaagcgaacgagtgcgcgggaccgtgaaataaggacaggtggctggatctggatgcaaagtcagacagcggccggcgggcgagcgaaaggggtcggcggggcgaggcaggtgaacataaacctgggaacacccaacagaggcgctgtaggtcagcgacttgcccgctctcctgaacgaggcgttcacgtcatgtgaaaagatcgccatagcgggtagtctaggcatgcaagaggacattcaaagatttaaggcgtaatcaaacgctcagtccctcccatgctcccctcctgcacaaggttagg

SEQ ID NO: 6105 - DNA, 700 bp, Nannochloropsis_gaditana
atcgtagctttttgtcgagctcatagaggtcatacaattaaacacctctccgtttttcgacagaaatctcagagacaaaaagcgccaacatcccagcgtctcgtctttctccttcaatttcgaacaaaatagaggctggcttcgactggcggctagcaaggacgtgagacagagaagaagtcctaggggctcgcgagccgccttccgctgccacgtcacatgccccgctgggtacgtctggagtggcatgcgcattacacggcgggtaaaagtagaccgcgtgcattggaagcaagctgtatgtcccatgtctagtgacaggtcccatttgcggtcgccgtggcgctctcggtattccgtcagggcggacatgcattttaagccaatgggagggcacaaccgggccacgcaaacccgctgctcctgccggttcctgacaccgagcgagcccttgcggtgaaatcccccaggtagaccttagaggagggccttttaattgtgccgcggtacttgcagggtgtgcaatctgtttcctctctttttcgtggctatcacggtcgaggtagacattttttatccaatccccgagctcaccgtctgcattcccagcgcagcctccgcgtcgaatcgcgccctgcgtcacgtatgaccctgttcttttcgcaactcaggaggattttctcccttttatgtgatcaaa

SEQ ID NO: 6106 - DNA, 700 bp, Nannochloropsis_gaditana
ccttggaaaggcccgtatggctcggccgcaggcaccgactgcccgcctcaagagaatccacacccgggtcaggttcgatggttgaggcgcgcggccaaaggtcgtgtgtgctgaaagccactgcattgtatacatgttgaatgtgctcttttttaaatcaatcaacgaccagaagtgaggacacgtgggttggagaatggacaatttaatgatcaatgcccccccaatgcacctcgcgtaggaccgcaagtatgacgtacgcatgttctctacctgcgtactccactgattgaaacacaacatttggaaccataagctttttttgtaaacaacaatcgtcgtagagatacataaatcgttgaataaccacataacatgtgcaaaagtgcgtttttggatactagaggacactctgcctggggcacaaggttgcggcttcccccctaaatgatgcttgtggacgttgccgaagcggacccttctcctctgttacatgtgtttctagtgcatgccctcagtcaagcacttctttactgtactcacatgctttattgtcgatgctgaggattgcctttggccaattctttccgtaaagtcgaaaaggttgtggctcgcgggagcggacaatcgggtccacgtactcacacatttacttttcctattttttggtgcaggcgcacaatccaaccacaaggacatg

SEQ ID NO: 6107 - DNA, 700 bp, Nannochloropsis_gaditana
tcctacgccagcgagcgcgaccttgagggggctctggcgtggtttgagaagatctacgaggccgggctgcggccctccctcatatcatactccaccatcttcaaggtgtgtgcatccacgaagcgcggcgacctggccctgacttttctggaccggctcgtcagggaggaggatctgcagccgagcctcgtcaccctcaatcacgccctccaagccctgaccgccagtcaggagcatttcgacgacgctcgtcgcctcctggagaccatggaggcacgcttcggcgtcgcccccaacgcctccacctacacctctctgctccgcgctgccagcgagaaaggagacgcgcggctggctctagaattgtaccaccgcatgaaggacgtggccgtgttggcgccggagcccaggtcgatatgggaagtcacggtggcctgcacgaagagccgcttcttcgagccgctcgaggagctggtggatgatttgatggccctgtcagaaaaggtgctggctggcgatcgacaagaccatgtcggccccgcggggggggcggtggcgtcagtgcccgccctgcctggcacaagcgaaggagggggaagtggagaaggagcattaggcgggggtgtacctcctccgaacagcagtcgaaagtacgatccaacccgttcgctcctgtacgcctacagcgcgctcatgtcag

SEQ ID NO: 6108 - DNA, 700 bp, Nannochloropsis_gaditana
cagttgtatcacatgggcaaaatgatcgcttatggtggttatgtcagaatctccccctttgcacgtgaatagccccatgaggacttcgcttgtcgatatccgccgagtcaggtagtagcgagatacgagagccttctacaccgcgttgcctccccctacttaccggtcaaggcgaacataccgacgcagctgaagaatccagagaggaaagagttgaaggggaaggtacccacaagtgcacaatacagaaattggagcacgccagtcgccactatgaaggccaggaaaaggtccacaattttggtttgtgtgttggctgcctttctgtactccgcgagcagactcttgccaacgcccctgatgtccaaagctgacgcggcaggagtcatgtccagcgagactagtgagatatcaatcactggctggttctacagggagtagatgtacaaaagagaagcggaatacgatgtaaagcagagtgcacacacggctcttgaatcgccgggcatacctccgccggttcaggcgagtcttcgaagtccgagggagacccgaggaggacgcagagcgcgagggggcgaaacgaaacaaggcgatgtggtaggacacatatagagaaagtgtttcatggatgaggcggcactttcaatgcacagagccgcgtagacagcaccatatttcgttcgaaagacgctggatg

SEQ ID NO: 6109 - DNA, 700 bp, Nannochloropsis_gaditana
tcgagatcgagttcgcggacgcgagccgtcggcccatccgctttacggaccactaccgcttcaatatgggctccatggccgaggagggggcaatttttgccagtgcaacactggatgaaattaacccggacaaaggagataagcaagtggagaacaaggatgaggagcgcagcacagttttcttccgacccttcgccaactactccgccaaaaatcaatggctctacacgctacccaagaaagaaggagcactttgcgtggctgttggtgcgcgctggacagctgtggccaccacacgacagtgggtgcggctcttcacatttagcgggctacaagagggcgtcctggccatgccgggccctgttgtcaccatggtgggacaaggggaacttcttgccgtgttttatcacggaggaattcctctcattaaccatagcacaggatcggcttcgcagtctcttcactatcagctcctagatatacggcgtactgttgtagtctcgcaaggccctgtctgcctctccccagactccttgttaatttgggcgggattcgacaattcggacatgcttcatataatggactccgagggtttactgtcaagcctcgtgcgcggcttttcttggcattggacgcctattctggaatcaagtcgtctgcgcaggaacaaaatggactcgttttggcccgtaggtgtctt

SEQ ID NO: 6110 - DNA, 700 bp, Nannochloropsis_gaditana
aagcgtgaacgagggcatagtgggtgcctcgcgttctcgagcgttgcgacagttacaatggattgagatgcggcagctggcagttttggactgcatgggcttttttggcattaaaaatgtgcctgaagatgccatatcaactttgttatcttcaagtgtgcaggtgatatcagaattgaagggctcgaagagagacgctgccacgaaagatgcagctcccggggagtctcgcagaaggactcaaacgcctgaattggaaaggcatgaggaaaaagaaagagcatcctcaaataaaaacgttgagactccggaaaagagaagtctctctctccatagagacaagcacatagaatcgacacatgaaggcggtgagggttttgaggaagaggagtcagctcctgacgacgagcctgatgtcctggactatgaccacattaaggaagagcgtgagacaataccgccatattctcacttgcaggggccattcttaccatccagtagccctgtggatgccctaaagcgctttttggtctggaatcttgttggaaatattgtttcccaaaatttgggagaccacaatgtgatcgagatcgagttcgcggacgcgagccgtcggcccatccgctttacggaccactaccgcttcaatatgggctccatggccgaggagggggcaatttttgccagtgcaacactggat

SEQ ID NO: 6111 - DNA, 700 bp, Nannochloropsis_gaditana
cagaggaaaggatttcgaaattgagagacatgttccagcccttcaatcctaaatcggctgacatacctggatacactccgtcaatcttcctttttgaagataacatgctgcccgattcgcaaaaatggcgcaacgaagctcttgtattctcttttcttcttgtcgagcctcctgccagatttgtcggtgcggccatcacttgtgatcgttaacagcttgacatatcccaccacatctcacctcgtcattatggtctaattttcctggtgcaacaaaagggaaatttaatgcctcgtcataggcttgaatagcatcatcgattttttttttcttgtacaaggcatttccgcgacgcttgagctgctccatgagcagtcagaggaggctacgagaaagggagcaagcaatctgttgctattttttcaataaatatccgttttgtacgtgaaaaatacaacatcagatgaaccgtaaactcttacacctctctccattacccctcgcaggcacaaacttgcatagcaagaatgagagccgtctgggaggaagcgcggaagagcaccgtgatgccgccctaccttgccctactaagactgcccccagcccgccgccctcgctcattgtccatgtgtgacactctgcatgggatgccttgaaactgacaatgcgccgaccactccccctacactccatggctaga

SEQ ID NO: 6112 - DNA, 700 bp, Nannochloropsis_gaditana
aggtttgataagtgcttttcgaccagaatacatgcggtagtcagctttgctctgtgtaacgatgttcagaagtagtacacaaaatttcagatgatagcagtgcttccacctcatcattctcgagaacagcgtctacaaaaagaaaatgttgaatgagatgtgtgtgcttaataagagatcaattttatggttgccggtgggtgacttcagacagcgtggaccacgcacaagtaacaattgcgcagattgacgagtgtgatgtgaacatatttaggatattcatcgaagtcatcataccaaagggcgaacccaagcaacactataaaaagaacggcctgattgaaggctttgccgggaggccgagacttgccgcccacgctctctccatcctgagacctcccccccgtgcccctccctgccaacagtgctcgccttagtgtgaaagcatgtagcaggctcgacggggacacgagcttttcaaaaaaggcatccctagatgtcagtcacgaagcctagtcgctcgccggcgcacagttttcacatcttcggggcccgcggaacgcaggcgtgaaatggctgaggctccggcggagtcgccgaagttgccgccaagaaacatggcgccttttctgtgaacgctgtgtgttatttatctagtctcataaatggcacaacaaattacagaaatctgaactggatg

SEQ ID NO: 6113 - DNA, 700 bp, Nannochloropsis_gaditana
tgttattcgtagagaatgcaagcgataaatgcttctgcgaaaataaacctgatgcgatgatgaagaaagagtaatagccgcgtgctctttagaaaatagtgccctgtctgaggtgggatcgcagagagctcgcctcgggcggaggcggcgactcggaggaagataatatccaccctgcgctgccacactgccttgccggccccttcctcctgactactgctcttccttactcaatttcaccatgtgcgagcgtcaagatgaaactgtacgagactggcctttgataagctttgttcacagaaacctcattgcgcttccttcacacaggggcactttcacgtaaaacaggagcctcgttgggccgtggagggtgctttttgttatgacataccgccattatggccatttcagagccttattttccattatttttctcgggaaatatctttcaaccagtggctttatacaaaagcatcacgtgtcaatttttgggacgtcgtcgtcgagcaacaaaccaaccagcactcctctgtatcgatacgcaccgtccgtgagtcaacttttcattgccagcactccattccatgagaaacttccaattgtgtccgctgaccgaaacttggccgaaacgtcatctgtgattacgtcaagcagtgagaagaatatcgcacaagtagtcactcagctccggcaagtcatg

SEQ ID NO: 6114 - DNA, 700 bp, Nannochloropsis_gaditana
tcgtaccctacagggagatggattcacaggtcctaccaagtttgcgcggaagggagtcgtaatttcttgacggttcacaatgccgtaaaaagatcgcgacctaaaattgaaggcaggcttcgaggaaacaaaggccgcaacaggatggactgccacaacagccataagtgatgtaatttggaatagggaaatttgcatccgtcgaccctgtcggtgtcatagtgttgaaggttgaatagatataaccgatatcaaattgtgcaacttcaccaaaattctaatcaaacgcggaacatcatatcagacttgcctgcatgatacttgactgcgcttgtggatgtccgtcctagtgctacccactcgtcggtactatgttttagtgagcggtattgtggcgcatatccagactagctgtggcacctgtgttgtcgcaatcagtggtgtgagctaaataacacgtctgccttccatttatcatgcagtctctggaaggtcggggacacgagctaaacaagtcttacttcaaaaaatctggtcagggcttgggtgcttatcgtcttccaatgtggggcctcgccagcgacagggttgcctcccgttcgctcaacctcgcactcgacctctgtcgacacgcactcacactacatggactcattaacgaccaaaacatctcgccaagcaacctacactaggtgaaatg

SEQ ID NO: 6115 - DNA, 700 bp, Nannochloropsis_gaditana
tgtaatagagtcaagaggagaagttgatttgcttgacggatcgagggatgaagcaaagtcggcccccccctccgcggatttgtgatgctggtttcggatacaaagctgttggggttgcgtatgcgcatgctcagtctcgttcccccctccctttcgaccttgattcttcgctggatttctgcgacaacacgccatcgtggaacacgggagctgagtaggcaatttattgtggaaaaagatcttcgcgaccagcccgtcgccttccacaagcaaaagcatgaacaaaaattccatgagtctccttgccaaaggcattattaaagtactgtgttgtcaatgatgtgggattcggggattcatgtcagcccgttctacaggcctgaagtgaactagctaaaggttagggaaggctctttttgttttgttgcttgacgtttttcctcctttacagcaattctttcacgaaatcaggatactaaataatcgatgacctatcgttttttcatcttggaaacgcactcctcatcagcttgcggccgcacatcgtccgcgcttcccttgcacttcagcgatgagagcgagcagcctctggcagcactctgtcaggggggtggttgcacgtgtcttccctgatcattcccggataactggtcaaggtcacgcatattctgtgttacgaaacctttcactgcagggcatg

SEQ ID NO: 6116 - DNA, 700 bp, Nannochloropsis_gaditana
catgatgccctgccccctggatgttacaatatggtttgttggcaaggttagttggcatggtttgttgacaagagtggtatcgacagcagatgcttctgcgggtaaggtacagcgacaagtggacaaatgtcagcataaaaaatgctttatgtaaagtcagtggaagtgagccaagtatgtcgtatgggccatgggcctgaccgccccttgcggggcaaaaaggggcgggggcgggagcaaggcatgctccgccattgccgtgaaacacatgtcgcaaagtatgcaatgtatcataatcctaacccgacagacgagccaatgcccatacacattgccgtgctgtacctcgcgattgtgcgggcctcaattaaaagaactttgatggatgaaggccatgaccactccgtcatttccgtgatggaacgcgagtatcatcgctctgacagagaaaggcgagcaaagcaagtggagcgaagagaaagtcgttgaaggcgactcatggaatagaatcataaaatgtccgcctttgcctacatgctcgcttagactagcggcggactcgggatgacacggcgtcgattcccgcggcgtacgcgactgaagattacaagcttctggacttcgagttagagatcatcacgacacacataaccatccaagaaggaaactgagtgaagtcggctctgcccattcttgcaca

SEQ ID NO: 6117 - DNA, 700 bp, Nannochloropsis_gaditana
ataacaatgcaaaaaatggctcgcaatatgtttaaggtctaatgtatttctttgtatgttttttacgaggcccttacgtgaggatggctagtaagtctgattcactgtacagaaaaaaggcgtaggtatttctgggtaatacgacggcagatgaacgccgacagctgcccgtcggtctcacgccgcattccgtcaccatcggtgcatttcggcgtttacgtcactaaagttgttgttctgctgagtatgttcaaattatgtgatgcacggatagaaatcaatgccaacaggctgattttcccggccatgctcctaccttctgctggtgcttcgacgtagctgggtcttacaaccatcctcaagttccccactatttctagtagtacgtattgatttccgtgaggcgcattcttacgcattatatggtgccacacggcgagcgggaacattccgcggtaacgaagtcgcaagaaatgtaatcaacatcagaacatgcagcaatgatccacttccctttttgtgtatcaaggaaaataagagcttccgctttttttgaaaccataaaaaggtgtgttatcgggagtcatgccctttcttcacatcgccttctcctttttcttacatgcataggactatagatctggtgttatcttctgacccttttctcctaaggtgacaagctaatacttgctccatcatg

SEQ ID NO: 6118 - DNA, 700 bp, Nannochloropsis_gaditana
catgcatctctgcctctacacctcagtattaagtttgcgcatgatatgttttcactgactggatgcaagtcaacgattggcgggcatgtcatgtcactatctgaattattacctgcccgcgcctcttggacgatctgagcagccttctgctcagcagctctcagctctgccatgccaccggacgccatagcaatagaaaaattgaattaagatctcaaaactgtttgtttgatggggcaatgcaaatatgcagtcgttattatttcttcatagaagacaaaggttatgatttatgccatcctgagagttgtgggagctctcaggcgcccaaaaaaaagtgagggatccgggaagttatccgttcaaacattttgtacaattgcactgatatggtgtatgcagcaggctggccctttctggtgtgctgaagccggggggcaggctccgaggccggaagtggaatctcaagctgggaggggaggagaggcggcgtctcgaggagggcgacgccgttccggcctcccaggagagaggatcgagactctggcctccatttcaccacattgatccacaaactcttgacattaaacagggtatctttatagaccgccatctgaaagtccgagcggtcttttccagctgcccaacacctcttgccgtctatttacaagtagctattgccacatcggagacgcccatg

SEQ ID NO: 6119 - DNA, 700 bp, Nannochloropsis_gaditana
gcagagattcaccacatgagcatgacacttactttatacgctatacgtagattatcattatgggtcgacgaaaatcctttctggagaaggctgtaggtttgttggcacaggaagccgtacaagcgacatgtacgtatcgtaggtccgaagagaatttcctaaagagtcggtggtgttttaccattcccaggttcctcaaaacaggggtacaaggtgatgtacgacaatcagaagatgcggacaaagctgtggaaaaagcagtccacgattttgggtgagtggcaaattaaaaggtcctttggatgagacttctcagaagatgcctggctgccttccccaacctcatgctcgaatgtcgctttatttattgcacagctctctgtctattctcgtgaatgcagctgccggaaattttttggtagcaggcgaagatttaagcacaaaaggatttagggtgagcggtcattttctttcctgcacatgtatatgtatatagatatataggtgtccttatcaaaccgatggcagcttcagaaattttaccgatcttggcacgcctaggatgacgtttcacttatttagaggagcgatgtagaggcttttgtgcaacagaggctgaactcaagctttctttccaccccacatggatggtttcgcgtagaccgtcatggaaatcgataccgtagggtctttcaacatg

SEQ ID NO: 6120 - DNA, 700 bp, Nannochloropsis_gaditana
tcccatgatccccagaccaccattcacaatccatgtaagggggcctaacgtaccatttgagatcgttttgtacaatgtatttgctgtgaacttgaaataagttgtcccagcgctcgcaaacggagaagacgcaagttttcctcttgagttcggaaccttaatgtcgcacctgtagttgtcaggagccctttcagagcagcgataatttttttaaaatctttacccgtgatgggctggccctcaatagccaagagtacgtcacccttatgaatttctgtcttctccgcccaccgattctttttcagagccttgacaattagcatttcgtgattccaatctgtttctagccaaagcccgatctcctgccctgggggcaattgaatatcgaattcgggattctttctagtcataagatgccttacgcgcgataaatcagtaagcctggtgagtcttaggcataagtctgcaccagcatcgataaggaagggtgcacttttatcatagccaccctgaagttggacagtcacacgcttctcagagctcctaggtagatgagcctgagcgatgcagtgactgccaatctcatcagatatgtgacccaggcggaagtatgttgagtcctgagaaaggtatagagggagtgggtgtctgttccagacgacataccgaggacaaaagaatacaacttttgtgaattgtc

SEQ ID NO: 6121 - DNA, 700 bp, Nannochloropsis_gaditana
acagatggattgatgctcactgaaaaactcagcaggcgttttgctttcaacaacctcgattctgtttttccgtgccataacctcgtctacccttatgttcgggaaaggccttgaagatcgaacaccaaacgaataatagaccttgttctacctgttgacgtatgtatgggtcaagcttgttggtaatcgggaggttttttttctacgtcgctgtgtccaatgctatgcttttatgacttactttcattggatatggtgcaatcttgattgtgcatcgaaacaatcctaagacgatcactcataccaggcggattgaacaagcttgtcatttcctcttcttcatccccgcgccaaggcttgtgagcgagtaggcggcggcggcgagattgggacaatacgcgtcgtcgagattcacgccccatgttcttggcctcctcaacacttgccaggcatcattcgccggacagggcaagactacaagtagccatcaaggttgtttcttattattcttcatcttcgtttttttaaatgatgacgaagtatgctctaccatgggcgcggctctgtttccttccccccaaagaagctttttgagaccggccacgcacgctctagctaatcaaggctctaaggggaaaaagtcgcacgctttcgggaaaaactcacaattattctatccacttctcaaatttgtcgtagg

SEQ ID NO: 6122 - DNA, 700 bp, Nannochloropsis_gaditana
ccatcaacgcacccccattttcctgggtagccttgacgatatcttggaattagagtcctatggggacgtgacacaaaattataatccaggctacagtgctctttaaagaccaaataacagcgcaaaggagaagggggaaatgtgtctcgttcgtttccatatttaccatcttaattgcgataacggctaggtgtaaataataaagtgctataatttcatgctgctcggtttgtatttcaaattcatttgttccagagagaagcaagagcacattggttgaaaatgtttttcagagtgtatttgtgcgtatgcttaacaatctttgcgaaggagcacggggccctaggggaacctcctggtccgcccctgcgactcggccgaacgaggaggatcggatcgctccgcacagcttgcactccttggggcctcttttcccacaaaagcatcacaacacgtcctagcaaatcccgaaccaagtaatcacatatgtacatagaaaatttcgtgttttattttaattgtgatatcaatgaaattcacaatgtatgggggaaagatgatgggacacaatgtaaaggtggatttggcccctcatctcgtttgtgcgcgcgacatttaacatcgtgttttgcattaaaagcaggatacaggatacaagacctatcaggctgaactttaaacagagcgacaagcgtgaatg

SEQ ID NO: 6123 - DNA, 700 bp, Nannochloropsis_gaditana
cccatggcttactgccgtcggcgcaaaaacagccagatggcggcaaaaggtatcagatcggcctgctcgtgcctctgagggtcgaagctgaactcctgtgcactgtgacttataagtacaaaatgtgttggagattctaattgccacgctttcgccgcgtcgacatcacaaagatcgagcgccttagcagtcagaaagatatgggggaaaatagagcaacaaagcgcttccgcattcaccgacacgactttattcctacttcgaagcgacaaacacgggtgtgggatgaagctgtcacgggtcgtacatccgatgaggagcgtggcatgagtcagcagaaaacgaggcggcgagaggactaggccagaccgtctgaccccatcgccttctggcgcccaccccggtgcccttcccgaggacttgcgcggccccgcttccatcgcttccgctaacttgccctttcaacgcccattccaaattcaggactctgtgcaggactcaggccaattctttagcgcgtttgtgtgggactggaatgggagttcgggttctctgttgccgctttacctccccactacccccctcctggttgatatttttggtgctctttctgagcataaaatcttacataagatctgaagcctttgtaaatacaagcccttcgttacaacccatctatcaaacccaaccgcacttgatg

SEQ ID NO: 6124 - DNA, 700 bp, Nannochloropsis_gaditana
acagctggctcgtcccaccgaatattaagccatcacagacccttgcgctagattatctataaggacttcctatacaaggaatattggcatgattttggtgggcatgtggactgtccaagtcataagtggtagtccgataagagaggaacaaggcttttttccgcgtcctcgctcagcgctcgctcaaaggcaagcagtatctgtgctgccagtagtcactcaattggctgcttaacttactgggcatatgacaaccaaatgtagatatttttcctgttgatgactattcatttatctacaggcttcatgagttttagagacggaccgtgcaggcggcactagccggcgaaacgcttaaattctgcagtggcagaggcaacagagcatgtcattcccagggcgtcctcgtggcgccctcgagacgcttgccaggtcgacatacttcgtgaacttgccacggttaacactttcggcggttttaacacgcaacagaaggcattttggcgcgtcctcgtccccattaattcctttgcttaaaaagtcggcggaaagaccctctctggaggcgctgaaatggtatgcctgcgggcccaccgtctacgactccgcccatttgggccacgcccggacctatgtttcccaagatgtgatacgccgggtgctgacagattttttgggtcaagacgtaatttttgtgatg

SEQ ID NO: 6125 - DNA, 121 bp, Nannochloropsis_gaditana
agctggggccggggggggggcggcatcgatctacgatgactacaagtttgtgagccgagaggagctggaggagctgaacgggagcaatttgatagggacgcccctgcttcggggctatatg

SEQ ID NO: 6126 - DNA, 700 bp, Nannochloropsis_gaditana
ggtgacctgaaaatgaaatactacatattttccgatgtgatggcgggagtttatagtcttaattttttttaaatataagcaaaagtggctcctttgactactcgcgaatcaaattggtggtcacgatcgagactcacgtatttcgatgtcggctgcgctcgtggagcggaatggcggagaggggattttaaattcaaattttcgaatcgctttcgatttgtggccatcgtactggagggacggcgattggaaagtgtaaagtcatctcattatccttgctcgaattgtgcacataattaagagcctagttgaatctcctttttaacaaatattctaccacttcatgctaatttgcacggtatgccattgcagaagcaggatgcacacaaatcccctctccagcaaaagcgttgctccttccttctccgcagtgtcttacacctaacaccgaaaatgccttaaatgcgtcttttaattttaattgtcctcgtagttccttcgcgtggtattcattctagccattaaatgcctgaaaggcttggcttcgagggaatacttggttgaaggtagaaaacgacaagacagacgtcatgcgtgtcattttaaggacgatgagaactattccgtaaagccacctagattcagtttgtctcgttcctttttatagcgtttctacaggggcaatccgtgcgaaaggatg

SEQ ID NO: 6127 - DNA, 700 bp, Nannochloropsis_gaditana
accggcaagtcagtcggtaatccatgctaaaggttatatatagacgataagtagaatgtgcaacacgatctcacttcgtagggacgcatcataatctaaaagccattggatggcttggttggggagtatcaaggaggtatcaaggatcagggaacccatcgtacaatgacttcgacagtgtcgtgttgtacctgctgattgcttgctttagaatggtgcacgaaggctcatcgtgcgttagaacgtgtgcacgaagtcgcacaccctttatcgctggctaaatgacttaattttcgccggcacgtgcggtctctccttgcagcctgtcgcctgatgcttgaagagaattcgtctcgccttcactgcaaaatgactatgaagctgatgcccgagattctgcggacaatgcggtggtctcccaatgcgacggcgacaagacacatacatgctgaggcccagcattacagcacagttgcacgactttgacggtgtcgtttaggatactagttatgagcagaaatggcatcgttttggctacggccttgcttccccccccccccaacgtctacccttgcagcactcaatacctcattcctttctgttcttattgcccagcacatagtcacgtataagcaggatgggccgtttgtcacttgcttgctgtgtctcggcccttctggccttgacaacatatgcgatg

SEQ ID NO: 6128 - DNA, 700 bp, Nannochloropsis_gaditana
acatgcaaacaatactgccgcaggatttgacggaaaaatgacacgttaacctacgagcctccgagaaaaaaaggccgctgtaatgggggaagatgtgcatgcgtttctattttaaaatgtgcgcgctgttacgggggggtgaagcgttagaaaaagaaaggaagacaaaaaaagcaaaaaaatagaaatcctcctacgcaagaggtagcaatttgcgatttctcgccgccaacggactacttatatttgatttggtgtgttgaagtaacaaaattttgacgttgtattggtcttgcaaaggagaaacgctatttacaagcctcgatgagttcctgaggccctgttctcatcattgagcctgtcgagtgcgtcgctgcttctcgctgtcgctgccttccacgtcgagcacatggacacgggacaaagcacgaggcacgcgtctgcgaagaaacatcaattgcgatcacactgcgcgatttctttttccacgcgccgcgcgcgtttgatgtctgtacgtttgccctggcccttggagctcggccgctgttgaccgttcatttctcctcccgagtccttgccgagcccatctccctctccctgtccgcccttcccaatcttccccaagcctgggctcaccccgcctggcgatgtcacccattccaaaactgacgtccgacaatacgtcaaccaccatatgcag

SEQ ID NO: 6129 - DNA, 700 bp, Nannochloropsis_gaditana
agatccgacttgtcccacacttcatggccactgtgctgtccgtacgtgtgtcgatggggcaaaggatgagtagggaggctctcttgacgaagggtgtgatctaactctgagaaagcaagcaggagggaatggaactttcccatcgctacgcaggattatatgtttgtgaagaccaacgcccgaactcacatgctcattgttctgtttctcgtgcaccacccgcccagggagaggctctctaagcggaggtacacggctggagagggaggtacgtggtctatgcacgactaatagagtagacaggatggacttggaggagacgcccactatctccactgaaaggtgtacagctcggctgacggggtagaatgacctctgtagcctttacgtctcttatatcggaagatcagcatcacaatgagacatagaggcaaaggcttttcttgctcaggacagtaggcagcgtgcagaggtggcaattagttccaggaagggatgtagtggagtaggaaaattcaatttatcaattgtactcatgaatgcgaatatcttagcgtagtgaactgtgtctttaagggctgcgcagggtatttaaatgagtccgggcaggtgtaggaaagtggatccaagaaattccgtgctaccaccccgcctcatgatcatcattaccccgccaaacacaatcccaggcttcagcatg

SEQ ID NO: 6130 - DNA, 700 bp, Nannochloropsis_gaditana
tgcaattctgcttttgataacttgagagaaaaacgggtggagaaaaatggtatcgacaaattacgttgtgtagaaaaggtgaatgggagatgagtggggatgcattggcatattgagaaagtccaggataaagagaaaagatatcatcgatgcaacccagcgtggtgtgttccgtggcgagcgagacaagttgacttggctaacattttccgaatggcgtttcagttttttttttcaaaataatagttaagccgccagtatctcaatacaggctgtagattccgcttccgctatttgtatagctttttttatcggcacaaacgaattgcttggttgcactaaaacctcctgccgcatattttgttccccctacagtctaagcgatagcatgtcgactaaaccaccttaattttacatatcagcgggttaaaaacattgtattacataaatttatggatgtggtcaagcgtactcgggactttgatcaaaacaaggcccggattcttattgatttgcagggcggagaaggaggggggggtaaggacaggtctaagaagggcagcctcgatgccccaatcgtggatttggtcggcatgatcaacgcccataaagactatgtaactactagttcatgctctggtcgtattgctctttttgaggacgtggacggtgtagtgtgtcacaagagcggaggaaaatg

SEQ ID NO: 6131 - DNA, 700 bp, Nannochloropsis_gaditana
cccgtctgccgaggaggtaggcgtgtgtgcatggccgcacccagggcgggggtacacatggagaatatcacgacctcttcctcgtgcggcaaccacgttgtttgcttcacctggggacgctcctgctcattctggctttgcggtggacttttcatcttatcaagccgccctcctcttcgatcatcccaagccccatcattatccttgtcagatttttttccactgcaattaaatgttgtgacgattttccgtattgcgtcccaggttctcatgtgaaacctttcctagaatattgaaaagaagatggcagttgcaaataaggacgcttccctagcgcgtgacatcgcgtgcgccaaaatacgctagcctacttctactagtaggaagctccgagtcgaccttgctcctctgtcgtactcgtgttggggactgaaaaagtacaagggggaaatcatgcccacgtactccaggcaatgtttgtgcttacttcactgatcacatccatttttgtggcaggcgtcgttccgataaactcttctgcagaagcaaattcttgtgctcgctcactttctgatgtgaagcgccttgttctggctactaagcatgatcgaggtggccgctcctcctaaatcccgatttcctcttcaaaacaccattgttacacagggtctatcatttgagggctttgtttgtaaccatg

SEQ ID NO: 6132 - DNA, 700 bp, Nannochloropsis_gaditana
ttggccgcccgggctgaaaccagtatcgcccagcataagctcatgttgaaggactgatggcagccgcaaagggtctttcttcctcatgctgtacgtacgattcgaacacgcacgaaaccaaaaagaatcacagcgcttagaatatcggaagtgagagtcggggctgcgcagcgagttcaaaaatggtcgggaaggtgcttgtcacaatccctaacaacagatgagagattaccaagagattaggtatcaaacgagcgaaagcatgcaccgcatattccgtgatgcacaatgtcacaaaatgccattgagtccttcgacctcaagggggggctgaggaacaatctgtggatacgaaagcagggcggcgcctatgtcttatggcacacgacagcactcgcacacgccatggcacgcgctcccccctgcatccctttttttgtcttttatgttttctctgcttgcgcgcaacggcacataagctgtacgcgatcctgatatgtctttcactctcttgtccatctctcaggggcgcttttaaaacctcccttcggccccttcgccttttccacgcacaggcccttcctcttgcgaccatatcgcgccaggtttcatgaatcccttgcatggttttcggagagtcgtagcccttggctcaacaaagcatccagctttgagatgcttgcgctgcttggctagcatg

SEQ ID NO: 6133 - DNA, 700 bp, Nannochloropsis_gaditana
acgggacaacgtgtcgacaaggatcttcagcccatcaccatcatcgcaaccaatcacagcaagcaagtccatatattttcccacacaacgcacgggcacctgggaaagcgcgtgcggggactccgaggcagcaacttcacattcactcgcgtatctctagggttttgaactcccggggcgtgccccctgcccgcttttattttagcctagctcagtcatgcaacagcacttgtataatccgacttacgacttgagcacgaatcgtcgtgcattgcatggttgagaacaatgacaaggagttggcaagcggtcatattttatcccactccgctgcccccctcttcctgtcctcgccctcgccgagaacgaattgctgcaagcctgcactctgacaaaacaaattacgatgttatttagttattccctgtccaacccccccaaaaaggacggagctaatctaatgctttgtttcaaattcctctgacacgacatgctgcaccgttgggtgcctgcgcggatgagaaatgttggattgtaggagtatcataccaggcgaggagacgacctgccccgcatgatcgatgtgtggacggcaaatggttgagcatccctatcagaccgtactcactctcttttcctttcacaaactttcctcgctcatgatgttgcgatgacttacattgcagggcaggaaataatg

SEQ ID NO: 6134 - DNA, 700 bp, Nannochloropsis_gaditana; identical to SEQ ID NO: 5786

SEQ ID NO: 6135 - DNA, 700 bp, Nannochloropsis_gaditana
ggaaggagagatgtcttccatgttaaagcgacgggcaccgcgtcaggctggcaacagaacagcgttaccgctccgtttggacgggtggcaggaccgtgaaactctccactctcactcccaggggagtgacctttgatttttgccgcaagaaataaaaattccccaaaaaaaaaaataaacggattgggagagacaacatgcactgcgggagaatagggaaaggaaaaggactacatacactctcctgtaagcccgatattttgcccccgcaaagagaaataccaccatgctaaaactaagagctgaagtaaaaatccgtgtcaatttgttgccggagaaccaggagatgggccgccttgcgaattcttgcgagctctccaaatatgctcttaggagccggggggtaaaagccccacgtggacaatcgtcaaatagaataaaacaagacgcaatactagtctttggtttttaaaaaaacataagccagcaggctgcaagagatggccgcaattcatgcagcttgaatatttttcttgttgaattcatttttatgtgctgaattcgatcttcgatccgggtcgtccgtgacgaggagcagcatatttcaaaaagcacgagaaaacgacggtccctcatacgacaatcgtgttgaatattttcgtcgcttccaaccacacgcacactttcaaaacaggtcatg

SEQ ID NO: 6136 - DNA, 700 bp, Nannochloropsis_gaditana
cggaggatttacttgcttgagggaggaggttgcctcgtaaaacaaggatacatgagtgcgtagcaacaaaaaaagtgtgataccacttattgattggaggagctggtaacgtttttttccctctaaaacatataactggtgtagagcggcacgagaagcgccggagagaccacatctctgtccttaaacaatcctagaattaaacgaaagcaataatttgaagtcccaaagaaccccacacaaagcatagaatgtgaaaagcaacttgtatgatgtttccagatgataccgcccgcaagctgctttcgcttgccggcttttacaatggtcagaacggtgtcagagccatgggggagggggatatgggccgagaccaagcggggggggggaacgggcggctcgcggatggcgaggagcgctcgaacggcctctgcctaatgcccttcctttcatgccgctggcggcgttctaatcattcgtttcgagcagaatgagggcatattacgtgatggcagcaatgtagtcagtagagacgcgggagagcgatgcgcgacgacgggaagggagggtgggattggcatccattcgttcctcccttcttcttcgagccttcgccacagatagtctcatctttgagctctccaccatccacgcacacagacaccaacttcacatttattgtataatcatttgagaaatg

SEQ ID NO: 6137 - DNA, 700 bp, Nannochloropsis_gaditana; identical to SEQ ID NO: 5776

SEQ ID NO: 6138 - DNA, 700 bp, Nannochloropsis_gaditana; identical to SEQ ID NO: 6133

SEQ ID NO: 6139 - DNA, 700 bp, Nannochloropsis_gaditana; identical to SEQ ID NO: 5777

SEQ ID NO: 6140 - DNA, 700 bp, Nannochloropsis_gaditana
aattcaagtcgttgaacagagacgccttcagaggatgaaaaccccgtcgtgggcaggttctctaaagtgcgtgagctgcaaggaagactgatatttcaggtggatgcctgtgaaacgtgagaggacaaggaaggtccaaaagcatgagaaacatgtcgggcacgtgccacttgcagaacatcattaaatgacagagagaaaaacgtgccatatcgagttttctgcctcatttctctgacgaagagggtattgcctttcaggaaaatggcattagggaaacgacgggcttgaaaactccctgcgttttcataaccgaggccacggggaagagagtggcggaaacctaggaatttgccagggttacctcccggggaaatgtcatgatgtgatggaatatagaccccacagggcgatgatgtgatggaatacgacccgacagggcgatgatgtgatggaatacgaccccacagggcgatgatgtgatggaatacgaccccttagttggcgtaggtgcgtccatgtcctggaaaggcaccgatacagtgttcacgagaatatgtgccaagccagagtctcagacgcctggcgacttggagcgaagttcttcgcatttattcacacttttaatgataagaagaccgattgcaccgacaccgacagggattacatcgtctgagccccagctgttgagaggacgatg

SEQ ID NO: 6141 - DNA, 700 bp, Nannochloropsis_gaditana; identical to SEQ ID NO: 5781

SEQ ID NO: 6142 - DNA, 700 bp, Nannochloropsis_gaditana
cctttgatcccctcccgctccaagaaaaacaaaacaataaactcacctttcaccccccccctcccgcgatccccacagcatcagccatcatgagatatttttcaagcgtgttgttattactctcgggttcaagcctcagcttctcctttctaccgccgcttccctcatcccgcttggactccgcccatcctgcttcaagacatcgcccctgtagccccggcctctctgctccactttcagccaaaacctcacgcaccgaccagaatggcatgtcgtatgtgaggagaccgcacatatataggccagggaagtctcccgaattgaggtgagggctttgtacggtcgcaaggacactcgaaagaagagggaggaagggtttcaagtctggccgtgaacgtgtcctctccatggctcacgctttcgcaacctctaggtccctttcaaacaataatgaacgccttggccttatgtcttttttcgtttgtatcttcgtgatctggtcacatgggcctttgccgctctccctctcttgcccccttcaacgccttcgtcattcgtcacacggtagtttcctcatgtttcaaccgatacattgatcactccgttacgtcgatttttctttgaacacggctcccctagcaccagctccagcaacaaggctgccctcgcagccgagactcgggagggcccggacggtatg

SEQ ID NO: 6143 - DNA, 700 bp, Nannochloropsis_gaditana
taaataggttccgattggcttgtcgagacgcgcaagtcgcatgtagggttgaacggcctttggcatgctttcaacaaatcgagaagaacgaggtgttaaaggtggcggtggcgagggtcgtgatgaggatacggaggctaaatagtggcgtgtaagctttggaataggaccgaacatcgacataaaggacccatggcggaggcatggatggcatgccaattctttctggaggtctgtgctgtgaaatctttgtctgccgcgtcgcattgtacaagaggggttttccagccaacaaggatgacgggcatgcacatacacacaaggtagatgacatcttaaatgatgggatgacaggtgtacaagtcgctggcggcttgtactgtgttttctgcttgttgtcccgcggatcagcctcccgccccaagccatccacatatccaaaaagattaatcaatgggcagagaaggcactgacttcttaaagcttacacctgtgaatgtaataattaagagctagacgtcttagcgcatgaacattggacggacggctcggcgacaggagtgagcgaggctcagagaccgggcgtacgtgcttgactcgctgtgtgtcgcggggtcggaccaggaggttctctctcgaaggacctgctcaagtgacgcgatttcaatcctgcaacgatacaggacacgaaaacgcaatg

SEQ ID NO: 6144 - DNA, 700 bp, Nannochloropsis_gaditana; identical to SEQ ID NO: 5784

SEQ ID NO: 6145 - DNA, 700 bp, Nannochloropsis_gaditana
tgaacttgactttgctcttcaatttcccgcgcattggttttgggggttttcttcaggaacgtatggaagcatcacgctaccgtggcgctgggcggacaccggccgctggaggtggcgaaggtcttggatgccaacagtgttaatctttatatgcgcatgtcccgtgcgctccagtcattcatcagaaccagcccaaatctaacgccctccgccatggagtacattcacgaaatgagctttttcatggctgcgctccagtttcgcgccagattgaaagcgcttcatcggccagctcatgttgacgtatcatagcatattttgctgaaaacctcatttggctgcagtctttgattcttttgtctacaagactattgctctttcccctgaccgctctagagaaggactcgggaccgtacaagtcactgcgacgggggtcaagggttgtggtctccccttggcgatgcccgtatggcaatgctttggcatgccgaaaacccaccccagtgcaacatcaagcctttgcgcacataagtaggtcacagtcattatttttccgaaagtaactctccctccacggatgcgaataaacaggtagcggaccaagtggggcaacaaagcgaaaagacaagatactctcgcttaccctcatcttccttgcaaggataaatttcagagcaaccaaatacgggattcaactatg

SEQ ID NO: 6146 - DNA, 62 bp, Nannochloropsis_gaditana
cccctccgcccccctagacccacatcacggacgtgacgaacgcgtcccggacactgctcatg

SEQ ID NO: 6147 - DNA, 700 bp, Nannochloropsis_gaditana
tgggtgacaacgataatttagtgcttcacaaattcaaatcaaatactcttagagcatttttccaagagcacttgagcacaaattcgatgctctcgaccgcactaaactttgtacaggaaagcccctgacgtagaacgacaataataatacactggaaaaaggaaaggtccgggcgtgggggtggggaggttaagcattcgccgctttttcgctccctttgttcttcttcgctcgctttcccgcctttcctttcccccccccgcccaaaaggcagcatgctctgcactccgcggggtgcatgacaatcgagaagtgggtgatttgctgtcttctccgtttgctgtcgggtacaatcagacgaagcataatgtgtgtgcttgtctctaatcgcaaattgcttcatttgtgagctcctagagggacgtagtacgcctaggctgcttgctgtcagtctcgttctccgcgccaaagtttgagtagaaggatctgcaaaaggtgccctttgtaccatcgctacctgtatatgggatattcaggccattgtgaacggctatcaggtgtagagcacttcctaagtcagcactgccatcccatcgagtacatttaacccgtgcactcgcttttccttgctcgcacggtactcatctgttcttcattctgtgtttcagactgacaactacataaagtctaggaaaacatg

SEQ ID NO: 6148 - DNA, 700 bp, Nannochloropsis_gaditana
aggagtagcagtggctttcgacggctggtaaggagaaatgacatgcttgcactgcggtgcctgaagggccgtcaacaggagcttcagaaaagccgggaaacacgatggctgcaaccccctgtgtcgaaaagtatatcgggtcgataaaagtgagcgttgtcattacgttgtgctggctctaacaggcatcctcacgagacttatgtacaattgtgcagtccaggaggccgggaggtcaagggctttcctccgagagtctgtcgtcggttgctgtggtggccaagcctgcaggcatccaaagacttgctccaggccatgatcgcgaacggcaaatatgcgctggccagtaaagcataaaaccaaggaattcctcaagaccgttgtcgggtaggcgtttttgatttcgtccgatcgagcgggctcatggagttagttgccttcgggcgtggctgccgatcgccctcaggctcgctggacgactcgctttcagacgctacgctgtaccccttgacaccccccgaaaacgtgtaagagcccacatgttgcagtacgctgcgactcgcggtgttggtacacatgcatcgtggaggcttattgtttgggggacaccactttggtcataataacggacattttgaggctgattttcctttttttttttgtacacgcacgtggtgcagcgaaacataaaccgagaatg

SEQ ID NO: 6149 - DNA, 700 bp, Nannochloropsis_gaditana
ccccagtcagctattaaaagccgttttctcccaccgttcttattgtctccatacttgagaatacctgctaacgccgcttcgtttttgttctgctttccaagagccagacgatcgcatgtggagggtatgcctagcagggcagcgacgcgtgactcgaaaggatgaaaagagtagtaatgcggaaaattaccattaaagtgccctccttgcacagcaatagaatatttcggtatcgatgacgagagtcgctcgctcccagtgtccgccttgctgtcaccgtgagccagcgacggagatttgaccatctacgtgccagtgctggagggggggaggttggtgcttggaatggcgttgaccgagtcgatgcaagttacccgccccgaccccgcatctgctccctgtttgtagaatgccaaacgtcgtacgggacttaaagaacaaattgttgagcgtattgctcccgcgtgcggtatattttttttaattccttctactcgcggccctcggtcgccccgccctactactgcctcgctcactagccgcacataattctgccattgcccccccgtacatgtacagagacgaaagaaggggtagatatacctagggaggggaattgcagccaatcgcagagccgacggatccttccttactaacctcaactctgccctcggaagccgtcggatcaagcgagcgtatg

SEQ ID NO: 6150 - DNA, 700 bp, Nannochloropsis_gaditana
ttatttatccaaaatcacgtgatcaatgtgaaaagggctaccccaggatctcactacagaatagttggggggggaagggatcgggtgggaggttgcctctgagaggtcaaagtgcttagcctagcccacagtattcaacacgacattcgaaaaaagatgaagcaatgacacacatgcattcctctcgcttcatgatgcaggatgtggagcttttctttcattattgacacgcgaggccgcagacggcgccgtcggcttgacaccttgaagcagatgcatgctctcgcccgtgcgagaggatcctcgcgccgctaaagcacgtgaatgctccggcagtccgacgtgcaggcgtaatggcgccatgtataacttaaaaccacgagcgactacttttgtgtgagtcagaccggcgatggaaaaagacgtctcaagtttgctatgccccccttgcttttctgatgtactgccctgtagcgtgcacccgatcccgctgctttcttggcgagtatatgacaaggaaaaatgaacgagtgctcagatttcagagactcgtatcctgtaggcgatcacaagcgaagtgtgcgcttgctttcagctttcctcctcgctgccgccatcaattttccgagtgatgctccatccatccgtattcctttttttcataacttgggcacattgacgtatttgatactcggcaaac

SEQ ID NO: 6151 - DNA, 700 bp, Nannochloropsis_gaditana
taaccctcctcgcacaaaacctgatggcctatgccccgcccggctgggaagaagtcgaggccgtgctgacgagcaaagttctcgatcgctgcgtaccgagctagatttttgggggaactatcttgcacattgtggtcaagggccagcaccggctgccgctgatctgcgatgcttggaaatggattgtcagggctaatagcgctgccctcagagtgagagagggagacaaattttgtcatgaccgccagggtattgtcatgcgtcatcacatgcttcggctttatggagattatattccctgcactaatgtcttttttgtccgcgtccaccgcgtggcgccgagcaattttttcaaccaagtttaacggagatgctgcagcagcaaaagaacaccgaggctggttgcaggcggccaaattctgctgaagtaattgcaatgaacgaccctgccgccccagcaaccggggatgcgcggccatgtgcagaaaattctgccctctacgtcgtgtgtatacgcgttgctcggatcagtacctgtggcttgcgattaggacaggggcaatggactggttagtgaagtcgaactgcgaaagtcggcgacagagcgacctggtccgtcctatctcctcaacgcgagcaatgatggaacttcctgtcgtgcagcaacgtctgaatgcttcatttcatacacgcctacaca

SEQ ID NO: 6152 - DNA, 700 bp, Nannochloropsis_gaditana
ttgtcacccggattccacacctaagacatgtttagaaggttttcttcattctgcgatttataccatactgcataatgcgaatttatcctggtccccatggcacaagtgagtttttcctccttcgaatccgaaatttggagcatttcttcctgactgagtacagcttgtggtgctttcagcaaaaatctgattcctgatcactcctgctacttcttggtagagctgataagtcagtatcacgcttatttttggagttcctgaagcactggaataagactaacatgggccgggggcgatgacgggaggagaccagctcaccgccgacgcggtcgaaacccgagggcgaggctacggacaggcggactcgcatgcttgcttcgagcttgggcggagcagccttttttcgagtctttgccacgtttgataaatataggaagcgcattttaaaaaatcacgttggtcgcgaggcagatcttgggaattttgtccccgggacagcacaccctcccgactcgctttgttctcggtagcaatttatccggatctagtgtatgtccttaattacaacacctcacgacctacacaggtcctgcgtgccatcattcctctccctgtaatttttgtcagtcctgttttgctacaaagttatttcagggcagctccttcagacataggcgggatacgataacatcacaacatg

SEQ ID NO: 6153 - DNA, 700 bp, Nannochloropsis_gaditana
cgacgatcatggaagccaaatgggatcataatatcagttattactggtgttggtaccctgcttgtatgtatcttactctacagcagtaggctgatatttttataggtttttattgtgtggatcaccgttacgggtcacgtgtgcggagagacacgaaccatggaattgaattgggctgtgtgcacatgtgaagcttttgggaagcattgtgcaccgatattaaaataattggtgtatactgaaattaaaaagatggtcgaaaaagtgcagtgggcatattgaatgtatgcccgatgtgggacgaagaagggcgtagtagctttgaatgcagattaccagcacttcggcgctgaatgggtggtgccttgcggaagcagaagcgaaaattgaattgaattgatccaagtaaatcataattgattacttttgggacatctgtgtacaaggtatgcaagatttctttcggcaagtattgcaaatttataatgttttccgctgcacgttgtgaaaggtggtgggggtggggaggttcgagaggttgaagttgaagggacagtcatagcgcctgcttgcctaggacgaatattcgtataactagacccaccggcggcgactttcgcgtgctttctgatttagttccttaaaatgctcttttatatatcattgtctcagagacgtcaccttaattcgccccaagatg

SEQ ID NO: 6154 - DNA, 700 bp, Nannochloropsis_gaditana
accgccatccgtcgcttttttcctcgagacttttcctggcacttcccccagatagaatccacgcatcgaggcaactctgcaagtgcttgtgtcgtgatacctttataaaaagctgattatttgcagcatgctatcagtgcttgagcagagataacgatcggaacgagagataatgtgcgcacccgccgctttgccgctttgtgtcttcacttgtacttcatctcaggcagtaatagatcatcccgacgtcgtcgtcgtactttgtctccccggacgatctcattgcattgtctggaatccggtccattacggcacaaaaaaaggtagacacgcgcaagtgcattctttgagaaagtaaccacctgcatctccactgtatggacgttttaaaggtgtagtcataagtctacacaactttgctacctatcaaggttttcctaggtatacaattccaaaccaggcgtcttgcaattatttatgccctcacatgcgattgccttgtagtagatttagaaggagttggtgcagagtctaataattaccccataggcagcctcggggacggcgctctgttttgtcatgcttattctcctcgacgcttatcgtgagttcttttttttgggacacattactcttacagtggaacagcttttcgaaggccgaccatcttaacccttccattatttgctgcatcaacatg

SEQ ID NO: 6155 - DNA, 700 bp, Nannochloropsis_gaditana
cagcaaagaccaggctaccaaaggacaaatcagtgatcaccgctcacacttatgtacacattactgatgtgagtcgggacagatgacgacgaaaatgtggcagttcagtgaaagatttggtgtttcttttcccgagtgcttaaggttggcaggatcccaggccaggagatccgcctcagtgcaaggaagggagaggcaatgacactcaaaatatgtctttcgtgttgagccaaggacagtgaggcaggcgcgttgtgaaagtggtaagaccttctcctctcatgtgagcacaagaatgggaatgagacgtcccatcagtcgcggcacagggggatacacagaccctatcccagcccccgaggaaggggctacgaatacatgtcacgccctgtgcggtccagaggacagatgctttatgtgtgccgccaccggtagcatctaatacctgatcacaagcatatactgcactgcttacagtttttcccctcaatgccaggacgcacgctgctgttgacctgaacaggaaaagaacgtcaactcgagtcgtgtgaagggcggcgcgccgtggctggtgcagcaagttgtgccgaagagtttttttgaaaatccaagaagtaatgcaaacatagcaaagcactgcttgtcaaggctaagctacaagtactcacacagaactcatttttcgattttcgaaataatg

SEQ ID NO: 6156 - DNA, 700 bp, Nannochloropsis_gaditana
agaacaatattgccgcaagccctgcaaaagcattcgccgtcccctttttctgaagtactgagaaagtgtaggaatattcaagttctgttgagggagggctgacaacattcttacgtaaggcttcgatcagtcaaagaggcagctatatatcatacgcatctttcaaccataacatgttgttgacagcaattcggatctcagtgtatttcaagcaagttgagttgagttcggtgaagcatgatagtgtgaaggtccgagggaagcagccatatagttgacgtgtcaagccgaacatactcacgcgttgtctcatgcatgtgcaaacaacttgggtacaaaagaactattgtgcataggtgatgagcttcgacggacggagtgcagtgcaatggtaacctaaaaaagcatgcaaggtgcctcaagtcctgctcgccgcctcgcccacgacccgccggagaggcgctgaggaagatgatgtgtctctgtcaccaccagcatgcgttcatgcctgcgcatctatctctctgctattgctttggcgtatctcccatccgcaatctagcctcgaggaggctgggcaagctttcccgggcgattacttgcccagacgtcactctctgtctctgctcatgcgttcttctttcacggacatcaagggagcctttcggtttgttatagcgtcactctgaaaggtctcatg

SEQ ID NO: 6157 - DNA, 700 bp, Nannochloropsis_gaditana
ccagcaaattagcatccaggtaaaatcatcgacacagcgcatttgaagcaacaggctgaaatcgtcctgctgaataacattctcgactcgtccaggcaaaagccgctctcttagctcacaggccaccagagctaatgttgtgtaatcgagtgtttgcaaacgcgagggcttttcaggccttactagtttcgtggtctcggcggttgtcatgaccggaaggatcgatcctgagggttgatacatcgggagccgtgtagtgaaggaggcgaaggcatgaaggcaatttggaatggagtggagcagtaccagccaaaaaagcggggtgcgattcatcattagttatatgtggtcccttttctagtccgtcatctgttttttgcgagagtgggagtcagtgttgggggtttacgaggtagacgggttacgacctctcgctgatgaaggaaagcgcagtcgacgcacgccgtggagggggcgggactttgatcttggcttcttcaactcatcctgtctcgtctattttcaccttctctgtttttactaaaggaacgttgctaacaggaaaagtagctttgttctccatccccattgagggctgtcgcttggctggaagcggaagaactcttgcttaaagcacgtaggcgcgcgaggagtcaggaactcaagtgaatattttgctctgtttttcttgtcaaaaatg

SEQ ID NO: 6158 - DNA, 700 bp, Nannochloropsis_gaditana
gtagccctctttcttaataacgacgctcaggtcccaagggacgttcgaggaaagactggcttttttacttgcgccagaggagaggggggaggttgtagtaggcggcggaggagatgatgtggaagccagaggggcgaggactgaggattttgagagcctcacaacaaaagcatgcgcgaaagtcaaggcctggaagagtgccagaagtacgtggaccgaaaagcagaggttcattagagaggaaatctgcgtcaacgccctgaagaaggcgcctgccggtacctaagagcgccgatgcgggggcactactgttcgagaaaagtggatgtgtccaaaataggtcacttggtcagtaatttgggaacatcctgtctctcaatgttgcagcgtccccggtagtccctcgagtacgaacaaagcgagcccttcctcgatcttttccgaacccttccgtctgcagtctaacctcctctccctccgggacgtgtccaccgcattttatcatgaagatttcttccggtgcaacactgatcgtgcactggaccagaaagaatcgtcttaatgtctcttttgtttccatggttcctcgttttcgcgcttactttctcttgtttcacttggtccttgtgttccacaaacagaaacaagggcaagtctataaccgattaattcagtgcagctcaatcgtctctacaagatg

SEQ ID NO: 6159 - DNA, 700 bp, Nannochloropsis_gaditana
cgcatcatgtctcattgttatggaagtggagtatcaatattgatctcgtccgtcactgcgataggttataggcttttttcgtttccaactcaacccgcacgaaaaccaagcaaggtgggaactacttatcttgattaattacggcgatccttggaagaaaatgcacaaatttgcgcaattgaaaaattaaaaaaaaaggcttttcccagttagggttcttcaacctttcacgaggccaggaggttggacatgattattcaaggataagaaagaatgctgcgagggaaatttacagagaaacgaaaagttatacaaagctttgggctccacaatgccgtaggtcatcttcttgaagcaaactgacacgctcgtctaacgtcagctccaaaacaaaaacagagggaagctgcccgcattggcagggatgctcaatcaaagaatgatggaaggccatccacgcccccagggcacaaattgaaagtacagagacaagccttaaaaactggcacacactttgccaggcatgtggtcttactcgcggtgatccttctatagaaaatgtgtacagcctcccatcgaaagctacatattctgttcttcctcccgtgacgacttatcgtgcgcttaggaacctatttggaaaaccattcaagtcgccttcagaaaaaaaatgcgtacttctttcacttcagtcgggatg

SEQ ID NO: 6160 - DNA, 700 bp, Nannochloropsis_gaditana
cagaagatgggctgccggtttcaaaaagcaaggcggagctggcggccaagatgtcatcgtttgacatttcagcaccagaccatatagaagcaagcagtgctttgggacctcccgaacagccaatagacattaagattcaagtgaaaaaagagagcgatgcggtggcagctgggcatcctgcgtcgtgtgaaggctcgaagacgagggaggcgacgttgcccttggggaccttgggcctcctgccggcgagctccgccaagaatcctcccatcgtcacacgccgcgaagaacatcacagcaagtcgagcttatcacaaggctcatattctctttccgcctcccggtcggctccccagcattcgtcgtcgaaggtcgggatccacgtcaactcgcagcgtcccttacgacccgacggcaaggaaacaaagctcactccggagcctgacacaggagagaagagcgggaagagaggcataatcgccgtggaggaaaggcgtgaaagccccttgaaagagccatcttccggtcccggaggcgggaagcgatggagcaaagaggaggacgccatgcttcgggcggccgtggcgagcaaagggccacagtgttggaagcaaatctccgacgagtttctggagggaaaacgctcggacgttcagtgcttgcatcgctggcagaaggtgctacagccaggcctggtcaa

SEQ ID NO: 6161 - DNA, 700 bp, Nannochloropsis_gaditana
acgtttctgaagcctaaagcatcctgtgtacagcacatacgccaccgaacacgcgaaggcgaaatttgaacaccttattttcctatcagaccacagattttaggactacgacatggggcccttcgcatttccgtcgctgcctttggcaaagcgcggaccgaacgggttgcctacgactacgtcgaaggacgctttgctgcttgccaccggggtcgtgggaacagcgttcgtagcttcgcacgtgtatttttttcttcggagccgaagcaagcgagtcaatgcatcgaagagtagcaccttgtgtgcatttttacgtttgctagggctgagcaacaaagcagaggtccactacgataaggccaccgggagactttgttatccttctacagccagagtcccagtcgttgataccttgcatgggacggcagtacctgacccctaccgctggctagaagatcctgacgccaaagatgtgcagaagtgggtgaatgcgcaaaataaagttactgacgcgtacttcaaggcctgcttgcaagaggacaagctcaaatttcagtctcggatgagcgagttatttcactatgataaatttagctgtgtctggcaaaagggcagccgatattttttttacaagaagaccggcttacaaaaccaagccgtcttgtacacccaagacactttaagctcgccacctcgcatg

SEQ ID NO: 6162 - DNA, 700 bp, Nannochloropsis_gaditana
aaacggcatctttatcctcaccaggaaagcacacatgcacgacgccggtcacttccgcactcggacaccaccacagcgcatacaacgttcccacacattactcgtcgtggagggcctcgacaaccttggtccccgaaagcagtgtctcgttggcatttggacaaagatctcctgcccgtcacccccccttctgcctcccctgctcgcccgcctgcttgcggctatcatctagcctgtcacctcaaaactcttgtcactcgcttcgcccatgcccgtcgacacacgcgaggctttgcaaactccgactagatcgaccctctttacaatctcgttgtcgtgccatccttttacctactatactgcacccttttgcaatgggcgcggatgggatgcaaggcccccgacgacagcagggccgacgggttccgcgcaaattaatggtgcggcacattaccaagtgcatggagtctatccgtttactggccacaaggacgatttcctctcgccagacatatttgtttgactggagtatagatgcacgttcaatcgtatctctaactgtttcctcccttgtctgcactctcgtcaattgacctttgctacagctgttgcgcgtgcactggacctaggccttcatcgcataccgacgacattgccgccaggcccgacaagataggccgactttcccccacgaaaaatg

SEQ ID NO: 6163 - DNA, 700 bp, Nannochloropsis_gaditana
ttggcagtcacgtgaacaaaacatcactgtcagctctttggaatgcttaacagcttcagttcaacaagcggaaatgctgatagagaacgaagaatcagtattagactcgcagagaccagacaattgtctatccaacaacgcagtaaatgtcatcgatactttggccttatccatagcaaaggctgctcaggctttccaagctgcccactccggcagtcctacagtatttcgggtactagaggtagtagaggactcctcattagcgaccttcgcggaggccctcggccggcttacactcgacccgcatcagataattgaggtgttcatcggatcccacgatatacaagcgctgaacatggtggcaggaacaatgagtggggcagaaaggggactacgtgttcggaaaatacttatgccaacattggatcgcgaactagccgattatgcatttgacgtcgttgcattgcatgcctggcatacctcagggaagatggcttggcaacagagcgatagcaacaccacaagcggtgaaactcaacgtgctcttaatgtagtgacaacgttggagtccttcatgacgcctggctcccaattttgggtgctgggattggatggcggtgaaaagaaggcatgggtggatgtattgcaacccctctctcccgacttgagatgtacgacaacacttgtggcggctcgaatg

SEQ ID NO: 6164 - DNA, 700 bp, Nannochloropsis_gaditana
gagccatttgggcctctcgaaagcactccaccggttttaatgggtgtcaattccttcggcatcggtggctcttacgcccacgttattgtcgaagagtatcgccccccaaaaagctctgccgatcggatcctggcccgtcatgcattcgaaggacaacttctcttgcctctgtcagccgtcagcaatgcacacctcaaactatatgcccatgaactgctcacatatttccaaaacaccccggaagttgatatccgcgatgtgtgcgggactatggcggttaatcgcaccgcctttcagtaccggaaagcattggtggtggggggacaagacctgcctggcttactcctccaattgaagggaatcgttagcggccctgacagccaagctcccgaggaagaaaagggcaagcgaattttattcgcatttacgggccaaggggcacagtggatgggttgcggggagactttgatggccgtgccagtctatcgcgaagcagtgttggaagtagatgccctctttcaagccttgtcggggtattctatcttggagaaggctcaaacgctctcagctgagactcttcgggagactcaacatgctcagcctgtaacattcctgatccaagttggcattgtcaagcttttggaaagttcggggatatggccgtccatcgtgactgggcactcagcaggagaggtagcct

SEQ ID NO: 6165 - DNA, 700 bp, Nannochloropsis_gaditana
agtctccttgtgtctggggcatgaaagagctgatggcccgcgcctatgaaggggcaggtttgtctcctgcattggtcagctatatggaatgtcatgctaccggtacctacgtcggggatgtgttggaattggaggcgatcggggagattttaggcatgccgcgcctgcgaaaagaagacgaagaaggccacaacctgcttcgcgtggcttcggtcaagagcaatattggccatgccgaggtttcggctgggctgttttcccttgcaaaagtcattgaaatgatgcgtcgccgaatgtacttgccaacagcgggcgtcactacaccgcgcacagatttcgattgggaaggacataacatgcgcgtgattcagaccacggagccatttgggcctctcgaaagcactccaccggttttaatgggtgtcaattccttcggcatcggtggctcttacgcccacgttattgtcgaagagtatcgccccccaaaaagctctgccgatcggatcctggcccgtcatgcattcgaaggacaacttctcttgcctctgtcagccgtcagcaatgcacacctcaaactatatgcccatgaactgctcacatatttccaaaacaccccggaagttgatatccgcgatgtgtgcgggactatggcggttaatcgcaccgcctttcagtaccggaaagcattggtggtgggggg

SEQ ID NO: 6166 - DNA, 700 bp, Nannochloropsis_gaditana
tgccaacttattcacggatgaagaggtggaaagctacgattgccacttttttcgggtgacggacaagttggcgcggtcgatggacattcgacaattgggtattctgcagagcgtttggcatgccttggaggacgctggtctgccagccgagcgactttatcgcactcggacaggagtatttgcggccgggtatgtccaagtcgagcacgcgcaagaagctcccgatgagacgacgcttcgcggaagtctcatgtcctctctatcggaccatgtggcctttttcctaggcacgcatggaccttcagtcactcttgagactgcatgctcctcgtctttggtcgctctctccttggcggttgcagctttacgaaagggtgattgcgactatgctatcgttgcgtgtgtgaacatccctcaagacaaagactttcatctctctttgcaagcgtgcggggtcctgagcaccacaggcacaagccatccttttgaggacgcggggccaaaaggatatgtgcgagcagagggttatggctgcatcgtgctgcggcgcttccgggatacaatatacgatggagaccgcgtcctttgcacgatccgcaacgccgtggcaggcagtgccggggctgtcgaaggtctcgcgaccggcgcaggacgcatgtatgagtctccttgtgtctggggcatgaaagagctgatggcc

SEQ ID NO: 6167 - DNA, 700 bp, Nannochloropsis_gaditana
gcatggagttgacttcatcatgctcggactcaacctgagcggcgaggcatatgggccttcaacggcttcttcaaacgcaaagaggtatcaaccgttgggctgagaacgagagcgtggcccctatgaaaatgaaagtcaatctatgtgacagcatcttaccatggacaatcgtcaacattcaatgtttgaagtaaggtctgaaagatcaaatgaaatttaaactattattcttgtccctcttacattttcaccctctccgtatgacggatcgatagaacaactatgccgcaatgtgcttgaactcgagcaaaaaaaagtttcagatttatgacgacaaaggacacagaggaagtcttaaatcttaatctgatgtgacatctattgttactacttccacctcaaaccagatcagcatttcttcctgaggcctgtactgtagagaggttgctgtaagtgcttcctcccatggacctgaacacagaatcctctgccaataaaaaaagtattccattctcagtggatccaagttgttctttacaagatcgcatagctgtcaatgggtatgccattcaattaccgggggatattagcacaggcgaccaactatttgatttagttcaagcgaagcggcagctgcgtcaagatgtagtagccggtaagcgttatccggcctccatggtagacgaaggtgagggcagcg

SEQ ID NO: 6168 - DNA, 700 bp, Nannochloropsis_gaditana
cgcaggaggagagcgaataacgtctcaacaatttcaaagtctttccggacatatcatttttacgaaacttaacaaataaagaaacggtagaacacatatcacaatatttgctatcagctagaggttctcttttggcaccagcaggcaatccgtgaaaacatagatcaaaggagattttcacctccccattccatatttcaatttcgggaaacgagaatactgccggtcgatgtaaataaccttcaagtgtgagttattgacacctaaaaaatacaaatctagctatgttttggctggctctggcttcactgaatcaaccggtgtcggaagtgcaagtcgtaagtggggttggtcggggggtacaggaggggggtagaccttatccagagacgccaacatgtcaccgacaagcttctttgcacgacgcctcagtgcggaagatgctttgcatatcgaggtatattcgtgtggattcgacccgactgctaatctgaacacctgttgcagaatgagtgactgcggtgtaattttcgttggctctttcctcttgtcatatcatctagaaggtcgaccccgccctgcccgcccgacaaacccaatcaagcccatgtatccgcggtactcatcacttgacagccgtatctttcattcatcctccaagcagacgggcggctccatacaaatcggtccttgatacatg

SEQ ID NO: 6169 - DNA, 700 bp, Nannochloropsis_gaditana
gttcccttgccaaacgaagcgatgattttctttatctcaagagctgttaaaaattgaaaaagtaacgaagatgaaatcttgatgtcttgatcccatctctggcctttcaaacctgcaggaagtatttggttggagaagcacgggtggaaacagcgctgcgcagtaaccgtataggatgtacaattagtctcatgtttaggacaacgctagatttgtcagtcaaattttcattcattgaaatctggttgccttcatcccaacaggctaatgaaggcgcctgagtcgtgtgcttcagatttttgatgatgatattgcgtcaccataggaggttattttcaagatatgtgagacgatgtatgtccgtgtatatatatatagccatgtacatataggtacgatctcgtatcatgatgtcgggccaaacaaagaacgcaattaggcgtaggcggtcggagcgagagagcacgaggcgtcgaggatacccggagaaagcgccaaaatctccgaattcacccgaaccgagatcaagcgaaaaggatgatacagagggacggccggtgttgaatgtttgccgggggctccgatttctatgcttgtcgtcactcggctctctaaccttatgtatgacattaaaaatcaatccaacgaatcacagacagacagtggagccagcagctgcgctggtggggccgaaagtatg

SEQ ID NO: 6170 - DNA, 700 bp, Nannochloropsis_gaditana
tcgacatcgaggcaggaggtggctggctggtgggaatcggtatgagtgttcttacattctgcgcatctaacgcgtcaacctcatcggcgcgcatttcttcatatttacaggcatggtcaactgcaatgcgagaaatcgtgatgtgattttcctttcaaaacatgtcgcggccacggcttcacccaaaacttctacctccacctcctcctcctccccgtcttcttctacttcttctttcccctcctcctcctcctccaatctctctccacctctaagcgccgtgcaagcatctcctacctttgtgagccttccaagaatggtacctcccaatgccacgatcactctagggcacaaaggggtgcccgtgcatgagttgccggaagaggctcgggtccgtgtgccactctgcagtgcgcgcgggaaggtatgcgtcgcaggcataaagcgaaagctttcttatggcggtgcgaagctatggcaagaagagaatgcagaaaagacgaatgtggggatactgcgcccaagtcacgacgcctggggcattaaaaaaattgtgttcatttactgcgatgacttcttgcggcgatgcttcgagatgccatggttccatgatccggaatggcaagccctgcttctgccagtatttcaagcccttaatgtagctccacgcatggtcgtacgctgcctcctcgcttccatg

SEQ ID NO: 6171 - DNA, 700 bp, Nannochloropsis_gaditana
aaaatgtggaccaatgtgatttgcgaaccacgttgatggaacatttatggcgtgaaactgacctggagcgatttttcctcgctagcactcttgagagcttcccagaggtgggatggtaggtcgctgtaataaggttctttcgtgctcatggtcacctcttgattactgcttgaaaccttatcctttcttctttctgcttctcccacggtagagatcccgaaggcctggtccagacccaataaaatgcgctcccgtctacggctgcttcccagtgcgggcagagaggatgacatgttcttctttttgctccctattatttttaagggatgggggatgtgttgacctgtgtcttccctgaggacgatgatatgaatcggcggctgggagctacgggctcattggtgaaccggaggggggaggttaagctaacttgtctatgtcgtggccaagcccgcccggacaaattgtgtgctagaatttatcgccctgcaagcctggctggaaatgatcaaagttaaataatacatgtcaatggcttgttgagttaaaagcttgtcacaatggcgcgaccgggaacgtttagacttctcgaggggggacatctttcgtgacgtccattaagcgactttctagagtacatcaatcgaactcaactgaaggccaacttctcgcaaataaaatagtctaaatagttgctatg

SEQ ID NO: 6172 - DNA, 700 bp, Nannochloropsis_gaditana
gggttaaatcttgtgatgtggtgatggtccaggaggcgagagaaaaggatagggatgagatggacggatcgtggtaactcgggtcaccttgccgcagctttcctggtgctgcgaagagagggaaagtccgtttaattatacgcggtggatgtgggccaaaaacatactatcgtacacgatctttgaagagaagggaagatcttttgaaatgcttgccctttgctttttcttctggctagtctcatacccgctcttcgcgaatacacttttcacatgacaactcgtgcggatcccaatgcgacttgtctaagcacacattttgggcgtggaaacctgcaatcgacatgcatacgcacacaggtgctcaggcaggcgtccagtcgcgggctggcctcagtggggctcggggggtatgaaaaaaggcgagaaggagggggcgaggaggggaagcacggcaggggaaaaatctgtagcgctgcttatcacatgcctcgggttgaggtactttctcggggcgtgggcccgtgctccgcaccacgcatctcatgccaatgctttcgatttcaatctacgcaccctttaaccacaggtctgaatttcgaggtgcatcaaatctgtcgagggccatcccgacagtgaaagagctggtcggacttgccccgggaagagatcttcagaacgtgtggggtctctgcccatg

SEQ ID NO: 6173 - DNA, 700 bp, Nannochloropsis_gaditana
tgaacgaagcaacgtgccccacgcgtgtcttatcgaattggcaatggccgagccggggccagagcgcgttcgaattccacgggacactaatgtcgcacccgcaggggaatagctcgatggagaccctcgcggcgcgtggaaggcagcttgagccacaagaggtgaggcccgcgcccggccgaggaaaaaaagtgtggctgtggtagcaacggcagccattgagacacccgctcggggtcgtagcattccttggctcagttattgatattcgaaagcccgtggtgcgttcagtccctgtaggagtgaaaaagaaacgactttgtcaggatatctgatgcgcgtgggcctagtctacgtgacctctctcgcttcttgaaggtctcgacgacaagagcactcggacgcaagtccttgccactgtagcaacaccaccaaggcgtggcttgtccgtgagataggttgtgtgcatgtgtggtacattgtgaaccctttgcaggtgtaggcttcgtgtcctatgccctgtggctccatacagggcaagttatcttgggtctgcgcccgtggccggcacctaccgtagtaaccaacaaggcgccgccacctcacccgttcacttcgaaaacataacttccccacccgcgcttccacagccagtcctttcactttttgacagcaaacttcactttactccatcgatatg

SEQ ID NO: 6174 - DNA, 700 bp, Nannochloropsis_gaditana
cagtccggacaacaatatcgacgaaataggagtttcgttttacaaaatacgtttcaggttggtcatgttatcgcgttttggcattgcagatgggatgtatggacctcaagtctatttttgtcatcatccacctcccatccagggccttttgcccatcctgacgggcccccttttcccacattgattacagctgccaaaatctcaacgccaacattaaggcagctatgattccgcttatatcctccgttcttgaaccttcaccctccatcaattacgatttcgtggcgggatcgtattttatcgcctctcttctgtgtctggccctggcggtatcgtcgcttgtcttcgaggtctcatctgtaaagggatggtggattgcccttgcaccgtttccaccagcgcttgtttggagcttgatagtaagagcaaggtggcatttggcacttgaatcgaagaccaaggtggagtagcttgatagtctgccgagttacggatacaggatcatacaacctttcctggatagcctatgattcgacgtagtggatcgtgcacaagcttcagaggggagggtgatattatgaaagatgacatgtacaggggtactctatctagatctgtgtgccttaaagaaaaaaagcaatagcgcaacttgctgcattgcccgtagaggagaatggcccagggaacgatcacacatatg

SEQ ID NO: 6175 - DNA, 700 bp, Nannochloropsis_gaditana
cgagggggcgcagtggacgcgacgatagaaatagacatcactgcatccgctacacaagtcacagacacctaccgccggcactccagaagcccggccaacctcggagtcggtgcccaagcggtgcccggagtcagggcgtgggagggggacatagaaagacagctgttgcgggcgcctgtcacgagcttgctgcctgcgcatcgggatggcctcccataggcctggcgtgactcggagccgcgagaccgctgacgccctcggcgaggaagacaaaaaattgcgcgaaagctgcagcagggacctgggctctggggtccatgcttggagaaaagaacttccgcgtgcaagacttcgcgtgatacacgtagcgtttgtgatttgcctatttttctatgtacaaagtcattacattatggatgccgcatgatcactgaaacacggtgatgagctctgtttagcgctgttacatgctccaacaactttccaacgaaacgagggcttttttcatctcagtccggacaacaatatcgacgaaataggagtttcgttttacaaaatacgtttcaggttggtcatgttatcgcgttttggcattgcagatgggatgtatggacctcaagtctatttttgtcatcatccacctcccatccagggccttttgcccatcctgacgggcccccttttcccacattgattacag

SEQ ID NO: 6176 - DNA, 700 bp, Nannochloropsis_gaditana
cctccctttttatagttacgcatgcaggaataccgagaaagcagcatgggccctcgcccattgtctcgtaggggaggttataaaactgtgtacgtgatgtgatctaaggatgcattggtcgagtgagttggacctggagcacccacaaaatgttttttcatgtgaacaagatggtccattgcatgcgcgcgcaatggcactgccatggagggccgggaaaagggaaagtggatgcaacgggacacattaatcttgacgatggggctcgggcagctgagtcatccgctcctttctctgcccttccactttcaccacgggcaacccctaacgccaaatccttgagacacacgactcgaggcgatctgatgagcggtatatgagtgcgtggagagcgcggtgtcgcccccgtggcgtgcgcgtgtcggttagtgttctggcagcaggcctgacccccgggggcagcgggcagcagtcgccgttccccttctcagccaagcgttctggcccgtcaccataatgccgcccacccaccacattgcgaaatcatcgtcacacctcactcatcactcgtcacatacattgcacagcttttaaaacaccagcaaatatgctgcgtggagcgcatagttgtgtcctttaaagggtggggaggagtactttctcaatttcacaagaacagcttgggcgtgcgaccagaatg

SEQ ID NO: 6177 - DNA, 700 bp, Nannochloropsis_gaditana
tacttgcttgatggtacagtcgcgctctctttcacctctaggagtcactacactaaacatccaccgcataaaaaggtgtcaaacgcgacataaaatgagtttttgatcaagaaacgcaaaaaatcttttatcatgggattctgatccaagaaatcctgagtaaaatggctatgccggcgagatatgtcacgtgaagaggcttccattgcttgtgttggtgacaaggggatatatgccatgaaacacaaagatttgggtcgattgcctaagaaagtcatgcaagtgtcaagtacgcatctcatttagctggacttcgcatgttcaagcggatcgcgtcgggaggatgcaggtttctgctccatgttttgtacggaggatgagtggaggcagcagcactgcgagaagagggctggttgaagcatcgcacaggagggcagagagggccatgaaatatggttcatcaatccattcatccgtcctatgcttattgctcttcacacatacatttattgacagtccaatctctggtcaggaagtctaaatatcttgtgcatggttgcgggctcccttgaaaagcctttctgctcttcgtgttcctgcccttacccgcagtactcaccgtatcggaggtgggagtcagcggggcctgaaagaaagctgtaaaaacgatcccacggaaaacatcgattcattaaagatg

SEQ ID NO: 6178 - DNA, 4 bp, Nannochloropsis_gaditana
ctcc

SEQ ID NO: 6179 - DNA, 700 bp, Nannochloropsis_gaditana
actctattgccgcttcttgagccttggcctccacagcctctaccagccgatttaggaccgcctcctgatcactcaaaaggtcccaccggaaaaaagcgaccatcctatcgctcaagccttcctgggatacaatactttttgccagcgcaatacattgctgacttatatccacgcctacgccacgacatttgcataacaatgccgccgctatcaaaggtcggccgtcgccgcaccctaagtccaccattatatgccgagggccaagccgtaaaatattgaaaatagaagccagatcctcggcggcagtgggtaaaaagggagagagggtatgtcgctgtacttgtatcgctgcttcatcaatgcatgaatccaaatgcgagtcctctagggcctccgtttctttcacatgacgtgccacaagagcctctatttgcgctgcgagtgaacacgggcgcgtctccaagtcatgcatttttccccttggaaatgataaaattggtcatattggagctcagaatatggcctgtgtgtgacgctgatagagatatgcgacgctttatggcattaaaaaaaatgctcgcgttaataatcaaatttccgcaacatcaacgtacacgggaggttaacctcctcaccaccttctctgtcaagctcatgtatttccgtcatctctgcagaagctggaggagacgtgggcatg

SEQ ID NO: 6180 - DNA, 700 bp, Nannochloropsis_gaditana
gcacgactgaagtgcacggacaagcgggacaggggaagggcagaaggtagagggcgtcgacgaacgcacgtagagatgtggctgctgctgaacgcgctccagcttcttgaccttaaattgaagaaatgaccagccagaccatacttggtacgtgaacccacgattagccggtgtgggatcataatctgtgtgcaaggccggaaagagaggcttcagctatgagcgtttgtatgcacggaaaagaaagccacagaaacccaaaggctgagtttgcacgtgagtattatcgcaccgttggtatactagtagtcatacgccgtgaacattgttattgcggacaaggccgttactaaagatgttttgacagtcccctattcatcaccagacccgatgacgtgttgttccttagaggctcctgcctctacggcatttgggtgggacacagggtgcttttcccttttttcgtttgtcctagcttgcctgggcggcattttctctgtatagaatccttctctcctttcattttacgcgtgctggtgtctttttgcgcgtcatctttcgcgcttgttctccccgttgaccttccaccgacagttggtaacctcttcctcgcgactcctccctctctatcaacgaacctcattttggggggggagcaggccaagggatcagtatcatattcttttcgattataaagatg

SEQ ID NO: 6181 - DNA, 700 bp, Nannochloropsis_gaditana
cgaaggcggaggaagaacaaaggggcgggaaggggcaaccgacaggcactccgtccagacgaccacgagttgaataacccagaaaggccgcccaccttcgtctgttacaattcgtcgttcttcaattcgcgtgttttcaacttctaagcgcgagcgcgccatgtctggtcttacagcaagctatttttgtcctcgtgaaagcgcgttcccccatctggcggaaatatgtttcttcttgggcggcaaagaagcggcttcacatttttcttttcatgaaacaattgtacacctgatgtgtttccttctgcaaacttcgctttgtatagctcaacactatttgactgatgcaatggcttcccttttgcggcgaattaagtgcgcatctttgtgtttccttgtgccatattccgtttgccgaaagtgcttcaacatcactaatttttgaatttttttctgtttgcgagtcattgaccttacaaacatcgcgtaccaatgtcacagacaaatccttgaagctttgcgtctgaagctaatcatgccggcctcttcgtcgcgtcggtcaccttctttgaccacgaagacggtaattttggccgctttgttccctgtcgcggccttaagcttcactttacccttccgacaccgcctacgggagcccaacgatgtccatcacagctttcgtgaaaaaactcatgcaatg

SEQ ID NO: 6182 - DNA, 700 bp, Nannochloropsis_gaditana
ccgcaggcataccatttcagcgcctccagagagggtctttccgccgactttttaagcaaaggaattaatggggacgaggacgcgccaaaatgccttctgttgcgtgttaaaaccgccgaaagtgttaaccgtggcaagttcacgaagtatgtcgacctggcaagcgtctcgagggcgccacgaggacgccctgggaatgacatgctctgttgcctctgccactgcagaatttaagcgtttcgccggctagtgccgcctgcacggtccgtctctaaaactcatgaagcctgtagataaatgaatagtcatcaacaggaaaaatatctacatttggttgtcatatgcccagtaagttaagcagccaattgagtgactactggcagcacagatactgcttgcctttgagcgagcgctgagcgaggacgcggaaaaaagccttgttcctctcttatcggactaccacttatgacttggacagtccacatgcccaccaaaatcatgccaatattccttgtataggaagtccttatagataatctagcgcaagggtctgtgatggcttaatattcggtgggacgagccagctgttggctagtagctgagccagccagccaggaggaggtagttccgggggcggtgaggagctgccggctgactttgacgtgacgccttcagggcgggtcacagctgctgcaaaatg

SEQ ID NO: 6183 - DNA, 700 bp, Nannochloropsis_gaditana
gccatcaagtgcggttgggtttgatagatgggttgtaacgaagggcttgtatttacaaaggcttcagatcttatgtaagattttatgctcagaaagagcaccaaaaatatcaaccaggaggggggtagtggggaggtaaagcggcaacagagaacccgaactcccattccagtcccacacaaacgcgctaaagaattggcctgagtcctgcacagagtcctgaatttggaatgggcgttgaaagggcaagttagcggaagcgatggaagcggggccgcgcaagtcctcgggaagggcaccggggtgggcgccagaaggcgatggggtcagacggtctggcctagtcctctcgccgcctcgttttctgctgactcatgccacgctcctcatcggatgtacgacccgtgacagcttcatcccacacccgtgtttgtcgcttcgaagtaggaataaagtcgtgtcggtgaatgcggaagcgctttgttgctctattttcccccatatctttctgactgctaaggcgctcgatctttgtgatgtcgacgcggcgaaagcgtggcaattagaatctccaacacattttgtacttataagtcacagtgcacaggagttcagcttcgaccctcagaggcacgagcaggccgatctgataccttttgccgccatctggctgtttttgcgccgacggcagtaagccatg

SEQ ID NO: 6184 - DNA, 700 bp, Nannochloropsis_gaditana
ggagtatatgactgtctcggagctactttgatcggcgatgtcgtcaaatacaacagtaacaacagcaacagggtctacagtttgacgatcgtaacatgatagagatgtcgcagctcagccagaaatatcgggatgtcatggactatcaaatggtttcttatcctggctggctctctcaaaatgtgttttatcctggttgtgcgctgtctcgagtaagactcaccgcttcgattctttctcggacaaagccatccaattgcagcattactacctatatttttgcatctttacatctaacaacagtatacaccatactttctacatgacagggataggaacatggctgcaactggtgatggcgtaagtgagcgcgtgtggaactatctcgcaccgtcgggggacaagaaggtgcgtacaagttgttcggattgctttgaatgtattttctcattcagtagcaaagacaaaatgagttaaaaaaaatggaaaccgatggtatgaatgtggtgccctgacgcttgactgagactaggagctgcaattattgccacacacagcgcccagtcagggatttaaggtgttaactcttcctctgttgtttatcttgaaccgacagggacctttcccagagtccactttgatacgaatgctggtgaaaaagttgccgggtctggacacttcatctttttgctggactccg

SEQ ID NO: 6185 - DNA, 700 bp, Nannochloropsis_gaditana
tgcaagcgagtatggccccaagctgttgcctaaagtgtcaccgtcaacattgccagcgcatcaaacatgttatctgaatcaatcaacagaattaaaggacgattcatcaaggacccgcgcaagaattcctgctactatattcgacacaattgtgccaattggtcatggcgtccgatcccgctgactcctccctccagcaggcgcaagtacgggttgaaagccagggcagacatggggtcatgtccgtcacgcacaattgtatcaaggcttcaaaactaaaatcgactctaggcctgatgtcctacgatccaggtacttgtcccacggcagacagtggaacccattttattcccttaactaaaacctccatgcgtagtagcaatattcttcaatttgaagcaaatacgacgtatgacttcgatacatccatgcctccacaactctctcgatacaccttgcgctcgaagtattttgtagtgccctccaatttgtttccgcagggatccttcatgctggaaacgtcaatcggcttcagggcgtccagcgtgatcactcaatgtgcttgaactatttccattaggcagcctctgttgtaaagatgccgcgtcattgttgactgcgtgatatgaaatattttgaaatgtttctccatcttgtcatttattcttccgactccgcccctttatcctcagggtacatg

SEQ ID NO: 6186 - DNA, 700 bp, Nannochloropsis_gaditana
gcgggaatttggagaaaagtaacctcgtgacgacgcagtgatataagcgacattcgcacagtgaaaatgtcaaagatgttgtaaagaaattcagaatcgccttatgcggtttgatgactccctctggcattattttttccgttccctgacctctttttctgtcatcgatggtttgtgagcccccaaaagatgcgacctcctgcctcgtatcagacgatggacggatcgaaacaaagcttccaccgaatccaacctgtctccaccattcttgtccttaaaaattatgctggacgcctatgattggctcaaaggtcatatttgaatagcttctgagtgacggtcgggaaacgagccggacgtgtggtcctttgcaaagaccacgcatcttagacgaggcggccgggcgggcgaggcgtgaaagaagcgaaccctcagaatcgtgtgcctcttttttcccgggccaatgtggccattggacgcgccccgtgcatcttttatcggccagatcttttcgactgggaccacacgcattatgcacacgctgtttgcgctgcaggtgttgacttggcaattgatacctcgctcgcgcctgtgtaggaacggacatgatgcgcgaaaagccccgcctgctggctcacactacgaatatttgtccgcacattcttttaggcttcacaactttcacgctttgaaaacaatg

SEQ ID NO: 6187 - DNA, 700 bp, Nannochloropsis_gaditana
gtcaaggagcccgtaaagctgatgcctagcagcatggacatgaccaggaagccgtaagcaggaaagcgaaatggcctgtcgggctccgtgcggacggctttggaacctgcacttggcaatggtaacctgcttacagttgatttgatggcttcttttaggccgttgctttgatttgctttttccacctcctcgaagagacggtctaattctcgcttctccgttgctggaccgctttcactttcatcggccgacgcgtagatgggcgcaaaattgccactccttacgcaattcttacgaagtatatgtgttgtgcatctaaaaggtaaataccgactgcggccgctaggaagaaaagcgcaaacgttcttcaggtgcaaaaaggcgaggccgaataggagggcaactgtagatggaaggagtatcctacgcgccatggagatcttgtacccaggcaaaatttaccaggcaatctgaaaatgtagagggagaaatcaatcacaagctgttgccacggaggattgccgaccgtgacgcggtcaaggtggagcatggaggcagtggcagctggaggcagcaagcccgcgcgctccaagaaacggtttccggagatccgagcctctcgtctctgccccgcctcggccccttcgttttattgcgcaccatgcagccgcccgactaatcgcgaagcatacacgacaca

SEQ ID NO: 6188 - DNA, 700 bp, Nannochloropsis_gaditana
cgccttaactctgaggcgtcgagagtcaagagaagagagaaccagccggtctggcagggcgggtgttgaagctgggccacgccgaagcacgatatcgtccagctgttcggccatgactacatcttgatattgctgctggtaacgtatttgttgttttttgcttccagaaggcataggtttcgtgagactgctctaaggcactgaagtaaatgagggaggaggttaacctgtattaggggcaatgtgtgtgaattacggacggaccttcgcagggttgcaaaagctacagccgcataatcattactttgtgcttgaaatgtgggtgtcaatccatggtatctatgaaagctcttattacctttgttggcgcgagcgtgctctaggacgacctgtcctgccgctccctgcttgtcctctatttagctgttcaggatgacagatcttcgcatattgaatgcctgtgcttgtccgcctgttatatgtggttgaattgagcttatccaggaattgaagcagcttctacagtctatgccgaactgcgcttccgcctggctgagattcccgacatgccactccgtgcccctcgcgatgagggcgataaccgcggagggtaacacgttcctatcacaccatttatgacttcaatttcttgctacagcgtgaagaagggggacatactctttgatagcacgctcgcatg

SEQ ID NO: 6189 - DNA, 700 bp, Nannochloropsis_gaditana
tgtatgtgcagagcagactgaagaactaaggctgatcccatcccgctgcctggacccttatcgtctggcattgctttgcctctcgccctttttctccctctggtccccgcccggcccctcacgagccacccgcgtatcgccggtagtactccagcatccgcggcgtgatctgccgctgccagccagccaaggcctgctcgaagtgccggccgcggaggaggcgggcgtggacaggatcctcctccactgcgcagagagcggcctcccggctcagggccaccacttccgcgcccgagaagccctcagtgcgccgcgccagctcctccaagtccactcccgccccttccgacgcctccccttccgggctctctgtgggcacgccccgcaaggcgatcttcaggatctcccgacgcgaggccagatccggcggcggcacgtagactcttcggtcgatgcggcccgggcgcaggagggcggggtcgagcaggtcggggcggttggtggccgccaccaccaccacccggcgcaggggctgcaccccgtcgagctccgtgagcagctggctcagcacccgctccgaggccttgcagtcctccccgtccccccggcgaccggccagcgcgtccacctcgtcgaagaagacgaccgtgggggccgcggcccgcgccttcttgaacagcccctgcagggccttctcact

SEQ ID NO: 6190 - DNA, 700 bp, Nannochloropsis_gaditana
cctccgtggccaggaacgggggccaacgcccgttttgcaagagtacctgcagcagctgaaggcgatgcacctggctcaccgccggtctcctcagtcccacaatttgtgaagaatgtgataaaaataaaggtcgatggtcatttctcggacgtcagacaaccaaaacgtgaataatgtgtaaaaaaaaggaaataatactagcatgtcctttcagcagttcctttttttattgaagggtgcgacgtgggcgattcgtggttctttctcatatacgtagatgtacgaggccaggtaaaacctgatccttccttgtacatactgaattcggaaggaataataattcacatatctaattaacctcccgttcgcgtctctttctggccccttctcacctctcgcgtgagtcatggatgttgacggctgccgtgagatgccattcctagcaagatctcgctaccatctttaagcgctcgacgcgaatcagaaggcatttcaacgtaagaacttttgcgcagtaaagcgccccactctcggcggcaagttcccacgtgagtgacagttggcgagtcgctaattttgcctcaggtcttcttgctttgaaatggtgtcttcaaggaggaggccacgaggcctaccacaggacgcgcggcacgacattgacctctcaaagtcgaattcgattcattaaataggggacatg

SEQ ID NO: 6191 - DNA, 700 bp, Nannochloropsis_gaditana
gaaggctgatacaaaggcgggtcacctccttggatcaaaagagagcgaggaaaatgccgtccgtatcctctacaacggcaacaccgtttcgcgacggagtttgcattgcccagaatacagaggtaaatatgagggaggacagggaatggaggaggagatgctgttgcccctcggttgtttgcaggagtacgtggagcgcatgtcacctagaggaggaagccaagttccgtgtacataaacgcagtgcagcattatcaactgaagttaaaagtaccacacagctcgccggccatcatcaacaatggaaaaaaagcggacatgggagcatacgattacgtacgaattttactttctttggtaccttcctgagctccagcagcgtaacttttttgttgcggattttccattgcttacaagtaacaacgttcatgaccagattttgaaaaccccattttcctcataaaagccgacagagcagcaacttttcccttttgtgtctgccaaggtcgttggtcctaaatttataaatctatttggtatcatgacgcacagtacatgtcctccgccccctattcacacacctttctcaccattgtttccactttgtacttgttacactgaatgatgggattgagccgccaccccgaacgccttcccccgcctcatgtatcaggtgataccgtgatccctcccctcccgc

SEQ ID NO: 6192 - DNA, 700 bp, Nannochloropsis_gaditana; identical to SEQ ID NO: 4587

SEQ ID NO: 6193 - DNA, 700 bp, Nannochloropsis_gaditana
agtcgtcccagtactgagtgtccaggtgatccgtttctctcaagccaacgcccctcccttgctctcattaaggcgtctgatctactgggcggcctgtgagtggaaaagccttgatgtgagcgggtgggtgggatcggcgtggatgcatgagctccccgggaggtgaaagtgcccgggcctcacatccgcaacccgaccgaccggcccatgaggcctccctgcgcaatcgtcctctgtaaaagacaatccggctagtgatccttggaattcagaacttcgcaaaaacctcattgaaatacaggggatgctgcatcgccgtgtactggcgtctatacgagcaaaaatatctcaccgacgcctcgaggcggagagtggaggaagtgatggcggccgcgctcatctattgtcgcgtggaatggcagtgatatttaccgcaagcagtctcctctttgtcgcgtgcctcctgctgccggcaaaattgccgcatggtaatttaaccttgaagctcaaaggcggcaaacatgaattctcctactgcgaagcccccatggatggggaggatggaattcttccaccaggcacgcgcactaggaagcttaaacaaattcaggttgtgattcggcacggagatcgttcgccgatcacgagtctgacctcgccttccccagaattcgattgtaaattgaaggacccaaccatg

SEQ ID NO: 6194 - DNA, 700 bp, Nannochloropsis_gaditana; identical to SEQ ID NO: 4588

SEQ ID NO: 6195 - DNA, 700 bp, Nannochloropsis_gaditana
ctttcttcatagggttgtctatccgcaacggaaagaggttggctggcttcctctaatatacgggagtactcgtcagcccaagaggaaagcgtttcttcgaaatgtttgcgtgcatcctccaccccttgtgacgccaaaatggtgtctacctgtgccttgacagcttcaacgtcatagtcaacaacggcagagatttgcatgcgtcgaagggggcgttttccggaacaagtgtgtgatgtatggtgaaaaagcgcggggcggaaaatcgcactacaaaactggctggaccctgtgtcattttgtatctttcacgtgagaaaattgccctgaccctaacccatgtagctccacagaagaggtttgttcattgttgttgcgcggaaacaggcattttggcggaccggcaaatccttttgtggtcctcgcagccaagctgcggggactgggcgcggagccgggaggtcgggagaggggctgggggtggggcctggcccatgacggacgaaaagcttggccgccctcaaagcctgacaccggcagcctcacgaggtgtcccttggccatacccatggggatgaataaaataaaaggataatctcaatcacaaagtcgacccgagtcgtgcgaatcgaaaattgcgtcctttaccttgccgttcgacatctcatgcctccgcaaactatcccctccttggtctcag

SEQ ID NO: 6196 - DNA, 700 bp, Nannochloropsis_gaditana
aaattcaattttccgttaggtaaacgcgcttcggcggttgagaaggccagtgcccctcgcgccctatgtccaacccacggcctgacgcaccgtagaagataacgtcgaagccgtatacaaagttctgtaaaaaagtaaattggtcggtttcatttcaggtcgcggtcgtgaaaggatcgtttttaatagctctcaatttcgagtcttgtagtagatggcgtagtcgtatgttctctcagaattgtgctggctgtcttgaaccctctttcattgccatttgccttacatgaacttattacgtagagttaatcattatttattgaaccagagcaccctgtagtaaccaggacgtgcgggaaaaaagaggttacggaaggagggcgatcaaaaaaactttacagctcgctcccgtccttccatcctcacctaacgcctacgttaaacaaagttccctctgccgtcaccatccatctaatcattacgcatccaacacacagctcttagtggagaaattcgccgtgggtgtatcttgctccttttgtagattcctctcctgagcgtcgcccttcgacgcgtctgcgggtccattgcaagcaggcgcttcggaaaacagggggtactacaagagtagggcaaacaacctgcttcgcaaccacagagtagcgtccactggaattgccaagccgagacgggagtcatg

SEQ ID NO: 6197 - DNA, 700 bp, Nannochloropsis_gaditana
tattgtcatgaagttatagttacatgtggggcaagcacatacgggaggagagaaagcggtgatacaggacttcacgttgcaatacagacgacgggagggagtgtcagaccgtctacgagtagctcgacgcgaaaatgatattcactcgcctcaacatgtggcgcatatgagctcatgacaatggaatacatcacattcgccatggtaggagcacatttggtcggcatcccccattttcttgcttcggaaaatttccattttttaatgcacgctgtctgctcttggcttcttgttcgttgacagggacaacgagctcgtaatcaacaccacgcttttcaactcccaggtagccgcttgtttgaggataaaacccacttatgtgatgtgccacagatgtacaacgacagaacatgacatagtctggatgttgtctgtgattccctccttttgacctggtgttcttgctagctacgggttggggaaaacctcctctggagtccaaagcatgatgtcacattccccctttttattttacgtcctcaatgatttggaggggggaggcgtcgacgacattttgcaacatggttttaatccttttcagaggaacttatagtttatgtcctgcattcgaatgtttttctacttcactttcaaaacagacgggcgccgccggccttataattcattgacccgcaggatg

SEQ ID NO: 6198 - DNA, 700 bp, Nannochloropsis_gaditana
ctggacaagacgcagttgcccagcaaatgcaggcaaagagcttaaaacaacctccaatgctcaagaattttcaccgtttacttattttatgacgcactcaatgatatcttccaaacagatatgaaaataatcgtttttggggcaccgcctcgcatgtcgtcgtatatcgcatgcggccgctgactagacaggggatgtgcatttaggcttgcctaaatatgggccggcagctgacgaacagccttccacttcaatttgaagcctgttgatacacaacaccacatgttccaaaagaaagcatttttttcccattaatttgtcatggattagacgcacgattgattctttttttcgtcacacgattgcggcttgtcgatacctgaccctttcgaaatgccaaacttgcttaagacttctttcgacctccctcctgatttgtccaaacccgtcgcccgggccttgtgccgtgtgtaacttgacgggacatatgatgtttaatcaatatatatatttgctgtcataccgaccatttctacacctctgcgtctttacaagaaaataaagctcgtacgcgaggcgaagtggtcaacattactcggtactcattgtcctttttcctaaaatttagtcccgatacatcccgtaccagtggtagcggcccaatgaagtgcattacaaccgcactaatcgtactgccatg

SEQ ID NO: 6199 - DNA, 700 bp, Nannochloropsis_gaditana
cccagtgcgcattcgcaaaattggcacaaaaggtagctcaacgccaccggtgctgtcacggtatagtctgtaggaaaccgcttggaataaaattcgatcggcgcaagccctcactacggggcaggtggagataggattagagaacagggaagcagacgactcaccagaaattccatttcgctcgaccgcgactgcgccgccatccccccgcgggaaaaaatcacaccgggatcactgtgagagtgaaatcaatgtattattaccagatgtgatcgcatgtgggggagagaaaggaccttaaatgaccacaaaatgtgcgtctagcgccctttccttctcctcgatgtggcatcgctcagaaagtcaatttgtgggcgatggaccgcgctttccctcaagtcaaggcatgcggccttggaaaagcgcccattaatggtggttgtggcggtcgtgggcgcgaggggaaagtatgttgcgtctggcaccgagtgggtcacgcataccgggactccacgtgtgagggcatacattttgcggcggaagacaaagaggaagcagcgcgagaggagaaatacaagcagcgataactcctcacttttcatgacctccggaatccatccacagtgtcgccctccattagtgctatgttatcatacgtgcggctgtcctcttttttctctccccgatctccaaggggatg

SEQ ID NO: 6200 - DNA, 700 bp, Nannochloropsis_gaditana
acgagctgttagagtggatacacgtgaagatgggaataaataagtcaggttcccgggtaggctttcaagctacgaggaagaagatggaagtactactttagtaaaaggatcgtggactggcccctctctttaatggacgcatggcattcctaatcagtttcatctacgtctacaaagaactagtcctccgagccaaaaaacgcttttgtgggcaaattgaacgcacacatataccggtctgatcggtcttttttgttgttattctttcttctgcttccgccttcgcgcctttctccctattgctgtgtggtgtcggtatgtcgtgtaagtggcacactgaacactgttcaaccacgaatttccaaaccaagtcacgcttaccgtggtggaatagtttcatgagcttcgtttgaggatgtttccttaaaaaagatggcacatgcccttcttgatgtatcgtccacatcaggcaacatgatgctgcccgtgttcctcctttgccttgaagaaggccctcgctttcagacggcctggaacattttcatcagtctcatgtgataggaatgtctacacactcaggctttccttatgttaagttgggcagagtagggctttgtttttaaacatgcctgtgacaactcctgcagcttccgtggagggagaaaatttgcgaacacggcaggtcgcacatcagcacatg

SEQ ID NO: 6201 - DNA, 700 bp, Nannochloropsis_gaditana
ttgttttctttaaaaaaagcgcataatttttctccaggaatttttgggggtacttcggacatggctttcctcgcaaagaggaaaataaatcttttgaatgatctttatgttccttttctttgccggaaacgattttcttcataggcatagctttgacctctccaagtgcaagcgtcgccatctggaaggcgatgacgtgatggaaaaggtacccatggccctacggcgagactcgtgcgctgttgcactgaaaatttcaatgcagtagatagtgggaaatgggatgccccccgtatcgtacacggattgggctatgtgggcagtgtacgagaggtcttgatgcttctttccttttggagagattaagaggggtttcgtgctcgagccttgtggcggttggtaagattccctaccgctcccatagtttttaacagggggacaggaatgtttgtcgcagtctcgtatatcaagctcatacttctctctgtgaatttctttgtgcaggcctcccttggtgtagaggcagccgtagcggcatccgcattataaggaggagaggtgcttgtggggtttgtccattccgtgtgagcgaacggattgacgaacaacaggaattgagaagcggagaaattccaagcaactattagcaagaatttaaagaagacatcattcgaaaatatacacacggtcagacagtatg

SEQ ID NO: 6202 - DNA, 700 bp, Nannochloropsis_gaditana
agggggggcaggagcaggccagggccaggggaggggagtgaggaggccaaaaagctcgacaacaaggccgacgtttccctcccggactgcgaccggcaaagcgctgtcatccaagccccgggccaagccgggcctgtccctcgacccatcccccggcgcgtcttcccaggggcccaaggggaaaaaagcgcgaaccaggcagcgacggcagctgcttcgcctagaccgaccacagcaccggctcgcagggtccagggtaccgttcccgcccacggcctgggccatggcgggcgcctcactttccgggctcgggtgggcctgcctggccgtccggcagattcaaggggcgggcctcgccagccactacacttacctattgaaccccacacaagccgttttcagccacgtccttggccccaccctcctcttcatccaggctgggaaggaccgtctttccccctcgccctcccagcgcccgcccctcgtcctccaagtcctcctccccctcgccctccttttcgccgccacgggcacgatcttcttggcaaggaccggcccccctgcggtcattgcggtcgtcctcgctgccgcctgcctcatccagaacgtgccacatacgcagccaccggtcgggcggcccgatggggcgaggagcgacctcgacgcgggaaagtggcgtcgatccctcctcagcctgatg

SEQ ID NO: 6203 - DNA, 700 bp, Nannochloropsis_gaditana
cgtggatcggatcggccgcactttggatggttctttgcaccagaacagtcacaaagagcgtcgtccaggttctcttacacacataattcgtgataacaaaaggcaatctttgctcattgtagcgaaatgcgtccgtcgagagtagcgagcgttgtccgtgacgccatctgagggccgtcgactggcctccgatttgaatttggcgcgaatgacgccagaagccgttaaacggtaacgcctagttcttgcctcccgtgcccaacctccatggcaaggttccggctcccgaggccttccctcctcacgccgggtccgtgctcgggttcaacatgggctaacagcacatgtgttacttttctgcttgctgattcatcacttattattgctttatcgtccacgagagggaatggcgacattgttacgtgtcctgatacttgaagcctttactgttccattctcaccagatagccgatagcagagttattgtccatagttgatcttcctgcatgacttttaaagacctggcaatttttgagcttgtagaggtttaattgcaacctagtcatccgtgcgtggaggaaaacttgtcctttgaacacggtccccccgtagtctgaatttccctaccttccttcctccaccttcgaagcttcagacactttcacaacgtgtgtcacctgaaaacaagctatcctccatg

SEQ ID NO: 6204 - DNA, 700 bp, Nannochloropsis_gaditana
tgttcacgaataggggtggacacgtccaacaccatctcatgagagaaccccagcgcgtgcagacatcgttggccgttgggactcaagcccgtacccgctccccgttgtcgatccaattgtgacgcacgttcgtatacagtgacatttatacccttgagtcgaagggcattagcaaccgcaagccccgcgatgcccgcgccaaccactacgacgtcctgaattttgggttcatggccatcggtctggacgtcgggctttcgaggtgaaaaagccatgcaaatatgaagatgcctaaaaaggggaatgcatgagacagcggcaatttttcttggagatagaggtggatgtgagtaccccagtttggcggcttgtgtgtgggccatgctatttcatagctatcgcttcttgagcgaacgcggatactgctgcgctcgcttaagcaggctttagtgtgcatgttgctccactagtaatcattcattcagaacgaaacttcacctccgttcgcaagaccggtcagccaaccgcttcgattgatgcatgttgttgcttagatgcgtggttggttgttcaaagtttatttcctcgacgcaatctgcacaggaaaagcgtctcctcgcttcccttcggcttctggtgagtccgcctggattcatttagcccccgacaccaaacttaattttcgtccgaggccaaaatg

SEQ ID NO: 6205 - DNA, 700 bp, Nannochloropsis_gaditana
gatcatgagagtcattaagtggctattagttccatgtcatgatggtctatgcacgattatattaaaataaacgatttctaagctccggaataccttatttcgatgtattgcaatctgtggcacacgacctttcagagtcttccccgggatgtcgaacctcctcacgaaagggcctccagtttcgcggaattcaaattcaaattttgatagccgtcagcaacggtcgtcggttgcacggggttggacacaatacatggtggtcgggggctttcgggcactcccaccatgaaattcaaaagatcatatcgtttgtgagtagaccgccacagacagaattttcgatgtagtaccgtggcactggttacagcacgtaggttcttgaggcatttacatttccacagggtttctgtcttcgactgtggttatggcccatgtctctttgaatgctcgtgtacaacaattgttctatgtgtcacgatactttttctgcgttcgctttaaaacatgcattgaaacaatctttgccattttcatttgcttttaattttgcataagagaccaatagtgtacatgctctttaagcaaacacaatacaaagatgaagccggactaattacttaatactcatttcttcttacctgtcaggaacacaattccatacaagtccgacttcacacgattttacgtaaattaatcgatg

SEQ ID NO: 6206 - DNA, 700 bp, Nannochloropsis_gaditana
ttgggccatgggatgccgtatagacgaatacaggaagtgaaattgattcttctgtgaatttgagtgtagttgaatcagcctgtagtagagcgggatggttttctaggtcttgtgctatcctgcgctgcatgtcttcttttttttttcccgcaacacacttgcacctactgcacgcgtaacacacgaaaccttgcgtgcagaaaattattgccggagaagtcagcaattcaagtgcaacaaatattcgtatgagcaacaatcgccgtggtattagttttcctccggtccatcgagctggttgtacggagcctcctacccttactcaatcgtttccctcctcgggccatatttcatcctaggtgcaacgacaccgccctcatcgcactgcatgccgtccatctcgcccagcttttttctcgctcctctttttgcggatcctctcaagttttctcagctcctggaggacttgatgaaattgattcaagggcgggaaggcacttggaaaccggccccggagtcagaagttgagccagagcgagactccttcgcaccgtcatccgcactcggtgcgggatggaacactcagggcaaaattacccacctaatagcggtggaagaagagagccattcggccacggaaagcagcgcccggctcgcagaggcccttgcaaccaaattgacggtcggctactccacaatg

SEQ ID NO: 6207 - DNA, 700 bp, Nannochloropsis_gaditana
cagcatggttagacaagagcagaaggcagcaacagaacaaaactcccaagtgcacacgtgttaacgcggttggtatcaagggcactgttgtgatcattgatgaaagtgtctttctattcaaaagttcctcatcaaagtgacgagtcgtaagagggaacctgaaaatacccaagcctgaaaattaacctccccaccgcttgggagcgacggagtgacgttgctttagcgagtgcctgaaaactgcggcttacacaattagaataaaacgacctctggcgtggtttcaaatagctaatcggcagcaggtattaagacacgacatgtgaatgcagcacacttgagaaggactcgtcggtgaggtcgggataataacattattaacctccccagagcccgaaacaaaccttgtggcggctttgtacttctccataatagggcaggaaatcgatattaaaaggacgatattgttccgcgcttccatatttccactcatttatgcaatttatgtcatctctggttgcgtgctgcacctactcgaaatccttgccggtatgaatgcatattcttacaacttcagtatgacacctgtcacttcaaacgcagataaattcatcgagttgcagctcacttacttacccagaaaagacgatttttatcgacttacaaccagactgctgatcttgggtacactcaaaagatg

SEQ ID NO: 6208 - DNA, 700 bp, Nannochloropsis_gaditana
gaagatatgctcgtgttactcgtacttaatttgtcttttttccgaataaaactacggggaacgctggcgtccgtcgagtcgggaatattaatctctcccagctcggcatcccctgtgtcctgcgtgtcgtgactgtctgatcgaggacgaagatctcgaggcgacggcggaggcatgacctctcaatgaatagccaccaaaaaatcccaaacaacgattgcctctgtgaataaggatatgtagggcgtattgtgaggtattttccatcttcgcttcaaaattccaccagcaagcagggttttgaccggcaagtcgtgtggcggggaaacgagcctccctcctgatcccgggatctttccctgaccggtcccccgcgtgcacataattagcattaccaagtcaccgcctctttcctacacgttccaaagcacgcccacgaaagccgtcgtcgtccccgccttcgtcgcaggacatgtcgcgaaagtgcgccgtcaccgcgggcgggtcaccccagtcgggaggctcatgccgtgtggaccgagagcttaaaggcaaagacgtcaacacttgaatattgctcagcgactaggcgatccccttgcaaggcttgaatttccatgtccctcacccgcgcaccttctttttctccggcgcagacgccttatggaagaaggggaagtgcctgccgacgaaagacatg

SEQ ID NO: 6209 - DNA, 700 bp, Nannochloropsis_gaditana
gtttgcaagcttatcatctgacgcatgagaaaattgcttcctagcatctccgcgcacttgccatcgctaccattgaatgatgaaaccgatcatatgacaaaaatatgatttctaaaatgaatatgaggattcgggggagttatgtgacgaagagagatgtgaaacttcgtggtgcgcgttcttttccgcgacaagccgtcgggcgacgaggaggaaaagaggcttgtatagcaagcgccttcaacgattgttgtgcaccagaaacgccaactatgcatcagtaaagtatgagtagacaagattctgaataaattgagctgaatgtatgaaaaggtgatagctacacgcgaaacattatagcacttgagatcaatagagggcgttgaccttttttatctcctctacgctgtacctccccgccgttaccggaaaactcacccgaactcagttggcaatgtcttctcacgtttgtttcacggaaggaaattgaacagcaagtcaagttagaagacttgaaaaaacctcttgcaggaaaggaaagcgcgccaaactttgtcttggaacctggaaaagacatgatttagaaaaataactgccaagaatggccgttgaagcgaaaaacgtttctctaacctttacttatacctctataccacacactttaagcgctcacttagctgcagcacatcaaaccagtatg

SEQ ID NO: 6210 - DNA, 700 bp, Nannochloropsis_gaditana
ttcgtctcgctgtcgccgatagtggctatggacttttttgctcctccaacattcgtatgaaatccggagacccttctttgggttgtaagataagtcccagtaaattcatcgttttccttttaaagtagtttccaccattcccattctattgttgaccatatgtcatggagcagaagagcaatgttttacgaaacctgaagcgcatgtccctgcgatgccacgtgactgacgtgatcgtccttttcacatgatatgcttgtattttgttcctgacaataattgttgctaaataccacaagataagacacttcacattcttttaccagcaccctttaatgggcctgcaatagagaaatatctgcgtcctagaagccaagtattgagactcaatttgcgtttgatccttttcctgtcatcttgtcatcaacatcgagattagttactctaagcggaggggcgacttgacaccaacatgatatgactttccccctcatcttctagcatggcggacaattatgggggcatgcctgcctttatccggtggctcttcttctggtacttcgtcacccatatccccatcaccctgtttatcgatgcacaaagcatcttctcgatgtatcatcctccagctttcacgaacttactacggtggtataccgagacttacggagacttcctcatggcaaacccccctccatgg

SEQ ID NO: 6211 - DNA, 700 bp, Nannochloropsis_gaditana
ggctacggacaaggaagtcatcctccataacagtaacggtaacgttgtcgcagaaacgactgaaataaaggaacgtgagatcggaacagacgacgaagtctcgaatttagagagggcggacaagaaatcgagagggaggaaggagaaggaaaccgaaggggagcaagaaaaggcaggggcggagcaggtggaaagggaagaagactatccttatgggattagagagggagaggctcagcatggtatcctcgaagaaggggaggacggcgatgggccggccggcctgctcagcgatctggcgaatgagggaaagaccgagggcaaggcgcaagccttcacgagcccagaggtttgggagaaggtctgtgggatgtttaagggcatcttacccttgcaggcgctgcatagggtctatggagaggcggaggggctggagggggctgtgcaggtaagaggggggaggagagcggggaggagaaggaagggggagagggtgtctgatgtaaaggaggaggtctgtgcagaaaagaggtgagaaaggaaagtgttacggcaaaaaaggtggaggagaaaaagaggagtaggaaaaggatgcatgcatgtggagagggagatggggaaagccgcatgccggcaaagacattcattgtcaaacattttcaccaagacttgaccacaccaacaggaagtagagaggatg

SEQ ID NO: 6212 - DNA, 700 bp, Nannochloropsis_gaditana
ttgtctgcgcccggctgccaatgtacgacatcataactatgaatcaggtaaatatatgcaacaatagcaatgtcaccacacttttaaaatgccacggctgcggggcgattctccgttagggaaggttgagctttctgtgaccgtgaaggaaaagggtggaatatagctgaggtagtgagggagttgacaatacaagtcctcctgtccgggcatccgtccgaacacttacgtcgagcattcttgttacaaatgacgacacatttctgttccttcagcgcaaaccgatcaaggggccttttggagcatcattgatcgttcaattatttgtagaaataattattagagcgtgaggagcgggaggtggttgcgttgatgaagtttggaatcttgaagggttcgtaaagcagtgttaaaaacataaatgacgtgtttgtgtactcagccacagggatatctgccatatcccttttcgcagagatatagctgcatacacgaggcatggaaggtgttgctccagctggcaaaataaattacgacatgaattaatggcgagctgagcgatacgcatacgccagcgcactcagtccgctcgaccctctccagacgcaaagaaaaatacacaattttgcacaatattcacacttatgtacatgtgctttctattgttttaccgctcatcagagtacgcctttttaaaatg

SEQ ID NO: 6213 - DNA, 700 bp, Nannochloropsis_gaditana
gcacgggctgtgattcttcctccgctccctggcacgttttcatcatctcccgcccggcgaggagctggggagggacctctggggctagagagattgccagctaaccctgaatagcgcgtaataagtttgccaacgtgttgaaccaagcatagttgtaggaaggcggaggatgcggcgggtattgtgttttgttggtattcgtatcaagtggtctttccagtcaactacctccaatgatcgataactacaagtagcggctgacaaaatctgtacaagcatgccagtaagagtcgggggagctttgtattgtgtggtaatggctacatggaggggaaggggggagcgaaatatcaatggccaacgccctgtgtctggttagccctcgaagaccgcatttcgggcccctccaggtcgatgaaaaacaaccagaaagacaaaaagcgatacagtcaagcggctctaagcgcccgcattcgcagtaatcgctgttgcttttaaagggctattcaccgtcctatatagaggcagccctgcgctacaggagatcaagcttgaggcggtggccgcaagtgcacggatgaagtgcccccactgatgcgccaagaggaagcaacattcttcgtggtaaagctgaattcttccaaatatatttcctctatttcttggtttgttgaatgtacatgtttataatcacatgcgc

SEQ ID NO: 6214 - DNA, 700 bp, Nannochloropsis_gaditana
cgcctgggtgtccaaattccagaaattcacgccgcttgtcctccctttcgtcctgctgccccgccattcgccgactccgatgacgctcgcggaagaatttcgggcgatggccaggccatggttgtatgccacatgcaggcacaatcatccctgccacgcgggatttttagcgcgcatgaaatccgtggatgagatggagtaagtcggggacgtcctgatcggcctcgaggtgccccgtcttacaaaatccattgtgtcttccggtgtgcttccaggccaagtccgcgtacccgtgttaaggaggaatgcggtggaagacgcattgcgcattccttctcccaacagaagtggctgacctttagctagttctgcttcgtatatcgcagcatttatatgtccttttccatttttaccgtccatctttcagcatttgtttgtctgccgctttccgttgccggcgtcatataagcgagcgtatgctttgtcaagcatttcgcgtgtgcttgacatgtgatgcgcttatcaatacttctccaaatctacacatttatatacacgtagtttcgaagttcaccggactcctctttttgccgtttctggggcgaggcttccgggcagcgttttctcgcttcccttcccgctcgttcttttgcattggtcagaagacaccaacttggcccgtcattgattcggaagcatg

SEQ ID NO: 6215 - DNA, 700 bp, Nannochloropsis_gaditana
ccctgtcgccctgacaaccacacagagagtcttgccctcgggccaggtgctcgtgcaggcacagatcaaaaacatcacggagcgacacaccaatctcttcctggaggacgtgacgttcctggcggccgacaggctgcattcggaggcggtggggttggcgccgaatgggcggtcggcgttgggggcgatggagcaatggggcgaccgaagcccggaggcaacacttccgtccgaggaaagggaaagcgatccactcgactgtgtggcagcctttgaccgacacgtgtacctgcagccggaagatgtggcgcagttcctctaccgcctgtcttaccgggccgaagacaccaggggcccgcccgatcaggacgggatgcaagcgtcatctcccgtcgctcgcaccaccttgtctacagggacacccctggggcagctgcgggtgtcttggcgcactaccttgggcgaaagtggcaccttgttgagccccctggttgagtgctcaagtgccgtcgcctccaccgccccgccggtcgagctacggctgtcgcggcctttgcgcgcacttcggagagaaggtgattctgagacatcatctgttgatgtcaagcctgcaaaggatgaccaggagggggcggcagtgctggtgcaaggccaggtttacgcggcccactgtacattatacaacaacaccgataaggac

SEQ ID NO: 6216 - DNA, 700 bp, Nannochloropsis_gaditana
actagaaggcagccagtcaggcgagcaattgaagaaaagtttccataagccaaaaagcccggagcagccccacgcttccccccaaaacacctgtggaagtgctgtgtagacgaacctgctgtcattcaccgagacagaagcgcgaactgcggttcttagtacttgatatcatccttcgaggaatgctcgctgaagccgtaggacgacctcgcacctgccttgcaggccgccttctacatgtcctgaaagccctcgtttttaacgcatatgatccatacccacaagactgagttactaaatgagtacatgctttattccactgtaccagggcacaattttgtcgccgctcctgttgtcatggcgtcaacagggactacaagtgggccaccatcgcgaggccctctgccagcctacctccaaccacaacagcatcaagaacaacagcagcaaagcacaagtacagcaaatcctgaaatctttgtgcgacgattgtacaagccgcgcctctgtgaccaagtcaacaccacggccgggactcagcttgcgtcgctcagccgccgcatgagcgcgggtaacagagggagcggcgcgggagagggagtcaaatcgtcgacatgtacggtattggcagctgagctggtccaatccgactatttgcttcagccctcactgaccctgcctgaagaatttggtaaaatct

SEQ ID NO: 6217 - DNA, 700 bp, Nannochloropsis_gaditana
gcatggtcgattatgaaacatcaaatatgcgggaggcgccgtcttccctcctgtggcagcaccaaacgctcagccaaagcgcgtgccgcgcacggcaatgcgaacacactctaccccactcaatgtttcatcttcaaattacaccgtatcacgtacaaacacgcctcgtgcatatcgtcaagatggttgaaggaaaactcaagtaggacagctgggactatctcatcaccagtcggtcggcgcgggccaaaaatttaacgccggcgcatttacaacttgcattcatgactttttccccattcaagcttgtgaatcgcatgtttccacattccatgccatggagcacgtgtggcccgcctgaataaagttcttctgcgccttgattttctctgggtggagcggacaaggggtggcgagagggtggtggctgttctcatcggagtgccacctgcttcaagttgactcgcccccgcgccatgccccattcaagcacaccaggggcccttcaaaggctgacgtgtgttgtccttatatcaggacgtctatgtattggaagaggacgtgttgtgactgtctagggcttcatttccggaccctcattctcgacctcttcccttgctctgctggcgcccttcattccgacccttacagactttcggtgcgcaagccgatcaagatcacaatcaccacaaggacaatg

SEQ ID NO: 6218 - DNA, 700 bp, Nannochloropsis_gaditana
ctctcgaagtaacctcccaccctacacggtgctttctcgacggcagagcttcaaccatgccgactccttcctacaaactacgcgctccccctgacacgcaatgacctctttcgatctttgctcactttcacatgcaggatcgctttaaacgttacctaaaggatcagcttttcttgcaggagtttccgactctgagatgaggccattccttcccttcctcttgatcctaggggctacatcaacacctctgcctcccctatactctattgcgttccagattccttcaccctcccggcccccatacactctgatcaaagtggtacttgatcagcatcatccagggcatggtcatggacgaacggccttcctccgtcacagtgctttgcaagcatccactggaactccaagtagcagtcctcctagcaaagtcgatctggagacctggatggaagagtggaaagataagcggcagcaagatggaggagggctagccaaagccacaatctttcaacatacctcgttggcggaggttttggcggaagtttacgaccaagtcctgaaggctgaaaaagcagagaaaggtgcaccaccacccgaacatcttttattgtttccgcaagctgaacgattgtacgatggacaaatgatgcggcaatttggagaccatttagacctgtgcaaagaatgctgtgaagtgatg

SEQ ID NO: 6219 - DNA, 700 bp, Nannochloropsis_gaditana
ctatttgccagcctcaatttcgccgcttcaagtcttcaagttgcttcggacacgaacgccccagcgctgctagggcgacaggacaaaataacaataatgaggacatggctgggcatgacagtggatactgccaatattctgggctatttacgtgtactttgtcagaatctcgttgtggacggtcccatacatggtattttttggcaggtcaaatgatttcgcatgttggggggcggggtcccctctgaggcgtccatgctgacttccatctcactgccacgattaacccattccacagggtacccaagcacccctgccttgtggatgggttgcagaaggaggtgaaagtgctccacttccctagcgtgctgttgtgtccttcattcacatgacagacggggcgattggacccgcggcttctcccccgtgctgctcgaggattagcgcgcaagcctctaagtcacaacccggacgtgcctttttgtgccgtatcatcacattgctgaccctttggaaacttggcaaggggaaaatggcttcctctgtccgttccaatggagtcgcagcgctaaatgcaactcctctcgcaaacgtgcatgtccagtggcggagacgcgcaacagcaggacgaggtcattttcgcaatacttttggagccttcatcagcacaaatttaaggacgcagtcgaccatacctatg

SEQ ID NO: 6220 - DNA, 700 bp, Nannochloropsis_gaditana
ctgcggccggttttgcacttcgatgtctcgagtcgcctctttgtgcgagcctttgaagacagaataggcgtcccaagctgtagaaacctgatcggtgatcttggatacagttttaagagggactctgcggggaaagcttccgaacaaaatgctgcggtaaatattgatactacttcggacggctgcccgtatcactcctgcttccgtacaccctctgtcatccgcatccgtcgcatcactgggcggcaccgtggactgcgacccgctgtgctccggaggtttagacatgttttcagatagcctatccttatctctggggccgtcatggaacatctggtgttgtgtccatcgcctgtggacgtgcaacagaggggaggtcagagagcagtgaacagaaagcaacgctcgcgtggagtcattgcgtcgacacagatcccgcagccttccgcgagttatcccaaccgccacaatgccacactttacccctcctcgcataatttttacgcggtattgtctctactacgtggaaatactccgtttcttctggcagcggtagcggcaaacgcgaagtctcgccagtgggtgcgccgatcgcccatgtccacttcaaacaggccctaccaccacatgcatacaccggaagctcactcatgaggacaacgtattccacaggggacctttattcggtcgaagcaccatg

SEQ ID NO: 6221 - DNA, 700 bp, Nannochloropsis_gaditana
agagcgtaatccacagcttctggtggtcgctccaggccccgtaaatgatgcggttgtcactcaaggcgctcattctccgcctgaccgcgttggagttcaccgtcgccttccactgcaggaaacacggactaactcgattcgactgcacgattcttcaatccaaaacctgcgctcggatgtctgggctgccttctgtcgcccgtttgaggtaaacggtgttgcggtcgcatctaagacccatacgcgactcttgcaaatgcctgtaacaagcagttcgcgaggtgacactattcaagtcaccaagtgttccgagccacaagaatcactcaagccaaaggattgtggagacatacatgaagagggagctttccgtcgagaatccgctgtttcagatcccttgcgaaaagacagtttgcggacggacactactgcctccaagtcatccgttcaacatgtgccctcgggcagccgaagaaacataccaaactgcatcacaacctctgtcaaatctagcccgccattatgttggcactgcaaacacaccatggaggatcgaggggtctgctccatcccacgctaccgctgccagtttttccctcggtgcccaggccggtgcgggacggaccgtccccaagaagctgttttcctgcaactccgcggcccgagcctgaaagacctttgcctttcctatcccgatatg

SEQ ID NO: 6222 - DNA, 700 bp, Nannochloropsis_gaditana
aagaggtgtacaatgccatacggattatgataacctgctacgtgtggatgaccggtttcggaaatttcagtttcttttacatcaagcaggacttcggcgtggtgcgcttcctccaaatgctttggcggctcaattttcttgtcattctcctttgcctgagccaagggaacacgtacattctgtattacatctgtcctctgcacaccttctacttcctcctcgtctacgcgaccatgcgcgtcttgcccaagcacaaccacggaaaatgggatgtccgcctcaagcttttgggcgtgggcctcctcatctacgcggcctgggacctgtttgagggcgaggtctttaaggtcctcttcagccccttcctgagcacagctcccgtcatcggcgccaaagcaggcactctatgggaatggtatttccgcacctcgctggatcactggtcgacgcttctgggcatgattttcgcgctcaatttccccatggctacgcgctggctgacaaagctggaagagcaatcgttgggcgagcaggtgcgagtgaaaggtctgaccgggctctgtgtggccgcgcctttcttgtggtgggtgtgggaaatctttccccgccccaagctcgagtacaacctgaccaacgcctactttggcttcattcccctgttggcctacatcttcttccggaacttgaccccgggcctgcg

SEQ ID NO: 6223 - DNA, 700 bp, Nannochloropsis_gaditana
ttacgtgtacttatgcgggtaagtcaagtttacgaatgccttcccttccccccaagcccgccctgttgccgccgctccagtcctatcatttccgtcacactgccctctatcggagctcgaaacatcctttatcgccgccctgaggaattgacatctgactttaacccgaacatctgacgcctatcaattcaggacggcgtggaccctgcctcccggcatgtcgcaagcaagcactccgagcccctggcatggacgtttccgtcgctctacgccttttttcgggacgttgctgccttaggcttggtcttgctggtggcattcatgtgcgagaaatatccacttttcccccgcggagaaaaatcctgggatggcgacatgtattggttcctgtgtcttctcctcctggttgcctccgtgatgaccatgcggaaggggaagtgcaccgacatcctcaaccgagaccagaccgaagagtggaaggggtggatgcagtttatgttcctcctgtaccactactacaaagcggaagaggtgtacaatgccatacggattatgataacctgctacgtgtggatgaccggtttcggaaatttcagtttcttttacatcaagcaggacttcggcgtggtgcgcttcctccaaatgctttggcggctcaattttcttgtcattctcctttgcctgagccaagggaacacgt

SEQ ID NO: 6224 - DNA, 700 bp, Nannochloropsis_gaditana
cgaccttggccacgcagctaagggagcttcctcggactcggttccccagcgcggcgtagagcccgagcaggatcattctcatggagaatgctgctctctctgggggtcaaatggcttgttcaatgctatttggaacagccataataacatacttgggactggaaatttcccgcttacgtgtacttatgcgggtaagtcaagtttacgaatgccttcccttccccccaagcccgccctgttgccgccgctccagtcctatcatttccgtcacactgccctctatcggagctcgaaacatcctttatcgccgccctgaggaattgacatctgactttaacccgaacatctgacgcctatcaattcaggacggcgtggaccctgcctcccggcatgtcgcaagcaagcactccgagcccctggcatggacgtttccgtcgctctacgccttttttcgggacgttgctgccttaggcttggtcttgctggtggcattcatgtgcgagaaatatccacttttcccccgcggagaaaaatcctgggatggcgacatgtattggttcctgtgtcttctcctcctggttgcctccgtgatgaccatgcggaaggggaagtgcaccgacatcctcaaccgagaccagaccgaagagtggaaggggtggatgcagtttatgttcctcctgtaccactactacaaagcgga

SEQ ID NO: 6225 - DNA, 700 bp, Nannochloropsis_gaditana
tgggcccgacggcgtcagtcgtctcaagagtcgcacttcctgcacgtaatgataggacaagcatgcattcttgacgcgtgcagcacatttgaagacggttacatgcttttcgctgttcaaagacacacgatttatgctgtagtttgtcgtctccatgatgcagaggtagtgaggatgaaattgtgcagcaattttggggacttatacccatttcccacacttccatacacgcatgcaaaggcttttcgcccgacattttttgagtcttgcgcattcacattgccgaccttggccacgcagctaagggagcttcctcggactcggttccccagcgcggcgtagagcccgagcaggatcattctcatggagaatgctgctctctctgggggtcaaatggcttgttcaatgctatttggaacagccataataacatacttgggactggaaatttcccgcttacgtgtacttatgcgggtaagtcaagtttacgaatgccttcccttccccccaagcccgccctgttgccgccgctccagtcctatcatttccgtcacactgccctctatcggagctcgaaacatcctttatcgccgccctgaggaattgacatctgactttaacccgaacatctgacgcctatcaattcaggacggcgtggaccctgcctcccggcatgtcgcaagcaagcactccgagcccc

SEQ ID NO: 6226 - DNA, 700 bp, Nannochloropsis_gaditana
ggagcaacgggcacatggagagtgcggggtgttgccacgacgagcataagatgggcgggcacaaacggaagcggtccctcattggtgccgaggcaggggcagacggaaacgggaagggggaagagggcgagacgacgcgcgaggcgcagctgacggccgccttggacacgctgcaagagctcaagcaactggtcgcaagccggggagaggagctgacgcaaatgagggaggagaagatggagctgaaccgacggataacaagcctggcaggacagggcctggtggatgggggcgccgggaagtccgcgcccgagaagcaagaggggggggggatcgggttcccagggcgactttcggaggagcagctcgtccgccagcccccctaccagagcctgctgtcggagagagacaatttgcgccgtgaaagccagatgaaggaacggcaagtgctcagtctccgccaaaatgtgggggatttggagggcaaggtccggttgctcggccggagccgtcaggcggttgtggaggcggagcgcgggcacttcatcagccgcacagaggagctcacgcgggagaatcaaagcttgagacgcttcgtggacgaacacgcgttggaaatggaggcgaagcgcgtcttggtccggcaggcggatgagctgaaggtggccttggcggaggagcgggccgaggccagtgggct

SEQ ID NO: 6227 - DNA, 700 bp, Nannochloropsis_gaditana
acggtgtcacactgtcagtgactaagcgcgatgcctttctcctcgacttcctcctcctcctcctcctcggcggcagctatgatggcagcggcccaggcgaaccgtactccggcggaggtggaaggctggctgaataagaaagggcgaatgacttggaaaagacgttattttacattgcacggccacataatcacttattacgcaaagaaaggggatgccaaatgccggaatcaaatggccttgaccgcgcaggtacgaaccaaaaatcaggcctgaagagaaagagtgaggaagccatcatgcaaatctcatcgagcatcatagagggaaaatgacagagcgagggcaggttggatgggcaaagatctataagtttgggagttggatgatttgtaattacgaagcgtgctgaatggtgtcacggtagtgtgctgaatggtgtcacggtagtctcaggccttaatcaactaaacttcatcctcccctttccatcttcctacccatcatttgacatgctccctgcattcgatagagcgtattctcctcctcttcatccaaaaaaaatggattttccatcgtgacggcagggaaggggtttcagctgaacgcagaaacccctcaagataagcacgcgtgggcggtggcggtcacgagcgccatccgctcattgcaagcacagcaagcagggagcgggggtatg

SEQ ID NO: 6228 - DNA, 700 bp, Nannochloropsis_gaditana
gacccaacactttccgtgaagggttcttcattccggttgacattgtcaagcttttttggcagtgtcaggaataaaattgttgtatgtgggccgacctggagcccgcaccagacttctttttgctcttctggtgcgaggataagaaatactatcgaagtccaatttgattacccatttgccgcatcccccctttccacgcaccatccaccagaacaaatatgccgtcttcaggctacagcggttcttttgcgcgcgatagccatagggagcatgaacgtggccatcgtcatcgggagagggaccgggacaggcatgatcgtgatggcggcagtgggaggaaacgggcccgggagagaagcagggagcgtattgacacgcatccgagggacaacggtagcgtgcgtagttgtttatcaccacgccgacggagcaatgggtccgagggagatggcagggggcgtccggcaacacatgtctcgcgtgtctcgtcctccccgttgccttctcgcggaggcgcacatgctaagcggagtccgagccgtcctccacgcaacgagcaaccaccacccctcccaccagacacacatctggccttctgcgtcagctcttgcgcttttatcgtagagatggggaaggcattgcatttgggcaaagtggccacccataccgccctcgtcttcttccatcgctttttcaagca

SEQ ID NO: 6229 - DNA, 700 bp, Nannochloropsis_gaditana
gttaaaggctcttgcgtgagtcgtgaaaatattactcagaaatcagaaagtttgacggagggaaaaaggaggattaagtcaaaagaccgatatcgaaatcgagacggaagatcgagggctggaagcagcgaagaagcaataaagtgaagtccgtctacatgtccaatataaataaagtcagccaaaaacagaaacgcgaagatgaccacaccctgcaacatgattgtcgacgccacgttcttcacattcctcaattttcccccgggtgctcgacgagcttgcgccctatttatttgccctcgcatctgctgccccttccttgatatctctcagtgcttgctcttggaacatgcgcaccccacctgcaggacgcggcacaatgaagcatgcccttttcgggcataaacattcatgtaaaaagggccacatcttccacactgggggcattcaaagtcctgtgccttcgcgcggggctggaaatgtcttggggaaggccggtggggtcgcgtgttgctgttgatgatgaaagtcatgatatcatcatgtcatatccatgcgtgtgatacccgagccctgatttgtgtcgcctgacactttcagacatgaaatgctcccattgaacgcgagaagaattattttgactccatgttttcttcactctaggtgtttttcagccgaggtgtccaaataatcagtaatg

SEQ ID NO: 6230 - DNA, 181 bp, Nannochloropsis_gaditana
gaaaagcaggagaacgcggcgcggtgcgcagagatggtcgaagccttgaaaagctttcctagatgtccttgctccaacctgagttacctccctttctctcgctccacagccctccaacatccttttgaactcaaactgtgacctgaagatctgcgactttggtctctcgcggggggtgatg

SEQ ID NO: 6231 - DNA, 700 bp, Nannochloropsis_gaditana
aagggctccagaagagctcaagggcaacttacgtctggttcaggagtcgtggcgagtcactcttagacaacggtcaaaagtaccggctcatgtgctcgaagaagttttgggtgaagtatcgtatggacagccgcaatttttttctcttgacctccctctgtccacaccttgtccccgtgcccctcgctcccgccctcgtcatactgaaaaacctgtctggggtatgcgacgaccgacgagcggactctcgccgtcttattgaaaggggttggacacgtcccagcatctggtgcatcttctgtaattggagctctcgacctgaaattataacaactcacgcatcttatgcattttatgacagcagggaggagtgacctgccaggattttatttccctcaacaagtgtaataagcaggaagccacgcacgcacggaactcctccgtgtagatgagcaaatcaatcggcaagggatgcgcccgtagacgcctttcctatctctttactctaggcgcgttgtgtcggcgtggcgatggcagcctcgagacaacccattccttccacgcctcctcgtccaagccatcgtctccgtcagcttggaaggagcacgaagcggagcagcacccgcttcgacggcaacagaaggaaccacaaataagaccagcgtcagcggttgggaaatgcaattcgccctcatccatg

SEQ ID NO: 6232 - DNA, 700 bp, Nannochloropsis_gaditana
cttatcacgcagtgcgacaaagtcatctaccccaaatatttggccttgtagctgacgttggcgttcataaacacactcttgaagcgcggtagcccaagatggaagcgagactggtactgcagttgaagactgcagcgccagaagcatcacgcacgccgacaaaaagaaggatgaagacagccgcctccgcagcaggagcttcgcaaaccagtggacagccatttcccttcaaaaaagtggcctgagcgtgcgtgcgtccgcggatgaggcagtgagcgtcggtttgcctggcagaacaggcatgcgtgttggcatttcaagaacacggaagccctcccctcgagcctcagcgagcatcagccagaagccttctccgttggttatcatccattaaatggcatgtttgggctccttttggcgcctcggtccgcacagaaaattcacgtcgtgaccgatatctttgttacaccaatataggtgagagatggctttaaattcctgcctgtttcatcgtaggtcgatgcggagtacgaaggccttccacccactaccagcagcatcaagtaggcaccgccattgtgctaccctgcttttttgctccttccttctcctagatatcgtctcccctgtcttttcatttcatttcaatacctttcccttgctaaatgcggggcggataagaggcagcgttggtgccatg

SEQ ID NO: 6233 - DNA, 700 bp, Nannochloropsis_gaditana
caatcaataagccatccatcctcttttacaccaataatgttgcgcaatgatgttcacgtcgacgagaatatccaaggactcggggttagtgactatcggggggccaggtggttgggataaccaggttatcgccagaaaaaggtcaaggtcgctgagagacgacagcgtccagagagaggctgggttgcctctttcttgctggcgttatgcacaccaaggcgaggcgatgcgtgcggtaatatatcgcatgcatagttaccagttggacaaccactgtgaaggtgtcgtggttgctgtcttatgctcggaaagcctagaatcgataggaaggcaggcaagctgccagaaggcgggaataggaattgtgtgcctggccgtgctctgcaaggatttttgtgcgtcatttctactcgcattccaagcgcactcgcgcattttaatgtcatcaatgcaatgttatgcaatggacttcctttatagttgactttcgcggtagaaggaccattcttttggaacttcggacgttcaacctcatcatcgttctccttaactcttcactcatgccccgaactcactcctttatgtcgcacatgcacgtttttccacctagcacgaccgtgcatcaaaaattggcatgagttggaacgactcccgtcagagtcttggaccacgtgcgtccatggggccacgccctagcatg

SEQ ID NO: 6234 - DNA, 700 bp, Nannochloropsis_gaditana
aacagggacagggaaccagatacacgcgtacggacgggaggaaaatgtactctgcatgataaatgtggtggcacaatatagatgggctattcctggacagtcaaggcgtggtgctagtcaaaggtcatgtgcccactgtttcgtcttcgcctgctgcctgaagctcctcccttccaagttgattatctttaccgtgcggcttcctccccctcatctccctcacaccgaccgcttctcatcccccaccacatttttttctccatccaggagtataagcaggtgttggatcattttttgcataagttggtgcactcaatagtgtctaaacgcataccgcaaggctcgtttggctgcccctcttgagaaaggaaaaagcagcatcaccgttgcacagggagacccgggtgcaagaactttacatggcgccacactaaattacagattataaagtattcacgactgagtcggtggggacgacggtgtcacactgtcagtgactaagcgcgatgcctttctcctcgacttcctcctcctcctcctcctcggcggcagctatgatggcagcggcccaggcgaaccgtactccggcggaggtggaaggctggctgaataagaaagggcgaatgacttggaaaagacgttattttacattgcacggccacataatcacttattacgcaaagaaaggggatgccaaatg

SEQ ID NO: 6235 - DNA, 700 bp, Nannochloropsis_gaditana
atatgtagcaggcggatccttcacggtcaaaggcttaaaattgtgataagtgaagcccagccatgcgatttcgtgttccaacattcgtcaatattcgcgaggttcttttgcctgaatgtctacgcgtagtcttcgtagtctcaagagaggaaaggggcaaagtattggggggtatgtttataaccctccggaagcagcgtaatctcatcttttgctggcgcccatccacataaatatctgagagctgatcccatttccttaaatccttttagccaaatgtaatcggacagcatgactgtcaaactttaattttttctacgtatgcaatgtctgattatcacacacactgaaggcgggcccttcgatttctaatgtttaaccccttttgtgccaaatgtaggccaagccccacaatgcgtgcgataaaaaggaagttaaaaaatatgtttgtgcattaaaaaataggcaagcatgcagcacgtcccgatattgcatagatcagtttgttgtcctcgttgaaaactccctggcctcaggcgaacgacctccccctggcatggctcaatgggcgccttgacatgtgtccgttttgcactcgtgataatgactcatcccttaattgcctccgtctttccgcagacagtctttgcgctttgggtacactcttggctgacgagatcaggcattgctggggcacatg

SEQ ID NO: 6236 - DNA, 700 bp, Nannochloropsis_gaditana
aagcaacgtacaagaagacacagatgacctgagtcctgggagacggacaagtgcagaagcgaggctaaaaagtgaacattcggatccacacgtgtacgaggatactcagggctcatcagattcatttctggatgcggcgcccacatcgcaggggacaccgacgtcatctcatgaaaaagaagtagccgcagagctccgacaggtcctttcaacgggctctttcgctggtttgttgatgcaattggcgggcagcagtggtagtagctgcggcagcagtaaaggtagtgctgatagcacgtccaaggtgtcggcttccactgaggtagctgtagacgaaggcaagcgagaaaaaaggcggcggcaactatcgccagggcttgtcgaccagcgccacctggaggggcaagcacacagtatggaggggacggagaacccacaaaaaatagaagctccgccacctctgatcgccttcgccccgcgtccaagaactctcgagacccctgctttgggagtacgtatggccgcgacggaccatacaacgtcgtccatgcagcccgtggtatcgaggggccaaagcgggacgagcgacagtgcgggcagcctgaattttgcgaacatgtctccattttcctcgatagaatttcccattggacctacgctgttgtcctctccttcgtttccttcctcctcctctgagatg

SEQ ID NO: 6237 - DNA, 414 bp, Nannochloropsis_gaditana
tctgtccccgcctctctccctatccccctcacccagtctctggatggtttcaacctatatatgtacgcggtcgccttgaaagagatggagccgtacctagtccctcggaggaacacaacaccatcctcggccgctgcagccgaggtggcgtgaacgagggaggggggaggggcgtgggaagcggagggggcgggggaggggagagggaaacggtcgcctcgggggccgcagcacttaatcgagagggggtttgcggggaggaagggcagatgcgtcggccgaggtctgttctccctccctccctccctccctccccctttccccccctttttctatccgccttgcctcgtttattccactccctttgcctgtttctgctctctccctcattcccatcctccccccctcctgtct

SEQ ID NO: 6238 - DNA, 700 bp, Nannochloropsis_gaditana
cggcagggggatgtggaggccctacgccgcggcagcggcacgccgttgcgtcaagcgtccgacatggtctgcagtctgtcatggcagccccgggggcagaacccagaatttgagcactagccatccccccacatcaacattgtcctccgcggtggtcccacctaaagcgttccgggtcctttcgccgcgtgaaatttacgagggtttggaaaaatacgtgatcgggcaggaggacgtaaagaccggcctggcggtaggtgtccatgcccattatttgcgtctttatagcaaagagcaagcaaggcaggcagccgaggccgcggaggcggccaacgggcaacggaaaagaaaacatgcggcgcctgcattggcggctcgagagggcgacaccatgacagtgtaccacaacgggaagactagcagcctgatcctttccgagccgggagacatggacacggcttcgggctccgtccatcgatttttgcgcgaagagatcctcaacgccgccagcggaaacccgtcctcgctgagctctacctcgaatacgtcttctgggaacggcaacgacccctcctcctccccctcgtttcccaatgcccgcaaagggatgaccatccgcctgcaccatgacccgcggcggcgcactcgcccccggcccagcgtggagccggtagagctggagaagtctaatatcctcatg

SEQ ID NO: 6239 - DNA, 700 bp, Nannochloropsis_gaditana
tttcgggctgcgcgctttgctttggaggctaagtctagcaccaaatgagcaatctgcaccgcgcgcttgtactcaatattctcgtattttatgacgattcctaaattggactatgtgtcagtgattgctcgtaaaggcaggcaaaacgcaactcaccatcgttgttcattatcatgtaggaggaaaagccgggctgcgctttcagatctcgaaggatgacgtccacctcactcatggcttgggatggcgtagtgccctgcatagacgttaaatcatcattcggcgcaagagataaccaactttgtaaaaaagaagaaaataagaaaggcggggcttgacattttaacttacaggcttcattttagccggtggagggttatggtggaaaagaaacctgtcgaccatgtttgaatgtgagaagcaaaaagcaaagattttaatcaaatatttttagaaagtaaagtgaccgaatcatagactttgggcggtggtacctatactgttcaaaaaacatcgccacagcccttcgaaaaatgcacctcggctcttttgcgtctcggtatcgccgagtcctcgctcctgatctcggaaattgcttcaaaggcaaccggggaagacctttctaatagtgatcctgcaacactttcacaccgtacccttttctgatgttgttttattttgtacgacagagagaaaaatg

SEQ ID NO: 6240 - DNA, 700 bp, Nannochloropsis_gaditana
ttttatatccgcaaagattggtaaccagtaccaaacgaggccgcagtgtgaaagaagacagaaattaacaaagtcggcgccagtactgtcgagaagcgggcatcaagttgcgaggatcagcgggcattttttcctattagaagacagtcagaaacatgctagcccctcactatcatactgttgtctacatagttttttatagaagggagagagggcgtcaagacagagctgatgagacgccggcgtttgagttggcaatggaacaaggcatacgcacaatcccctccagctcggaacgaaaacgtatttctggaggggacagagacactctacatcgtccaactcgtaaatcgaccttgccaacgatgcgctctttctagacgagcttttctctgattatcaatgctacggtgacccattatatgtcttcgtgaggcattcgcttgtctaacaacttgttgaagtatatgcagcgcagcagagtgagaattggggagcagtcatcatctcagagctgtttttttttcttctttcttttaaaggaattggatgcgactttggctacatgatagtgcaatcagtgtgtctgaaaaccatggtgttcttaattttttaatgtcgtcctcaatcgttttcgcttctcagtacgtccctgtgcctatttccgtctcgagggacattactggttgaggggatcatg

SEQ ID NO: 6241 - DNA, 700 bp, Nannochloropsis_gaditana
agggcagcaggggaggtgaggtcgggcgaggggaagcgcgccagtcactgccctatggctggcctcattaggcttgcatcttttcccgtgccaaaccccagaacgtggatattgcgctgtgagctaattgtgcaccgcacaccaatttgctcgctgcaggtctcccacttaaaatcatgaaggaccctcgagtgccccgggcggggggtcgcgaagaagacatgctatggtgtctagcttctccaggctaaactatttttcacattcacaggtctctttctggtgtcactggtcgacacgcgagtggaagcgcgtttggctggcaaggtttttacaaatgtggcctttgggttttccggttgtgcgccttatggcgggtgtcggtgtccttctcttacagtctggttgttcttcatccgctacactgaccaaggccgcttttttggcacccgcgacgggtatcaatgtaaagcgaagcagtttttacggttctaagacaagtttggctgcagatgcagcgtcggatgcggcttcgctgtcccgtgatattccaaacagccggagtttgtatcagcagcagcagctcgagcagcaacgtgctctgcatgagcagctagccgcaatcccggattcgggttccccatgccgcatcaaggtgattggtgtgggaggtggtgggagtaatgccgtgaaccggatg

SEQ ID NO: 6242 - DNA, 700 bp, Nannochloropsis_gaditana
aaaccttgcaggcgcagatgacaaggacaccaaggacagtcgttgacgcaccggtcgtttggctaaccgccaagggcaactcaaggcgattaatttccacactgatgtctacatttgcgtcatggctatttataaatttgtaacgcaaagcacggtagtcccctttcgcataggaaagcatgttgtggatagttcacggcgccaaggagggaggggaggggaggtcgcgacgaagattgacgtaattcagacgctttcctccgcgtgccttctttgtgtcactttaagcatgatctcacgcctcttgacgaatatctgcgatgtatacgcgaggaaattcatcgggcaaacatgagaaagggccgtgaaaatcgcccaccctggtcagtctctgtgcacgtcgccctcccttgccaggcagcgagtgggaggccgccagcaacccttccctgcctcgcgacggtagcttttctcatcttgcgacactccttttgcgcataatgtactgacaaagacttgctgacaagcatcctgcacgtgaaacaggtgtagtaagtttaagtttttgtcgtgaacaacgaaagaaggaggcaaacggcaacaggaagggcggacctcccattgcagcgcaacataagacctaagacttgtcgacgtgcgcacgcgctgcagaagtgcttctgtcatcctttcgatcatg

SEQ ID NO: 6243 - DNA, 700 bp, Nannochloropsis_gaditana
gaaaaggatccgacgcactacatttcctacgacgagctggaggggctgcgcgtcgaccagggccttgcccacgcgcttgaccacgctcatgagctcggccgctgtcgtccaccgacaggtgcccattactgccctgtagttgtattggagagacgagcacacaattagggtcggtgacttcgtctttaaaattcagttctcctccgatttgggacgtgtcggatcccgccgagcccctggaacttacttcagcaactcgatggtcatcttggcgcatggtagtgagcctgccactttccgccgctgcagactggaagaggaggaaaatgaacgccagagtcgatcactagaccaatatacggatattgggcgtttcatcgatcatgtttgtctccttacgccagtctctcaccttgtgataagggatcgatattgcccgtgtacatgcggccacgttgacagccaggcatccaggtccttccctgatggggctacagaggatttcatgaagcttcctctgtatcatttgtatgaagatgagagggaagcaatcaatgatttcgatgcttgtgatggcttattggccggccgtttccaactccccttcgctcgatggggaggccggccaggcgacgggcgagttattttatgaaatgcggaggctaatagcacttgtcacacgtgaacccacacaatcacc

SEQ ID NO: 6244 - DNA, 700 bp, Nannochloropsis_gaditana
aggtaaattgtggtgggtgacttgaggggcctcgctcaagcggcgtgggagaataagacgtgcatgccgccacttgagttagcgagaaaggcgctggctaatgacgtattgcacgaccggcccatgcgacctgatttcgggggaagtttcaaaccttttctgggcactggtgcgcgtcttgccatcgtctatttccacagaaagatcagtatgcgtctttttttttaatgtgcaagcagtccagtgtcatatgattacagtttacccggtcttacataaaagcattgccaaccgtcacaggagaggggagtgtcgaagcccgatttgccggtaatcttttcgcgttagtaaaccgacacagccccttagattgataacatcgatggtaggatcgcctcacagtataacagaggacactgggtgccatgctgatgcacctaccacgctcaggggagcgcggcctctgcagcgtaaagcttggttgcatttggcgactgccagttcctccgcctccgatacgacatcgtctccgtccacaaataatgatgtaatgcgtaagcgacctggtccccttaccaacattccgctgctggactccgcaagccaagcatcctcgtctgtatcctctcaggcatcgcgcttcccttttatctcgccgatggagccattagttaccctggctcgtttcagtcgatacatg

SEQ ID NO: 6245 - DNA, 700 bp, Nannochloropsis_gaditana
atgctgtagtctacacacatcgtgactcgcattaggagcatagggggaggcaagaagaaacgaatgccatgcaagcttgtccgccagaaggcaggaacatttaggttgccgaagaacaaaagaaggcaagacactgtcgtagggcctttgagggagtgcgttcaaaaaaaatggaggcagacttacttgttccccgggctatttttaatttccagcaagatgtcgggcggaaatggcccctcggcccgcaacgcggcaagcgcactcatgtttttggttaaagaggctctatccggcgagatttaggccctgggaatcagccagatccttgacattgacaagccaacgccatgcactgccggataagagctgcctcctgcgcgttggcaacacggacgtccttctgtcccgacccgcccttcgaactatatgtcaccctccaggctagggaaaacacctgagtgacagcagaacgccctcagcctagtcgtgtggtgaagaaagagctccgcgagtgagttgagaggagcgcggcgggccctatgtcgcggtcgcatgccggcggccctggcactcggcgaggcagaacaacttgaacgcgacacggcgacgtaacctgaccatttctgtcgaccccacgttttgccacgctaattgcaggtgcgacacagatgtttgcctgattgctggagagaagatg

SEQ ID NO: 6246 - DNA, 700 bp, Nannochloropsis_gaditana
ctaaatgagaccgagagggtagacctcccctttggccatgctccctcctcgctccgtgccatcactgaagcgctcccgacacaatgagtcatggagataatgcagaacctattgagcattttttcacctgaaatcttgcattcatcattgatatatgtgtaattgtgtaatgtgtagaaatgcattgacagcaccagcgtgtttcgcgtgcacgacgagagcggacgacgaaagggtgagcgcgataactgaggtggtaagagtcgtcggtcggccgagcccctgaggctgccacttttgatttgcaaccccatgcatcgtcacgtggattttttctgtactcataacagcgttgctgtgaggtcaaggtgctgacacctgacgaccaattccgacaactcaaagcacgcgatggcaaacgagtagggctgactccaggtacgaggggaacaggtgtgcaactggccatgacaagaatactcaggttcacctcttagggggcatatggggaggggaaatcgtccccttcgtcatccgtgctctgtgcagtagaggttgattgtgagcttgagtcctttcgcgagttcgtctgtaacagcagtagttccgagatgctatcggtcttgcaagtaatttgttttacaagctgatgcgaccactccattttcgtttatccatgtaccctgtcaaatgaagcatg

SEQ ID NO: 6247 - DNA, 700 bp, Nannochloropsis_gaditana
tcagtcatcgttcctgagaggtaaattatctctggtgagtcattctttctctgataccgcccattaactttctaccggcgctgtctccaacaccatgaagcctggcatcacgaacagccattccgaggggattacctattatcttgacagagtcattccacatatgtaaactggacatagcccgttcatgatccacaaaaaattgatcgaaggatgtccgacatgtggtgcgtcacaacggaataaggcacttttttctccctgcagaccgccggggcgttgaagtttgaacacaagcatattaagagacacccctgagttctgatgcttgagcggcatcagttgctctgaaaacaagctgattgtgcgccaatatgcgcaaaatgctttttccatatgtggattgtgaaggtccacgcagcagctggtgagtcgacacgttctactcgtccgttgtttatttcaaggggcaaaagattttcgtgcttgcctgcttttgccagcaagagcaagaaagaagaacgttgacgggcattgctcgtataagcagtcgcgtcaccaaagatggatgagcagaacactttcactattctgtcagatgcatcacgcgtagacaagatgatctagctgtgtctcaaaatcatactgatgcctttgcaccattccatctccttctccttctagatatccgactactatg

SEQ ID NO: 6248 - DNA, 700 bp, Nannochloropsis_gaditana
gcgcaacaattgacttcatttccttttgagcacgcatttttttggtcctgatgctgtgttgggaggttgccagccttaaaaacctgcgccctcttctatctgtattatcagtattggcattttcgcaatatgtcatcgacaccattattacaaggtcgtatgtgcgtgcttgtttaggaaaccgtctcgttcctatgaccatgcattgccagacgcgatccgtgagctcaatgcctcccgctccaagttcttcgcttccacttcatgttgctttgtaggcttttctacccttcttcgctccaagtcattgtgtttaagtgacacacaagagaatcattttgtgcgagagtgcatcttttgagtaaacaaaaagcaaccgatgtaatgtagtctcgtttcctccttcaagcctcgccaaggcggaagaaagcgaggacgtgacacaggaacacaagaccaatgccactgcggccacgcgaggcttgattgttgcatttgcgcgccctaggcgcactgcctggctagataccttaattatgttttgttctgtgaccactcactgcggccctcaactcacaaaacctgtcacaatggctttctcgccctccaccttcctcggcaccgaacgacttcgaaaaggccccaaagcagaaaccagagccacggattaggccgcagggctggcaactacgaattcatg

SEQ ID NO: 6249 - DNA, 700 bp, Nannochloropsis_gaditana
cttctcgttctctgtactcgcttagctacaacgccagtgcccttgttaataaggcgaactgcgttttccagcggggagacgtgggcgccgccaaagacctgtatttggaggccttaggcgtggaggcaggatgcctcgagggtgagtcgaggggggagtgtttcacgtccaagactccttgtctcgtggcacggggggttgtactgtaagtgtgtgtgcttggtttgatggacaatcaagaggccgcagaggccgctagaaggggttccatccgacccccctgcctccgtctccttgcatgctcacccgctacgctttatttcttcccgccctcgcccctctcctagcccttttcaacttgggcgtcgccaaccttcggctcgggcgtctcagtgacgcgcaagacgcctacgagaagcttcacacgctcacccctcattgccccgaggtcctctaccagctcggtcatatcgccgagggccaaggtcaagcgtcggaggcgattcgctggttccaagtcttgctcgcggagttgagggcgcgaggcaaggggatggggaaagagaagatgttgtaccaaagggggttgtcgaatagaggcgtggacgaggggggatggacgtcgtcttcgtcgctgggcttgtcctccgggtcctctctctcctcaccctcgacgccaggagcgggcagccacacaatg

SEQ ID NO: 6250 - DNA, 700 bp, Nannochloropsis_gaditana
tgcttaatggagcttgagcgcgcatcggcctgtgtccgtgagaagcgcttcgaccctgccgtggagatcctgcggtcgttcgagaggaaagagatcccggtcaaggcgtgggccgcgagcagtttgtctttcgtttatttcttggagggggaattggagaaggcggaggagctggccaacctagctgtggaacacaacaggtaaacgtggaggggagggaccaatcatgcgcttaccaaagggattccgagcctttccgggcttttgctaggctcgacctaggccggactctgcctaaccagctttcctccctttctttcccttcttcgcctcttcccccggccaatctgtacccgccttctcgttctctgtactcgcttagctacaacgccagtgcccttgttaataaggcgaactgcgttttccagcggggagacgtgggcgccgccaaagacctgtatttggaggccttaggcgtggaggcaggatgcctcgagggtgagtcgaggggggagtgtttcacgtccaagactccttgtctcgtggcacggggggttgtactgtaagtgtgtgtgcttggtttgatggacaatcaagaggccgcagaggccgctagaaggggttccatccgacccccctgcctccgtctccttgcatgctcacccgctacgctttatttcttcccgccctcgcccctctc

SEQ ID NO: 6251 - DNA, 700 bp, Nannochloropsis_gaditana
aatcatcgtactgaatcccatcacgcatttgaacggggaaagagcgggcacggcgggcgaagatgggatggggggcgccttggtgggcagtcagggcggcggacagggcgcaggagggaacaaggcgggcctgtcaaggagccaagcggacccaaccatcgtattgccttcctcagccgctttttccacctcccttctcggctccccgcgaacggtggtgttcggtgactatttccggacggcatacttgctcttgatgtgctacctggtcctgggggaggtggtgaaaatgaagcgggtattcgccaagatggtctccacgctgcccacgcccttggaagaggacgaagatatcgaggaggaagccgcggcggaaaaagagggaggggccagacaggtctgcggaccgggcggtggggtagagagggatgacgagatggagctatgggaggctgcagcgggggggcggaggacgcgaaaacgagaaacggagaacacagcacgggatgcagaagagcaagtgaagcccgattttttgcgcgaagaaatgcagcgacgacggcaggagggagttcggtacgtgctggctgcagggaagcttcttgcacccgttgtggaggcgacaggaggtcgcgacgggtatcagtgggtggtggaggccttgaagcggggaaaccacggcgaggtggcctgcttaatg

SEQ ID NO: 6252 - DNA, 700 bp, Nannochloropsis_gaditana
tttctatgatacaaatggcattaggaaacatcatttttaagttttggttgtcatcatttctctacgtcgaaaatgaaacttacggctgctgggaatttggctgcgtacgttcctcctcgccaaaactgtgagaaaaactagccctggacatttatcatgcaaccctcattctcagctaaatacaccgtgatacacagcatagcccggtattatgtctgaagaagatcatagtccttcgtacgtcgcgcggcgacgtccgcgcccgcctcagcatcctcctccaccttcgggtgctccaccccttcattcggctgcctaccgcgccagccgtagaggccctacggaagcgaaaatcgcaaccaagcaaagcagaaaagatgcaaaagttgccacaccaccattaactgccgtttcaggggcagggtacggaagacaggtgggcccattaatcgcaagcgctggtgatcaccagagtcagcctgacaagcctgcgtttccaagtgtgcatcgtacgtttcttccagaccctgccgttcaaagcaccggtgccagcaagccctctactgtctcgcttgtccccacgcaagacgacaagccggaagccgtggcaaggtgcttggaaactcaggttcacgcgttgcttgaggcttcagcgttcgcatcccgctctgggcaactggggctggccttgaacaaagca

SEQ ID NO: 6253 - DNA, 700 bp, Nannochloropsis_gaditana
cgttgagagtctgtattagcacacttcaaatttcgaacatactgtaaggacatcctgcaccatttcctttctagcaacaagtaacttgcgcatcacatcagagtgtagcagcatgctcaagggagggagaggaggttggctggtccaacctcttcgtattatttctgcacgcttgcaactcgcaaattggactgacacgccacgctgcacatcagatttcgattctgtcacttctttgattccaatttcaaatgatgcgagcccgtatcggtgccctggcagtcagtactcagagaagtcatctcgtggagacagcgacgagaacgagcgactttgcgatgggccttccgcgtcccatggccatacgacccgtgggtactgcagaataacttttaactatttcttaacatttcccgttctgaggatatgaacatgtaagcgtgacatgcattgaaagttcagtacggaaagctgacggtccaatgcacatacaggcctaagctcagctatcaataaagaagcaggatactgtccgagtgccaccaagatcttacaaaattctgaatttgcaccacctttactcatcgacagtgttcatctcatggcggacgtaatggcgcctatagcaccaaatcaaacgccggtggccgccatttgctgcatgtgcgcgataaacatccagccgaaccctacaaacatg

SEQ ID NO: 6254 - DNA, 700 bp, Nannochloropsis_gaditana
atacaaatacgcaggcacgtagagctagggcggcgggcatggtgctgtggtgagagcgagttgcagtagagatggggagggttcgaagtgaaggatttgaaccagcgtggattgccaaagaattgaaacacagcgaaaaagtgataaatcacacctccagtacacattcaaaaggcgtgatctctcaggtagtttaatgtgagctcggaatggcctggctgaaagtggcgcacccagctgcgagcgagcagctcgagccacccagtcgcctgcagttaagctctagaagcttgagtcgtgcattaaactttctgttttttggacaatcaagcgctttaatacggttttggtctttgtttggactctctctatccgttcatcgacctgaaaagtcctgtatgccacccaggcgtggcctatgttctgcttgactttttgtggacggtaacctaaagatactagtacgtgcggttccgaggcttctcaaggcagctatgtcctgcttgtctattgcaactcagcattaatgcacctcagtgtcctgaaatcgatctcacaagcgtaattagattctaaagagaccactatactacaaacttagctggtctgaagcgtttggtctctgttgttgatcaatttgttttcccctccatcctaagcctttcctctcactttgcggtctccatgtttccataccatg

SEQ ID NO: 6255 - DNA, 700 bp, Nannochloropsis_gaditana
agggtcttgtagaagtccacatggttgcatttagccgcttatcgttgaatcaaggcgtactcaattgttaaatttctcattttatgctgcaggtggccgaagcggggggctccatgtcatcagcgcaggacgtgaagggctacactgtataacccttgacaccctaccatacagtattcaaatgcaaacggagaaccccacatttctgcagttgaccgggttcggagcgtgctgaaatttgtacaggcataacgaaaacaaggaaccccgcacactctgctgcataagtttggaaagaatttgtgcggaaggatcgattgacgtgccatatcacttgttcttgttaaaaatgacaattatttgtgagcttccttaatttcaaaaactcatagcctactcggagtagaaaggcaggcatgcgttgaatgtctgcatggcgcgttcttctctcattgcgtcacacagcatgtcttcgtgttgtattcttttatgagtttggcattggaagataccatttccctgatggtcagtcgtagcggtgtgagaagaaagccattccttcaggggaaatgggtctctttcgaacatgggacattatgatcatctttcagaaaggatacccggcgtctgtcgagtccccatcactagcagggacaacgttgcggataattttaccgggcgtctcgtgtttaatttcaca

SEQ ID NO: 6256 - DNA, 700 bp, Nannochloropsis_gaditana
acgggtacgaatgactatgggtaggacgggctctggctgagtcaaagagcgaaacgcccggagcgacggcagctatggtaccaaccacattccagaatcgagcaaataaacattcaacaaggagaagccacgtacacaatttaagagcatgtgtctcgacatgcatgcgcaacaaggggcacgaaatcttttcaccccttcttcgcggtgaaagagatgcttttgcgatgggatatacaccttccacgatgaaagaggatctcgtctcgtgacctagcacgtgtgttgcctaaaccttccaaggaccgagcgcactaggacccagacaagcactcccccgccaagaagagcacagcacatgcacatgcggtcctccaagacgtctgaatgggacacggggccccgttcggaggcatcgtggcctcgtgtgcatcggagggcgctcgctcggctggagccgctcagggagggcgaggtcgaggaggaggttcggggacgttgctgtccctcccttctcctcctttccccccccatgaatgcccgtgaatcctgctcaaaacatattcatcttggcctctggccattggttgcctttcgagagtgcttttgggtgcttctatccgatttctgggaaggtgtgtttactcttttttcgatcgcatattatttctctctcaagacaaacccgctcacgctgatg

SEQ ID NO: 6257 - DNA, 700 bp, Nannochloropsis_gaditana
tgctccccttagtgaatgtccgatgcaaagaagaagggtctgagcagacagccataaattctaaggctgttggtgtgcgtgcgagggtaagcggcattcgtaatacgtgcaaacgctatcgccttggtgcttgaggccagcaacggcttcaagggcgaagagactgcttcaactcgaacgtcccccatgactattcattttaccaaaacaaaacgacacatgcattaccacatgcaggaaagagactcctagtttttcaatccatgtaccaggtacaagtcagaggcacgcattcgtcgcggtcctcgaactagagctttttctcttcgaggtcgcccctctgagccgccttccgctcatgttgaggtcccctctcctggtacccgtcatcaatttaaccttcttccttctggtgaggcacgcacgggcgttcgtccttccagcgggcagcacatgcaagaaagtcacctatctccaagtccatcctttccctctcgtccaggcgctccctgctcctctcccaccgatctgctaccgacgactcgccactttttctcgcaggcaaggaggcgcgatacggagaagagcagagtcttcaaacatcagctcacagcagacaggagcgtgcggacaagaggcgtcaagcatatcatcagtccagagccgcaacgatcttgtggcggcaaagaagacgaaaatg

SEQ ID NO: 6258 - DNA, 700 bp, Nannochloropsis_gaditana
tgccttgcgattttgctccaagcgtttttgccgtttagactcctcatcctcccagccctcctcctcttcctcctcctcgtcctcgtcctcatcttcatccattttggtcgggagcgcctcatgatcgagatcgttgcaatctggatccgtggcatgacctcttggctggcgtgtaggtgaagaggaagggcctcccgactcttggggatggctctggctgctcacaggaatgtaggaaatggccgtgccattcgtctgagagtcagcagggtagtggaagacaggcatacgtgcaatcgtagtggatgaaaggatgcttggcgtccttgatctcaaaaagaagaatgtccagaaggaccttcaccttcaagcgaagaagaaaagtcgcgcgcgggccagctccgtctcctctttcatagggtagagcctgtgcatgggatagacgacaccgagatgagcaattcattccaaagagtattatgcctccggaacaacaacggaagcctttccgcttgtttcaaaccgagagaaaagcaacaaacagtgtacgataataccccttcctcgcatgggcgagcgcaccgagtcgccatgggaagacccagcccttcctggggtgggaccttgtcgggacggagccattactgacacctacctttttttcgcacaggtggatcgtggggacgggtgagggtttatg

SEQ ID NO: 6259 - DNA, 700 bp, Nannochloropsis_gaditana
tgcagtcctgttggagtctatccaatgtttggacaattttcagcgtttgaaatgctcaagactcttttcttaccagtgctttctcttcacaaaacttgatgactacatctgccgctatgtaacatcctgtcgtaggtgaagcagcgggaggaaagcgcgggcctgggcctcgaagaacacgaccggtcaaagggtttggagagctggtggtacgactcttttgaatgcgcgttgaggaatttcaaatcagtggggcacagaagcagtgacagcagcagtagtgacgaggatgaagagaccatgaaaagagttagggagaaagaccggaaacaaaaaagggaaagaaggaggaggaagaaggagaggaaacaggcaaaatcaagggaacaatccagaatctcccagcagcctacggacattggtggctttacagtgcccagctttgaagacctgttcaaggccactggagggaagcgaatgggtgagtgaggcgacgagggccctttggatagagcccctatttgaggaagggtttgtctttgaagctttcgcagtgcttctcctcttctatcttcatcctctcccccctctatcagtcatttgtggggagagagtattccccccccttgctttaacgtcccatctcatcctttttctatcccctggggcccatcttattcgccggtggtgggcagggatg

SEQ ID NO: 6260 - DNA, 700 bp, Nannochloropsis_gaditana
ggcctgctaaggtgatgcaagcgcgagatggaaaaagagccgagagcgcgcgaaaacggcccccctggaaggaccccaaattaatcccgcacagcatggccacgaccgacgacgggacaccaggatgcattcagtcgtattcgtaaaatcattaatcgtttggcatggcttgctccatgatattaaacacagcatagacgacatcgatcaggcggaagttacgggatggcacggacacgtaaaattcatcgacggctcggaccgggatatcttcctgcacgccatttttgaaagccttgcaaaaaataatcgggcatcgtgccggtctgctgtctcccacgccgccgggtgatctggcacatgtgcacaaactccgactgtataatgtgggtctctcatttcgtgtgatggggttcacggaacagtggcctccattttttcaaatcgatgttagtcattgacagtcgcttcttttttctcgttcctgctgttctgacctgtcaagactttcgacgtagtgctctgatatcaagcgacttcccaaaatgttgtccgtgatgtaatgctgcttaacacctcctagttccgcgccgctcacattgcatcaacagcataccacagattctgacgtgtgaatgtcagcgcgaccaatcggctgaagaatacgagacggaacacggcatcattttttacagcaatg

SEQ ID NO: 6261 - DNA, 700 bp, Nannochloropsis_gaditana
caccgtcctcatcggccggacgggagttagccggtcagagttaggacgatcaaggtcaaccaattcaccgccgatggagctctcgaccgccgtcgccagcaaggccttgtccctttggcaaatttcagcggtccacttctctagtcgagcttcttcgtccgcaatttcctcggggggtgtttgcgcccggagggttgtgactttacctcgcacttgcgcgggcgaaaaaagccacagccggtctttcacttcccgctccagatctgcggaaagaccgtctttcccacttttgagcctgcgcaagatgcctcggaggaccttgggatcgtcgcagctttggatgaaatttgcatccaacaaagctggggtgatacgaatgggcggcttctcgtcttcgtgtcctgcgaggaacagctcggaaaccaagtccatgtgcacgacacagagggcgaaggacggatttcaaagtgactggcatggacgtattgtgacggtgaatcgtgaagcaattgggttgaaaaaaagcctagggcagggggtggaacatgttgagctttttgggcgaggggagggtaacagggaggcaaggcgtcaaataccatctacctttccaatgcaacgataagccactcattcgtgtccaactacgatatgcggaccccccactatttttccaggtggtgcgagcgtgtcaaagatg

SEQ ID NO: 6262 - DNA, 700 bp, Nannochloropsis_gaditana
ggcggcatggaatatcgcctcattttaaaggataacaggtaccacgccacacgagagtcatgtgatctgaaatccataaaaatatccaacaagaatgacttgcgcgaacagcatgcggacgaactctggtttattgcagaaggacatcgaaccgttccgagcctttcaattaattccccgagaaaaagcgtcatcgagcgctctcccgcgggcctgtgcctcgcctcattccacttgcatgtacacagaggccggccacaagcttgtttggccggggtggcgatgaaaaaaagaatggcgcacaagcctcgatatcgatcgtgaccttgacatgcgtggcctttgcctttaaatagggcattgttaggctgcggcctggtctttctgggtggctggaaatgtcctctgcgttgctttgcttgcctaggtggtttcgaccgaggtcctgcgcatgggaacaggttctcgaatcacgcgctcggccatccactcagcaatcgggtgcactccatctttactttgtcatcagcactctgaacggcctgaaattctcatacaggtccttttcgaggcggtgcgcgcgtttgaatcatcatcgccccccgtcgaagtcaagttttcatcctgcttcatttccattcgacctgatcatcaatttccgacgctttggcggaagatagcaagttaaggaagcaccatg

SEQ ID NO: 6263 - DNA, 700 bp, Nannochloropsis_gaditana
aaatcatcttgttcgtctgccatggataatgacttatttccgacggcaaatagcctgatatgtatttgagttggaggaagggaggataatgggcagaggtgctcgtgggatctctattggtaggcagggcaaggaaaagataaatcctccaaaaaatagatatagatatagctatatatataaatggagattagagcaaagagccatgtttacatccactatatgcgggaaaaaaatgaaggaggagggtgaggaggtgggaagggcggcaggaggggagtgaaggagggcaatccgttccgtgctccctccctccgaacgctccctgtgttagatgatctgtgcacgttgataccgcgccgtgggctttcaccaatgttctgcgtattcgaatcttcgtacaggtttggtggtcgcctcctgcgaggcgttgggcgtgcagcatgatgcgccagcgcgtcatctcttccactcgccggtttgcgcttaagcaggcggcttcttgcggaactactccccatgccagcgtcagtaccagtaggaggcttgcgcacatagcgaggcctactttttttttcttagttgcagcgatgggagtaggccaatgcttaacatgggcttttacgcgggtaggaagagcgcctgcctcatgagccgcagagggtttgcggacctgccggaagtgagcacaatcgttatg

SEQ ID NO: 6264 - DNA, 700 bp, Nannochloropsis_gaditana
tgtgagcgtcttggaagtgggggacggggtggtggaggtcctcagcacctttggggacgcgaccttgggcgggaacgacttcgataagcgcgtcgcggactggctggtgggggagtataggaagcagcacgggggccaaggcccgccctcggacaggacgagtcagaggaagcttatggaggcggctgaaggcgcgagggtgcgcttgtcacaggcctcggaaaccgaggttcgaatcccggcgctggggggcgaagggaaggatttgggcccgttgacgctgacgagggcgggaatggagaagctgtgcggagatctgtacgatcggctgctggagcccatgcgtcaggcggccttgatggcaggggcgactcttggtggggaagtggtgccggatgcgctgggagggcaactggtggatgcccttggggacgggggggagaaagcagccatggaggtcttgatgcgggaccaggaattggcagcggcggacgcggaggggatggaatcggagaaagaaaaactggcggcgttaatgcgggaacgcgccatgaccggccgcaaggtgagcaaagcccggagcacgtacagtaagaatttaaacgctgtacggaaacgcaacccgggcctgaaaatccgtgaattcccacaaggacgaagtattcaagaggtggtgatggtgggcggggcgaccaggatg

SEQ ID NO: 6265 - DNA, 700 bp, Nannochloropsis_gaditana
tatccccgcgctcgtgccgatgggttggcaggaggcagtgtgaaggggaggaaggctctatcacaggatctcctgccgctcccgctgtcctcatggagggcgcgggcggttgaaacgtaggatggaaaacgaatctaaagcatagtggagattcatgtgctgtgagtgagttgaggctgaacttgatctacaaatgttgtgtactttctgctttcctccttctacctcctcccagatctgcttgcgatagtgatccacgagcttgtcaatgaggcgcgctacaggtaatgcgctgcagctgcctggcgaataccagaggcaattcagatgcagaaatgacagcaaaggccgagttaaccacagcagatgctgtttgctcgtccccccctatcggactttgtgaagacggagatagttcaaccctcgccctcgctctctcagatcctcgccccatgcccgtcgccggctggtcgtctcaagcgtaggaatttcttttatgttcctagtgggtcatgcatgtatttctccgaaagtgctacggaggtgcttgattgtggttttggttggacaaaacgtcttcctcattgcggcttgtgttgtacagcacaggaaggatccgcgcagcacctcctctggtgcgtgtatgtgcggtagtatcccttctaccgcagctgtcgcttaataggttaaagaacaaatg

SEQ ID NO: 6266 - DNA, 700 bp, Nannochloropsis_gaditana
gtgatcagccttgccagcgtactgccctctccgggggcatttgcgccatctatagccacgcggctgcctggtccaagcaatggattgaatggccggtacaaattactgccacggccttgctcaaggtccgcgtgggtgggcggagtggaggggttgatagatgggcttcgccggtcatacggagactgaggtggggggggccgacttgaagaaaatgcacggacaggccggatgacagaaatgatgcccaggaagaggcagatcttatgtgcaaattgcatgtttgcgggtggcatggtgcgccagaccattcctgcaaatgttcaatttctgaaggtcagtcagtgccttggttgttgcatttcttgcatgttcgagacggcgattccgcgacagccgagagagacagagcgtgctgagtacttcgtatgctcccagtcgtcactttattccattacatgtcatgcacgtgttgttacgtgtcatgccccgaacttactggagtctgcacaacatctgaaaattgacagggtgtcctttacctctttcttagtgcatgagcctccccttgccctggagcgcccgccgtgctatctgcctctctgtctccagcatcttggccacagcgaaaagtaccgcttttgcgtacccgaccagcactttccctgccgatacacgtacgcgcgggctcgctgccatg

SEQ ID NO: 6267 - DNA, 700 bp, Nannochloropsis_gaditana
tgctgacttgggggcaacttgcgccattcctccatcccttccgtgtcgcggttcgcgcggtacaaacccgcagccacgccgcatcccactatcccgagcgatgacatgagtagaagaccgtaggatggcgtcgaaggagaggataatggttttgtcgatggtgttggtggtgatggctccagggcgtgagaggaggtcgtcaaggagccctcgcgcctgtttgcgctgatggcggattccttccacacagacaacgcaccgcccattcctgaacgtgtggaacaaaacctttacttatttctacgaccctgtcacgaatgattaaaaatggacatgaaggtgtgagactcgaaaactgccatgtaaagcagagacagagctgagaggactgaggagggcgagagagctggaagtgggggagcgaggcgaggacgaggtgtgaatgttgttgcctaggaacacgaaggatcctttcctttactcgaagatgaccggacctccgcctggtgtgactcgtatggcatctcgtgggctgggcggtgaccgcaccgcggtggaagtgaatcttaaaacgaggtggggatggactctctctgagccttcttgcccgtcctaggtcccctcggcaacgagcatcctcatattgccctgtttggtattccaatcctctgcaactcctctatcactacagtatcctatg

SEQ ID NO: 6268 - DNA, 700 bp, Nannochloropsis_gaditana
ttacccctcgggttttcattcttcttttttgagcgagtcgatcaacccgcttatggcgacggcactttcacttctagtttccgcgcttactgaatgagaccgtcaggcaactcgttatcatatctcacgactacgacacatgtactgtagcaggctctgtggcgacagacagacgctggcgcggatactggcttggacgtggcggaacgtggccgtattatcttccttgtgtgccttcaggccccctgtccttcatcacctcctcgaatcctgtagcacaacgactcagctccgtgctcactcttctctcatctccttcgcctccgcgctcttagacactgggaatcgacctgtagggcacccaccctttattactgtcaataggcgtccgttcatgacggcgggaggtagtatcgagaaggcttataccgagtcgggcgacgcctcctcactccccagcttttcaaaacctcgaggagcctttattgtccttgaaggcgtagatcgttgtggtaaaacaacacaagttgctcgggtcgttaaagccttgcatgctcaagggcgcgcggcagaagcgattcgttttccagatcgcaccactaccatcggtcaaatgataaacgcctacctcgccaatgccaccgacctggacgaccgcgtcattcaccttcttttctctgccaatcgatgggaagccatg

SEQ ID NO: 6269 - DNA, 700 bp, Nannochloropsis_gaditana
atattgtcgagtaataccaaagaatcgccttcaggaaatcctgtacaacttctatacttaccgtaagccaaagccaggtacaaccacaaaaactgtgttgttattatataactacagcacggcttgagttgtgccttgccatcgtccatgacatccccgggagctcgcaaactcaatgtgttcgccctttgctggggagtggaaacaggaacattatcagccaagactccgccattactttcttgttgagcgcccttccttcttgagcggttgccgccatagtccagaaaccgcaaaaatggcgcatgcatcatatgcatttcgaggataacagcgattggcaggtatgcgcaataacgatggggttaccccaggccactatgggccgtttcgtgctctgaaagagaaatgtttgatcgagctgtcgaaaggaaaacataatgtggtacgtaagaaatgtagcatgaaatgatgagacgtatcaaaaggataatttttgaggcacactttttagatcccgagggtctacgtgtccgtttcgcatttttgcgcttgccctgctcccgctgaccccggcactgccggggaatcaaatggcaacggctcttaacggtcggagggacaagcacagacctccaaagaggcgacgagcgtaggcgtcacaatacacagcatcaccatccacaggccgctggcaatg

SEQ ID NO: 6270 - DNA, 700 bp, Nannochloropsis_gaditana
gaacgccatccccaccataaacacacacttttccctaaccgtgcatccacaaaggatacatacgcaccctccgtcccgcgtgagggatgacgcgcggcacgccccgtgggaaaagggctccccattgaccacgccggtgccaaggctggctggaaggctgccacaaactcctttagcggctctaatatcatcgcgaaaccaaaacataggtcatgaggtcagatttccgggcgaggcggcctcactatgtggctgaaacgcgtgcatacaggcctgcgcgcgtgtatgccacacggtgaagggttgcgaagctagttcgtggggtgttttctgcggcgcactctcccctttttgatcacctcagcttccaaatcgtcataatttcggaccctaattatacaccccgacacctccatgtctcctaccaagcgtcccccgcacggcggaaaagacgcaaggcacggcaggcaacgacagtgcttcagtcacttgtgtgctgtagtctcggcaattctttgtgtctgaggccttgcatttttgggtcaatgcctacttctcatgctcttcgattctccaagccttcttaatcatacatttctgtttcctccatatcatcacacgttaacctccaaatacgcacaggccttcatctacatttttttcatctcatgtgcacctgaatcttttccaaccaaaaatg

SEQ ID NO: 6271 - DNA, 700 bp, Nannochloropsis_gaditana
catcgccttcgtaaaacacaaggagtatcccaaagctttgcctgtgttggtgctactgctcgggcggatcctgctggatcttgtgatttacgatgtgctttcgcccaggcttgcagggcttccaaatgaaaggaaggccagtcctctcccccgtaataatcgtatttttcgtagttgagaacgcttttgcccacttttgtcaacgcactgtagttgacaggttgtgagatattttttggaaaagtacctcctattctattaaggggagcattctgtaaacttacgctgaaagtatcgcctctaccaaaccggtaccgatgattataacatcgtactgatgctccaagccgtcctccctgggatcaatagacatctctatcttctatgtcattgtgatgagattgagattgagcgcgttgcatctactacatcatcctgcaacgataagtctacggcacaaaggaagcggcccagcagtcgctcaaactggggtgggcgacatacgcgagcttcaaacaaaccaagtccaacccgaaactcaacttattttcccaccagccagattatctgcattgttacagccgactcactgcgagaattcatgaggaagcagctgtgcgcaaccacgaggagggaactctggcgctgcagggggcggattcgtacaaggcattttcaacctcctcatctctcagctatg

SEQ ID NO: 6272 - DNA, 700 bp, Nannochloropsis_gaditana
gccacaaggctgcacatgtacatggtggcatgaaaacagcatggttggggacaatcgaggggcgggcaagtttctttcttaagaagcctggtctctgtgtcgcgaggagaaagtgacacacgaacagctggtagaactcccgacgactgactactactcaggaaaatcggcggtaaattaaacacgcacacaaagcaatgcccgcatcatgcatggagacccgagtacccctctgttctacactgcaggctgacttggcacccgcttaagcacgcctgctgtggcgggagcgatacacgctgagagtacatcgcgagttggttgcctgaagacttaggcctcgagaggagacgccaccagagggcagcaaggccaccaccccgcgaacaaaaagtcgctcgacgtgtcgaaacttcattccaacagcctcgtgcgtacacacgaccctgcgatgcgggtcatggtgacgatggaacgcccaggtacatggagatctacgtctcaggcgtgaaggcatgtgtctggggcgaggaagctgatcgctgacgcctgcattttggcatctccgagacccgaaaatcggagcagaaagacaagttgaccttgccgtcacccacgcacgagtgtttaccggcttctacgccgtcgtttttgtttctcagtgacacatcattgttgacgatcatcacagagtgacatg

SEQ ID NO: 6273 - DNA, 700 bp, Nannochloropsis_gaditana
gtaggagaagtctcctccgcggctgctgccaacagttttctgggcccagacaagaagtgggagcaacgtgtgggggtgacggtgaacgaggcgtataaagacccgccggtcattttgctcctcgggagcctggaggacgcctccctcgcccaagctgccttgcaaggcctggaccggacctaccccggcaccgcccgcattggtggattgtccgacggcgttgtcttgttcagtcgcgaaggcgggcccgggtcccctcagggcgcacggatcttccaagaagaagggaacgggctgttgggcctggccctgctcggtgacatccgcgccttaaccttcgtcaatcaaagggtaaagcgcgtgcccaacacatccacgtaccgggtcgagtctgtgagcgaagacgggaagacgatcatggaagtgtcgactcccggaggcgtccggcagactcctgtggaagcgggtttgcaggcggtgctggaaggggaagaggccagggcgttgggtctgggcgatgtggacgaggaggcggacatgtcggcagctgagagtccgggcggcgctcgacagggtgcagaccgctggagtttggtgagtgtgcgtggcagtcaggagccagcggccatgctgccggcgggatgggtatttggcagcgatggtagcttgaggctggcaggtcgcgtcgcccggaaaggac

SEQ ID NO: 6274 - DNA, 700 bp, Nannochloropsis_gaditana
tacccgacaactacgaggtcctggactcctccttggacgacatcaagcgcgccctttttccctccttcacccctgctgccatcgcgcagcttgacacgaacacgaccctcgtccgggacgtgcacggcgtttcctacctcccgggctttgtgggcctcaacaacttgaagagcacggactatgtgaacgtcgtcctacaggctctgggtcatgtgacccctctccggaactacttcttgcagccctccttgtacgaagctggggcgaagaaccagttggtgttgcgctttggggaagtgatgcgtaaattgtggagccaagacaatttcaaaagcactgtctcgccccacgattttctgcaagaagtggtgagcgcgagcgggaagcggttcgcgatcgggaagccgggggaggcggtggatttcttgtcctggctcctgcaccagctgcacgtggggctggggggaacgatgccgatggtgggctgcaagggtggggagggagggaagaagaagaaggcggggaggaggagcgtggttctggactgctttcaaggggaaatccgtgtccggactctgactaaggcgcggaaggattggacggtgggggggcggggggaggaggaaggggatgaggacgacggcaccgggaggggtaacggggcgcaggaagagaaggagggggagccggcgggggaatg

SEQ ID NO: 6275 - DNA, 700 bp, Nannochloropsis_gaditana
ggaacgggctcgtcctcttcgcctgcaagggcgctacaatatgttcctagggaagtgtaaatttctcaacatacctcagcaagctctgatgggggcataacgaaggtctcaggggcatttgtcagcgcgtgaaggcgcttcaaagcgtcttgaaagcaggtagggattgcgagatcaggcccaggcgggctgagggtggcgttgaagccgtgggagggcttggccaagacatcgccttccggtccatcattgctgtcgctgcctctcttggcttgatttcgtttttttcttggcattgcctgctccctggtgtacatattgaaaggtatattgaggtggaaagtgagccccaaatcggaaaagatactcgcccgaccgcccccaacaaagcggagcacgcacatccaccgattcccacgacccgacgcctcagaaagccgtgatgagccttgcgtaaaggcctgataaatgatccaacaacaacatgagaaagcacatcataaaattgtccccttgcctggtttccacagctcaggaaggggaacgccagcggcgaagacacaccgcgagagacggatcaaatcaagcgagcattcagtctttttaagcgcatacggccccgtggcaatcaaggtatccacttacagtgccccttctcgtccaaacacaggaccttcgtcggtgccaattgaaagtgatg

SEQ ID NO: 6276 - DNA, 700 bp, Nannochloropsis_gaditana
aacgtcggggtcccccaggcgctcagtgagttccttgtatgtgcgtgaaaaactctccagtttggtctgtacaaaaggatctagggtcatcgacacccaatctttatatcttcttgatattgagcgcccggacggcattaccaggttaggactgacgaaggcatgggtcatgatgagggttgtcaaccaccctaggaggcaacagcaatggaaggggagacgcattgcaacgacgagaagatagacccccgtcgggccaaagcacgcgtgcgtcaaacagttggcctgttttactgtgagtgaatgacatgggatgccttgagcaggaaaaagacgcattgcatggcagcggggtcggagatctaggatacggcgcgacgcgttcatcagttcaagaagttccagccgccgctccgtgcacgttcccaaacccgacgcgtccctttgcttcgtcggaaagagcacacctcatgaatattgaaacacatgcacatacacacacgaaaggcacaattatcgtcaaagagtggggctcttcagtcagccactggtgtcaatgcgacggaccttatgtccaggagcaggccagagcctgggtgggattcgggccgccgttacacgcacgaatataatatgcaatttgcatgtgatttcgaacgagcttcgaaggcagcaacatcagcatatcaccgtggtaatg

SEQ ID NO: 6277 - DNA, 700 bp, Nannochloropsis_gaditana
atacggatatgaagatgctactgctggcataccattgggagggaaaggtgttgcggcccccgaagaggcggtagtagtgccggagagagtgtgaggcagaggtggttggtattgcgtgctactgctcccagggtacccattggatatggccacggggcggtataaatctgaagacggatttactgtccgtctgtttggagacaaactcatgattatgtctgcagagggcaattaatctttggaaatcgaggcgttgataagtaccatggttcttaacatgtaaacgttgtgttgcgttttgaaatccgaacaaaaaacaaatgctggccaagtgcatgatgcacaagcatacaattcatacacactgcacacacacgcaacgcggaaggacgaattctcaaggcccccgtcttagcatgctacacccggggcggtggggtctggcctcgtctcgctcctttcctctcagggaaagatactcttggagcacgggcgcagaaaaagtacccgccagccccgcgctcgtcgtatgcaggcccctcgcttcctttcttggcctacgtgacagcgtgctttgtgacacatgaatgaagtgacctctttcacctttctaccactccttgtccttcacttgaaaggcaggggcttcccagtggtggcggtggtcgtatcatcaccagacaagggcaacggacagatg

SEQ ID NO: 6278 - DNA, 700 bp, Nannochloropsis_gaditana
agtcgtgagctttgaatttgtgcctcctccctcgaaaattgtcacacaaccggtattcgttatgcatatggggcccgcaaccgataatcaagtataatcactgtcagcttatgctatgtagctttttgtggcacgaattggccaattttacggctgggtcttcatgtggcacgtatgtcctgctgatctgatcgatcaagccatttcttctggcataactggccactcttacactaatgtgcgctcatctgacacctttcgctgatgacaccatcaatagatcaggagctccaaactgttgttgagaagtgtaacacgcagcaagaccatgctgcctgttttgtttgttctgtctgctgtggtcttgaacagagccttcgggtttcctagcaccattatagaggctaccgataaaggcaatcctccgattccatggtcgtttggggcggagaagagctgggacgctcgtcgcggactcgtagatggccaagatgccgtttgtgacgcaatcagcgactgcactagttgttttcaagaagcagggtgcgggtattgtgggggaaccggccgttgcctcgcgcaagcgagcgctgataagtgcagcaaagggtggagcgacacaggcatctgttacacatcctgtcctgcggatgcagcaccattgcacgaggctgcaggcgtcatccagttcggggcaatg

SEQ ID NO: 6279 - DNA, 700 bp, Nannochloropsis_gaditana
ttgtggttttgcttttactgcgcacataagtgccacactggcggcggagtgggggcctccatccaccgagcctgcaacgcatcgacaaagctgtgtcgccgccctttgaagggaaggtaagtcttcttggccacccgcctcgatgacatgaacgagatcttgaacaagtgatggcggagacgggtccattctatttattttttaaggccaagctcaagttgcacgggggggggggcaaggctcgcctgcagatcattatgctgtcgatactgttgctcccgcgccgcaacgccttgacatcattttccacaacgctcaccctattggtaccagctgcatcaagatcgagaaaagatgacatttaggacctaaaagcatttttcgttcgccatctggacgtggactcggccaacaaaagggagatatcaatgcttttacttgactcgctcaagaagcatcgctcaagagaggcgatagctcgtaccgcccgaaaaccgcgcggtccatcccccgcttcccgacgacagcaaggccttcgcgtgtgtgtctttcacgaatgccccttttatccactcgacatcgcagggactctaacagttggccaccaggaccactagggttcattatgcagaaaagaatggtgaacgcatcctcacgcttgaggcaccgggccttcgtcttccttcgcattttcctaatg

SEQ ID NO: 6280 - DNA, 700 bp, Nannochloropsis_gaditana
tgtgagacgaggctcgacctggagaagcatttcacgaaagaggttggtcatgaaatattcttacgagcacgggcatgaaaggcacgtttttcccgctccattttcgatgatcatacgtctaggacactggagactcggaaaaagcgaggagaggggcctaagggcgataagaaatgatcaacgcctgtgttttcaggcattgcccggtgcaacaaacttttcgaacccgcatcgcgtacacttccctacatcgacaggggaccatctgctagacgttggactccgaagtgttgagttcttcgtgatagtgtcgtctaccagtggcacaggagcctgtcactgagcgtgggagggaccttcataagtaagccatttacacgccacatcggtctattgcctgtagaagaccataactacggtgcgtcaggctgtggaatgtgagggtatgaaaataatccctgcgtattagctttttcaattggatggcaacgacgcaagaggcgtggatcttcgtgcgggacgttgcattcaggggtgggagaaatagaggaagagattgtggaatgtcatgcgccttcaccttgttttggactgtgctacgctcgcaacagaaatgcatggatggagattccgaaggtagagtgctctccaaatttcctgcacagatccctcacgagttgcccttccgtttccttagatg

SEQ ID NO: 6281 - DNA, 700 bp, Nannochloropsis_gaditana
ggaggaaggagatcgaactgtgaaaagaacaccaaaattgaaaagactgaagaagattgctaccacttgcatgatcaaaacacagctacttcatttccatcttctggtccgcatttcttcaacgcccgccgcgccaaactcatcgcaccaagaaaaagaaaccaattcatgaggtgtgtcatgcagccatgtaccttataaaagtgtgaaaattttaaagtctagcctccatcgttgagctagcagggggatatgcgtggctaagtgttgcgtagcagctccgccttcgactagtgtttgctatttgctatttttgcgattaactctgggtcacctgccttttctggggggcaaacaaggtacttgcaattcaagctcaaattacttcagacaattcaaggccgaatgagagggaaaaataataagacgtgcaagtgttgaacaacaaaatcgacccaaaaaaggctggatcccaaggcaggaggttaaattgccagggttgtacaactgaacgtggggagggggttgcctcctagctttgacgaattctccgagacacagccagctgtatacttgtttgcaactgacatcatttctacgtacagactccaccgtggttcttgccgtctggtcgctggcgtcctcttgctagctacgaataggcttttcttgccgaagtactatccacaacaccctcatg

SEQ ID NO: 6282 - DNA, 700 bp, Nannochloropsis_gaditana
cgaggtggtacattttctcatgaaagttttgatgctcgtgtctgatcaaaccggggtgagtgaaaattttatctagtccgaataatgctgtccctagctgttaattattgttccaaaccatatttttaacactactcgacctaaaaaatctgacaagattggcggaaatgacaaagaagacgatgttctttggagcaacctctacggtttcctcattcaaaaattcaactttcaacgggcgagagtacaggcagttgggaccgttagctggcacctgctttattctctgtctttttctatataggcccttttattttcaaatataacactttaaatacaacaaaataaatgttaaaatccattttattctttttttccctcccaatttttcttcaaatactgcgcacacatacaggcgacctaatccaccagacaagtcaggctccccacgtgtcgtcctgcgagcagcatcgaggttgctgacatgtcaacgaagtctgcttcaacgacccctggaatgaaaatcactaaagttgaaaacacgatgcctgcacccactgccgctgctacgctgaacggcgaaaatgatgtttccaccccgagcaaatccaccaaagtttgtgagcttcataaggatgtcagtatttggcgcgctgagcttctgactcaaacttttattggatgttggcgttgtgctatg

SEQ ID NO: 6283 - DNA, 700 bp, Nannochloropsis_gaditana
ggctctgtctcgttcgtgggaagagaagtcttgaggcccccgcagactaatacgggtcaaaactatccccacgacccccgtggacgaaacattctctcactcaatcttaacattgacaaattggaactcagctcatcaaacgactatcttgattgtatttatcatcagtgatcttatcgaagagacattctaaacttcaacgcacagcaggacccatcggtgccagtttatattctcaccatctaagcaacacctgcatttatacttgtaagtgcacatcctgctctgcctcgcaccactcggtacattttctcgtgcaaattctctttcgcagtcgccgccggagtagactttcgctctttgaagttcaaaagcgacgaaatcccctcccccccaacctctcaaagcaccgcatctttgcacccaaaaagccaagcaggctcacaaccaaattggttaattaacacgtcgtttgcagctctgttctcgtgtctgcggatgataacggtccctttgcaccgaaattttcgatgaaataaccatgacgggcgccacgtactacgtagtactacgcacacggaaaaccgcaggccttcggacgacagtaattcgattcatgtcaaccaaaatacccttgtaatacatacattcactttttgatctcataaaaaactttattaaacgttataatcttcttata

SEQ ID NO: 6284 - DNA, 700 bp, Nannochloropsis_gaditana
gtcgatttggacctcggatatgatcccgcggggaggggccgtagatggaggagatatatcgatatgaggatccatgatcgtcccaccaagctaccacctgtgagtcgcgtgcaaaggaacgtgttgagaaggacatgggtgtgccgagaacggtgacagaggtgacggcattgccgtgtgcgcggtcaaagagatggagggcgactccattctatcgtcgctctcgactgggaggtgggaccttccacgagcacgacattcaagacgagcagggctgtgaccattgccgagggatgtcaagaaacaagatatagcaagtcctacgtctatgaatgcaattgcttgggcgcacaaagtgcgtggtgtgtccgtgggaagagggtggacacaataaggcgcctgagcggcggagagcgagtcaagcctctcacctcgctcatcaccgccataattcacacatagcactcgggaaaagggtccctacacccgtgtccgcgcgcgtcatgtcttcaaagggacgatgagcatgggcatgagtgggcttcgtgggtttcgatttgagcaagggctgctttgcgacgatagcctttcttggtgccttctatttattgactttctcgcaacttctcgtctccgaatcgatgaaaaaacgatttaacctgcccacaacactctccacgaagccaagcgcagcggcatg

SEQ ID NO: 6285 - DNA, 700 bp, Nannochloropsis_gaditana
aacttaagcatcctttcatccttgcctaaaccgacgtgccccgttgaagccgtatctttgaaagggtagccgatgtagtcatttagaccgatatgatcgctctacatctttttatggataatgtgtggcacaccagcaactatggtttgtctttttgctcataaataggcgtgtaggcgaggtgaatagcatgaaaattggggtcgagggtcttcacccgtcatccttccctttgaagaaggcactgattgaattcaggatatatctcggccgccgtggagagagagatatgagcatgctatgtttgcagggagtggtcgtgcaacctgtgtctgtcgctcgcaatccccacttatttaatgttgtgtctgacatcttggcggcgaggggcttgcggcggtactgcctgcttgctgatggctgtggcagttgcatgggagagctttgctcgcgttcctcgcacggtacccaacagcaacccttcttccttccagcctcccttctcgaacttttgcgacctgagagccacagtaaactgggagcaaggatattgcttgtcgctattcatgcgtgcgtggcttcatgacaacgaaatcgtttctgttgtgcgtactattttcgcagatgtccatgacgtcttcgcccgttctccctttctcgcacgaaacaggcccctcgcaccaactttccagtcaaaatg

SEQ ID NO: 6286 - DNA, 700 bp, Nannochloropsis_gaditana
cggaagaaagaggcgatgcaggaggtcgtgcaggacggatacgtcgctcccgaccccctggactggagggcgaaatcatttgcataatgagggagggcggtaaaggaataaacgctcgatgttcttgagaatatgtgttctttttaaattcctgatggtgctggctctgcgggattgaaacgtgtccactccgcagtgtgataggagaggtcgcagagagtcgtggccgcgggatggcaacccaagaatagagtgttgtgtccgtgtccgcgccaacaagattggcatacttatgggatccatagcacctgatacaacacacgtgacttgttacttttcctcaaagcaatcaatctcatgcgcctcactcggcacagctttcccagaggattgtccctggcgtggaaaccgacccggatgtaggagcctaagtccaggacacaggcctctttatcactccctgcggtcacatgcacaagcaaccgcaagttttcattgcgtgcacaccgagacgcacgagtaaggcgtttcaacgcgggccgacaaagcgtgcatcgttcagccggcgctcaccttcttgcgtttttcttcttacattgcctccgcgttccagttcagggcaagaggaacacgctaaaagggacgtgcttctccaccaccgcagcctgccacacctttcccaccaaaaaaggacgccatg

SEQ ID NO: 6287 - DNA, 700 bp, Nannochloropsis_gaditana
tctcttgtgagtacgaccacatttctggaggaagtggatgtggaggggggcgcggaggaccttccagcgaataaggatgattttatcctttggcttatccctaccatattcgagggcatgcgggcacggttgacctctacggaggaatagccgaatgactgggtctgtccatgcttattaagatagtttggatgcacctgctggtggaacgacggctgttgctcgtgttggggtggcgctggcaggaggtaagcatgcgaggctaggacatttacggtcaaaaagcttactgctgcagagaggatgaggcccacaaaactgaacaacggtgaacagagtcgacttggtgaagaaactagtgactgcggcatccctgtaggtcgcacagaaaggggtttagcctgattgcaagttattaggcttgaagactcggaactcgaggaggttttaccgcccagcacggcgatcatcagatcgcacccaatatatgtctgcgagagtttcaattctcatctttttgtcgccaaattctaatcttctcttgcatacattcacctggggcatgcaaaggtagtttttcatcgtctctgagtacaagcagggagggcacattcgtaatgcgggctgaaatacgcgtgatcatatctaagcagctctccccgttggttccacaggaaagtgttcaaattcagacaaaatg

SEQ ID NO: 6288 - DNA, 700 bp, Nannochloropsis_gaditana
tgcccttgcctggaatgacaaatgcccgacccccagcaacggcggaaacgtcaccgcgagaagcgcaatttggcttttcatggtgtcctgtgtgaacgacgaattcggtaggggtacaccgtgtgtgaggaggcattcatggacgggagcgaccagtgggtgtggcgaggaacacgaggggggaggtctgctccttgacacatgctgtaccacaagaactgctgcatgtgctcacacaggcgattgatcaagcttaggtacactcgatcataccacgtagtccagtcatgcccgcatatttctccccgtgctccccgcttttcctaaagcacgggttgttcccccgagatgaagaactatcccttctcttgttccagctagcagacccgtcatgacttcaaacccgccctttattcccccttctcaaccaacataaactggcaatttactcacgtctgcctggtttgaaggtattggtgacccgtgtcatgcgtcacgcgccccactcgacgtgggggcaacataagcacagaaaatagttttgcacgcggagtcctgccagactgccgcccttttttcctgggcgatgcgcaggaattccgcccccctggagaccatcaaacagacaaccaacgttgcaccaccctctattttcattgaaacagcgcacaaattggcctccgggcggtgcgtcctaatg

SEQ ID NO: 6289 - DNA, 700 bp, Nannochloropsis_gaditana
ggacaaaaggcagcattgggagagaggttgtacagaacgaggcgaaagacagctatatacaagggcgaacaagcaatatataggaagagagcggaagaaaataatattgacgaatgatgctgcaatccgaatagccgtagactttttttccccggattaaaatatgcatatgacaagttgttcggtgtagtgattgacgtgaagatgcgcaagcttttattctacaacacttggaaaaaattactgggtgcaattcatcccgtccagtcttggggctgcacgctttacatctcggatgcgtgcatgacaacgggcatatcccgtcgttctggtaaaacgtgtgttgcaatcatgtcgccaaaaggccatgggccgaggagacgcacgcacaatccctcattatgactctggctggttttctcgtcgatggagcagcacaagatcgtctaggataaatgcaacctactcgatgtctgcctgcctcctctttataccttaccccgatgataacgtgtacatgacggagcaaaggagcactctcaattaccttcgcgccggggttacccgctcgttgaaggcgcttgagaaaaagatacacacatgcgtgtctccagggcaccctgtgcggagagccaccctagagctgaaagcttaccctcatgaaatcttattcttctcattgtgcagggtaggagtcatg

SEQ ID NO: 6290 - DNA, 700 bp, Nannochloropsis_gaditana
cgtgttctttttcgcgcaaattttgtatacagagcgtgttctggtaaagtcaacaaaaaagaaagagcaaaatactgtcttatttgcggcgaccttttatgcaccctttcattagcgtcaaaatgggcaatgctttccgataaaagatctgcacctagcagtactggtgttgcgcgagactcacgcaggatgggccatcagtgcgggggcaggcccttcgaccatctcctccgaacgcaccatgaaggcggcaattcgcgggattactgcccactacatagaaaggagaagtaagtgagcgacatgcgtgcgcaaatatgtcgtttgtgggttaaagggaagggaggtacccgccaaggtgggctggacggctcgaatcggcgacaggcgctcgtcgactcggaggaaccagctgggtccatgtgcggcctatgtccctttacggcgggtttatgggggcgatcacggagtacgcatgggtaaatgatgccgagcttacagcagtgcaatcttctgagtgatcgaccaaagttgagccgcgtgcatttaaagacgagtttttaagtggtaaaacaaccccgggcaagatctcgctccgagacggatcaatttcctacagcgcctttgcatggtacacgtactccacaactctaattttcgcaactacgcggaacaggtctcaacgacagcaataatcatg

SEQ ID NO: 6291 - DNA, 700 bp, Nannochloropsis_gaditana
tggaatcactgtgggttgcttttcggacagccaccggatgcgcgacgcaactcttccttgcacgtcttcctcgcccatgaacccccagggcagcaacattcgatcttgcgagggacccaagacctctttccagcgaacattgtaccctttccaccgtggaaaaagtccccgtgcccatcttgttgtccgttgtgcgaaagacatgacctctatgtagcgagatagggagtcggcatgagggtgttgaacactagaactctatgtgccgtcaaagaattgaggtatcaaatgcatttgaaatacgtgagaaatcgtctcaaggaaaagctgggacaaagaccaacaagagatcttcgagtggggattccccgcgtttccacgccggtaatgcggtcgagtctggtgtggaatgctggtgtcaggctccgagttgaagttcgggctggggcaaggaatggtaggggtggccttgggagaacaagaataattggaagaaccaaagccgaaaatttgcctttgctgccccttttggctttgggacgtagccagattgcatgttctacgaaaaacagtgttccaactactattttgttacagtcatggaagagtatgcccgagggatggcttcgttgctcgccttatttcttttttgatccgaggccgtcatcccccctctccacgcaggactcttggtgtcatg

SEQ ID NO: 6292 - DNA, 700 bp, Nannochloropsis_gaditana
gaaaactgcagtgggtggcttactctgttgtgttatatcgctttcccacattagtcttgcagctccttcaacacaggcttgcaaacggcgtggatcgtaatccatttccccttaccctcgtcttttatgcgcgcatttcgacaggttactgaagagagatatcctgcaagtgtattggatgcagtcatcgggatttcattccgaaggcatttgacaaaggtgaactcaagccttgttggcttcaagcttccagaccccttgtgtcctcacccagtacatctcgtctgcgtaaaacaaaccattgccaaaaaaatagaaggcgtgacgtttgtttggaggacatacttgtgtgtgtctggtttcacttagctcgagccagacatacatgacgaggacaacccgtgcggcttttccgtccgctcctcaacttcgggcatcgagcgcagggaccagcaacagaagaaggcacatcgctggcgctggcacgttcctccattttttcactactactggtacttgtctatatttttctctctgttggtggaccgtgtgcgacgccttcataagaaaagcagggtgggtagccccggtctccgcctttgcctcccagccctcgccctctccacgcggtccacaacgtgtcgcgcatcgttcactgtcctccgccaccttcccgtcgagcttcaatataatttccatg

SEQ ID NO: 6293 - DNA, 700 bp, Nannochloropsis_gaditana
tttccaggaagcaccactacttccgtatttccaattcagtcttgccacacttgttttctcgtcggaaaatggataaggaaaacttggcctgtgaacgcgaataatatgagaagtaggtgtctgggaccatagatatgccacatctttttcgttccttttgcagaacgcgtggccgctaacacgttctcctcgacacatttctggtcacgccgctttgtctcgcgtcgagcgagaaacactggcgagagagagaaggggttcctaaccctaccacgcgggatggagccatgggaacgtctcgcagcccaggggggcggtcgcgagcgtgggtcgctttgcaacaccattgtcaggggtctttttgttggcgtttaatggcagccaccaggctgaggccattgcctgatggcaaagcagggagtgcccgtgttctcctgagggagccgtctttcggaaagcgcagctctgtaaggagcaatgtccaatttcgtgcccgacactccatcatgtttacgtatttctaaagtcatctcctcggcgcgtagaagtttaacagtgtgtagcagggaatttacttttccgcgccgtcacttgcctctgcgcatgcgagacggattcgcagtcttgattcctttcctcttcccacacgctcaacacaccacccatccttccctttatcatcctagccctcagtgacatg

SEQ ID NO: 6294 - DNA, 700 bp, Nannochloropsis_gaditana
taacacactggcattttacccgttcacattttatttgctcggacgggagcgcgagactgaccacctgattcggatatgtcatcatgctaccaactttgtcaaataactgttccttcaatccatcctgtccggcgatggtaggcgatatttttaatgttctttttgcgttgtccgaacgcacttttgaaaagctactatcgaaacgctcctccagatgcgacaaagcgatacttttggctgccgtcgatgtgttattgcacaaatcttcgttctgataacattctagaccgatgtaatagccacacggacagcgtgtagtcggctttaaatatttttggggtttaagggtgcgggaacgttttgttggcgcttgccactttccgtttttccgtccgcccgtggtctctcgccgacacaaaatgtgacacgaagcattctgttcccccttgaaaatgaggacacgccttgcactgaagctgtgagccatcgcagagcagtgacatctgagaagtttggtgcgcaaacgggggcttgtgtctgaaaaataaggcccttagaagtctccttcttcagcttgaaggacggcatcggccgtcgcttgtaggctagcggaatgtccctatcgccctgtctatggcaccagctcaagtaccgtttcctttctccctggtcagacaaacagcgcttcagttacaggatg

SEQ ID NO: 6295 - DNA, 700 bp, Nannochloropsis_gaditana
gccaacacgcctctcctcttggcgtcgtagccgtccgccctgaaatacctgaatggctgtacccgctttctaccaggtaccgatgcacaaggatgttcacctcgtctgtgttgaaagacatgcttgcctggggctccacggagatgaagcagcgaagggaaagggaggaaggatgcacaggagagggccacgaaggcggctacctcacgcctaaaggacaggtcttgtatgacaacacgcttgataacggccacaccccacctacgccggtgtacagtcctttgactgcagccactgcgaacgggttttcctcgtatgccagttggcaggctttgtacctgtgacagagcggtaagtgaaaacgaaccaaatgtgatgatgacgatagtaagcatgctgtactatttgtatgtccacctggcaccgtgccctcctggaataatcgcttgccaacatgggacactcagacaccatgtactgtcttatagaactcggcgtccgtgaatgctcctctatgtctttcgaattccatgttaaaccaaggaaaggtgagggccatgacaatgctgatacggtctcgcgccatcgccggcggtctgaaaaattaagttcatatgacgcctgaacgtgttaagctctcgactggccctgcgtttccaggaactgaatcgcgacgctaatgctacgtatcccacctaga

SEQ ID NO: 6296 - DNA, 700 bp, Nannochloropsis_gaditana
aacatgtggaagggtctttgataaaaaaaatcgcggcgcgggcaacctcccggtccatttctcttgccgggggtcttccacacgaatccacttttgtctttcgcggggttacgtgggagatggacgatggtagtactctcacactgaaaaatcgagcgttgaccggggggacggaggcagaggacggtgcagcagagttaccgttgaactacatgcaggggtcaggcatgccggaattatgcggggagctccgggcgcacatgcaacgataccatacgccagcctacgacgattgggctgtaattccaacaactgggtccacagatgccttgaccaaatgcttccaattgttgatgcctccccccgggaagaagcccatcattttgtcggagtccttggtgtgggcagctgccttggccatcgcggcccctttgggttacgaagtgcgaggactggagcttgacagcgatggcatgttgcccagtgccttggatgtggcctgccgacaactggctagcgagggggaacgtgccgccttcctgtacttgaccccccacggacagaatccgacgggcacctccttatcaccgcaacggaaacgagacctgtacgccctggcgcaggagcacgacctgataatcgtggaggacgatccgtaccgccttctctttctccccgccgacccggaggagacggggga

SEQ ID NO: 6297 - DNA, 700 bp, Nannochloropsis_gaditana
ccgttactcggtatgatgtgggagagtttactcgattgcctgtttcaatgtaaaaagccccaaggaacgccctctcagtaatcgatgacgttaaaaggagggatggaatgcctggacagcgcggacttcactgtcacgggtatttaacgtgcatattgaagggctcgccgtctgacaggaaggcaaaaaagcgattgtcaggaggagtttacatggggcgaatcgaggcaggagaagactacaaaccaaacagtcctttcacagcagggaccgcaaacacgacattgtgtagaactcaacgggatttacgatgcgtgatataaggtgtggtggagggtttgctggtcgcagccgatggagatggcggcggctcttccggctgtttgcgtgaattgatactggtctggatttatacaaagtcccgttaaaattgcagaattctattagtcgatgagaattttaatgtgaataaaagagctgctttaacgttgtaaacatgtgtttccaattttttcgacgcgcgtgcgagcaatcgacacgatctatttttcaactgcattttgacggaaaccacgtgctttgtccctttgcaacccttccgtcctctaaacagacacgtagccattggaaggtagcatgccactcgaccaagtcagcaaacgcttagcaccacaatttcaacatgtggaagggtctttga

SEQ ID NO: 6298 - DNA, 700 bp, Nannochloropsis_gaditana
tgccacgacaagaccgatgatcagccacattaccctcccagtatgtcgattaccggtaagccttccactgcttacgcgtggcctgtcatgatcgtggctacccatttttgtcctctcccagcgcgctatgttgcacccgcgcctcggcgcgttgtttgcatccaccattctccacgctgtgtatcttgagcacttcagcgcccaaatgcttaccaccgactccaaagcgtaccctgttaaatgacagcttttgagtaagcccttgtcctgtttctataaattcgtacgcgatgatagaacgtggacgggaataaccaagggcacaaaaggaggcaagttgcagtccgaaggcaagttgctgcagccgtccactcggagaggaaaaagggtctgcttgcgttcaaagccactcgcaggcctatcccacgccacgataacaatgcaaccgtatggttctcaacaaatcagtcattccattgaaatagggtcgggtcgagtttatatttaagtatgtggtcaaagacaaggagtggcaatgcctcattcctctctgggaacgggcgagcagggagactcgcccccttcggccctccgcttcgggtgccactttcctttgaaagcaggcgtccaaccatggcgaattttctctccatcttaaaattttctgttttcctccagtttctaggttctaaacaggtga

SEQ ID NO: 6299 - DNA, 700 bp, Nannochloropsis_gaditana
gaaacactctgcgccgtactactttgctgcactcgctgcttttcaagcataccctccaacatctcaagtgactcgatttccacgatatcagccactaaacatctttgagagactccgttctcttcatggtgaatttcttcacgttccgtttgtttggacgatgttttgttgttaagcagggtagagatcgccacatgcaggcgggcccggcactcggctaagccgcctcgccctgatagctgcagttggcacacaccaccttgataaaaccgaaaagtcgggactcgatcgatcagggggatagtggcggcattatttagagtttttagcacatcgccatgatttatgccgatggcgctgctgcttgtgggagtgctaaacgtgcacgcgagggggagccggctgagtagcagtacgagaagagggagactgaaatcttgcgtcgttcgtctcgcgctagtatcctcctcttttcttgccattactattgcctcgacaatgttgcatgcggattgcgatctgtgttgtttggactcagtttttgatgaattgctcaagacggggctatcgcggtattgcctttccttaagcacgcatatcgctcttcgcttggtctcggttgtttatccgttcctttaacctcgacacggcaagaccgtacgaagctatgcttacttattcataacgaccaaaccagatg

SEQ ID NO: 6300 - DNA, 700 bp, Nannochloropsis_gaditana
gtggacgaggccatgtttgacaagtaggaaggtgagctcaaatggtaagagacaacgtctctcacacagttcaccgtcaagtgggacgcccaggtctcgcgttccgtctaaagtgaaaacagtctttgtagggacgtgatgatgtaggaggcccggacctggtcccaaaaaatggggaagtcgcggttagatccctcaggaattaaagcaactgcttcatgatcgttatttaacctcggcacaatgctagaagacctgtgactacattgaagtcacggagtagaaaagaaacagaatcccccacgcgcacctcatccacacagtgagcaagatgcgcgcgtgataagtgcggtttcgctggcatcgggcgctaaacccaatattttggtgggatcggtcatggctttcttttcggtgtggtttcggttcgacttcagcgaggcggaggccagaccccatcggcggccacacggccaagaggggccaggataaaaacgtcctttgttcggtgtcaggtgcttcgcacaccaatcacgctgtagtctacgcgctagcacttttttttgctgtacgcgcatgctgtaacccatgagcagtcctccctttgccctgcctctgcctcctgtggtctcccgtcttacttgatcttcacttgaccgttcatgtcacactttcgccttcccgcaactttaggccgatg

SEQ ID NO: 6301 - DNA, 700 bp, Nannochloropsis_gaditana
aaaaatgcgtttcagatagcaaaggtacttgcagatgatctttactgtagttaatagaagacatgtgccctcagcgtgttctagctcccaaatcactcattaacatctcgtctcagtatggcattgatgttgatgctaataaacatccaaaccatcatatacacgacaggtttatgatactcgcttccacgatatccatcactcgtacacaaatgccaatttcggcttcccatttccttttttggatgtcttgcacggcacctaccgcaaagagtcctagaagggtcctcaggaaacgcgggatatgtctgaaaacatcactacgatacctgcttgcctggcaacatcactagtgtgccggggaataatcctcgaatggtgatataaagttaatgttaatagacgcgtaaccatattgatagacatccgatacgcttgatgattggcttttgccgtttttcagaggcgcgaaattgctctttctggtgcattttgtgtcttagaaagtgacatctctgcgacggtccgtagcacgtagcacgtatattacttctccagaaaaggaaaagaccgggaaaactgaatcgggcatgtaaagccggtgtaattaagattcgaaggaatttggcctgcgactgacgctagtcagcaagcatctatccctatcttacattacatttctatttctttccccattcag

SEQ ID NO: 6302 - DNA, 700 bp, Nannochloropsis_gaditana
ggccttgccgccgcaccatgtagcaggacgtgcacaatcgccgcagggcggttcgaagcttcatcactgcctgtctctgactgtagaggtttcatgtgcattcgtggggaatgggtaccgccacagaggacgggggtccatgagcattttgaacaaaagttagcgtaattcaaacactcgtgaagataatcactccacgagtgcggtactgcctctacggttttcgtatccataaggcagaagctaatgtttggcacgtgtgtatatgactttagacgcatgtgtatggccaaacgcctcgcggtatcaccggcaccaaggagcgggcggcgggcgagagccgggaggttgacctactctgggtgaacaaaaaatgcccaaacgccagcaataacctgtgaaatccgtccacttaaccccccttactccattgctgtcctatcaaagcttacatagctcaccagaaacgagcatagcccagtctttctttatcgatctgcgctttggtcgcgttgctccgagttgtttggggcgtcgtaagggtatgtcacatttgcttccactttctccttacgcggttgctgccttcttaattatattttggggctatcttaccttgaatgcggcactttacatagtcatctaccaatgccgctgttccgaaacggaaagctggaaaattcagacccacaataccaga

SEQ ID NO: 6303 - DNA, 700 bp, Nannochloropsis_gaditana
tcgcaacggagagaggcccttggctgtggtggttattgacgggtgtgctcggatcggctgcagctggaaagatcttggatgacgctgctctagacgcaatagtgcgtatgatgagcgccgttactgaggccttgtcccgtaggtcgcaagatcttctgacagaacggcttcttcgtttcttcttccctttccctccctcatcttctccggctgccccctttgtgcgtacctccaccagcactccctcccgctttggtattgtagatccagaccctccagacgcagcgaccttttcaattcctggattccaacccctggatccgtcttctcatcggtctcaagggcaagctgtgaccatcctgcttacagtactcaactcgctacatgtagactccacgatatttgactcattgggtctggagcaggacctgcttcccgcccttgtcaacctcactctgctagatgcagagggactgggagtggtggaacaccgcaccgagagtaccagcattgcttcggttaatgatagccgtgcccatcctccattggccagtgaagggccagcgccggcctcgtggggcgtggctctcattgccaacaaggccgcgaagcccaggttcgtggaggtctttgtcgcaccgcttttatctcaacttcggcaacgcctcgcagcggaggagagaaagagtcacagcagcac

SEQ ID NO: 6304 - DNA, 700 bp, Nannochloropsis_gaditana
taatacgatgcggcagattgggtcaagtagcacaggtcgggaacaaaacggaggtactttctctcttccacctacccttcttcaggcactccctaagagctacagcttttcggctgttagcgagaatgacgaccacatcgcctcgcctcttcggggaagcctgctcgcggtgagatggcgcagccaggacatgcagctccccactcaatgtgtacagtctacctcgcgtcatccacgtagaaaaggcggtcatgtgggtgtcccacaacgtgtcaatttcgggatctctcgctataacctcctgtcccaggctcgagcccccccctgtggctagcgaaccgcccagtgcaatcgcatgcatcctttaattcaccctcagcactttttttcttaacgaacacaattttcaggtgataggatggctagtctcacttttaattctaccgtggatggtggaggctatgaaagtacaaaagagagcatcaaagaggcatcgtcaccacccttttctacctcctcctcttttgccgaagcgctctcatcgtattgcaatgccggtgacgctgctgctgcaagtaatggagaaggggaagcagtgcctccaaatgtcacatcgccagatgccacggttgcgcatctgaacacaattctccttcacgtgcagcgaagtaagcgctttgaggatctagtagccgagatg

SEQ ID NO: 6305 - DNA, 700 bp, Nannochloropsis_gaditana
ttggtcccagcagccagtccagaaggctaatcctcccattgcctccacgtacccctcaagtaaatggcgtcagctcgggtcagctgactccgccctgcttcccgaccggtcctggtgctgataccgttcacatcaaacttaattgacgacgcaccgtcactggacgattttggaccaacatatggctctatgcacagacagaccttgggggcagcccgcagagctcttggggtttcccgccccggcgggcagcccagcacgcttgaagcttcccgatcgtcaaccttcaggcaacatggttaccaattttaagaaaaaaataagaaggagtctgcagctcctcctgcttatacctcccttatatagggttaacgggtgggtatctggcagcattcaaagcctagaacggcatcaccaccacgcgccgcgaagaagacagccgtctgccaacaaggtcctttcctctccgccaaccttgcacaatataaaggcagctgttacacccgctcccacggatggcagtcgtaatgaatatgaagatgtccgggacgatgaagacgcgactgagctccaaaaacaaataacaatagaactgaccgactgggtctcggagggggaggagctgtggcaggaagcattctcaacgccgcgcgatgagaagagacacagaggtaaatcagagccaggcgataatggcatg

SEQ ID NO: 6306 - DNA, 700 bp, Nannochloropsis_gaditana
atttaagtctttctcattggaggcgcgatcagtcacaggggcgggtgagtgcaaggaagcggaagctggttcattagccatcagtcgactaattgttgtggcaagaatggaaagtgccctgttcatgaaatttgatcgaggttagcatcacagaagtttgcatattgaaaacgcatcactcgcgcttctctcaattgcacgccttccccttcgctcgactttgttccatgcaccccgtgcttcacattgccgcaatgccctgcctttctatcctgtcctgtgctcatcgctcactatctttcgaccacactgtgaagcttgatgtcctatgaatccacggccgatggatagactagcccactttgtccatgacttgggatgatgtgagactaagcggtcaaattctcctttttctcgctgagcccagaggaacaagaacactccaggaacggctctgaggccctggactggcattttccaatttgaggaagggcgcttgtagcgtcgcgaatatccttttgattactttatgacagtacggcgacgcacattaccccgattttcttctggtggaggactgtggcgcgcccatggaggcaatcgccctgcagctgattgctgattctctctcccacccgtacgcaacaacttaacacaggcagtgtgagcaaggacaacactatcaccagctacgagaatg

SEQ ID NO: 6307 - DNA, 700 bp, Nannochloropsis_gaditana
gccccggcatgaaagattcatcatggccaaacgcaaaggcagtgccggcatcaaaaatctagtcttatgcgtggattcaatgagcgtcttgctgtaaaatgtttttcgcggtgaggtgcgacgtgaagcttcatatgttaacgagacaatattttttccctagtagtatgagtatcttgcgtcaagtacctcggagcgaagcttttcatccagtagggactgcagcccaaagggaatgcctggtaccatcctattaatctgttatttgtgcatgccttgtgacgggtaattttagtccgtgggagccgttgctagtttgtatccctgccgagttcttgggcacgacgagtcagctgttcggcttgacgtcagaaaaccggttggcccatacgagcacgtctgctaagcatgtcgtcacacacatgagtgcttggacaatccctgcgggctttttttcacttggtgggcactcaagcttttggcaaggtagagcattgtgtgaacgcattacgcatgctcgtcaatagtttttaaaaataaatgtaaggaaaatgggctatgcttattttgcatgattttggggcattctcgaagtcacttgaaattgtacagatacataataaagcgaatctgtctcaatactcagtaacgccacttttaattctcaccaccaataaaataggctccaacgttgggcatg

SEQ ID NO: 6308 - DNA, 700 bp, Nannochloropsis_gaditana
tcaatccacgctctaagcgcagagcctcttccaaggtaggatcttggcctcgctcgacacgggccagcatcacagccacaggactgggtcgcgccgcggttgctttgccccctgcactggcactgctttgctcctttagctggctggcatgtggcgtgtttgctaaaagagagctcggcgcatcctggaaaagcgtgttgacgtcgtctgcggcatcttccaacaaaaaatccaagtcggcaggacgaccggcgaccaagatcccgtccagattgcgttgcacaaattcaacacagaagcctgcgaggtccttagcgtccaaggcctcggcgtgagccaagacggaaatggcgttgcgcatatcgacctgggcggcaatggtccgctcacaaagctccttcagcgaagggttgggctgcacggcaggcacgggatggccaatctccgtgcttgatcccattacgtccgagccgtgcgagagaggcttgaaagtctccacatcatcgatctcgaagagattaccgtcagcttcgcttctggtgtcagagaacggggaagacgatcgactgtcagcttcctcttccccgtctccttcctcgcagacctttttgccagccacgagctccgatcgaacagctctgagagctgcgtgtggatgaggcaacgcaggagaagacgccaacagaagcaccacggtatg

SEQ ID NO: 6309 - DNA, 700 bp, Nannochloropsis_gaditana
atcttctggcccaccaactgctgtgttcgttctgttgccgtgccttctcgccatgccatggcgatgtacctgtgagggtgggtaagaacggggaggtgtggagtcggacggtgccatgataagtcgtcctgggcaagagaatacgcaaggacatcaagaagcgcggggcagtatgcgaatgatgacattgggattgaaaatatcttgtttggtagacaacgagcgtcgtgtccggttttccgcataccaggagggcaagtcatctgatttggcgcccggtgggcttttcgttcttcgcctgggtacgcgcagggggcggggcgaacacgaaaaagacttgaggagggaaagggcacatcaccggggaatttacatggcaaaccgtcccgccgcgaccacgcccggcgacacaatcgcttctgtgactatccttctatctatttccgtcgtttgatccaggctttttggatggccgtggacgtattggtcgagacagggaaggaccaggcagggggcgggccgggcgcaccgagaacaagagaccggctcaacacaaatggtaaaatcgttaccacgtcaacccgagacacggtaccccgccctcccgcaagggaaggcagcacacgtcttgcatgtgtggtacggatgtcactcgaacgactgaccatgtatttcaaacccgcatttgttcagagagatg

SEQ ID NO: 6310 - DNA, 700 bp, Nannochloropsis_gaditana
cgacaggaccctacgtcttcctcagtacggcattacataccggcacgttgtggaagtcgtctcttctttctacgtgaccacgcgtggtcttgaatttagctccgatcctcggcgatggggtggtcagccggtgcagcaccctctcagtctcccgacaggaccgaggccgccatggcctggaccgcctcttcggcccgagctctctccgcatgccctccctctacaccggccacggtcaggagcgagagtagcagccccaccatgagtgttccgaccccgggaagccttggaaccgccgggatccattctcatttccccccgtcccggcctccctccgagcaaattggcattgatgtgagtctacgcgagcggcctgctgcctgcgtatgcgacgtcaacgtgcagcagcatttggagcgcggtgcgatagtgcaccaagtgcacatggaacacgcatcgcttccggagtcaatagcaagccagcagcgatcgcttcaccggcaacaacaacatcagcaacaccaacagtcccagcaagagccgcagcgacgacgacagaatgtctccgagatggtacccctcaccagcaacactcctgcctactgctcctcctcctgctcctcctccgcctcctccttgtcactggacgacctcgaccagggtccaaactgcggtgccagcctggaagcggaggcccatg

SEQ ID NO: 6311 - DNA, 700 bp, Nannochloropsis_gaditana
ggccgccgacggcagccgagcggggaccgagaggttgagggcgcccgtacgtgccaggacccagaggttgttgctggtgcggcggcggctgctgctgctgcggcgattgctgataagggctttgatagtgttgtgatgacgcagggtagcctggtgccgggccagaggggcgtggaggggggggctgctgctgaaagggctgctgtggcggcatgccattcatgggcggtccccggggagccccgtaaggaggagggggcggttgagacatgtcacttgcctgtgctttgaacatggtagagccgtcgtgtaggggggaaagagattcatcaagttcaaggtcattagcatagcattgaccgtaggctcacgacgagtggagcggtttctcgcagggtcatcagatgacgggaatgggagaccaagctcacaaacgtacgaaagtccggcaacatgcattacctgattacagccactttataggaatctattttacctttgtcgactccgtaagaaccttcaaatgagagcgcttggctttgtcccccaaggtatagaacaacacttttccatgtcgctaaagaggaaggcgtttgaaacggaggccccaccaaggtcaaaggatgcgaatcaaagcccatctttccccaatacaccgccgcgcggcgggtccaaaccctcaatgctacccacatccatg

SEQ ID NO: 6312 - DNA, 700 bp, Nannochloropsis_gaditana
ttggctttgcctaaaaacaaatacggtgatttccgcccaaagacatgaaattcatagcagcttagatacactacttcatggcccttgcaaacaaagaacgcaaacattagtcgagatggcagcattctcgcacgttctccgggccgcccccctccaggctagcactgaaaacggaccggcccccgccgctggcatggagaggaatcgacctgctcgccccttttgattcgtctcccgcccaattatattaaaatgcctagaattaagttgggtcgtctgcatagttctatcacagcccactgaagtcattcagtggacatcaagatatgtcagcctcctttctgtgttgcattatttttcctgattgtaaatacttgtaagcggccaccttctccagtcaatgtccgttgagggactttttgtctttcaaaactcaaaattattcttcaatgcttgaatcgacccagcctttttttgatgctgcctcaatccgcaatagcttcaagcaaagggacgaaccaagacttttgatgtcgacatggttgtgtcaccgaccgcatacgcggcgacactgaatcgagtagtggagcaacgtgtgctttaccataagcgcctcaacgcttgacttaagtctcttctttatcggacaggcggccttgtaagattaaggcgacttgtgatacctccataaatcccgatg

SEQ ID NO: 6313 - DNA, 700 bp, Nannochloropsis_gaditana
gaggagcggagtgttcctgggcccaagcaagacaaggtcattcaccagcgtcatcacatttgaggctgccaaggccccctcagacacaatttccccgttgccattttcatagaagcgcgacggaaggaaaaaagtgacggtccgaatcaaaccctccaggggtcgcacgaacaacgcgtggtttcggacgaagctgatataggaatctactaccgtcatgacccaccgaaagtgccaagcaaaatgttgcgtgagtcggtcacgcgcccttgttgcccacggacacggggtctcttcctgctcctaatgacgtacagttttaagaagagtcagtactttgagatgttgcttgacgaaaggtcgtgcgcactcgaaggcgccaatgagacatgccgttgaatcgattgctcgatatgacgtgcaaaggccttacacgaccgcacgccttctggcatatgtcttccagaggggggaggtcgggaaggggcgagggcagaaggagagcgattcgtgtgcccacagcgcggcatgaaaacaaaaagttcacacccccacatgaacgcgattttccgttttactgcatagatttcacgatattctgtattggcgacgggaggggcctgacatgaccctcctgcgctcctgatggccgggtgtgggatagagaagtatcaagccaaaagcaggaaggagcacgatg

SEQ ID NO: 6314 - DNA, 700 bp, Nannochloropsis_gaditana
agaattgtctctgacgcaggcgtgcgattagtattggtcggtggtcgggaaaatgtaggaaaatcaactatttttctaccaaataaaactcccttgttgcggattgggcggtggggagacatctctgaaggcgatgagctcatcagacagcctttgcctgatccagaacctcctcgcagcagcttagatggcgcattcaatatcctatatacctccgggagttcgggcccatccaaaggtgtcgttggaagggaaaaaggttttgtctatcggatcggctggatgcatcaggcttttccttttatcaaagacaaggaattagtgcttcgacggacaccactcgcgtttgttgattcggtgtgggagatatggggggccctcctggcaggtgtaccgtaagtatggatttttctaaaagaactctcgataattttgtggctgcttctggcattgatgattcgtcgtcgggcggtctgacttttaggcaaactcacgagtcctattttgcaaaaaatgggaggaatggaggcctgttacaggactgagagcattcgacgtgtgtacaaacatcctgagccacaggaagcatactcagcgttatccaaaaaattgctatgccctcatttattctacctctcttataaagttctttcttgtctcccccaccagattatgtatccatttgactagtcttggaatg

SEQ ID NO: 6315 - DNA, 700 bp, Nannochloropsis_gaditana
cgtggtccagatggtggcgtgttgagatttgccgttagctcgaccgttgacgaaacgtctcgggcccaacgccccaagatactcgccccagcctccccccagcgccccgtcccccctggactctctctttttcacggtatgcatcttcggtctcgcaccacatataacagggaaaatatcaatcaagtacgcattgtaggatcttggcagcggtaaaaccggcgttttaattgatatcatcacgaaggcctccttgagccagtctttcacaacgatggcaaagtgtcctcccgatggaaccacaattgcatttttttcttccgtccatttcctcatatttgtaatgggaatatatttgaagacttctgatggatttatttgtcctcggggtggtatgcagcgattatccttgagtccctgccctcagcagcgtacggtgtttgctatgatggcaggcagaaaaccaccatggcaacgccgggggccggataagaagcaagactcggaagatgaattgtgggtccttgaacagagcttattgaatgggagttctcctcgaacatctgcctttgttccgagcatcacccctacttcaaaaacttcatcttcgacccccgaaaagactgacaatactttaaaagatacggatggaaattttgggacgcttcgagatgaagcaaatataacagcacaatttatg

SEQ ID NO: 6316 - DNA, 700 bp, Nannochloropsis_gaditana
atcgcgtcttgttttcaggttgtcgacgggataagaccctgactgtgttactcattttccccaccgcttccgcctgatacaattaatgcaaaaatacatgaataacgcggccgttcttgagccaaatctcaaatttttgaggactcacaggtccttatataaattaatgttaacactttctcctacgcatgacaccatcttatccggtgttcatgtgtgacttcacccacctggcaaaacagcatcgcagtaaggcatgcttgcagctctcagcactgttccagcattcatcgagtttcggtgcctgtcgcccttacggaattattttctgccttcatggtgctttcgccgtccgggtgggcgcatcaataaatgttctgctccgacacacgaaaattcatcttgtctcacgccacacgccacgaacatgaatgaacgcaaattttgtgatgctccttctcctataccttcatttcaagatgagtttaaagtcattctcgcgcagcagcttcgggccgtctccagtattgacacggatgttgaccgctatctgatccctcggaactttcgaaagttcattcttgaaagtttcgacatgcagacacttggaaaaaagggtgaagatactctgctgcgccgcattatgcatgcacatctttcggggccaacggatggggatcccgtgtataggcaactgatg

SEQ ID NO: 6317 - DNA, 700 bp, Nannochloropsis_gaditana
gatgacacgcggataaatggtgtctcacccatggagacacgttcccatctttgaatttgtatggtaatttaaagatatttgaaaccgcaccaacaggatggcgcagacgcctgagctttcacagcatcagcatacgtctttgacgctgtcagtaatgacaacagttctggaccagaatgaagacatcctgcttgccatttctgaaagtcagcggttgggtgaaaacgtgcgggctgcaaagtaccaacgacagctacaggagaacctcttggttttgacgcagctttgtgacagtcaagaatactacccgaagtcttttcgggaaatggccttgaaaaagctgcctcggcagaggaaaatcgctactgagatgcctgttccttccatggatgtcctacattgtgtcgacggagcaaatataacccacagacaagcccagcaacgtgtatctccgctgtgccgtcagcctcaagcctttcaggagcagcaaaaatcttgtcttggcgctagatgtgacacttcatgcaacaagtcagcactttccccgtctgtcattgatggtgatcacatttcattgcaaagattgcacacggcacaacctttaagtatgtcagacgctgctgatccgctctcgatggacaggcacaaagcacaattgactttgcaaagccagtcacttaataccggaggaggagagatg

SEQ ID NO: 6318 - DNA, 700 bp, Nannochloropsis_gaditana
aatatatgcactataagctgagtgtttccaaatcgtctcagacaccctgcccacgtaaattgccgaagtcttctccctcatcacatttcacgtatggtaacccgaattgcaatgcgcgaatttggggaggaaatgatgtctttagtcctctaccttctcaaatccaccatgagaaaaataaaaacaagtcaatggtacaaagcaagacatggcaaaagaagacaagggggagcttactcgaaaaaaaaaaggtaggaatgcttcttcgcaatgaattcccccaaccgagcgacgcgaactctccggagattggttgaagacctcgtgtccatactctcatggtgcgacggattcgcaccacctcatctacacgtatcatgaacaaattgagaaaggctgccttctcgttaaagttggggtctcccggccagggcgagggcgagaagctaatctagccgccactggcttgcacaaggagtacttactgacgcctgtcgcacgacctcgaggagctgcagccacgtgggttaaaaaaattgggaacgctcccaccaagacatgtcagagccgtatcgcatttctcattgaattcaactctcttgggcatgaacagatatttatagctgctacgccgtcgcgcacacatcagtacggtttcagtgtcgcagcatatcctccggtatccagatacatcatcatg

SEQ ID NO: 6319 - DNA, 700 bp, Nannochloropsis_gaditana
tgtcttaccctgctgaggattgtgtgggtgggagggacaagatgtgtgttccaatatgcacacacacttctttccaaatgtttgacttgcttcaccaaattacatgtttggcattcttctgaatgaatttatttccttcttatttgtagggaacaccctgcccaagatcgagacggactcggcttcgatggtgcccagaaaaaagaggaggaagtgctgcagtatacgcacagcgccactagctctttgcatgataatttatagtttactgttattgtcgctgcaactatgtgtcaaagcctattccactctgcctttgtgtggcagcggcgacaaaatcagatttgttcggcggcttcgaaaagaagggaggaagagagatatcggcatcctatgcagtccctcatgtagtactttacgagtcatgcaagtcaccatgtcctcacctgctccgtttttctctgaaagacggagagcaatcacaaccggcagcgagtcgtgtcactccgtggagcttttgactccgtctgctggtagaataagacggttccgagcagagcgtgggcgtcaattagaaaatgaacttgcacgtatcgaagctgccggcgcgagggcttgcttggacttgtacattaaagcactgcggtcttgtgccaaattaggaaaagttgacgtggctatgatgctgcttcggcagatg

SEQ ID NO: 6320 - DNA, 700 bp, Nannochloropsis_gaditana
gtccgacggggcggctgctggtggcaccataaaagctaagattcacatcgagcaaggacgggaagtagttgatcccatagtttctttaagcccgctcgctcacagacccctctctcgccaacttatcttcagtgccaccattctacccatcgacaatctcacacagataggccccgtgcgtagatatgcggcgccacgcaacttctgttgtaccagccgctgtaaataatttctcgtccgcatcattgcccaaggccaaaataagcctgtcgaggctttgcaaggattttattctgcgcatggccaccatgttaccggtaagcgaccgcaaggaaataatggcccagtggatggcacaggaaagctcaatttacacagatattgcaactgtcgaaaatcaacttttgcgcatgcgattggaggtggagacggcgaaggcttcccacgtttcggcacttcaagaagtggagcgactgaggtgagagtcgaggctggagcgattcctccgaaagccattgattttccatgacatgttgatatttattaacggcccatgtgaaatgtgaatacccagtaaatagaacacattgtactgatagctacaattcatcatcccttcagggaacgaattacgtttcaaactaagataaaacccgaggactcgagtcatcccgttctcggacaactaattgctgacatg

SEQ ID NO: 6321 - DNA, 700 bp, Nannochloropsis_gaditana
gttgcgtcaacgcgtatcgtgattgccgtctttctgacatgtgccaaggcctcgcttcttatttctgaagaataatccacttttaacatttttacgtcaaagagccataaaatcggctactttgccaaatttgaagcaacttattttggtttcctcgcctgttgtttctatctttaacggagggcctgcgcactctgtggcctacaaagaaggagcagtattacgcatccgacagaatgagaaaaccatagaggcataaatattacataaacagaaaaccatgctttaaaatgccaagttaccctggaagggctggtcaaacttccgggccctacgcggtcggggcggctgagaagatcgagcgtcctggctcgcgtccacgcattcggcgccaaggaaatggtggcgagacaccagcgcacataccactttgatatcttcccgcaggccgatgtggacgccattgggcgcggtctctgctgctctacgatgtagcgtcatcattccgtgtcctgcaaacctcaccgctccctggagcggtggacagtgctttgcggattcttttcctctgtaatcagatcctcttgcaatctttcgtgtagtggctacctccacgtacgaggcttgtctctatgcgcatatatacgccctgactttttcttccgatgacatactacatcaccttctagacgtgatcatg

SEQ ID NO: 6322 - DNA, 700 bp, Nannochloropsis_gaditana; identical to SEQ ID NO: 5878

SEQ ID NO: 6323 - DNA, 700 bp, Nannochloropsis_gaditana
cgccaacctaattccatccacaattgggaaattgtgcctgtgtacgcatgagggaggaaacgtacttgtccgataaatgctgaggccgaaaccacttcagtacttatgcgggcgaaaagcgtaagcgcactgaagagcataaaatatgacttcggtacattgtgcgtggggtcttgtggcgcacgactgagaatcccgcgacaacttacagtgtgtcagcccccgggtaatgcatccatcttgtgccgtggccgccatgggggccgagccccgacccgaactgtgttgaggactcgcatgcgggtcttccctgcgaccggatctcacgtggtcaactgttcattgtaaggctacatgccatttttatgcagccaaaactcggtgctttttcaaaattgatgtcgctccctgctctacacacataacgataggcaatattcaacgcccgctcaacccgtctgcagccgcacagcctgctatcttcttataagccaagcttatgtgcttgatctctaaatatcacagcatccctcctatttagcaaaagtttgagagtagtacattcctgctcgctcagggatttttttgaaacacgtccatattggcggatacaaaggaagaagctgggagacagcatttctgtttccttgcacggtgaagataagcatccaagaagtcacggtcttctctgtcgcacatg

SEQ ID NO: 6324 - DNA, 700 bp, Nannochloropsis_gaditana
taccaaagcgaccgtcttcgggatcgcacggagagctatcctttcccggatgagcaggataatgatattccaaatcgcccgacagcccatccattactgcgtctctcagaccagactgaagttctcatacgtaacgactcaagagtaggataccctgtcgaacagccggatgtgggaccggaaaggtaatttattgacggggaaatagtcagcaacatattatctcttaaagcaggagtacggtagtatggactgcgatcctccattggcagatggcgtttaacccatcagcaagcctggcatgtctgatccagcggtaattactcatttgatatcgactcatttcgatcactccaccacttcacgcctcagttttggttggctgttccccgcgcagcagattctattgaactatgtgctccaggaagggacaagaatagttgtgcagctcggcgcttacctgggaaaaacaacattgttcatcgcggagcatgcccctcgcgctttgatttttgtcatcgatccctgggacaatgccgcactcaaagctgagccgtctttgaacaaaaattttgccaacatcgaccttttcgagcgcattcctttctatgccactttcctccggaacacttggcatttagcggcacggcgtggatcgaacaaagacaatcttctcgttggtgttgtaccattacgcatg

SEQ ID NO: 6325 - DNA, 700 bp, Nannochloropsis_gaditana; identical to SEQ ID NO: 5880

SEQ ID NO: 6326 - DNA, 700 bp, Nannochloropsis_gaditana
agttaacacatcagactcgtttctggtgctgtccaacagcgtaggtcatccttcttcctgcggttttccctccgccaaacagatgcgcaacaatggtctcgaaagtagatgcttcgctcggcagaagctgggccacctgacaaattcacgttatcagtgttacctgacgtgtatacgcgagcacgtcttgggatgttcactagtcgaaaccttccatcttcaggggcaaggggaagacgaccatgcttgcccaacttcctcccgacagaccttcaagaataaaatggaagtgacatttgatcgtgcaagcatagaaaatatattcatcacacgtcccatccactgtcaattagcaccaaaggaaagggtctcactacacatcccgttacgctgcatagtagcattaaatccacaggggacagggtgagaggcactgcacggtcaaaaaagaatgagccatatccttcatcatagagtacgcatccgtgcgtggtcgtcatcgcttggaacatttttaacgaccccaacggggcgttgtggcagctgggaagcgaggaacgtcaggaccacttaccatgacgagagatatggcctgggtggctctggaaggagaacgcttacaaatagcacagatgtatctggggagcattatattagcgttgataagcgaggcctctatgaagaagtgacgcgagctatg

SEQ ID NO: 6327 - DNA, 700 bp, Nannochloropsis_gaditana
ctgagccacatttgcgcggagggacaggtttcagaaaaaattatgagaatagagagaaaaattctttctttgaaactttagcacaacgtctcaagagctggggggtatctcgagacaacaagctcccccatgtgcagttaaaaaagtaaatgaagacagccagggatggatagcgcgtttccttgtctaagacgagtagctgaggccctttccggacgagggaaatccctgttcatctctccgagtgatcgctcattgctaaaaatggcgcgaacgctcctagtggcggcttcttagaaggcgtggcccagtggtcacatgccagggcgtgacgccggcgcccgggcctgcgtccgcgatgcaatgtagagtgcgtacccgtcagccatgaatctatgctgaacttgcttcacaaattaagtgccacttttcttcaattggggcaacgtggcgccagcccatggaggacagccttctctcgctcgcttgtgactcgtaggatgagtagtggagcgacgcggcgggcaagagaacgcaatgatctagttaataaataggcaatggggactttcctgcatgccatttcgaatctgtagtctcgagcttccgaagacttctgatgttaccatgcgggatgaatgatatccaaatgtcgactcaagctgttcttatcatggacacattttacaggaacataatg

SEQ ID NO: 6328 - DNA, 700 bp, Nannochloropsis_gaditana
ccagacgtcctcctgcctaccctgttgccgtacttgtacgcgaagctgcagcaggggtcggtgtgggaacgggaagcgtgcatcctcgcccttggggcggtggcctcctgtatggagggcatgggcgagcagctcttgcagctcttccctttcctcctgcagcagcttgacgataaggcggggatggcgaccaacccgcagctgggatgcacggtggcttggaccctggggcggtacgcggggtggatcctggagcagcacaacgacagcggctttctggccccactcgtggagcgcctcttgggggccatgctcgatccgcacaagaaggtgcagcaagcagcctgctcggcgctggcctcgctggaggaagatgcaggactgcgtctcctcccgtacttgtcgcacctcttgggtttcatgagccaagctctcggccgctaccagacgcgctccctcatcgtcctcttcgacacgctggggacactggccgacgccgtcaagcacgagctggcggcgccggagtacactgccttgtttatgcccgctctgtgggccaaatgggccgccgtggcggactcggatcgcgtcttgctctatttgatggagtgcatgacatcgctggccgtcgccctcggcccggcctttcagccctgggcgtcagaggctttcgcccgttgcctgcgcctcctgcaacaag

SEQ ID NO: 6329 - DNA, 700 bp, Nannochloropsis_gaditana
ttggagcatatggctacgttggggttgtcatggctctgaagtgctactccacgcaaggctacagattgcgttcgtgaaaagaatgaacacacgtgctcagcaaatacaatcatgcttagttcggacgagattcatacaaattggagtttctttccacgaaggagatgagaggtaaagacggcgcggccagtccttcctagcaaacatgacagggtcacgcatgagccccaaccaagcacgacttcttccacgccccccctcacaatacgcctaccgcgccgacaccattcttcccagccctttcgcgaacggcccgccaccgaagcttgcactctttctttttacctcgcgcgagtgcgggcttcaggcatgaagggaaagagagaccgcacgatgccgtcggggtggaaaaggggggggtgttcgggaccggcgagggcatagggcctagggcgggagcgagcaagagaaagctttcccttggaagacatgctcagggtacacacatcactgagaacactgcatactcccgcatactgattgtacaggtcaccgccatggtctggcaggaagagtggttactctgagggcacggcggccaagcgacctcctcccctcccagcccctgcccctatcccgcgccggctccgccctcagtgccccggcacttttggtgacttaggcgggcgcaaacaagatg

SEQ ID NO: 6330 - DNA, 700 bp, Nannochloropsis_gaditana
gagtaaccagattgggcgcgacccacagggggagccattggacggcccaattccagaagtgattgagcacacgatccaggaatgtcgaggacccggagacatacctgtaagtggccacgccttctaatgctagctctgagagaacccaccttggggtacgtttccaaagtgtgcaccaagaaatgtgacaaaagtgcatgaatacacgcctcgggggtcgaatcccgagccgctcccgcaacaacaaagtctctccaactctgtctccctccctacgaagccagtacgcgggggacggcagataacacgcaacccccaaccactttcatgtcctacctgctgccgccccccgtccgctcagtcggaggctggactccattgtgcgggcagacactttcgcgcatggcaccctcggctgccctcgacccgtgccggctctcgtttaggccttaagcgtcgtccaggggtgttgctacggagtagggatgggtaggaatgggggcgatgagcacgcgagcagaccgctcctgtcgctggcgttcgagtccagctgaaggcgagcggcaggcattaaatcgtatgttcccggcgttgcggctcgtcggacattggattcaccgctgtagttgattcgcagctcacacatatacatttgaacagacaaataaaaggctgccatcattcgttgcagccttcgatg

SEQ ID NO: 6331 - DNA, 700 bp, Nannochloropsis_gaditana; identical to SEQ ID NO: 5219

SEQ ID NO: 6332 - DNA, 700 bp, Nannochloropsis_gaditana
gccgagtctcttaggacaagccaatccttacttggggcccggggtcgtgttgatcgctcaagcatcgaggcgcacatgccacatgctaatccgaacaccctgggaaccaaaagaatggttataggcaaaggccgcgttcctgcctcgaccggcaccgggagacatgagagatgagccagcctcgggcccccaacccctccatgtcccgcatcttgccttcagtcattctccctacctccgtctcaccaatccattcacttccccgacaacgactgtaaatgcggtggctggcggattggcggcgcgcccctgagcttgcgcggcactaacagagaggaagggcattccacgcatggtgccctctcgcacgccccgcctcgcctcgggtccgccggtctccctgtgctgccgccatcccagcgcgaccgcttttgtccacctttttgtcgctcacaatagaaatcctgtgtcttcagcatgtaaatgtgcactaaccaatctgtttctgctcgtctgtgaggcctaggcaaggtgtagtcgcccattacagcggggcagacttccatccactaacctcttcccccctcggccctaccttgtgttctttttattttccccgacctcaggcctctttaggaggagctgagcggttgtattgtaatttcacgctgtgcctttgttatctcgagacattaccatg

SEQ ID NO: 6333 - DNA, 700 bp, Nannochloropsis_gaditana
gcggcgctatagaggaacgaagccatctgaaggcacatatactggattgtaccaccggaaaataatgatagagcatcttaaacttgtacagagtcacttcaagatgtttcaggcacaaacggtggcttatcatggactcttggacatgcaaagcttcttgcagaacaagcaccagcagggaacatgcggtcgttcgcctttgagtacagaatataagctacgccttctagagtttgagctagctgagcgagaagatacattgcgaaaagacactttcaaaacaaatttgctttcatgcgttgacaaggatggatgtctgatggacttggcaacagtagttcagccgtacctacaacttctgatcaagtcagtgtcccgtcggtgttggagagagcaggccttgctggtcttgatcttacggcgtacaggtcttgctttgaagaagagacggaagtactccttggttctggaaaagttggttcgctggggaggcctcgaagttctcaaagccgtcgtgaacggatgcctccagcaccagcagcactctcaggagcgagcgaacaggaatgcgccgttgggagatccaggaacgctatctaaagaagtagttgaaagagcggtgtcagagctattggttgccaccttaaaagcactagtcctccttcccgtcgacatcgaggctgtgaaagactccaacatg

SEQ ID NO: 6334 - DNA, 700 bp, Nannochloropsis_gaditana
gagaagcacggtgtgagaaaggactctatgaggacagggagcgtaggagccgtagagaggaagttcaaaaattgctatggaaattttgaggtgattatttagagacgaaaccaatgttaggtcagattaaggatgcagaagccaaggcatgtttgtccgagaccgtcaccgagctgtgaaagcttcggagagagcatcttggggcatcatttcccttatttattcgaagcatatgcaatccaacagtatgcatgtacagcggttaacaagtagaattaggcgaggaacaaagttaggaatataccctcatgagaacagaatatgaaagacatcgaatatatgtcgatcaaagctttactggcggcgagggtcagatgcgtgcaaatatcgttccaaaataaggtaaatcacaattgtcagctttgagaagaatcacataaatagtaacgatcaataaatggggccgagcgcgcgaatgtatggccatatttcccagattcttgcccgacgggtcgagggggtaaccggggccaagcgagttgcgtttttgggcagatacccggaagtacggactgttggcgcgagcgaggaggacgacggggtcgctgggactgaatcaaaaaagttgctttgttcctagaaatgcggactggcgaccgattttcactctcttaccctcgtgggctcctgcacagctatg

SEQ ID NO: 6335 - DNA, 700 bp, Nannochloropsis_gaditana
ggcatcgcctcctcgcccacgctgtgagagactgatatcctgagctcgatagcggccccactaccctccttcaccggactggcagggccacgccatggtcttagctacacactttgtcagtatgcgcaaacatatgggcatgcaagggccaacagggcatcccattcgccttgatcgctcacataaaagtgtctcgcccgtccccctctcactgctgccacacaccttgcaggggccgagggagctcagcgcttgcgtacccccttcctagccccattaaacttcacacacgggggcggagacctgacttctggaccagcatagccatgagtccaacctttcgcagaagacattcaaatgctcccttcaaattgcagatatttatggtcaaattgttggcggtggtcgccctcctcggatgttgctgtcttcatggcgttgcttccgggactcccccgcatgccgcatttgttccgagagcaagtacgaaaagcttgggtaataggctcgcaaaagccccacaagcaagacgagagcaggtaagggccatggcattggtatcattggacggatcgtgagagaacccagactgctctctgctaggagtacatcgttttatctcctcccttgacccatttcttcacatccatattcatattttacccgtcccacctgttttggatgaatacagacaataatg

SEQ ID NO: 6336 - DNA, 700 bp, Nannochloropsis_gaditana
gcgtctacccttcttccctgtagcctgtggactgtcctgattttgtagtatttgggggacaattttggatcgaacaaagacagaatgtatgtgcaagacgggcagatgtgcattcaacctcgatctgatcgtctgcatccacccctgccctaggatatgtcacttcacacttgccagctggaactaaaaagcattttagtgcccgtgaagcatttacacgaaaaggcagggcaacctcgcggagcgtgatacatttggcatcctgtatgtctgtgaaggccttcataccgtggcgtcgctcaaagaaaggattgagacggggtgagaatttgccgccgagaccaaagatcgaccaaccggcgagctcttatttactaatgcataagtcacaacggacaattgaaagggctcatcacggagctagagcaacgacaggaggtcattttactgcacattcatcgtttgaaaggcttgtccgacgtataaggatccatcaaatgataatttgccctgggaatctcggtctcgcctaccccccttagcgcgtaacctaatacttttgacacttttgtacaggcattcatcgacgacaattaattattgcacaacgtgaaatattaagaaatttgagtgtccttctgatttacggggttctaccgtggtataggtcccgtgatcttctaattggggcagccacatg

SEQ ID NO: 6337 - DNA, 700 bp, Nannochloropsis_gaditana
cgctgagaaggagcacgaaatcgagcatctggaagcggcggtgagacaagcggcgcaggaccgcaagtatatagaatgtgaccgactccagcagcaagttgaggatgctcgtcaatcgttacaagccataagagaacaggaaaagcgagcggcagtagaggccggggcctctctgagtgtggacaagcaggaatcgcttgaaggaaagaaaagcaaaaagagccgctcggccctggaagtagacatcagcactcttaagaaggagttggccttgaaactggcggccaaagagttcgcgcggtgtgaaagcctccaaaaagagcttgacctattggaggccgagctttctgctcttccaaccttgagccaactcgagggtcgctcggcagatctaaaaacggaaattcagaagctgctggctgccaaaaagttcgtggcttgcgaaccgttacaatcggaagtcgatggaatccaggaagagattcgtgaattgcgggccgccatgccgcaggaagccgttgaggtcctatcatccgcgcgtgctgctccttcctcagcggtgtcatcgcccgcgcgctccattgccagcactatatcccctgccaagttctctccgagcaagtctgtctctggccgaaaactttcatcgatgagtttcacgaccccaaccacgtcgactgggaggtcccagcaaatacgc

SEQ ID NO: 6338 - DNA, 700 bp, Nannochloropsis_gaditana
aaaagctacggcctgcttcgagaatcgcaatcactagattagatcggtgccttatccaagtacattgactttgagaattggtacagcataatggtggattgatgttgggcaaggtccacggttgagaggatgaaacaagatgaattcttatcattttcaaaattttgaatttttgaacgacaggcggaagaagcgaacggcaggaacccgggcagacaatcgacttgtgccggtaggttatgtctcacctttacctcagtgacaggtgaagctgtccattgtcacgacctcttggtggattcaaagactttatgacgatgttttcgaggattatgcagagataaggcagcacggatgctgaatttaccgggatatagaccgtttaacaaggacatgtcgatacattcgtatgtgcatgaaaggagctcagaggcgggagatccacaagagtaaaaaacgaaatcttatccttttacttattaatacaaagtattcatgattcactcgctacaattagcgttctcgcaaagcatatgctgttagtaagacaatgtctgtcggtattcttgttcgtttggtaccccataccattctcctgcccctttaagacagggttcgacgacgggaataccacaacaaggacattactctaaagatattgatagcgccatagtggatctggacggctgcatgaatcatg

SEQ ID NO: 6339 - DNA, 700 bp, Nannochloropsis_gaditana
tcttctttgttgccaccacatttgatattcaggggcgtgctggatatctacggcttcgaggccttcgagcacaactcgttcgagcagcttctcatcaactttgccaacgagacgcttcaaaaccagttcaatcggcacatcttcgagatggagcaggaggactacgagcgggaagggatcgattggagctacgtctctttcaacgacaaccaaccgtgcttggcactgctcgactctcggtattaccgggaagccggggctccggaaggggaggctgcaggaggggccgtggctgccacaggaggaaaaacgggggcttcctgcttgttcaacattttggacgacgtcaagagtgtgggcgggggcccacgcaaagcggacgcccgcttcctatcggcgttgcacacaacgttcgcaggaaaaagcgaagcgtacgtgcggcctcgcttgcactccgacgtgtgcttcggggtcaagcactacgccggcctcgtcttgtacgaggtcgacggctttgtggagcggaatgtggagaacctgcaccagaatgtgcgggccttggcattatccagcaccgatccgctcattcgtgacgacattctgttggacgtaaaactctttgaagagcggtcgcacaggaaaaagggaggcgctggcgctggaccggggagcgcgggacgaggggggaaaggagggggtt

SEQ ID NO: 6340 - DNA, 700 bp, Nannochloropsis_gaditana
atggcgattgaggatgtggtggtagacatgtacggctgcaacgtgcctttttttctacgcgccaagccgtctcggtttccaagagggccacttggaatttccacattggtgtcaggcttgcactctcaacaaccactttcccgctgccacggggttccaactacgtccatatggaagacatgacgtgacctttccgagtcggtgtcgggctcatgcaaggccttttaaactcagaatattggaactcgtccattttacgtcatacaggagagcgaattgatccaagcgattgtagcgcgcagcacgcgggcgaggataaaaaatcctgcgtgccagatattggcagcagctcactacttgaattggtcattcagaccaaggcacacgcgaggtaggtccatttataggtcaaacctcgtgccatgtggcgtgataatgagctgggatggcgtgtccatcgagcagcaaccagcaaagggagcttctgatgccgccaaaaccgtcctcgcattttttggactgtaactaagataaaatcatatgatactgttgttcagtgaatctttttggcggcaagcaggcgaagtcgttgtcagaccttgccatgagttggcgctttgatatctacgtgacgcaaagcggtagtattcactctcctcctttccttcctccttctccgatcgcgttacagtcgggcatg

SEQ ID NO: 6341 - DNA, 700 bp, Nannochloropsis_gaditana
aaagatccctggccaggaggtcaggttgaatcaaaaactgaatggatactagcgtcccaatgtctgtctcttcttagtgtcttatgtccaatgctttggctcttcagacatttttgtctcacaccgggccataaacatgaaatatctcgtatccggtcatcggcgtctgaccgatcccgaagtcgtcggagattgcttttgccacgactgaaacgctaaaaagcacgtggccttcgaatcacgggggcagaagtttgcacacccacacacgcggagagccagcaaacattcccaaccataagtaacccgaaaaatctcgtcaaacaagtctgtccatgttgttgaagaagcaagtgcagcatgttgacgtagaaacggtgtactcgcaagtagggctgtggatatatcggtttccgacctgctgtctcgtgctgtccaccgggagtcacgcgctcattccggaggcccccgcgggaggacgggggtaatttttaaataccactaccttgtcattacgctatcgtatcgactgaatttgtcgtgtttatgaacaatatgatggctgtagctcgcaaggcttgtcttggatgcgaggggacggcttcgaccaagattcaagcagccttcctccccccacccgcctcgtccgcaggcgtacttcaccttctcactccccctcacgaaccctttaacagccatg

SEQ ID NO: 6342 - DNA, 700 bp, Nannochloropsis_gaditana
tccaaacaagcagcggaggtgtatatttgttcctgtcgaagtggtggtaatgcatgtatgatatcgcaccgcatcgaaagtcaccatctctagtcttggatggaacaattgcccacttcaagctcagacttgatacgcactgccaacctcctccctctctgctgctagctggcccgtctgcccggaaaaatgaattgcaaagaatcgctagtgtcgattgtacgagtgtgtgagcacatgccactggctatcatgcatggagaggctttgctggtcatggtgcaagcgagatggagagctttcttgtcagcctcttcccttgcatttcacgttgctctcacctcaaaaagtaaattgcgcgcaatgaggatcactctcaaccacagtcatgaaaatgtcggtccgaaatttaagaccatgacatttaccccgtgctttgcgcttcatttgattgtgatttgtgtcgtgattcgacacgtttaagtgcagtcctttcagcagagggccgcacagcttatcctctacttcctttttcaactttcacactccatcatcctactcgtcgtcctctccaaaatctaagtccgcatcgaaatttaatccatcctccatacctcccgcaccctttcggggggtgaaatacccccctcggtcccctcccgtccttctcccctcgctcccccccccctggttcttccaa

SEQ ID NO: 6343 - DNA, 700 bp, Nannochloropsis_gaditana
gcggccttcttttttcgttttctcttcgtcttcatcacctctgtcgagagtgtcgttagcatgtgaaaccaagttgggaagaagttgacgtcttatcgttgaagtgctgagagcacgtcccggaactcttagctctccccctctccctttccaacgccttaccgttagcgtcgctggtagaggaggagaggtagcgttttaaaatgtcggctttcgacttgataccgggtgctgacatgcctgtaaatcccaaatcacctactttatgggttactcgtatatcgaagctttgcacacccgtcctttttgccactggtcgagcgtcggatgaaatgacaccgcgattgagacaactatgaggtgatgtacataattaataaattgtgcaacatgcattagtccatgtcttaactttgaaggacacaaatgatgtgctccgctgcattctttccctcttgtgtgcctgtggcatcgcctcctcgcccacgctgtgagagactgatatcctgagctcgatagcggccccactaccctccttcaccggactggcagggccacgccatggtcttagctacacactttgtcagtatgcgcaaacatatgggcatgcaagggccaacagggcatcccattcgccttgatcgctcacataaaagtgtctcgcccgtccccctctcactgctgccacacaccttgcagg

SEQ ID NO: 6344 - DNA, 700 bp, Nannochloropsis_gaditana
acagtgacaaaaaaattagcgagtagcaacgacatctcctcgaaatatgtccccaggcccatctctggacatggttaggacagtgcggcgggtagcccgtgacattctcctccacaggccaccgcatgtgtaaatgggagagaaaaagagaggcggcgcacaagcggcgtggccagctcggtgttggcgccttttcggtcacaggacttaaggtggggactgctccctcccaccctgaggccactctcgaaacctcttagatgaaaccaggggcatgcgcgacgcattcggtgcaccaaatgaaacatgtcaagtggtaagtgagaaatgggcgatgtgaaacttcttctcatggaattgtcaggagctggagccgagggcaacttacaaaagggatgagagagttgatcgcttgtttgctgatttgataccgcccatccctcttactgtggttagagctcctgttgaatttgttccaaacaacggtctgctttattgtaaattgtttcacacaactgggtatagtagcgattatgccgctccctggatgagtgtgtttgcctcatccccgcctgtttcccttccgcgcaatcgatcccttcatctgcatgaagattttctagacgcacgacttacgattcattcatctgttcatattatgatacagcgcaactttaatcgcttctatacagtcatcatg

SEQ ID NO: 6345 - DNA, 700 bp, Nannochloropsis_gaditana
ctcccacgccagtagcggaatatccatttattacacaaagtaaagccaatacttatcatgtaccacgacaagacatacttgcaaattcgagcataattgagaaaagggtgccaggggtgcgactcaatgcgaacaagcctctgcaaagcctctgcggccaatagtagcacaaaggaaagaccagcaggaataaggagctcaagtggaagtgccggcatagatgcttgcgtacaatgccagcatagggaaagcagaaggccgccacaaatcgctactccgtgagtttccggtcgtactggtcttctaccgcgtgtgaacaaaggaaacagcctaagtgcgaatcctaccgcacgaaagcttgctatatcatgaagattccaatttcctacctgtacaagagagtatcgaaggagacgaaacgcagtggacagcgtgaataaagtgtctccttggccctggccgtcatcgccgaggctggcaacggctagcgggtccgaccccgtttacagatctcgtgcactagctagtcggatggcaggttggagctcctggcacgacacctgctggcagagcatccaaccgtaaattgactctcgaaaggattgtactaccgtcttcatcgaacctgtcgctcattcccgaagctgtcggcacactttacaggcactctatagtccaagctgtccttgactggcgtatg

SEQ ID NO: 6346 - DNA, 700 bp, Nannochloropsis_gaditana
gagtgatgacccatttcgtcgtctctgtgtaacagctctttcagcgcatccacgtatcccggatttcgcccgctttgaatgaagttggcaaagatttcacgatgctcatcggggctcagcaaagtgtgcccggcacggataaggcgaactgctgccgcatttctgtgtggcgcgacgggatgaccagcatgaagaggtggaggaggtggagaaggtgacgcatgacagaacataactttgtcaatggcgtatgcaattatgcctgccaatgataaaaaaatgagtcgagatgcaaagaaaaggctgaatgccagtcccttgtgagaaaccccttacaatcaacacatacttcacgtcttctcccaagtatcaagctgctagacttccctcccaaccatcatgctgaatcgagccgcgcgccacgaagcagaaagacctcttcaagcccaacaaacactaaagtacagctagcgcgcggggccgctcaggccttcggctcgtagcgagatcgcagaacacgggaggcacttgaaggagggcagaaaggcattttaagggcgccacgggggaacttgctactcggggcacttgaagaggagtcggcggagtgggagaaagggcgagggtctggcgaggctcaaccggacctgtatcttccctcaccgcccccactcatgcacaggtcctctccaccaatatg

SEQ ID NO: 6347 - DNA, 700 bp, Nannochloropsis_gaditana
accgggaatggataggaggttgtcaatttagctactgctccgagtcatagctgtccataggagacaattgaaggaaagggcttcacgatggatgttttcctcatcgactgcaattgaacaagaagccttgtcttgagacatattcttttgaacggtcaggacctacgtgcgagatgctgagtcgatggacttgaaagaacaaaagcggattgtggcacgctctgatcgctcatgctacggcggtcgtcaggtactaccttgtgtgctggaaagagggtcctcgctttattcatcgaccaagcggctatcgaatttgcctatgacagaatcttacttaacacagataaacatggcattttggaagcctgggacggcagctcctcaacttggtttggagcggccaactggattgtcggaaaccgaggctggagacacaatagggtataatcctcactacagattgcctttcaagcagcaaaaacttttattgcccatcgcgcgggccagagagaatatcctatatgcactagagcgctacaagaccgtggtgcttgttggagaaacgggctctgggaagtcgactcaagtcccgcagtacctacacgagagcggatggacgcagggagacagagtggtgctttgcacgcagccccgacgggtagccgccatcacagtggctgcacgggttgcagaagaaatg

SEQ ID NO: 6348 - DNA, 700 bp, Nannochloropsis_gaditana
taggctcttatgccgcatggtgctgggggagacaacagcttctgcaactcacatgaatgtggtacctcaagtagcagacaatatatcaccaactgtacaagatccacaacggcagaatggacaaccccagcagcatcaccacaaacaccaacaccagccgaagccgccagagcagtcgcacaggcagcggcggaaagcaaaagaagagcgaaggaaagtagccggcctcacgaccgtggggacaaagaagggccatgagcagccatatggaacgtcgcggatgcattcgagcacgaagtatcaccagcgtaaaggccttgtagtccgagtctaccaggaagctcagcgcgaggcacgtagtggccgattggagaaagcggaggagctttttagacgttgcttgacgatggacaggaaagatggacgcagttggcttcaattggcgcagcttgctagccgtcggggacgacaagaagaggccaggtcgtactttgcgcagggagtttccgaatgcccggagagtgttcacctgctacagtcatgggctatgttagagcacaaagctggcgatctcgagaaagcatgtgagcttttcgagaaaggcatggcacaagatcctgggaatccatatatagcacatgcttggggccaactggagcggaaacgggccgatcacgacaaagcgcggacattgtatatg

SEQ ID NO: 6349 - DNA, 700 bp, Nannochloropsis_gaditana
ggacaagcccctcccgaggccaaaattgggacaagtagcttgaatgtacaaagcgccgccgaattccgattgcgcggcagcgaaaggaaaattttgctcctattttaccagcgtcattccatcattaacgatctgaaatgtcgtttgaccgttcgcacataaatttgagtaagccacgattagcggagtactcaacagaatgggccgcggactccacgcgacagccgcgctcttgtctaccgcgcttcgccttcgagacgttgggcaccagatcctgtccaagacgtgatttagaaagggttccgtgagaagcactgtctttaaatcttccgttaagcactccggttgcaggactggtctactgactgtagaagccatcgcaggcggggctcagtgcctgtactgatctcttcgctctcccgaggtcgcttctttcaccgggaagcttcatctcgtatcactcatcaagctttctttgctctttttctgagacaacagcctctcacatgtgatctttttcacgaggtttttagacgatgtttctcgaactcgtcaccaaacaccaagtgtcaggggcatagcgagtatcggggactcttgatgtcgcctacctgacttcactcgctatgttccatcgtcaggttctcagctccttgtaccccttttcccgcatttcacgaaacaaagaggaaggactatg

SEQ ID NO: 6350 - DNA, 700 bp, Nannochloropsis_gaditana
aaaatgctgtactccactttctgccacttacaggtgcgctcagtactcatcttgacggtgacagcaatatgaaggtcgaggacttgcgattcctgtaaattttgcacatcgtaggatttgaatgagggcgctacactggtgagaaagcctcacttttgagacgacacagacaaaggacttcgacagagagacactccctaccgtcgttccgccgctcgctcgcgtgtgcggctgcgagcgagtttccccgtcgccgagacccgggcccttttgaactggcagagccctgccctctcacgcaaaaatgccttcacctgtaggggtcttaggcttgagcacaaggacgtgcacggaagccctcgagtgcctattcagatcctccatgcaaccatctgcgtactgctttggttgtgacggccgttccagtcggaagcttgatttgtgaggaccgatttgtgggctctttgaaaaagacaccttccgatggacgccaaacgggacaagggcaagtgcagtacagccatgttcttgccagcatggtgcagtcaggactatcactgtatttcggaagttccgagtgtcggacgttcagcgcactctcgacatcacattgacaaattactccataatgctcatctttgtcatcgcacatagagacagagaacacaaagcagggcatttggcaaactttgtcatcatg

SEQ ID NO: 6351 - DNA, 700 bp, Nannochloropsis_gaditana
ttggctcaacccgctcgaatgatactcacgggcgaaatgtggattcaggagcgtgccgggaagtaagtaaggtcgcgtcgtaaagcaaagggagcttgaagggaaaggggcggaaacggtcatggcgctggcacgttctgggcccgcccttcccgagtttgtggcagccatgccctcgcccctcacccactaccacgcttcccacgttcacttcctccttccgcttccccgtactcatgtggccgaccagcaagctattggggagcagtgtgggagtatagctgctgcgagcgtgacaagaggtcgtaattcaattcgggggctgcctcgtggctcgctccgctccctcgtggctgcaggagcgaggttgcacattgcccgacagtgacgactgtctgtgcatttcctgtgaagtcatgtagtccaaacctgcacataactgataccacaattggaaggcacacattaccttttccatactgagaagaagttcctaaatgtgtcgctagaatgtgttgatgcgggtccaacacgccaccacaactgatcttttcagccactccttgtgaatgctcaccaagcttgccttgcgtgtttcggctcgtcctttcaaacgaagaacttgaccatttgactcactcatatcgaccatgtctctttatatatctacagggagtggtgtcagatttaattgaccatg

SEQ ID NO: 6352 - DNA, 700 bp, Nannochloropsis_gaditana
tcctcgttcccactttacctctcacccttctagctgggcctgctagccttggaggcttttattcaagccccataaatgctgttctgaacatttttctcccaactttctcctccttgtcctcgcctcatttatctgatgctctgtacaagcggatcggaacggagggggctgtcaagtcttcggagcgcagcctgctgggtttacgggacaggaaaggctcctccgtgtatcgaaaacacgcgaaggtatgcgcggatcattttaccgtcgatggaggtgacctgtcggcgacgtacacagcatgttgctgtcgcaactctttctttcatctcaatctcgtctcgtagcttcctgacccttcctacctcccctcgctccaacacaggaaacagctcacccgtgtccttgtctcaccacttgccctttgagcctcacagtacatgtcatgaaggctgttctaggctgcgtcagttctttgtacgtaacggcggcctttttgggtcctcaataccgacaagtaccgtccttctctaacggactcaacacctggatgagaggtagacggcagctgatcgtctcggctgcagacggcaccagcggatcaacgtctctcgaacgagagactttacgctttttgaaccctgacatagttgaaaacttggctaatcagtatggcactccaacctatatctacgacatg

SEQ ID NO: 6353 - DNA, 700 bp, Nannochloropsis_gaditana
tatttcgtaattaaagagctgtatggcttcagcaatgttcgttattcatttcataataaattattcgttactcgctccatccgctttggctttctcacgtgaactgtgaccttcagtgcgcactttcccaaaatgttcaggcagacaatcaatgtccgctggggtttcgcctacgaaatactttacacatcacttgaatatacgttttaaaaaatgtttgcaacctattggggggggaagtttttggagtcattgaggcaccaccaacgactcggacttcgccttttccacctcatcgccccttttttatggagtcgacgacgaggggacattacgacttataagtttcagaaggctgcacggtgctaatgtgtacattaaggtcacagctgaataatctcgtgcaaatatgacttgccgccggaaatcggaaagtcaagtcctgatgcagactcaaaagcagacaggtttcgaaagcggagaaagatacgatcggagggccctcggtcgcgtactcgagctgtcctgatcctgatttgcgcaaagtataagaaacaatcgattttttttaaagaatactaacctgacgtgctcgtcgattgctcccgcaggcaaccacgtcggtgatgtcacggctgccgacctacgcgttgatgacgtgcctgctcttcctccacaggtcaggtgctcaagtaacatg

SEQ ID NO: 6354 - DNA, 700 bp, Nannochloropsis_gaditana
tcccatcgccgcagtttacacatgcgttccgtataagagattgcagtagtgagactgtcaactcctccaagtcttccccaatttccggtgcctcaccaagtagttctcgcacggccgggtggagcaaacccatccgtttcgactgatgaaggcgggcgaacgttgacaatcaattccacgtcacgatttagtacttttaagctgttcagataagacagtacactaaatgacgcacgggagaagtaaaatgtagccctagtgtgtaggaagaatccatgaagaagacttgaagcggcagactctgtgggacgcgtacgcaagcattgagctaacagcaggctccctcatcgtttgacgcgaacacttcgcattccatgttccgaacgcagcttacagtaaaccattttttattaagatcactttcctgcaatgcttcattgtgaaactaaagaaggccaaaaataagtaaaactaaagaaggccaaaaattagtgcgatttctggtgtctgaagcacccccaaccaatgtccactcaagggccccctggaggaagagtcttcttagcctcatagagaacttcttatctttaaattacaaaatagcataggtttacttcctttcagtgtaccttttttgagacgtgatctatactacacccaagagaaaagctcacatatttgatgtccgctgtccatcatg

SEQ ID NO: 6355 - DNA, 631 bp, Nannochloropsis_gaditana
ccactagcccctcctgcccgaaacgaaacattagctccctatcaagattgagggccttcctatcgattacaagagccctgaggcctgaacactctgtcttgtcacttaaaacatttacccgttccttctcatcccgttcggctccccgcgcacacgactcaatttgccaccacttatcctcgtcgtcttcctctttcgaagcgtcattccgttttgcttttggcttgagtagggctactggccgtagctcatgagaaaatctgccaacctcatcgatattttcgtcgtttccttttcccgcctctatgctgtcgtcctcctcgtcgctgctcccgatcaagacgtcaaagcctccccggcagcctcccacgggactgtccgcgtcctccgcaacctccgcgtccacgccatccgccaagcccaggttagatattctaagcgcttttaaatgtcgggcactcattatcctacgtgtgtcttttagaagatatactggtcaggcctttgtacgagcatagcgaggagatggtgaatgccgcctgcgtcgttcaacaggcaacggcgagcgaggaggtaaatgcattgctttctcacattgcacgtcaacaaccgtgacagtcggtcaaccatg

SEQ ID NO: 6356 - DNA, 700 bp, Nannochloropsis_gaditana
ctgatgtcgatatacctggtagatcgtgatgaatgggatcattaattttgatagaaatgtcttctgttgcgcaaaagcaagcgcacacatgtatgttctctcaattgaagccagatacggtcaacccaggatagtagaggaatgggccgatgcttggacgcgcttacgacgatgcctgtttgtcgatctggctttgggcttctccagcactccaaagaaatttgccttttgcataggcttacatcctagcagacctctgacctcccctcatcttaagacagcgggcaggcgcgtttgaggggggtgagccgccgaccggcgtgacgccacttgcccatacgccgctcttagagcaagcgacgaatacgaaaatagcaatttttttattttgaagcgacaaaactcaatgcatccgctgggctgtatcaattgtccacttgtatctttcggtttcgtcatagccaagtatgaagaaagaagaagaagatggagcgcatgtagcagggtagcagggaagtgcgatgtgacacgtacctgatatcagaagtacgccttccaagtaatatcgaaaatcgaggttaaattgtaactagctgtaatttgtcccagcaagttcttctactatcagtatcgagtcgttgggcgtggggcaattaggactgaatttggccatgtccttatctcttttgtcacaaacatg

SEQ ID NO: 6357 - DNA, 700 bp, Nannochloropsis_gaditana
tgtctttggcatcgctatactcaacaccgtcgcccataatgccgcccgtgaggtactcgacaaatgcatccacctcgaagacatgttctccgcaaattagatggcgcagttcctccacatcaataatcaaggacgcagctgcagtcggaggggtcagagcgccaggcaggggccggggcttacttggcgatgctttttttgaaaaggcagacgtcggacgcgcttccatcccggtagctctgcggcaaagttgaagaaaatttgtgtacaggggagatcacgacagatgagcagggggtgagttcgcgtgggagccggcccaggaaggcacatggccggcgtgggcgccgtgagcccgaggactcgtccgacgagccggatgggacgggaatagtgccgcgatttctagagcaatgcaaagaagaaggtagttcgggtggaaggagccagggaaagggacggaaggacttgtatttaaaaaaatacagattggttgttgtttatcctggttgtttcatttatcactcaagaggatgcattgattagcgctctcgcccggctgggaccccttgaagcaactgcaacacccggcatgggcataccatgccgcccacgacctaaatttgtgccatgcccacttccaatcaccgtggacgcgctcttcaaaaaacatctcacactgattccgtatcctattcta

SEQ ID NO: 6358 - DNA, 700 bp, Nannochloropsis_gaditana
ataacgaaatctcttgctcgtggggcgctttaataaagacgagaaaaaagggttagagaaaataaagcaaggtaacgtgtccgaggagcagtcttcctgtcctttccgtacctgccgaaagctgtccatttctttgcgataatagtgcactttccctagccttttgtaggtgtggggagtgatgtgactgcttcgaccagtacgtttgtcaaacatggctccttcactcctgatcctttcccgcccctctcttcttccaacaagaagctccgaacctttgtccgctttcctagtcgaggtgcatgaagggcttcgtaagccaaatcaagacattgatgcattgatacgctttactgaagtttgtgcgttgaaacgccgttctcctagaaggtttcctcactgaagtacgtgccagaagcgcgcggaacactcgctgctggaaggcgggagctgatcaagaggtttgtcgggcgtctacaagttgtcagcaagctggttacaaactttgaggcgtggattatcttctaaccgtgcgttgatagaatggtcggacgagcacgctgcgctcttttgatgctatattatccttcgtcactcattgaaatcgcgctacacaaggaccaaataacatcagggatggtagatttctcgccgttgtaaggattagaggaagcggtctctagatttcgcgacacgtatg

SEQ ID NO: 6359 - DNA, 700 bp, Nannochloropsis_gaditana
gtggccttatataagcctttccgagggttgatcacggagctgcaggcggacgatgttacgtcacccctcggtgtgcccgcatacctggaactggtcgaaggcctaagaacaacgccgaatattgcggagacgtctgtcgccggaacagactatcccgcctcatccaccaggcacctcataagcgtcttgcacccctctgtacaaagattagccaggcaagcgcgcacggacctgacgcgcccattcaagctccggcgcatgctgccgctggcggtggcgccgtgtctggacccgtgcacgaagaacctgagggccatgggtgcgcccgacgacgtcttgaagaaagcgtggagagtcatataagagcagacggaccggacaataacggtgctcaagaaggcgaatgggtatgtggaggggcgcggcgagaagcggggctgtgaaggggatttcaagacgactagtagcttgagggccctcttcttcgcgcagagcaaccactataatgacttggcggtagtgcatgacatggagcccgcgctcgacttcgagggcgtggagatagagaacagggaggacgtggcgtcggagataaccaattatctatccaagtcagtgcaaacgataggcctcgagaagattggtacagtattggtggaatctgcgcgagggctgtcccgtactcaccatcgtggccatg

SEQ ID NO: 6360 - DNA, 700 bp, Nannochloropsis_gaditana
tgctattagtaatcacacttctgctgtggcattgagagacaattgcgatggatgaggcagatcgagtgctcgcgggactcccgcctgatcaccatcacacgtgccgccagcctcccggcgagcctccgcataagcatgataccgcccctcgctgccccccctgcacagctttcggcgcacatacgcttttctctccgtgcgtctgtaatgagagaacgggaaacgcaaccatgaaagcagtgggcagctggatgtcgctcatttgatattttaccgtctggtcatcgcactgcggttacgattgcacaacaaaagcttgtgggggaattcggggctttcctgtgtccttccctactagtaatattctcgttggctcatgcaccgggagggcccgacagagcggcccctcgcacacgcgacattaaataatcctctcccccttccatcgcaaattcgacaggatatgatcgcttgacagtattcagttaaaaagaagttaagcatgcgaacctcccgccccagcgagtgcgataactactgagtaacgagacatagcaccttcccgcgaatgcattattcgactatgcggccgatcttcttgtggatgaaaaaaatatacgctaggcctttgactaagccattgacaccaatcagaagcgctacttttgagtgttctgtccgcttttctacctgctccatg

SEQ ID NO: 6361 - DNA, 700 bp, Nannochloropsis_gaditana
gcctagtcgttcaaagacttagttcatgggcagaagccaattaaagtacaataggcggggtcgtggtcgggtaaagggcaagtatccaggtgaggaggaagagcgttgaatgctggtgtagccattagagggaagaaatccgcgaacgggtttgaaagacaagcactgtagagtagcttgtagcatactagagaccctctttctgtgtctttctggatctattaaaaccccgcatggcaaagcacggtacgtatgaacgatgcttgaagatctggatggagctttttaaaatctcccttctcaaaacgtcgtgcaggtgaatgaaggcttgtgtcataacaacttctagttacatgtgtgactttacgtgcgctccacaccacacctaacaactcatactagcaacgaggtggagttctccgtcgaatgttgattttcatcatgcggggggaggcgctcctgttcaaggtttcgaacatttaaagcagcaggacaacgcagaatttggagacgatttgagaacacacacatccaggcaggtcaaaaaattgagtgaagcgggttttctaccgtctgggcgccgtattgctgctgtgcagggggatacgctggctgtatgctcttgtccgcaattcacctaatatctttcctcttgtatttctgcgatatgttatcagcacagagccctggctgactcatg

SEQ ID NO: 6362 - DNA, 700 bp, Nannochloropsis_gaditana
ccctttctcgatctaggcctcaagagttatatagagtgagaaatctctaatttttgcgttgagcggcagtcttcgtagcaagaaagaaaaataaccagcctccgtagagacggtgggataatctttcttcttctacccttgccccaacccaatattgctccggtgtacccgggtgtggtggcctccccccccggccgtgaagagagcccaagcacttgactgcattgctagaataaagccacagataaaatgtcctcacaagctttcctccgaccattgttatttagtggaccagctcatttgttgtgtctttgtcaagtgaaaatcaccacgaaatgaaatgcatgagcgtctggcttgaagaggtcggggggtggatcgagtgaacacgctgcgccctgcgggctcctcgaagcctcctcacctcttgcagatcgccgcgtatgaccgccaaacttgggcctctatgtccaactcacaacatacttttggttacatttgagtgtgcgcttgctcgctacgaaagttttccccatgaatttgacatattttcaatccggcggagatagcctttgtcagccttaagtccgaattttctcgaaccacactagaagtatcctcacattctccttttcgaatcacatgcatcagcggatcgtacaggtgggaaaggaacgcctgaaatctgtacgaaataatg

SEQ ID NO: 6363 - DNA, 77 bp, Nannochloropsis_gaditana
ccgatggggggggcacctctccgtcttcgcctggcgatgccaacccgcacgcccctgtgaacgtcatcctccgcatg

SEQ ID NO: 6364 - DNA, 700 bp, Nannochloropsis_gaditana
gggtgcgtgcacccacagccgaccatcggaaagccggattaccgtcatgcggataggagtggtcacgttgaagaaaccttggggctgctcaaaggtccaaatatccttggcgatttgtcttcggacggtgcgcctttcaaaataaggcttcagtgggagccctgtgatcagcgtgtattgcctctctttccgcaggcggatctcctcaggactatcggaagcgacgcccgcattgtcaccactgccgcgagtgtatacttcaaaaagtgttgccagtgggttgggtttgctgtttcggacgggcgtggttggggtcgccctatttctggacggtgctcttgtagcagggtctattgtagcttttgttccggttgaaggcttgtaggcagagatcaagggactgagaaataggagcaatacaaaagcagaaaatgcggcgcggacatgcgggcaatatcttggtggcttatgcatgtgatgggcttcatgatcggaggagaaagggaaaataagagtgacgtttttctctaaaaagcatgtgggagagggattattaaacatatcaagggggcgactgggcgataattggccttgctcagggatggcgaggggggaggctggtcatggacacaggctctgcttgattaaatgaacatttctccatcaaacaaattgttatacatcacaggcatttaccatg

SEQ ID NO: 6365 - DNA, 700 bp, Nannochloropsis_gaditana
cttttcctttgtgctacaacccgtctttatgcaggtgtcacggctcaaactttatttgccgtatatggtacggaagaaggcaattaaaaaaatcatggctcatgacgaggagaatgagtgtgggatgggtgacacggtgcgtatcaagccctcgcggccgttgagcaagagaaagcgatttgtcttgcacgaggtgattcgtaggaacccaaagttgacgatatgaaaggattcaggctgggaactgcggacgacttatagactagcaagagaggagtgcctatatatttgtaacaggcttgcttgccaccgttcttcgatataacaaaaccaataacgaagcttgtaacctctttctcgatggttgttgattttttttggtgggttttcatctcctttgttgcgtccggcctgtgtccaggcgccttgtgccagcgctactcgttccgatccgtccacgtcgacagagcaacttggacatggcgaggcgatgttcagaggtctggcaaggtcatggtaacaaaccaaggcaatcatgcgatgaatcgatacgaagtacatgatatcatcaagcaaagtgagatattgtggtaagatttttcagtcgtgtgtccttttggcacttccacatccatcttacagggccattacctgtatgaggaaaaaaccttcccttccctttctttctattctccttctc

SEQ ID NO: 6366 - DNA, 700 bp, Nannochloropsis_gaditana
atgccgctaggagggcgtggccggcgcggatgtggcactggggacacagagtttgtagggcaggcggggggagcggggctgtggaggtagggtggcgcacaggggccccaagggatgcacatgatggacccggtcgtagggattttgagggccacgaaggtgctgagaggccttgcgacgaccacggagtgcatggcacacccgtgtgtcgaagcggttagtgcctccctccctctcagatacttacgatctgagggaggtttaggacgagaagatcgaaaagtgtcaaatgaagaagagaaattgagagggtgtacagtcgcctccatttggaaaaagaacacactaagttttggtgacagagaaacaatgtatctcgctcggcgattctctcttttcttatcttatttcaagacacctgtacgatctgaattcctccctcgcccgtcgatgacgcggctctacttattcgcgatgcctgctttcaaaatgaagccgttcacgaaccgtagcacagccgtgtcatcctccgggtattcttccgtcctcttcgcttcacgggccccctccatcactctgtcccaaagcgccaggaacgggttcgagcctcttccctccgttccccccgccattcgtcgtgccggagacggcctccgccccgtgagtctgtaagcaaaggcgaaggcgtcctggagggcgg

SEQ ID NO: 6367 - DNA, 700 bp, Nannochloropsis_gaditana
catagatacaaccttggccggtcgataagtcataatgacaggtctttgaagggaaaccaatcgattcccctctattcggaaaccttggtagagtagagttgatgagaaaagtgccaaaatgctggatacaaggtttgcgatggtacatgattgcctcgcatgctgaatcggagtttccataggaaccaacccctagatttgttcaaataaatcaagaatgtacgttagtatgagctctatgattttcacgcttgggctttttggcaaaaagcggggtaatgcgtactacataggggaggtttaccgctttctcaataccgacccactacaggcccaaacggacagcaggacgatttgaaaccgcttgctgcaaaccctttatgagatggtaccttttcgtaacctcactcacaaatatgagcctacgcgattctcatggaagccacatacttggtgcatcgacatgggcccctaaacggtcacccccggttaatgtcttgggtctctctttcatcatagacccgcgtcatcagcttgtcatcacgaggctcatgcactctacaagagtcgaggatacaagccgaaagcgttcaatgtgactccatcttgggggagtctcaaccatggctttttgaaatgagtttgatagattaatttacctactatttactttgtaccggcacaggaatctctgaaaatg

SEQ ID NO: 6368 - DNA, 700 bp, Nannochloropsis_gaditana
ttccgcacttatttacacctgcttgccagcatgcaaccttcaagtttagagggcagacacgcgctcgaagtttgtccggtcttgcaagtcgttaaagtggcctccgcccaggaactccggtcggccgacataggaaaagatagggcagttcccggcctaaccgacgagtcacgtcgactccagcctcaccaagggctgcgggttcctgcaggtgtcaccggatctcccgataaagactacatggaggacttagacatgtccgcgcctgcatcccaattgtttggtaaagtcgaatgtatgaaacgctacattcgaataatgcgtgtcgcgtttatagcttcgttgtggtgggccccacatgggacgctataacagcccgttgcatggtgccggaaaaccccaataagagatagcctgaataaagtcgtgtgcccgttcttgatgtggcacgcatactccgctcactttgagaaagaacatgtggtgaaaattgacaaggcctgcaaagccagactgcagtagccacgagagcatggatgcgtctgagccgaggagcgggcgataggctttgattcttctcgtgccaccgccgtgtagctggcgtcacgaacagaaacatcacacaccaaaccatgctccaaagtgtgccacatcacgcgcctaatcttttctcgtgcctctccttgcctacagtagcatg

SEQ ID NO: 6369 - DNA, 700 bp, Nannochloropsis_gaditana
tgacgctacagcggtcgatgagggcgtcgttttcttttcgctcgatgatgaacttgacggtaaggtcagcgaagaatccatttgtttaaagctcattggtggagtataggtagcgaggagacgtgagagcttatcaagccgtctggcaactcgatgttgctttgcgtctctgcgcaaagccccttcatttaccagtgcttcgtacacttcaattaaaggtcgatttgcaataccagcactcgctacttcgttctgtgagtgtatcgtatgcagaaggcgtgggcgtgatgcaaagcatgaattcgtgccacaaattgaggaggcgaggccctacctgaagtcctggacgaagggagtttgcgtggcaagtagaagcaaggcctagagcccgcgtggaggctaaaaaaggacgacgttgccgtgcagccaaaagtaggacaggacggccgagcatccgtatactgtgcagtaaatacgataattcttcatagaacaagtacacgtcattgtcaagtgctgtgacctcgctctgagctgaggcagcgagggggctggcttgcacgatctcagtctttgttcacaaccagaacttctacggaaaggcgcgtcacacaaacagaccttgaaccttaatatgtgattccctgatagtactaaacagctagacatgccttctcacctagttcgtgtcgtcatgaat

SEQ ID NO: 6370 - DNA, 700 bp, Nannochloropsis_gaditana
gagcacacccctaacaacatgcatcatttcctccatcactttctctcgatcctgcgaaaaattcagcaaagtcacctcctctatcatcatacactacggcgaaaggttatcagaggactccgatgtagattgatggtctggcaatgattacaactaccacaagccttataagggttgcatttccacgtaaaaaacggtggcgagctcaacgcctctcttctcttcacctaaatccattacgtctgagtcatacctgaggtgaagggcaggagcaaagctgcgacagtcgccagacgttgcaccatacctaaaaacgtctgagaaaagaaaaacatgggtggtgattcttaggttaggaaggagaaaactatgtcgaagcgcaggacggcttttccctctgtgcggggggtctgactacgatctgcgtgcctgcgacgccagtcgagccgtgaggcaccgaaagtcgcttctcgatgtaataaaccgcttcaagttgtattttgctttgtaattaatctgcctctgtgcccggcaaggcctcggcacctttgtccgtggttaaaatggacgcagcccaagcgcgtgatggagcagacggcacgcgagcctggatctatcttccaatcgccgactcccccctgcctggcatgttagatgcacacgcgtggcgtcccggggctccccaccggtgcaagacatg

SEQ ID NO: 6371 - DNA, 69 bp, Nannochloropsis_gaditana
caagatttcctcgccacctttttggaaggaaccctcaagcttttccgcgcgctcaacttcgcctacatg

SEQ ID NO: 6372 - DNA, 700 bp, Nannochloropsis_gaditana
gggacggaggcggacgggcactccttcgacgtggtcaagatcgagggcctgggcgacgtggtttatcgcgcggggaaacaggccctggtggacgaccaggtcacctccgcgccgggacccgagaaccgggagagggtgggcacattcgtgagtcggctccaggcggtggcccgggagcagtctgccttcttcatcggccgcctcttctcgcagcagaccgccgggtggatcacaacgctcctggggcagcagtacgggggcgtgggggcgaggaccgcggagcaggtcttgggggtgaccctcccggactatcgacagctcgaccttttgcggggcatgttccgcacggagaacctgcaaccctcggagctgtccttcgcggcctacgtgtcggcgacgaaccacgccttggaaggcctgagctacccgcaggggggcttccggagcctggcgcgggccctggtccccaccatccaggcggccggcggccgggtcttgacgcgcgcgcacgtgagagagatcctgctggacagccagagcaagcccacgcgggcggtgggagtggtgctggaaaatggagagaaggtgtcctgtgccaaatcggtcatctgcgcctcgggcgtggtccccctcttcacccagtaccttcccaaggcccctctccccgcggggggagactgcttgcaggaggcaaggcccc

SEQ ID NO: 6373 - DNA, 700 bp, Nannochloropsis_gaditana
aggcctggtcgaagctgcgccggccgaagggctatgtccccgcggaggagcggaagaagcggcttcccggggccgcagacgaggcccagggagtagagggcgatccacggagtgcgcaggccaagagagggaaggcccacggggcgccgggcctgtcggaggacgcgcgagacatccggaccctgctgaccctcccccaagacgtggaccacatcgtgctcggatcggacgtgggggggctgtacgcggcggccctgctggcccgcgtcggccacagagtgctggtgctggagggcggggagacggtggggaactgcacgagcgagctgaaaggggtggaatgcgactggggcctgctgaacgcgggcatggtgcacgtctacgacgagctcctcaaagccggcgccctggaaggggcgcccgaggtgaaatggtcacggatcgggacggaggcggacgggcactccttcgacgtggtcaagatcgagggcctgggcgacgtggtttatcgcgcggggaaacaggccctggtggacgaccaggtcacctccgcgccgggacccgagaaccgggagagggtgggcacattcgtgagtcggctccaggcggtggcccgggagcagtctgccttcttcatcggccgcctcttctcgcagcagaccgccgggtggatcacaacgctcctggggcagcagtacgg

SEQ ID NO: 6374 - DNA, 700 bp, Nannochloropsis_gaditana
tgctggacgtctgcagccgtcgaaacgtcaggctgacagaatcggcgctggcctcatctttgatcagagccaaagcgtgccgagcccccttgcctacgacgtcgcatccattgacccggaccagaaaatcgcccactcccaccaaaccactctcctcgatgggacctttgccgccttgcgagctcacggagtcgaagtgagagacaaatactgtccccggcagtatccatgagtcgtcccgcacccgtatgcacagttttcccccgcgagccaccatgattgagtgctccaggcttggcccatgcgcttccctcatctcttcgtcgctgaggtcggcctcctccgtgtcgtcgtcatttttattggcgtcaaaggccgcctcccacaacactgtggagtactggaggtcagccgattgatttacttgtcttgaagtatgcatgcgtcccggcgcgacctgtcgtcgagaaggacgggtgagtcaagttgacgccgccaagccgggcggcgtaaaacggcgagagagcgagacctgaggtcagcagcacgcaagcaatgccatgtctagctagaggccgcaagggcggcatccgggcgatcgcgaactgtggaagacttcccactggcttcccattgactcgtctcacaagcatggtgccttctttacgcacaccctgcccacagaacgcccgcgagaggc

SEQ ID NO: 6375 - DNA, 700 bp, Nannochloropsis_gaditana
tttaactcctgattaaacggtcgaagaatttgaatttcaaaaaagaatcgattgcgcaatgtcctatttcactgcaaggctccggacggtgacattatattaagtggcttccgaccgaacaaaattctggttcattgtttgcacacccacaatttcgccgtttataacgtcttaaatgcttcttgctcgatggataaacattcgagccgttggctctggagacgctctttcgctttgtcctctggcgtcgtatctcactttttgccttccttctcattctcctcttgccatcgttgaggccataaaatgtagtttgactatgtatacatatcataaatggctgtttatttgtgtactctacgaatcaaatcgtgactcagacttttgcccccatgattgccctaaataaaatcagccgttgcgtacatgcccttttccgcagcgttctcccctgtcctatgacgtcgatgccgtcccatgtccaaaagacgaatacatgccaaaattcttacgattttcacactgatattgagaggctccctatcttccattgatcatacataatcagttctcctggggcacggtgtcacaagcggtggaccgacttgctcacgcagggacatttgaataggcgctcaagttgtttgccggtcgtgtgtgagtggggcgcagaaatttatacagaactaattgaagcatg

SEQ ID NO: 6376 - DNA, 700 bp, Nannochloropsis_gaditana
gctccttgttggcggcgatgtctctgcttagcaacgaggcggacattcaagaaacgcagttcgcctccccttcaacctccctcggtgttatcggcgtaatgtcacctccttcgttctcgacgacacacctatcttctctcaatatggctgttttgggtggaggagagcagattcgcaagcaccagacaccgggtcactccccacacttggatccatctccatccgtttcttcgcctcgctctggcaccccgcccagcaccatctcgttcatgcaaacgtcggcgcgcccccccggcccgggcctcggccgcggtgtccctgggagggaaatgggagaagcgatatcaaccgtgccttgtcacgactcctgccttcagtgccagcttaatgacagggctaccgaagcccccccggtgcctgctttgttcccctgggcccctttgacggcgcaaatcaacaagacccgcgatattgccgacctctgcaaagccaacgcgcacgcgatggagcagtggggttcctctcgtgggaaggagttagccaagctttggtcaatgctcttcatttccgcctccgcctgtttggatgccttgtgtgtagaagcaacacgcttggtgaccgcgacagtcgccggccgcacgtctatcgcgctttcctcagaggctttgcggccttggagggatggaccattgggacggcc

SEQ ID NO: 6377 - DNA, 700 bp, Nannochloropsis_gaditana
cacaggcatctgattcaggagcacttatttttgttccagggccgtgcgatgttctcgctcacccagacgttaagatctgccacgcatgcgcgaatataaagcttacgacactaagcaaaagcaccccacaaattgcacagatttcaatgcctgaaggccgtggacgtaccacagattagtcgcctccaatattttgcggagcaagacggatttatcgcatcgtcacgacaaaatgtcaggttctaggtgtcgaccgagttccttcacaacctcctccgttgtcctgtccctgaattttctgattcattttctgtggacgagcttcacgacagctcgtgctgtttcacaattatattgctctagtagcgaagggtttgttgccttacatcggaacagagtcgtctctcccttcgcgtttcaagtatctcaaccccgagcagcattgctctctcgacagatccgcgctcggctcggtctcaatgccccagtaaacgtgcgatacacttgtaaatccactgagaagacaagaatgaaaaatagtaattccccttatgaatcgtcgacttcgatcttaacctccctgtttaaatctaagccttcccagggcgggaacgacagatcccttggcaaggggagaagggaaggaagaggtgtgaggcaagttcggtcctatttcaagttttggaatcagcgtcgcatg

SEQ ID NO: 6378 - DNA, 700 bp, Nannochloropsis_gaditana
agcgtcgaggcgacctcctctcccggttgcttgggaaatgacgtcaaaagctgtgcgcgtcgcacccgtaaaatcctcgctccatgtgttaagcaccaaaggcagcgcagatgcaaatgatacggcaggatagtagacaaggacacccatgattgcgaataaattcatgggcaaaaacctatttaagggttcaaggggagaccccgtctcgccaaagttggttgtactccctggagccggcacgaaacaaagcgatgaagccgatgggaccaaatcagcgcgaaaagataatcacaaattccctcttcgacaaatttcctgggcgcatgaagggttctggtcatgaggagttgaatgtagtacaaacaaaataccacccgaggctgtttgaagaggaaacagcggggctggcgagccggatgcagtgggcacgcagaccttccacaatgacatggaggaagatcacacccccgagaaccctaggcctttctgcttttggttcgtatcacctctcgactctggtctgagatgaaatgtgaagggcccctaagtcgccagagacccagcccccctagccccgtgtccaccatctcaacctcccgacccccctcacaggaaagcacatacagagagatccttgtaggcgcacgtacacacacccgcgtcccagagggagccggttccgccatatctttggatg

SEQ ID NO: 6379 - DNA, 700 bp, Nannochloropsis_gaditana
tgcgcttgcttagtcataaatgcattcagttggtctattgcgtccccatcctgacgaccgagcccagcattgtcatagtaacgtttgatgctaccacttgcactagtatcggacacagcagctggcggagtggctgtctccgaacgcgcgctgacacacataatgttgttactatgcaacaatggcgacgggcgggcctgcgggaaaacttcgtgccggggcggggaggaggtattccgtaagcgacaaagacgaccattaagccagtctcaaaagctcaaatcccgagggttttgatgttttataagtgcatttacatgtccctggcgaactgcttcaaagatgaaggtgcattaagtagcgccggcgcgaggggtggcatcgatggggcgatgtgggtaagagcactcattgccctgcaacacgaccccaggagtcgacgtgcgaggggaacgactaaacttgccgtcaaaacataaatcagtcgtgaaaagcagtcgccatcggctgataagcctgcatcattgcaatatcctgcggtcgcccatctgcgtctcgtcagcctcgacgtgggatgatgccgcgctgtgttcctcgcagctttttgacaaatgcgatgacgagttggcgaaaattaaatgcctacgcgcacaaatcaaaacgaggccacctttaaggaagatgagctaaacttgttgtt

SEQ ID NO: 6380 - DNA, 700 bp, Nannochloropsis_gaditana
ggttatggcgctgctgaatagactccatgatcagtgtgggcacaaaagcaggggttggaggaagtgcagccagcggtaccagcatgaacagcagcagaagggcgggagttttgagaaaggcagaaattcttattgactgtgagagtatctcgggcctgcggtgcttgtggtgggaaagactcgtacctccgggcgctgagggcatggctggcggggaaatagataggccaagttcacgagtgaatctgccacccagcaaataagtatgcaaccaaattgtctgttttactgtatggcagattgatgggaaggtgggcttgttgtggggcaaaagcgggatcgaaagcaaaggtgtgcgcccgataggcgcgatcctcttgcctggacgcgggcgaccctgtggcctcgcccgacggcttatactggttagtgttcttagacttaagaacacacggtgttctattcatgcttagtttgttaaatgtctgccgtggacattgctgcgttgttgccctgcattctgtgatttgttatgtggcttgtgaacctggcgagttcatcacgcagacaccgacttcacggctacactttggagtcgaaccgtacacgtccgacttgagtcaagccttcttctttcttttcatgtccccgcttcttttcttccattcctctagcgattgtgttgcgttgaaaaaagatg

SEQ ID NO: 6381 - DNA, 700 bp, Nannochloropsis_gaditana
ctctggcaggaaggaaggggtttcctctcgtgacctgcaaggccgccagcagcgtcaggcctctggggcttgcagcctgcgagtaggaaagcctgaccctctgataacagaataggatgcagagaccgactgccctgtgtcctgtgtgttcagtgcttgtttttttgagaccgtcgggggacaaagagagggaagaagcccgtcagatccagccgaggtacgaccccctcgtcctgcttgatgtcggctctgccggcccgcaacgtccccctttgaacttcatggcatgaccttgccggtgcggcacagcacatgtccatacattcaccaccgcatttgataaccacttgcgagtgtcggatgctacaaacaattctcacatgtcctttgaggtcaccgcgggcggctcttgcacgcgcacgtctcgggacgggcttggacaactcggttggcccccgcacgacggccgaactaacccctcaccaaacatctttcactccacagtccgaaccctgaaaaccacagggtccctgtcggagcgctgtgggtcgttgttatggcatcttgtcggagaagggaagcggctgaatcccgaaagtcgactttcatgtgtgaccttggtcgtccgtcttttctggtggcactgtacgtgaccgccacgttgacactatgctgtgtccacggattcgttttgcccatg

SEQ ID NO: 6382 - DNA, 700 bp, Nannochloropsis_gaditana
tacgccactcacggcagttacaaattgtgtcgtagtgaacgggggaagaccccggggcacatggtacaacgccacagtcatgcatttatactttacactttcaacgcgtttttcgttgtaggctatgtattgggcgtcttgcgaaatggtcgtcgttgttaggttctgaaggagcgcgtcgtttacgtcggttcaatttgaaatctcaaattcgaagattgcgttgaagtacttctactcctgcaagaggtttccgttgagtagcctccttcgcttcgctcgcctcactcacctctcttgtattcaccgcctggaatggcgcaaaccgagttgaagaagagtgtacttatttttggctcgcgctttttgtcgaatgttttgtgggttttctcttcttttctaaaccccatccttcacgcaatcctcctcctgcttgtgcagcaaggaatcctggcgacggagacattgtttggatcttttggtaaacccctcaatctttcggaatcattcaaatgctttactatcaatattcagcgcatctgaggtctgcgttatcctttacaatcttaaactgagatgcaccttgtgccccctctcgataaatgcacattttctcgcacaggaatctgtcgataggccacggtattaaagaggcaatctgtccttgccctagaaatagcgattggctggagaaaggatg

SEQ ID NO: 6383 - DNA, 700 bp, Nannochloropsis_gaditana
aaaaattccggggggaaagagtaaagtcaaggagatcagacgacctccaggctgctcgacgaaagagaccgtacacccctccggacaagtgattacaaaaagatttatgcctacattatcacgccaaatgggtcaagtgttgaggcatagtccatatggaagatggcgggaattgtgcaccccggaaagtttgcattaggacaggcattaatgtgacccatacggagggatgcacattttggtagctaggactgaaaagtagaccaaagaaattgtgcaaattatataacttcgtcccacaggccagactgttcctttgcatatttcgtttttcgttcagcgaatcaaacgcagccatggcctctggatgtcctcaaaattggtcgactgccccccccccaagataagagagcacgggctccgcgtcgccaggcgtcctctccccggctctaatttattaattaattaatttattaattaatgaagctttgtagaagtccattcctgggagctttttacgcgattatgatcttgaattctcatttcttgctcatcgcttatctgtacttgccacttgctcactgtctcgcatggttctgttttttctcacagtaagaaggcgggacggcacgcgagcgagcagcaccaacggcagccaccgcaactttctgactttcgagttctgttaagagaaatcatg

SEQ ID NO: 6384 - DNA, 700 bp, Nannochloropsis_gaditana
gggcgccgaagcatgtgtccccgagggccgcccggcgatggatcatgcccgtccaatgagtggcgcaacatgcattatggcacatgacgatctcacgacctactcgcgcttttttcctgtctttcctacgcaaacataagtatggtatatggtagaaaatcaatgtaaacacctctcacctgaatggccacagtgcctgtacattccttttcttttcatttttctaattattcgttctcggtgccgatcctggcatgggctgggagcaagaagaaaggtgtcctcacaacttatgactgtatgatgcaatgcttgggcgacatgttgcttttttctttttatttaattccccagccattaaattttaatgcctgacggtacgaaagtccagacattttgactttacttgcatgagattctgtttcacgacatcgcacggtgtacgcctcggcagtaacttactgttatgttaaacatgcggcaactctccatctcatatgcgatctggacctcctcgttgcggtggtagtggtcttgcagaagatcttgagattccaatcgttatgcaaaattgcgagcgacttttagcagtttgacctcgaaattttcccttggagcagcgcttgccaagctgcttcctaccacagccctgcctattccgcatcctaatcatgtttcttctcgtttcccgcccatcaaa

SEQ ID NO: 6385 - DNA, 700 bp, Nannochloropsis_gaditana
tcctttgtataaatgcgttgtcgcaggcaaaaccaatcgttcgagtagccgtagaagttgtccatcaagcggacctcgaagctctggagaaaggacttgcaaagctttttcaaacggatccggccgttgagataagtatccagcaaagtggggagcacgtaatcactgcacttggcgagttgcatttggagcaatgcctcaaggtacgttgccgtcggacgagattttgcgagataaaagctttaccttactacttgtttccctgcgtgtgataaattcccatccttttaggacctccgagagcgtttcgctcgtgtccaaattcgcgcatctgcccccttgatcgccttcagagagagcgttgcgcttgaaaccgcacctggggatgaaaccgatcgtccgccacagcttttgctggccccatggtctgaggaagaaggtaggtgtagaagaactaaataaagcgtgatcaagaccaatcattacataatttgtgctattgcaggcataattgacgctgctgaaggcgtttgcaagctgacaacctcgtctggggactgccgactgactgttagatgtgtggctttgcctgatcgactggcacgtcgtatagaaacagagccagacaaggtaagtttccaccctgataaatgtaccaaaataaaattaagtacttataacgcgcaaaccttgcattaag

SEQ ID NO: 6386 - DNA, 700 bp, Nannochloropsis_gaditana
tcatctcacccattcctggcagcggcgtctccattcgataaaaaggttcttgtgggcttcactaatttgttcatgttagggacgagagttggggttgatgaggcagtttcggggtcaacagatgcaagcgcttacgacgttgcagacagaatagtatattgatatctgttagcatgttcttgacttgttttcgagtctcacttgggaattcaaggaggacatgagaccaatgcttcaagggccgagtatttgaattgtgaccccgtcaagctgcaatattgcagatcgaggagtgaaggaagcacgtcttggttgcgaagctcaaccacaagagactggtcactgtgtcaagactttcagataaatgaattcgcaggcgtcgcggcaggaagacaagggcggggcaatcggggagcacgtagcaagtgccacgaatcaggcggctcgcggtaacggaacttcaacttgctccaagcccgagcctgccatgggcctgccggtctgcctctccccgtgtggcacggtgttcccacttgtcttcgacgtgtccgcaagccgttttgccgcagtcattcataggctaaaatgcctcatatgtagattcttttgggacttacttttcagcctaggtgggaattctgtcccgagtatcgcattacttgctgtcgagctcccaactggctctagcatcgtcaggatg

SEQ ID NO: 6387 - DNA, 700 bp, Nannochloropsis_gaditana
gcgcgggcagcgggcggcagcaaacaaaaaaataagtaaagcacagaaggagagggaagcaatgaacaattcactgtcaagccagagctcgaatggttttgaaaaccataccggtcgccgtgatctttacaattcatgtctggacagcattttttcctctttgcttggagcaaaaaagaagagcaggaagatacttcacatttttatggcgacatgcacgtgtgcgttgtggctgttttgctctcctcgagttcgcaccgtctcgtactccctctcgttgtggcgaaagatgttaatgtagatgttgcatgctgttttcaatccatacggaggtgtcaggattgctcgcaagtcgatgtagcagatcatgcagggatttctaccttggccataatggcaataaagccaactcgcttttggtcgacaacactccaggcctcgaataaagtcatcatccagctcctttcgtacatacgggacaggtggagccgtcgataaattaaattgtctttcgtagtggtggcaacaattcgcactggtgttatacccagaagtcaaccgtaggctgcgttgagaacgtctactttctgttcttcccgcttactcatggcacgccgcgttagtgcagacgaattgattgcccttcagggaaagcagcaatttatacggaacgtttgcattttggctcacgttgatcatg

SEQ ID NO: 6388 - DNA, 700 bp, Nannochloropsis_gaditana
tggcatcaggacaagcacgagacgaagagcgacgcgtcctgatacgggggatcagccatcattcgtctcggcgcatgcgtcgtcggggctccgtttgtaaggcgggggcaggccgctcagtctatagtgccccttcctacgatccacactgacttctacactgccgcttcgaaccatgccgaaatgtgaccggtgaacacagaaagcaattccttctcctagtgcttacaagaagtgagcttttaagcgacgcgacacgagtgtgcgtgggattcgacgttgcacatcatgtgtcgctccacgatttcagatcactcgtcttgatcgctaaaagcatgatcgtaaatctcgtgatgttcacagaatgtaggaatatggccatttcacgaggcctgtagtgtcgtacaaacctgctgtgtttatcccgctattctttcaaagacttgcagtcagcttgaccttgttttgttgttcaagatccatgcatgtccaagcccgccacgtccctgcagccttgcttgcaggaggttgataacatgattctgggcactgggctcgcatctacggatctcagagacctgctactgtaacatacgtttcgacagacaatcaaaacatttgaagatcaatttctgcaatcaaagggacaatttttcctggctgaggtgggaaagggctaagaaatcctgtaacgaccatg

SEQ ID NO: 6389 - DNA, 700 bp, Nannochloropsis_gaditana
tggggataggaccacacggggacgcgggggcgtctggaggaggcgcagctcctttgatgaaggccttgtcgaacgtgatatcctggacaaggacggtcgtgaacgggctgtaccagcttcaatggcagctgatcggctacgagtcaaagccagacggggcgcctgacgtaaacaagccccttttcaacatccagaaccccaacgccgtcatcacgaacatcttgcacacgtaccgcggggagacgatggagcagctgcggtatctggtgctagccttggaagccatggaaggggcatggcggggcgggcagggggagggagagggcttggggcgtcgtgggactgggatcgggatggacgccgggggagggcagagggagggaccgcccctggcgacagcgtcgggggggcgagaaggggagggcaattttggaagggatggatttacgagacaagggggtgcgtcgacgtttgctgggtcgatggatcacggggtcggggcggggaggagcaagggcgaggagggacagctgtcgcgccagcagtcgaaccacttcctccaagataccctccagcgcccctcccccaacctcatgccgccagtggggcctatgctgccgcccatgattcgcgggcgaagcggtttgggagggaacatgccagcagacgcgtcagggggggggacaggcggggcaggggg

SEQ ID NO: 6390 - DNA, 700 bp, Nannochloropsis_gaditana
ttaaccagctcgaagaagtcccctcgcaggctgtcgcgtggatgaggaaaggtaaggcccagttcttacacgcaaaattactgacacacgcatgcagagaacaatggctatgtattagtcaactgtacataaggaaccaagcggatatcggtattttcaaaggaccctgaagccaaaaaatgcatatggagaataaagcaggatgaggaggagggaagttcgaaacgataatcagtcggtcgggtaccggtagcgaagctatgttttatgagcttctcttcatttgacaaaaggtacaggaagaggggttgtatgaaaggaccgtaaggaaattgcgggccagacaacagtggtcccgagggcagcacaacatagtggacgagggtcttgtgaagcaatcacacccgttttgcccggcttacctggtactcatgttgatgatgctgctggcgagatctgccatcagcaacacagaagcagcggctgtcccgtcaatgtccctgttcgaagaagttcgaggcggaagtcctgtgagatagcgcggctacgaatacttcctgctcgctccttcacctcagcgagtccttgactggctttcccacagcttccacgcacacacaggccgccgcaaaaatcacaccctcacgctcaccaccatctcctgtgttccagattccaagagatcatcctttgtatcatg

SEQ ID NO: 6391 - DNA, 700 bp, Nannochloropsis_gaditana
gcctgagagacgtgtccatgaacttcgacaaccgcgatttccgcctgcaggtggcggtggggggggcgcaaagggaagcgggctggcagtcagcaaatattttgtggcccctgttttttcggacccgatgaccgtggttcggcaccgactgcggattcgctcggagactcagccgccgaccgtatggtacaaggacgagggtggtcgggacaagtgcatggaggtggcggtggatctggtggactcggagggccggcgcgtgcacggacaggaggtgccgctccgggtctcgttgctctacgaggacttgcagccggtggggaagcagaacattctcaagctctcctcggactcacggcagagcatcgatcatacgggcacggccatgctgcgcctgcggatcgaggacgtgtcaaaaaaccaccagagcaaaggcttcgtaatccaggtgggggcagacgtgcagcacgcgccgctgaactcggacatctctcccgacacgagcacctctgtatctgtccggtcgaagcggaatcggcggtctaagcaggggagaggggccatgggagagcgggggggggggcttggaggggttaacggaggcggggacgaggacatctccctcgtgggacacaccctgtcgcggaactccatcgatttggccatgccggtggtctcccactccctcctccaggaaacg

SEQ ID NO: 6392 - DNA, 700 bp, Nannochloropsis_gaditana
tgggatggcggcagccccggcaagagggaaacttggctgaggcagtaccggaagacccctcaggctgcaatcgcaggcacgtcgccggctctgttaagccacacacccagggccgccgccgcaccatgcgatgtagcatatttcctggggagtaggctgtctggccgaagacttggtgagtcacatttctcgtcacccgactgcgaacatcgcctgtggcgcctgaggcggcgatctcgacatcggaaaggggcgagaggcagcgaggccgcggcggagatcaacacgataagaggaacaattcctgggcgagataagagcacgtgtcaggcccccgccctccggcatcgagtgtgatgcacaagtcatacacgtggaaactcaaagctggaggcaccgagcacggggaggctgtgtcccggcgtctgagtgctctcttcgcgctgtatcagacctaccccgacctccgtgacggacgaggcggcaagcccaggaaaattcccgggaaagactcacaaattcaccgatccgcttgtcctgcaaagaagcatcactaacgcaagcttctttcctctcagtttcaacttgaaatttcaggggggttgctagagtattactcggtttttacgtgcgaggagggggggaaagcttgaatcccggtcctgcctcgtgagcgcgaaggttttctccaaacgacatg

SEQ ID NO: 6393 - DNA, 700 bp, Nannochloropsis_gaditana
aaacttcgggaatatttttttaacgggtctcacgagtctgttcaactagcaacgttgccgttttctggcgcgcagggagaccctcttcccgtgagcaggcgcattgcaaaggatgataaaaaccaaaaatacggcgttttatgctatcaaaatcctctgaacgatgtatatcaagttgaatggcacatgcatgtcattttagtatatcaagaacaatttgtgacgtccgacgtgacatgatccgccgtaccgctttgtgggatgttcccgtcgctatagagcccgtccgggaccagcctgggaccgctccttgcacccttttcatgaggcaccgggccgagttgtggagggcaagatgttgataagcagacaatttacgtaagcataggacattggtgtaagtttggaccgctttgctcaatggcgacagggtccttgtggacatgagaagcagtcttgaagtaacgccgagtaaggaagaaggaacagccagctgctgtaggccgtctcattacgttttcccccgtgcacacgacagccaattactttgcggctatgggcaataagccatcactcgaaggtcagtgcttgtgcgaaattgctggaaaatacagtcgaccggttttgttagcggcctctcacacgaagtgcttctctcacagaccatctggttaacttgcgtctcaccagcaagcaaatg

SEQ ID NO: 6394 - DNA, 700 bp, Nannochloropsis_gaditana
cgaatgggatcgaatcggatcggatcggagcctccactttggccccattcggccccactccgagcggcaaaaaccgctagccgcacgtacccgacttgcaggttttgcgcattcttctattcctttggtaacttttgtcgatgcctttcaggtttgtccgtttctattttttggtaaagtgtgtggagccggcagagtgttagcctgtgcgtatgcgattgcattgcagcttccgcccatctcccttccatgtgtcgctcagccagtgctcggcttcacctcccacaccacaacacgactctcatcaggcaaacaccgacacttacgcatcgcactctaaatcaatttttgtaccttgcgatggttttgttggcaggaaaagaatatctctttccaggcataaaacggacgcagggtaatttttgcacttgccaccgctcgatacatacgccttctctcaaagcatatgctttccagatgttggttgtgtttcggtgttcttgaatttgagaattgctttcgcacaagcaactctgtgaatagaaccattttaattaaatagtaggcgacgcgagaaatgcagtaagttatccaaagtgagccgtaccttctcacgttgggatgcttcctctgtactacaacgatcctactacacggcaggtgatacaatctataaagtgttcttacattcttcggtatg

SEQ ID NO: 6395 - DNA, 700 bp, Nannochloropsis_gaditana
cagaaagccttgtggaaatcgcagtcactgctcccagacgacaaaatcaaaacttacgtgttgacagtcaggatgtggccgttgaagtggtggatgcatgacagtctgtaaagaaaccccttgagtgtacgttatgcataaagatcattagatcaaataatgtgtgggacattatcaggagagctgtagtgcagttttgtggttttccatgaacctcgcaagtgccagggcactcacctaacagaggcgcgtctcacacaagcaccactgatgaagggtcgacccctcctccttgttattcgcttcctgttgtcgtgcgcggcgcgagggagtgtgttgagtcatcgagtcttgggttcgggccgcgggagggaacgagcgatcagaggggggggaggttatttcagaatggagcataccgtaggagcggtatggtgagtctttgatgtcctacgacgattgttgctacgctatcaaggactcaggaggctatccctatggcacattagcacgaagggagaccgtcgatgtattatttcgcaggttccaagggcgccatgattcgagtggggtccctacgttgtctgcgcgaattcctccccacaaaagaggtgtcgtgattcacggggcgactcgggcgttaccattgtgcatcttctcctaagactcgtgacgttgcacatatcaatatttcttagag

SEQ ID NO: 6396 - DNA, 700 bp, Nannochloropsis_gaditana
cggattaggagccccaggtgacgcaggatgacgcggttggcgagcgagcgcgagagcacaagcaagatgtactgccctggaaagtcggagcaggctcctggcagctagtagacattgtgtcctagccttcttccctcgattcaatgttttatttgttgctattcgtaaatttgcgctgcttgaaagcttataatgagaaaaatcgactgggatggagaactcttcaatcccaaggaactttattcagacatgttcttgccaactcggacgtgaggccttacgtccttgctcacctcttttctccgcctttccatactctctgttgtattataagcgttgccgtcatgtgtaaattgagcggaaatatgggttggctatccttgttgtgtgccagagacgaaaatatctcgtggatggcacatcccaggatagatgagagtagaaagaggttaccaatctggatggtacgggctcagaggcttgtttgcctaagcaataaggttgcatcgcattacttgtggcccttgtatgttttttaaaggaagtgtgaagtttatgtaagagatgaggggtaattttcaaaccagaagagcttttgaagtcgcgaacaccgctcctgcaatgtctgataacctgacgtgttttaacttgcaaaagtgtttttatcaactactgtaggtttctgaaagcaattgttatg

SEQ ID NO: 6397 - DNA, 700 bp, Nannochloropsis_gaditana
cctttttaggcgggttgtcgcttaagcagaggccctcttcagactgaagacaaaaagcgacccggagcacatggattggcactagatcattcacttagcatggcatacacagcgtacttagcatttagtcagcatacaaatgggaatttgggatacatggcagaagttcttcttcaaaaaacaatttagaaaattatggcttccgtttcttcgagctttactgcatacacgaaaacaaaaaaatgcaaaaaatgcgcccaaaaccctccgtgatggcgcaggaaggcttcattggatgagattttaaagctactggtttacgttaaagcggactgagcatgcagatgtagcgctatcttctggcaatgttgtcgcaccggacgcggtaaaaattcattatcatgatgtgccattctaatagagacggagttcgcctcctaaaaattctttgcgagcagattagaacatacacactttgcgcataattccctgtggaataatttgtctgcagcttacatttcacgtttgtcctcagttgcggctcacctgcgattagctgcgttgatgcacacaaacggataattaagaacacacgagcagccattgcggtgaaacaaacgttagcaatagtaccagtcctatccggtcgagccaatcattaatatcacaatgaattttgccacagcatcggctcaatatg

SEQ ID NO: 6398 - DNA, 700 bp, Nannochloropsis_gaditana
cgttgtgaggcgagagcgagaagagcgagaacagaactactaaacggcaactggaagctcacttaattcaccgcttgcgagagggctttgcgtctactgtcgcgttgcttgcaagtttaccgcgcgatgacggtcttttgagcgacaagtgaaggtggcctttcgtacgcggctcttgccgaagggtcggtcgtgagcacgcctcgtactacgtagcatgacgggcactcggagtgaaggaatggcttattcgtgggctcactcggtttttcgacagcatgcaacttctctaggccttcgttactcaattcactctcttctaccctgataggacaaaaggcctggtctcgaatagccaaggcaacaaggacgtcctctttgaagctgataatgatgcgctcggtcggcttcattagtagccgcactgtatcacagacctcatcattttcttcttcgccgccggccctttataggcttatggattcccgctcttgtaagtcgtctctttcctgttgtgtggctcttcgtccgtttcacctactccgtgcgtgcttactctctcctcaagtcctcccaagccattttttctttctataagagtcaagcttcttcccatgcgcaagaacttgaaccacgcgaacactacctggagataataacgtgattacatttttttttccttttccgtaatcctgacatg

SEQ ID NO: 6399 - DNA, 700 bp, Nannochloropsis_gaditana
ggcttctcatcatgaccccaagcctaagcacatttcagggctgtcattaggcaagtatgctgctacaactccggtgggaccgtccagggggccgtcaagacgcataagcttgcgtacattagcgccgctaatgcgactccgaagtcaagatatcaaaaagcatccttggattgttgcactcaacagcacgcgtgtaaaagagaagaggttgatagaacaaggtatcgctaaattcaatgagaaagctgccgctggtattgactttctcattgaaaatggagtactccagagagctccagcagacgttgccgtgtggctgaaccagcaagcattggaattgagtaaaaagcgtctaggggagtatctgggaggtaacgattcttttgcgcaggaggttttgcatcaactcctacaggactatgactttcaagggatgtccatcgatgaagctatgcgggtaagattagagggaggaaaaacccttttttgatttgttatcttcaattttatcttctcgcgaatggaagtttcatgtcttcagcatattcaagccaagcttggaggacggagggcggcgagatatatatctccacagacaggctcttatggctttcctcgaatgattaaaataaaagacctcaatgctcactttccttcatattcatctcgcgtgcaggtgtttatcaatgatattcgcatg

SEQ ID NO: 6400 - DNA, 700 bp, Nannochloropsis_gaditana
gtctgtgtggaccggagcagggacctccgtccgcggactcccacggccccggccccgctctctctctcgcccttcgcgcgccctctcaagccgcctcttcccgggggacgtgcccggggagaaggtgccgtagtcttccacgaccgccggctgcgccgctcccagcgcgctttcactcaacgtcttcccccagcccggcctcccccttccactccgccttcccccctaccgcctcaggggatgctatggtcccctgtccccgctgtgcctccttactctcctcacattgcccctgctcctgggcttgtcggagctgactgacattcaagagcacatgctcccctccttctcgccttcccccctcccctccctcggccgccacctcgctcgcccactgccccatcccgcccgcgtccagggtggctgcaagcccatctacccccacagaggaggaaacgcggcgcatcaagcgaggcacatccgggaccatggacggatccgctggaagcaacggctcccactttcccagctgagcagtgccgtccctctcgtccgcctccccgcccctcgtctcctccccagcctccccctcctcctcccgcctgggctcgccgattttcaacgtccactccttgtctccaaatttaaaggtgtgcgagatagacggcatgccctcccccaccccgtccatcacctgctt

SEQ ID NO: 6401 - DNA, 700 bp, Nannochloropsis_gaditana
gcacgggaagtcgggtccgaggtcaccacgatggctgcaggtgaaaacaagacacaaactcatggtgaaaatggggagggattttcctgctcctcttcgtgaattgaaagagggttacatcttacctgttgggattcccagtagcttgcttcccctcccaaaccctttgaccaccgaggctttaagcaggaatggaagctgcggtgttgtgcctcctgccccgtttacggcactgccatcactgcctccgtccccaagggactctatcgacatgaccttgtagcggcggctgcctgagacggctgtcgcgctggtgtccttagtcgcgcctgtccgtgtgcccataaaaccagatttaaacatcgtgaaaaaccggcgggccaagtctgcgcgtcgcgctggtctggcatcgctagctgaccttggcgccagggtctccggccccatcacgttttgttgcgaatcccaaaaagtcgcacaacgcatgcgcgtgaccagaagctggcaaggctagcgcgttgtaggttggcagacttggctgtgaccacggtccatccaagcgccgtgactgcgccgtaactaccgcgagggcaactaaggccggcggtcccaaatgatgaccttccgacgtgcactgaatcacatcccatcgaaatccgtccgcccacttctgtttccccccgcaggtttgtatgcgatg

SEQ ID NO: 6402 - DNA, 700 bp, Nannochloropsis_gaditana
ttcgaattctcaaagcatgtatgaaattcgcaagatctcgcgacggcgacacggcttgcagcgtcgtgagggaaatttataatgtcacgagatctttcaggcagtactctccaagttctctccagtccaagtaacaaacgcaattgttgacgcgttggtggacggaaggtgatagtccagcgacgaaaattatgttgttggaaagacaatatatgctccgtagggcgaaggctctactttattgtgcttccaacgcaaccgacaccgtgataaaaggtggcagtggtaggggagctcggccagtaagttattgtcaggataaatgggtagatggtacgtagtccggaatgcttcctgaagtgaaattccagttcggaaagaacattgaacctcctctggcgaggaggaagtcgcccttgcgacgctcatagagacagacagcttgttcctgctcccaaggcattggggcgcctcagggaccctgcacacaattttatttggctacgatgaaccgagtacaccacagagcttcttagatggtgtcgtttgcttaggtcgatcagagctatttcgcacctttttgaatcgcatcctttcctcattcataggcccctccttgacagaggcgtacttgtaagcaacaaaagacagggcattcaggctgggcaagtcagtcatctagcctatcagagaggagatg

SEQ ID NO: 6403 - DNA, 700 bp, Nannochloropsis_gaditana
ttggtacaaacgctccgccatgcttctatgcatgtatagagaagaggagaggggtgagtaatgtttttaaaaggcgtgcggcgcgcgactgaggcgtgcttttcaggcagtcagagagcggagtcagcgttgacctcctgcccccaccaaaaggggactgtctggcagtatccggcccgggaatggtcacgctctctccggcacaagttccctgcaaaattatgcggcttgtatgcggggacactcccagaaattcagaaaaaaaaatattcgtgtggataggttgcgccctctgacgtgaagggtgacctcgcctcctcgctctctgtcggttgcctcgcctaagaaccctcaggacaacacccacacagacacaaacaaaacagccttgctcgcgatgccttgcgacttcttgacgccgcttcaatttcgtctttgtcttcgtatttacggaaattacaaaccttaaggtgctcttggtgagatgcgagtattcaaagacattctctagctagttgctcagcatgtcgttacgagagctgatatactctcaacaagacgacgttcatgggagcgactgtccttcaaccgaggaacaacagccgatacatgcaccacaaggcttagaggtcgcgaatggcctcctggaggccgccatgtggcggcagaggtcaagagacacgccgagatcctgccgatg

SEQ ID NO: 6404 - DNA, 700 bp, Nannochloropsis_gaditana
gtaccggcgagcattatcgaagaccagccagacgtcccgagcaaaggcttccggtgacacgtaggccttctccttcaagttagccttgatcgtacctagatccataggttctgtgacgatccggaaataatcgtccagcccaagctgctcggcgttgaccgggcccgcgaaccatccctcctcatcctcctcaagcaaccgctctacaagggtcatgcaccgattgcgccatcgaggaacccgagtccctatcctctcgcgtgaagggcacacctcgaaaacttcggcattgctatccctcactctttcttgactcgtctcgtgtttcttgcggcctggcttttttccaaaaaaaatggccaaagacggctgattcggccccccaacccgcttctcccttcccatcctcatctctgagggtttcgtcgagctgcctgcactatcaaacctgccctggcaattcacttacgaccataagttctgttgggggggaaataattgtaccagtcgtcagcaaagccttcgcaaatttctcgttgctgggagcagggcgggggaaggcgggagcgcaggcaaagcagcgagggcgacagaaacggcgaggaggcagcccggcgcccgcccttccccacctcccatgctcaccctttggtcccctccactccatgcgaaacaggtggacgcagccttcttatgaatg

SEQ ID NO: 6405 - DNA, 700 bp, Nannochloropsis_gaditana
cgcaggcgcgggcagccaatttttgggacacgtcgctcataatttggagaaactaccccaggggttcaaggtctccttctttgttccttcgtccgtgggacgttggacacagcggtgtgtgcatttcgtgatttcggggctggtgtcgtagtgtgtcggaaacgtggtcgtcttatccttgaaggagggcttctcggcagcaggccctcggaccgacgctcttgtgccgccggttccgaaggactcttaatgtcaaaaaggcaagataacgtttgttctgcaaggcgcacggactggtcggggcggtggaagggttgggatgatcgtggtgggtgaatgcatgtgctggactgcggcatgcatgtggtgtttggtggtgttggaactagtcctaggtagtggattgtagggcaacgtgctggagtgttgttatgtgagggaggcggggagccccatagcgccgggtgattctacgacaaaatattgtgattcaccctatttttgctccatatcggcacagggacagcattattatcgtcgactgtagattttattgggggttatcacaaagttgcagtcacgtagatttggcttcatgtctcacatctcgtgcaaaggactttcgcagaggggctagtagaagactgtcgccttttcattttagaccccatccacaagaggaagacacaacgaaggcatg

SEQ ID NO: 6406 - DNA, 700 bp, Nannochloropsis_gaditana
aggtgggacgtgcgcaattatcgatccagcatctagtccatccggaatattagtacgggggaaattctcgctcatgggtagcgctagtctggatggcaggaattatggcacctttccatcagtttgtgcgcggattatacgcttttttaaacgccccgtcttcaacggcgatcttacggtacgtgtccccagcctttcacccatgcctgcccttttcccgatcgtgttatgcgcctccatgagactaatgacatcttaatcaacagagaacgtcatgctgtatgcctcggccggctgggatgggcgttcctgtcaagtagcctttgtggtcagtgtgcttatcttagttcgcgcaagactgcctcaagcctactcctcatctcgccctgccagcttcatctctgccgcattcaaaaatcgtggaggcctcttcacgaccaacataagggtacaaaggagcctactctttcctcggacgtctgtggctgtctgtgacactcgacgtaaaagaaagctccactacgatgtacccaaacccgattcgaatgacggaaacttcgataattgggagttcggggtcaacgcgggatggagtggagagaacaacggtcgcagtcttagaataaagcaacatggtgacggttctactcaaagtgtcggtaaagaagctgaagaaagggagggtgaaaatcacaatatg

SEQ ID NO: 6407 - DNA, 700 bp, Nannochloropsis_gaditana
ccaaaacgtgtgtagcttccctcgggaaaagaactccaatcgacctccgtgggggaacgcgcaggtttcaggttgctagatggggttcgcaagtctttcccttcctgcttcttccctttgcgctctcgcagcggggcggggacgcgcttctcctcggtcgcttttgctggatcggtcgacttgccatcagtttttttgctaccctccccaagcaccatgatcacgctgtccctgtccgagtgatgtaattggtcattttccgccggggcggtgaggagacgatttccgtatcgagaaaatgccggcgaggcctcagcgacgccaacgtcatcggatttgaactaacacaaatgcatgccctcttccgactccttgtctttttaggccccgtgcagaccgtggtacgctactcgtattgttgtgtgatgaagtctgttgtacgccttctcgtgggcgcaggaaaattatgccaagcgcttcatgatctcttttcttacgtaagcttgagtcctgagatcacctcttgcgagtattacagctcgtaaaataatccttctttttccgatcatcatttggatttaccaggcatcaaatcatgcgtaacacgttcggcttggggatgcttgctttttgtgtcggctcctgttctgctttcaccgtgcctcgtttactacgtgcatcatcaagcccgatagctatg

SEQ ID NO: 6408 - DNA, 700 bp, Nannochloropsis_gaditana
gaggtagcacagtggtcataaagttctcatcagagaaccccgttgttcgggccaggatgaaaaacagaatgatgcgtatattgtttataatgcctccatgtaacggcagagctgagacactacaatcggaggttgatttagaacacctaggggttatttctttccccatgtcgcttagtacccaatctaacactgtaggcctgggtaaagtgtgcccaagtggacttcctgacgccttcaccagtgtacggtgcgcacaacgacctcggggcggtcgtccaaggtaaagagggaaaacctgatctccggcctcgcccacacacccgtgaaggaaagcagtttcggcgaagaaaagaaaactaggcgatcgccaagactcgtcgctcccgtgagtcctcagatgctgcagggttgctcccaaattgcgtggtaccatgctcactggctgcgacggtttctcgtagactgccggtgcacttatcgaggctggcatgctcgtcatcttacggtctcctggtgtcgtgcaacctcccgttttcttttctgtaacttcactttccctccactacagcagacacggactccctcggagacctccccagctcccccaccatcgcgtgtatatttgatacaagcttggatctactgacagactcgacagcattgcacaacttgcgtggacgcaggctagacacacatg

SEQ ID NO: 6409 - DNA, 700 bp, Nannochloropsis_gaditana
aggcccgttgcaatttacgtatcttctcggcaggatgccatgtcggtgctacctcactcatgtcttatacccaaagcacatgataccatggaaaacaaagtttcttgtagcgccagaagtaaagcttgcaagctcatggtcgccaccgtccttaattgatgccggtgaggatgcatgaagttggaacacacttctatcaccctcatgtacaagcatcgtctgggccctcgaccccggcgcggccctgacggccgtcaaaccttgccacattagacttcgccagaaatgcatggactactcaaatatactcttgatattaaatcggtgaggtgcattgggtaacgatcccagaccagacggcatgacggagggcaatgctaaggctaggcatgtgaggtcgcgggaacacgctgtttgttgccctcctcgccttcgaattccttggcgagtggaaagactaaccaagccgtcccgaggtccatctccgcgtccgtgtcatgttaaatatttatggatgtcaagggacgcaggaattgaacggatgtgtagatctagctgcagtttgatcggcggtaaagcggacaaaggaattttgaggccgatcactccactgaagaagtcgaagaatgacatgaagctcggaaaaactctaaacctccgcaatttccatttgaatcgatataaaccataggaagcaatg

SEQ ID NO: 6410 - DNA, 700 bp, Nannochloropsis_gaditana
cggagacaggtagcaagtgccacgccaattgtggcatttgcttgctgttgaaaggggagagtcaaatgcaagcccctgtgaagggaatgctagaattggagaagacagggtcaacaaaccactttgggcaattaagatgaatcgcattcctcgaggttttgagagaagtgcaattgggagcatttgaaccccgttgtggccaggaaaaagctctcatgaaaattatgaaagcgtgcttgcctgcggcggtctcggtacccgccccatcgcccaaagcggacagcgatatcacctgcctgatatcacctgccccgtccctgtcctcctcatcccgcccccctcgattggcgcaagaccatccaaaaattgagaacaccctcctcaggaaacagggaagtggcggatagcttgctttgatttgctggctcataatatacttttaacaggctcaaaatcttcaaatagcagcaagaagcgcattcttcatcctccgcaaagcttttccagccggcctggggcggcctcatgcgacgcagccacgcaccctcccttaaaaagttgccggacagcggtcatcgctttgccagttctagtggggtcgaaaatgcaggaaacagagatgcaggagcccaaagcggtccgagcgacggaaagcatgctggcgcaataacgggagaaagcatagtggcaaggcgcaatg

SEQ ID NO: 6411 - DNA, 700 bp, Nannochloropsis_gaditana
gggaggtcaaaaaagattatgtcaacttatttcataccgcctacagacgtgtgtttgcagtttcggagcatacaggacaggtgcagagaggcctcaacgtcgtactcaaaccgatcacaggcttgactcaagcctggtcgacttctcgatccgtcgcttccatcatttccctctcagctgacgcacctgccagtgccgccagactgctgtacgccccgcctcgcctcgaccctgatgaaagctcagaagaacacaaataaatttactttttttagagttagatcggcatgataatttattatgtcgtttgcattgaagaatcgggacccaagatcgaaggcgccgaaggtcttattacaagcaccccagcagcggcacacgtctttcaagagtgggcaggtgtaaaggagtttcttgccacaaagacccgcagtactttttccattcgccccttctccaacctcgaagatgctcagatatatgtacgcactttgggataccagaaatgcgcctcgacggttgttggagaggaaaatatcgccactgcaaccctggcggcgccatgtgagggtagcatgaacatgtctgccggttggatgcattcacagctcgacaatatgtgcgctggaataaatcttgatgcattacaatacaacgccctggaggaagtcctcctgcggcgaaggaacgtctttctgtc

SEQ ID NO: 6412 - DNA, 700 bp, Nannochloropsis_gaditana
ggcgttgtgatttccatcttttagatatccagctttaaaatatccttaaaagctagtagtctctttctcaatggattcgaaaaatacgtgacggttcccaggtcccgaaacatatatatgtacatttttagacgtagacgttagagtctgtggtgcccgttccttcaaatgacggaaggaaagagccttttcaaccatgtttggcatgagttctagcgcgcttaaactaaaatacaactcttgtaattcacaataaagttcggaaggcgacagatccattaagtgactcaagttacaatgtatgccactcaatcagaaaaaaaagggaaaaaaacaggcgagcacttctgcaaaatttcagaacccgccatgtgccaacaacaggaactaatcctttctagtcagacttaccacggcgcctgaagccagctttcgtttacttcaccttgcaatcacgtccggtagggtaaattgtgattttttaaatatcaacaatgtcccaccgcaattgggttgtcgcatggcatgtcgcaagtggaagttcgcaacagggtttccgagtttcgacctcctatcgcgaaaattaactgaagggcgaggatacagctgttacggaggaacaacgattgcaaaaaatagaggtagtccaagctcataaaaagccgggaaaggctggactcacttttacaatgcacagatg

SEQ ID NO: 6413 - DNA, 700 bp, Nannochloropsis_gaditana
cgctgtgagacacagacaaagccatcatttgaaggaaagcccacggaaatgctgccttgcgaagacggggggggagttgtgtgaattaaatcgatgtcagctacaacacatacttccgcggcgcgttcagcgaggtcttccacaaggccatggccgcgggcggctcagcgacatttccaactcctttatcatcccctcgcgtaattatggacctcttacaccccatcattgcgtgcacagacaataaagccatggggtccgcgtattacgatgcagaggccggtcgctacgtgctgctggggtacgcaatactcatcacgtttgccggtactctgggtaagtctatttgttcctcgtattatccttatttctttttttttgaggggaaatttgcctgcgatacgtttcttaaatcggcatgtaagtatcaaaaactgcattgacacgagtgtacttgatcacgataaagcttaatcacggattttgctacccaaagctataggggaggtttgtcgttttttgcgttatgtgtccatgcccgacgaaatctgtgatatcataataacatgtcaaatgaatttttgattctgatcctttccttggtgccaacttccacatttacaacaattcatatcgcccgatcgttggttctcctctcggtgtagcttgggtgaaggctcgttctcgcatcgaggtgatg

SEQ ID NO: 6414 - DNA, 700 bp, Nannochloropsis_gaditana
ttcctccgctcccagcatgtgccccaagcgccggcggtaatttccaatccatacggccgccccacctgtagccatatgagggtcaagagggaggcgtgggacatggcaaagtgtcaagtcatggatagccgggcacgtgcggaaaaacgtggacgggaaaaggagaggaggaaagcaacagacggcgatgtcaggcacaatatacaaggcacgcaggggacgctccaaacactcgcatgcgatcatttgggtgcatcatgcttggtgtctacgcggagctatgcgtacgtgaggtcggtgtgccggtcaagttcgaacggaagctagattcttggcttattggcttagcccatcacgaaacgaagtggccgggggatcgtcacctaaaaggtcattcgagaaaaatggaccgatgtggactccatgggcagcgaaaagctcgtttctgccatcttaatacaaaggagcacaatacttcatctggtgcctgaaagtggatagcttatccatgaaagggaaggaatgttgctggctttgcttacgtccttgggtgtcctcgacaaccctcattagaccaccctttttcatctcacttatcgatgatcccgcacaggttaagcttttcccttggattgtcctttacttgcaagcacactgaccgtgatcctgcctcagcgcgatactttgagcggtggccatg

SEQ ID NO: 6415 - DNA, 700 bp, Nannochloropsis_gaditana
gtcttacctaaccacacattgaccgctgaaacagcaaagagccttcccatcgaaagatgagaatgtacccctatagttcgtggcataataattgattgagtcacttaatttgggtcaagttgtgtccgtatcaaatgatagaatttcctttgcgaagtggatgccttctcctttatctgcatcggaattttccccgatacctcggcttctttggtaatttggggctcgaagatggatttcgtcgcaaacttcccctacaagtaagatacgccatcgcgtctcgacgtggctgaaaaatgcacgtgccttggtgtgtgttgcacccaggggatgggccttcgacttggaataaccgatcctcggagaatcgcgagcccaagtatcttgacggtcgacaaggactcagcccgctaagtaatggcgagggccgttgccagcgttttggggcgcaatgggaccgggccagtggtgtgcttgttaggtacgtgcagcgtgattttagcatggattcttttgaatcatgggtttcttttactttttttacctaacattgcagaggacgcggcgctttttggaaactacctcccctgtcacattgttgcgtacaccaagcatgacgagtgaggctttgccccccccggcctccgaacttcatgtcacgaaaaaggcaaaaaagctaccaacactaccagggtccatg

SEQ ID NO: 6416 - DNA, 700 bp, Nannochloropsis_gaditana
aattttgcagcggtggctgcttgctacgcgctggatcggctgggttgtgggaaagtcgctatattggacctggatgcgcaccacgggaacggccatcaggctttcgtccgcacccatccatccatttgctatgcatcctttcaccaaaaggatgctttccccatgacgggtttggatccctgcgactacggtccgcatgggaacctactggacgtgcccgtccccgcgtacagcgacctggggacttatcttcccctcctcgacgacaaggtcctgcctttcctgaccgccttcgagcccgaccttctcatcgtctccattggttacgactgtctggtggacgacccgctcgcccagttggccctggggcctcaggatttcaccgcagtcggggaccgtcttttgagggcattcgggagggagaagattgtattcgggttggaagggggctatgacccggataatgtcgctgtcgccattgtctcgactctgaagccctttttataggttgtaggacgattttcagacagtgcttgtctgcatccggaacgccctacgaaagcttttttcaaagccgctaatggcaggcctttaaaagtattttttaaccgtaatggatttcgaaacaatcacagaactttgttgtccgataattgtcgttcttctcaaaacacccttttcaattccatgacagaccatg

SEQ ID NO: 6417 - DNA, 700 bp, Nannochloropsis_gaditana
ggagaccctgaagacggggcgaagacgaacatatgagcttgaaaaaagaagtcgaggtcgtgccttgatgaccaagaactttttatgaaaatgtcgtagaaagcaagcctctcagaccttggcccacttctatgattggagcttccgccatgcccgttcaaatcagtacctttggaaaagttgtgccgtcgacagattgaccctggctgatataaaagtacccggagattcatcaagtctggtggcttcctccctagccccacatctcaatctggcaaacgccacgtcttgtccttttcgtgcaggtttgtgtatgccttgttgtaagctggcgacttatatatgagttgtggccttttatgagtctcggtggcgcgtttcgtggtcaggcagacaagcctcttgagcagggtccagtgtgcacgaccctcatgccttactttgttccatgcactccgtcgctcttctttgtccgtactcaatcacccaggcgaatagtacagccgtgttgccgcccttactttttgtccgtcaggcgctcgaccgctcgtccgtcagttggcccgggcttgcaatttccgtcaagtttgttctgctccctgtccttcaaacgcactatcagcagtcattgtcgggcaccatcagcatcctccgcacccagtagcaagtaacatcctgagaaagctctgtcctcgtcatg

SEQ ID NO: 6418 - DNA, 700 bp, Nannochloropsis_gaditana
aaagatgaagcaattaaagcacagtggaaagaggcaaggaaagaagcccgaattaatgttattcagcgggcaacaaaagaggaggaaagtacggttgaggaagaaggtggtgtagatcctgaaatggcggcattgatgggttttggaggttttaagtgaaggtttaccaagagttcttgtatgcatacgattgcttgaaggttcatgattaaggtcaagagggagacaattatagccaccaaatacagcaagataaaaggaaaagtaaaatgatttaaatgagccgaaagtttcttggaggattgcattatatcaccctttgtatgtttagtcgctgcacatctatattctcaggttaataagggtcgatgctcctttaccttggagacttttatgctcccatgtagagctgatcgacatttaattctatcctagccgacatctaattccatcctagccgacatcattcagaaagcaagatacttgcgtatgtagacttgcccggctttgtcttcccagggctcttttttgttaacctcccccccctgcaggcacggaagaaaaacaagagcagcagaggcttcgagcctctatgatcgatttgaactcacatctggtatacttacacaaaagcagagtgtaaatacaacctaagaacagagtctgaggagtgaggcttgaaactgcagccttggtcatg

SEQ ID NO: 6419 - DNA, 700 bp, Nannochloropsis_gaditana
aagctgtgtagcaccaaggcccgtccaagaggccagcaagacggggtcgagggtgggtgatggtaacgacgggaggggaagcacgatgggggtgccatcggaaacgggttcgtcgatgtccatcgattcgtcccccaaatcgtcttcatcaatgtcaattcttgacaaagaaaggtatgtgcgccatccgagagaagacgtggcgtacaggaacgccagggaacaaaggacggacatgcctcctgtggtggacggtaaacatggaagagttgagcggcggcttgcacggattatcacccaatataaaagggtaaagcgccccaaaaccaactcgctcgcctccaggcattgtaatttatctgccatccacaagattggtcgtacaggcggtctttgttgctcacacagaccgcctctaaaccccacctgttccatctcaccccactttcgagtgctcgctctttccctttcagcgagcatgcccctccctctttcgtaattcatgcccgccactcctgtatggcttatgcctgctccaactcacgccgacggccccgctcaccccatatgaatgccatagcagagtgacaggttcacggtccgatttcttggggctgccgccggtgagaacgaggaatttcgtttacacacagcggcgcagaaggcattgaaattcccttcctctacgtcacacgacatg

SEQ ID NO: 6420 - DNA, 700 bp, Nannochloropsis_gaditana
tattcgcactgggtctcgtcgagtccgagggtaggtgcggcgatgtcaggaagggtggccaaatgggaactctggatggaagagagcgtgggaatgcacacatatggcaccctgtttctctttgtaccagcaataaattttgtaatggagggactggtgataaagcgacgaggaaatcgaaggaaagttgccattactgcggtgtctagaggcgtctgcgtaggacgtctcggacgcacacaaaacgttatctttgcgcacgacggatgccaacgctgccacccttctgtccgcgtacaggagaatcagctttgcttaaatgtacagcaatgcctgtggtgcgcgtggtgggtgttaaatgaggtagatggtgaggtcgggaaaagaaaaaaatgcacaagtgaaatgctcgaccgcaaaacttcaagccgccgtgaaaaacgcgaggtaaaggtataaacgtgagacaacggcctccgtcgccgactcttgcacattcctgccaaggcgctcttcttcactggaaatgagcaggaaactagctatgttttagttgtgcttatgaaaatgaaggcctttttttactctttgtgccctgcctggtagcgtgttaggatttacctcctccagcttgtctgttgtgtgctcatccaatgctcccatcccatcgctacgcacatgcaggtgcccagacacgatg

SEQ ID NO: 6421 - DNA, 700 bp, Nannochloropsis_gaditana
gctatgtcggcatgcatggagccacgttgtgaggtggcttgaaatacaaacagcattccaggaaggagtgccgtcggaagatatctcactccctcccgctcagttattgatgctttttgcgtctcctcatcctcgccaatattcacagaatttcagcatgatccaagttcaagaccatcctgtacaacttggcgatgaaaggcaagatgctgaggccaatggcaaggagtgcgaggcggctgaaaaaacaactgatagaacaagccaaaaaaagaagaaaaaaaccaagaaaaaaaagaacgtcccgcgcatttccgacccaaatgcggtctacattccccccatttaccggaataacctacggattgtcgcatcacctcgtccaggcgtcggaagatgtgcggttgccgtcaaatccctcgctccaggggagttgatttttgaggaagagcccgtagctttgctgaactttagtcggtacgcatcggagtactgcgttttttgtgggaaatttgctgctgcgggaagcggccgcttgacctcagtaagggacgtatttattgacggccccacatattgctgcgcagacggcgcgtgtaccaacaggggctcagcccatcgcctggcagggaaatccgtgtggacccgcgtggcggaaattgcgaaggaagaaaaggcagacgtgtatttgttgagcatg

SEQ ID NO: 6422 - DNA, 700 bp, Nannochloropsis_gaditana
atggtgccacatgaagattcaatcagagcttggttttatttcttgtttccttcgtcggggtgcgtattagaggaaagtggaaaagaaaaaaacacttgatattaagttggcgaacaacattttacagaacttgcgagagaaccagctgcaaggacgcaccgggtcatcaatgataagaggtaatatgctgagctatttaaaagagaaagagcctgggcaaacacaatatcagtccaggcgatgaaaaaaaatcctcgaatttttcatccgccagcaggacagtaaaataactcacggcgtttcaaggcaacagaggaacttcctcgacatctgcagcaactgcgcgtcagcagctgatgtaccttttcgaagatttttgggataaaataagcgacatactgaagtggcactttttttggtcgtgactctgcgggggggcgacgccctactccttctccacctcgttgccccagccttccataacttggggtgtggtcacgcctgctacgtgataaaacctcgttcacgcttgtcgtgctgtgtttgtgcgaaggagcaccattgtatgtcatggattgagtcttacatcgttttcttcttttcggaaatgtgcttctatttccgtgtgttccggcaagggttcccactaactacgctacgtctttacccctagcatcgaccagacggctgctaacgcatg

SEQ ID NO: 6423 - DNA, 700 bp, Nannochloropsis_gaditana
agcagcattggacacatactgatgcggtaaaaaataaaagcaacaaatgtgtccctcaagaaatgatgctgagccccctctgggtgggataactttaaatttccgttaacaaaaattcaaactccccgaacagttgattcgaactttgaaaagcgtcgaaattagagcgcttgcagaagggagagagagcctaacaatacgcaattgactgccaatacagcgtgtgctaaaatgtgaaatttcgagacaggaattctctcaaattgaatcgtgaaaaggataaagtgtcatttctggcagtccttacttcgcctgaccgttgctactagatcatgctcgtgctcgttctctcgtcattgtccttggaggaacccatgcgacgacgcaacttcatggaggtgttgcaatttttataagcacgaagcgtccccataaacctctagaaccatggcgctatctgatcaaaatattgctgtaatcgactatcacaccacaatatgtgactttggttttaagagtagcagaaaggatcacttccctgtaaggagaccaacacacggtgtgacacacgccgcggtctaacttccctcgtccatgctttttttttttcttcaaaatttcccctcgatcaacttaatttcaggcataggaaggagggtttggcctgaaagtggccgtcgagagattgaaggcataaatg

SEQ ID NO: 6424 - DNA, 700 bp, Nannochloropsis_gaditana
aggaacccgaggcggcgaggcgagtggaagatacacagtgaagatctccaagtaccctcagggccggagagttggtgatagcgtgcacgcgttgttctgagagcacgcggtctgtgctagcggggacgggatcgtcacaccaatttaacggcaccatctctgccgggtctcagaaatgtgctgccggccctgggaccttggacatgcccataggcaccgtggagtgtaggcagctagacggtctgagtgcctggtgtgggtgctgcattcgctactgttcccatcgcgtaagatgctttatgtgaatgttgggaaaagcggagaagatcaagcctcgctctgcttgaacaaccccttggtgccatttgccacggcgctcacgttgtatgccgtggtgctcaattgcctcacaacgttgtcagcatgactctgggaatacctttatattctttggcgcggtggccgagattttccccccatgtagtccctcacaaccccgaacatgctttgcagcgaagcaagatttctgggccgctcgatcatctccatccttgccacagtttttcctcttatcaagcacatatttacgccaattgccgcatgaaatgctacacgcacaggtattcaagagtcacggagtgagcacctgttttattcgaaaatctccgcctgtggaggagcagtggaggagaaagacatg

SEQ ID NO: 6425 - DNA, 700 bp, Nannochloropsis_gaditana
  misc_feature (426)..(435): n is a, c, g, or t
cccaggacatgcccacctacacgttctctctcaacaaaaagggcaccattgcgatggatgtccatttttcgaaaggatggtgtccattttcgggtcaatcggggtggcggagtgcaggacttgcggcctctccattatcggggaggagccatgttcacccagagccagacaaacagtaccctggcaaaagacaggcgtgatgctgttgcggatgtgcaaccgactggccaggaaaaagcacccaagacctcacgacggcctccacagtccttcctctttggtctacgccgcagtggcggcgcctcagaggcgacagagcgagcaacgacacagccacaccacagccaccacgctccccccaccgaacaaaatccaagtgctcccacggcccagtcgactcctacggcgtcgaactctgcgtcctcnnnnnnnnnnctcccagcctccccccccctccccgccccaagccacaccgacagaagcaaccccacacagggctccacagacacacaaagactcattactgccgcaacaagtatcatcacaatcaccgccactgccagcgcagcagctctcatcgcattttccccctgccgctgtcgcgtcggcaccaggcctcgggcgggaggagggctctctctcggcatcagcgtcatcccttccttcccctccatccccacctccttctctttccacgatg

SEQ ID NO: 6426 - DNA, 700 bp, Nannochloropsis_gaditana
tcagtctctacgctaagccaatgcacactgctgcaggcgctgtccgcggcagaccttttcacgacgccgctctgagggggttcgctcacgttgaccttggtggggcattgcgtcgttgtagggttgcaattttcaccgtcactttcatcggaggagtcgaaggcggcgcctgacccgaacgcactggataagagagaagtcaggtaggagctcatgtttgagatcgaactcgtgcaggtcgtgcaataggttcgagagttgctcggcttgaatgaagcaaccaccaggagagggcaagcacccgacagctcgaagactggccgcctgtactatacattcgagaacaagaaacaaagatcaaatccgcggtctatctttcaaaacatgcacaggggaaacaagcagccgggcgggatgtacatgtgaaacagggtgggcggctggggaaaaaaacaagagagcaagcgcacgcctgcacggcaagaatttggcgagttccgcaaccagagagtatcgtatgcgacgtttttccattgcctgcgactgtgcgtctttacgtaccacgagcaagagacagtgcatgttttgtgggtgataacgcgatcacatcagggttgacacacgttatttcattgtgccttgcactgcatccgtaggtaatccgtaaaagcggctactccggacgccgggaggaccaatg

SEQ ID NO: 6427 - DNA, 700 bp, Nannochloropsis_gaditana
cgcaaaatagcagcggagtcgtcctctaagtcgggatgccggtccttttcttcctgaagtaaggaatccagcttcgcagcatcgtcgctagccgccgcgtccactagctgcgtcagaaacgtccgagcatgtaaagccgcttgaccctgactagctttatcttggtcgtcttcattattatcttgtgatgtgtgggacgagctgagggagtatagggaatgttgacgatggattagactccgcattacacgagagaggaggttaagaaaggtgcctcgcacgcactgcatacctggttgccatgctcgtaaatttcccgagggtcagctcaagcaccgcacctgtctggaagtatcaagttgtgagtcgaggaacgtaagagtgccgccctggtcccataccattcgagaaaaaggggctcctgcagatcgtgttggaacatcgatggagctcacactgcgtcctgtcgcctggggggcagcaaaaacaaagcaagatccacgcgttaactgggaggacaatcctccattctcggtctgatcccgtcactcactatctctgtgatacagagaggtgtgcggattgtgctgacttcgtaccttcccttgttttttcaggtggttgataaagttgcctcggtacgtccttgtacgccccctccccacctgatttccaccgtccgtctgtgtgcacaaacatg

SEQ ID NO: 6428 - DNA, 700 bp, Nannochloropsis_gaditana
cagcccccaacggcacccggcaacaaacgcttcagtgtgcttcatttgatgtgcagatttggtgaacatggctggtcatattcaccaacctatgacatcgaggatatgtgacgttcaaggccgcgatttaaaattccgtgccggccattgtaaatcagggacatgtcatcttgcccgcaaacaggatgtgaacagccttactttttagtcgttgcacagctaaatagacaccaccatggtcacaccggggacggacgtatgttctgtacggatctcgttcgcaaattcttcctgtataggcaacttcactcatgcattgttctatccgcctcagtagtggcttcacaggtctcaccaagcagccgtgttcgtacacatgggtgcctatatcagctccagcgtccaagcaaattcctcacgcccgcaatcctcacgccctgctttatcatcgtctaataattccggccctgcataccgtggagggcatcttcactcgtcccatggccgtcgacctatgcggctgtcgcggcacaacccgtgggcatttcaaacagcagtctccgaagctttgaaacgccggggctacattgacgctttgtgggatgctctgtccaatggcgacaaatcctctcaccgggcgcctgtgccgtgtgaggtacttcccctcatcttgcatttcgctggctcgtacaaagaaatg

SEQ ID NO: 6429 - DNA, 700 bp, Nannochloropsis_gaditana
aaatgccgcacatggaccatcctactccaaggacagatatgaaggcctcacaccgtccctgccgccttcgcaagaccacaagggggaacggaacgagcgtcaggcgtcgcgcaggacccaacagctggctgcacgcggagtgagaacattccctgccgcgagcggctcggatcgcttccatgttcaacatgggatcaatgccacgtcaaggccccaaaaggccacactggggggccacaaccatacttaacacctaagcatgagtatcttctgcaggaaatgtaccgtgttccgggtagcaggacccctaagttgtcgaatgagccaaaaattatgacaagcaaatcggcaaatagccgttgacgccctctttcccttccggccaccccgcgttggatgtttgccgggcaaaggctcttctactcggtgcccgtgatgaggcaattaccgaaatgtgggctgcacgaaacatcgacatgaagtttcgcgtttgcttttgtttcctcaggaataagggtagaggtcatatggccagcagaaggcaggaatgtgtctgttctgctcgaaatcagcactgacacttcgcccctcattcgaccctcgaaacttttttccgcggctggacactcgtacgcacgcactcaccatacactccttgctcatgggcttcatgaatgaatgtcacatatctcatccagat

SEQ ID NO: 6430 - DNA, 700 bp, Nannochloropsis_gaditana
gtaaagatatcacatgcgcgtaaaggtattgcttgaatttcctctttcaaaacatatctcttataagattacctttttttaattataaattatggttacggctacgacagtcaccgattctggaacgtatttttatggtgggtgtaagggaatcggtgtattttgtgctatttctgtggaaactcggcgatagtgacctaaatatctgcaacctgcgcaacagtactcgtgacgtaaaatcataaattgtgggactgcttcgatttctgaaaaaggtcatgtgtatgaagattggacttcgtggcacattttgtgtgtcggacccgtgatggggatgcagaggatcgggacgcttactagcttgaagggggcacttagaaaggggccaagtttatgaaacaaaagtcacagccctccgcaggtatgggaccgtgtcagtctcttttttgcgatttgtctggtaaatgcatgaactcgtcgttgtcgtactgcaccaagatttacacgaaaaataatcgaattgcacgcaagtcagcgaacgatgcttctgctgcagtaagtcacaggaaaatacctccgcaggaacaataacattcttgacattatctaagactttttggttttcggtacattggatcaatataatgcacatgacagttagcagtaggccactggaaaggctgcaagatacttcttcatg

SEQ ID NO: 6431 - DNA, 700 bp, Nannochloropsis_gaditana
ttctaatctgtgcacaatgctcatactcatttgctcgtttgctacgcgcatgttacacgtaggtgtttaggtatgttgcaacaggcctgcgcgcgcgtggaatcccctatctcacgccgtgtatgtgcaggagcagctgctgctcggataaccccgagaattgctgcattgcgtgcagtttccaagcatttcacatatagcgaacgacaatttacctccagtactggcgcttccaacaaccctgaagctcgcccaccttttcccccttacacatttgaaacagccactgaaaaggtaattccttacacacccgcaacaagtggttttatgatctagcttgacaatttagtcctctcattaggttcgaaaggcacaagacgcttggaatactcgaaatcctgacgtcgtagctctagcatgtacgtcttgtggctgaactcgggttctggtcatccttctcttcatttctcaacctccttttcgctgtcacgttcgatagacacacccgacagcaactggcggaaccgagacgaatttttccagggtcgtgaggtaagtagcgggcctggcatctttaccttccaagagtggtgaagactgtgcaatctctgatgcgtgtctctgcacttcctatgcacacaaggcaatcagagcatttctgcggaaaaagtgggcgaaagagcgcgattattgtctgatg

SEQ ID NO: 6432 - DNA, 700 bp, Nannochloropsis_gaditana
ccctatgggggcgcggagggagggccggatcgccttgctcttcctcttcaaccacgccatcagcgatcagacgtcctgcaacaccctcattcacgagctccttgacacggttgagcacatccactcatcgtgcctggaccgtcagccaactcccgggaggccggctcccttcgtcatcccccaggccttccccccttccattgaagaggctgtgcttggtcccacgcgagggactttgagtctcaccactctcctctacgctgcccgtgaagctctctttggcatcttgcccaccacgctctttccccgctttcctccgccctcttacacaccacggccgacggcggatccagaagggccaccggagagacctcccccgtttctccctgcggccacacggaggacaatatgcgaattccgtaatttggactcggactccttgtcgatgctgagggccgcctgcaagtcacgcggcgtcacggtcactgccgctctctgcgccgccatgttgtatgcgacgagcgactttgctcacggccaggacggggggggaggaagacctgagaggggccacaagcagcagaagggcagagagggggcgtatcacaactatcgcttgttgctatcgctgaatatgcgggcttttgggcgaagcaggaaggacgagggaagggagggaggcggagaggaagagaagatg

SEQ ID NO: 6433 - DNA, 700 bp, Nannochloropsis_gaditana
tgtctcagtcctgccaaaagatcaggagtcacttacgaaatatcaacgttttcgccaagttatgccggtaccaccaccgaacgagcgccgtcgttatgcgttgggtggtgcgtcctcaagcttaccttccatggaagctctatgggcggaggcgtggccgacagcggcttgtaaggatgcaatggagcggcaaaaagcgctgagcgatggggatggtcctccccaggcaggtgcactcacgcgaaagtttggacacaatgaaacattacgcgcaatattctataaggacgcggcatcttggtgtccctactgtgcttcggtttggatgacgttggaagaaaagtgtatgccctacaccttgaagcgcatcaatctgctttcctatggtgagaagcccgaatggatatacgacatctcggggacaggactcttgcccttgctggaagtaaatggacggatgatacgcgagtctgttgagatttgcaagtcgatcgacaaatggcaaggtttcgacgaaggcgtgatggtaaaacctcggcggctgtggcccgacgagggggacgcactccacgccgaagccgaagcattgctgggcctggagcgggacttgttccgggactggtttgtctatctgtttgagaagcccgagtctcatggccacgatgaattttggaccgtgctccggcaggtggagagtgct

SEQ ID NO: 6434 - DNA, 700 bp, Nannochloropsis_gaditana
gcttttctcgaaaagatcgcatgcatgtttgcctctgattgttgaccggcacgacgtgatccgtacccctgttccctgtttgtgtctctgtgagcgcgtgtagttgtggttaagtgagtcacagggttctgaagtgtcattatttgtctgacaaatgtcatgtatgtcctgggataacctgaacgtaacaagtggacatttatgtttgttaatgattctttaaagatactcttctactctttcatatctctacctttcaatcatttttttttaatttttgggggttttacgacaccaaagtaaggaagtgagaaatcgagaaaaggtcgattgggggcggctttccctttacctgttgaataccgcatcaacgaagaggttcccttcccaacttaatagtcatgcggcggatatcgtatgtttacccaaaattagggaagcttgtcctttgatggcttaaattagtggattcggtgtgaaccggcaagccatcgaaaaaaaggaaggattggaaacgggctactcgttccgaagggaaggagccaggaggttcaacgagggtatcctgacggcctctgtatttctgtaattgagtgtgcagtgttctgttttaccgtcaaatgtattcgtgatccaattctaatctgtgcacaatgctcatactcatttgctcgtttgctacgcgcatgttacacgtagg

SEQ ID NO: 6435 - DNA, 700 bp, Nannochloropsis_gaditana
agaggaataataagtagccaagataaagctctgactacgtctttggccccaggaaattcaaggggggagaaaaggtccgctggtgaccaggaacagctttttttgattgagagccgtgatgacggcctcagaaatgtggaaaaacgatggagtggaatacaatcagcagagaaggttgtacaagaaggcaagagcatcttgaatgcgaagaccaaacgcagcaaggtcgcttagagcatgaccacgacatgatggtagtgagacggtcatagtgaaagtgccgactgtgccggtgtaaatgattgactaggtaggccttcttctattgtgccaccaaatagatgtgccttcatcactggtccatgtacgtttgacgatacaaggtaatttgagcatgcgaagactccagtccaacatcaaggatggcttctgtgtccatctatttaggcttatcctgcatccacatgactatctcgccttctcacgaatatcttctgcctctacttggccgtctagtacatgtgtagatccaaccttcaaaggctttataaaaattaatcacagataactcccgaacagcgctgcatcatcccgctgaagtctgaagtgcacgtgtgacaccacccctttgtgctcccaacttctttatgcgacacgcgatcctcaaggtatcttttattggtaagattagcttctgatg

SEQ ID NO: 6436 - DNA, 700 bp, Nannochloropsis_gaditana
acccacaagtcatgctatcattcagtgctttggcaaatcggtgagctgttaaagtaagaagtgcttcaattttccatcagccacgaagtctggctcacgaaaaagcgcgaggaggccatgggttacctgacttacgacacgccctagccagagcaatatatggtcataagtccctatgattgtatggacgttgcctgctctcaagtgttggcttttcatgccaagagctctgcttcatcacctgtcacgaacactgacaaaacagcttatctgaaaggaaagcgaaagaaactcctcttaaaagcccagtctaaatagtgtctttaactatgcccttacatgcgaagtcatgtagaacgcacaatctttctgctgtgttggtggcaggctattgcctgtcgtacgaagtgtctgcgtgtctttttcttggccgcatgcctcttcctgtcccgtcacgactttcgctgtagttgtctccttctccttttaagcctcatgacacccccatgtcctatcgatattgtgcaaacagacacgtgcgtccttcctcgcggtagctagaagtgaaacaagaagccagccatgaaattgcttaccagtgtcgtcgttctctcagcggccgcgatcctaagcgtcgtgaatggcttcatgacgccggccccccaacgcctcctttgtcgccaagttggaccctgccatg

SEQ ID NO: 6437 - DNA, 700 bp, Nannochloropsis_gaditana
catccagaaatattactctaccttttccgaccaatggtacaattttttacctttccacccgaatttggcttggaaccccaatcgaatcacaaggtaagcccctaatcgccctaaccaatttcctcgcgcctctcgaaaaacagaaagacctctcatgggggatagtagttgtatcaacattagaaaatgtaccagagagaagttttgtgtggtagctgcagggaagagtggcagtacatcggaaaagcgcacgcttagtaggtactgggtgggagctggagggaacaatagcagtatttaaattggcaaagcacaccaaagtcaggtactgagtggttcaaccctagtaagtgtgggaggtcaaggcgtgatgggcacggaagccctaccccagcttgccccgtcccaatgggccaatgggagacgaccatgtcaggaactcgctctgatcgcccgcgattcgaatcagcagcgatgttccatcgaaagactgcagggttgtttgctgtgccattgcgtcgacgggactcgaatgcggaatggagaggcattgtaaatgagcaggggagtgatgaattgacacgaggttcaaacaaatttgttgccggagtcttgagggccagccaccaacgatcgcctctaagcgtctcacaatttaaatttctgccttctttcgacgtaaacaaaacagagcatcatg

SEQ ID NO: 6438 - DNA, 700 bp, Nannochloropsis_gaditana
  misc_feature (1)..(62): n is a, c, g, or t
nnnnnnnnnnnnnnnnnnnnnnnnnnnnnnnnnnnnnnnnnnnnnnnnnnnnnnnnnnnnnncaaccccccccccccccccttccaattcttcggatggcgtcattctgatcccgtgtctgccataatactaatatacctgagagcacgcctttctgaaaagagggtatataagctggtagcatgttttccatggtaatcctcctgataaaattgatgatattgatgagatggggttggaaggaaccctgcactgtatttatcacataaccttttttcatctcttccccctgtatcctctgtcattgacatggacacctggtgcattgtcttagaggcactagtaggtcgcttccgaaatggggcgcgagactgacatggtgcgccgtttgggggtggcattagcgggctcgtcgacaaatatctgcaagagagccgtcaacggtgggaaaggggccatgagcgtggtagcaagggtgcgaccatcgccgcgacgacaggcgtcattacagtccttacaacttctaagccactcaaccacattccgtgctattgccagtagcagtgtttgcagtgcggtagggggaggaagtgaggggggagtcagtcacaaaactgacaaagtaagctccagtcatgactgggctgccttggtccgggattacgggaaatcggatgccgtgtctagtagtataccaatg

SEQ ID NO: 6439 - DNA, 700 bp, Nannochloropsis_gaditana
ttccgaatgaacgtcaatgtcaaccccgcgagcggtgcgaaacaagcaggttcttcccgcagcccgcgtttttgtgtcgctaggtccggtaatgcgcgacattgcatctgcgggaatgatcgattccgccgccttccttgtcagagtcttcgcataagtcccacccgaccgcgtgcacaggtagccgtggctctactggcgctcttcacgatcctgaaggagactgacatgtgcaagagagatcctgcatgtccgtaggcacagagtctggctttctgtgcttaagatcgtgcggcgattgcatcacttatctcgtggcccctttccctgctcactttttgatttttctcatctgaaaattacaccatagggacgacagcagtgggcaaaatgtctccgcaaggcacattgctgggattgtaacactgtagcaaagaacagtatgggaccccaatcttcacgaggagcccaaaaagagggatgcgggactggacacaacgtgctttggtggtgcaaccaggacccgtgtggagtggtgtgtgccggcgtgacctggagtttgatattgtacgctcagtacaccatcaataagatagtgatattcgggtggatgggcgtgctatctctatggggttttctaaacgtaactgccttcaatgccacagcctgcctggctataatttcccatgtccgggccatg

SEQ ID NO: 6440 - DNA, 700 bp, Nannochloropsis_gaditana
cgggaaaacgtacacaatggaaggagagagtattaagtcgtctcagataacgtcgtcggcggaaatagagaaagggataattcccaattcatttcagcacatttttgaccgtgtagctgtctcagtgaaccaacaattcctagtccgggcttcgtatctcgaaatttacaatgaagaaattcgagacttactttccaaagaccctcgaaacaagctagaattaaaggagcaccctgatagcggagcattcgtcaaggatcttaggacaattctcgttagaaatgttgcagaaatcaacagagtcatgcaaaccgggaagcgcaatcgttcaacaggagcaacacttatgaatcaagcctcgtctcgttcgcactcggtctttacggtcattgtcgaatgcggcgcaattgatgaagacgggagccatgcctttccatcgaatggctcggataagcagcagcaagttatacaggtcggtaagcttaatttggtagatctcgctggcagtgaacggcaaggcaagactggttcaacaggcgatcgcttcaaagaggcgaccaaaattaatctatctttgtctgcactcggcaacgttatctcggcgctcgttgatggccgggctcaccatataccgtatagagattctaaactcacgcgtctacttcaatcatcactgggcggaaacaccaagacagtcatg

SEQ ID NO: 6441 - DNA, 700 bp, Nannochloropsis_gaditana
ccccttttcaaagccagacacaacaaggagcacataaatctcgcacaaggtatgaacgagcactaaggagggtgaaatcgctcgtcaaaaacaaaagcttggttgctggcccgcgggcaccgcattttctcacgcctgaaagtgtattcgcaggcgaggacgcacaagtcctagcttcccgctacacacgagcacttgaccgctcaaatataaccatccacacgccttgaatcgcatctagcccacatttaacgcaaattgtggtcctgcacgctgttgtgtacccttcgaatgccgcctacgatggcacgccaacgagtggtgtcgctcgccttatgtttctcgctcgctcctcttcggggctcgccaagaactgaaggaaaacaaaaaacccacaaagcaggcaggcatgatacacaaactcacttgggcagtattgcacaatgatggacaggtggggcagtgggaggtgtcgcagtcgaatgcggtctactcgggcgtgtgaacgaactttttctgcgtggtgagtgcatcgtctgtgtcggctacctgtggcagtcacatctccagcaccagcactatgcagtcgcagcatgaaggcatgaagagtgcaaggatgcagcctccgacattccacagccaagcttttagtgttctgcacgagaagtcaatcgcagtaagtaaagtggagttgtgtccg

SEQ ID NO: 6442 - DNA, 700 bp, Nannochloropsis_gaditana
gttcaccaagcaagtgactgtgtaacagctttaatatgtcggcaggattatataaagttcgtgttactcggacgcaggcaattaccggtgacttttattgtgtggaaagcggcgctcgctgccgtctcgcccccaggctgacgaatgcggtgaggcggcgagttgttcggggatgcttacaccacacaaaaaatcacgtgttttttttcctggagaaacacgtgacaagtggtgactcgaggccagaaataggatggttgcttgcattgtgcagcacctaaattgcttcctttttccacttgcttccctcgccctttcgcttcatatgcgattcccgttattccttcacactcacttgtacgacctccgccaccccccacagcattctgctgtgattcaaccctgtctataattcgtaatgtctggtggttgcccgctgcgagtcttactgcgtcccctcctgctgtgcgccatcctttcccgacgaatcgtctccttcagtacccggcgtcctctgttttgcgcccgtccgtcaacctccgcctttgattggtcttcaaataagcactcgatagccaccatttatccctctactagttacaagctgagtgccttgtcttcgacgccgtggcctttaccggaagtggaggcacgggccgcactcccaagcacacgtcgagcagcccgtgacgtttccatg

SEQ ID NO: 6443 - DNA, 700 bp, Nannochloropsis_gaditana
tttgttcttgatgcgttccttctggcatggtgctgaggtctctggtacggcggccctcggatctccctctcctctcgcctccagtcacgtcccgtgtgcccctcccgcactctccctgtcctccctctcccgtccgttcgcttatccttggcatcggcaatggcacgaagctcatccgctacttcatctcgcctcgttagtgtcggcatgcgtcctcgaaagctatgccggtcggatgaggagacccagtgcagatgccgccctgctggctctctctgggggatactgccggcgtctcggcaagagaaagggccaggagataagaagacagccgtttccgcagcaaccgcgaaagtgagcccttctagtctggtcaccgttgccgcactctttcctagtcgggaccgccctcgcctcgacgttgaccatagcgcctacccaaatcggccccgacaaggaagcattcgtgagtcgtgtttgaatctatcgccgctcatgtatttctccctgtccacatatcacttcaccacagcaactttcggccacgcgcgggaagcccctggcctctgcaacgaaaacctccgtcctcccctccccctccccttcctccacggaatactatgcgtctgccgtgcaggcggccactgcgggtatatcctcccctcgagccccccttcctagtacgaccccccctgttatg

SEQ ID NO: 6444 - DNA, 700 bp, Nannochloropsis_gaditana
attggtgcgtagtgaaataaaaagcatgtaagaagctcgcattgaaagggaggtagcaggcgccaggcacgtaccccaagcagacgggacatctcaggctttgagccataccctgcatggcacatcgccatacctcacccccctttataatgtcctgagatgggaggcgactgggcgattttagcgcatttactgcctctttttccggaccgacctcgtccgatctggcgggaataccaggtgtgaggccagtaccggccacggaaggggtgcgagaacgacgagcgaagtcggagtccgcattctcctggttgctcatcctaccttgggagcctgggtggagggaggaggggtcaagaacgggatggaatgcaagtggcggggcgggggaacaaagtgtttctggcgagcgcttgatgtgagcgacgagacgcacgagagcgagagttacacagggccggctgggcaaacgcgcaccgacgggttcacgcatgaaaatggggattggatggcagtgttgagtgtttccctggatgctggtcgagtggattccatctttgcgacgtatttgtggaggaatgagatgcgtgagggcatacaccgccatttcaacaccctcttgaatctacgtcccgctcctcaactgttcaaccatccaatgaccctcttcatcaacccatcaaagatcctgcacgccatg

SEQ ID NO: 6445 - DNA, 700 bp, Nannochloropsis_gaditana
caagaattgagaatttttaaggctgaagagcggctttttcataaagtatgcacatctagcgaagcagtgcgaatcacagtcttttgaattctagtaatggagtgcatattgcaatgtagaatgtacgggagacgggccgaaagacttcgttgtcgggagtgtcgagatacgaaatatccgacggtggtagtcgctttactcgtgcagtatgtagtatatgcaatatttatgcagttaactgaagtgtgaaaggaggggtgaacagcagggggccgggggggcgcgatatatggaaacggatcatgttcgaatacggtctcatcttctctgccttaacccacacagttttttgtcaaatcacagacaaagacgataggcaagcgttcagcttcaagactttggacgcagtgtggacatcgcgtctaagtgtgtgcatacttatttgttgatatttgctcggaccggaaccgatccgcagcctgtaaacaaccaccaaatcagttgagaaaatagagccagatacttgcacggggccaagatgggggacttattggtcgtgcaccgtttgtgcctgtgattgcccagatttggctttcttactcttaaggcaatactcctctccgagtgctgtctctctctccagtctataattcggccatcggttcgtaagattcccccgtatcgctgttcgtaaggaatg

SEQ ID NO: 6446 - DNA, 700 bp, Nannochloropsis_gaditana
ggctttgcgttcactttagcctactcattctcgatctcgacctcctcctctcacttgtttagtacgtcaagcaacggggggctggtttgcggactggtcgcctctacattgatatccgccagcagggaggatcagcgcattacatgactatgccttggttaccacgcgcggcatcaggcgcctctctgcttcgctccaactcctcctctcgcacagcatcccttttcgccttgctcgtccttggcccgcttgcgacgaccttgtcgcatgcctttttaattttccacgcacggccagggccttcctctatagcacgcttgcctgcttccgcccttggcctttctacacctttttgtctcccttcctcccttcgggccgtgccagagggtctccttaacgatgatggagagccccagtacgacgctccagcccgcgccaaaatcgaagaattgataaaaaacaacaaaatcgtgctttttatgaaaggaacccgattgtttccttcgtgcggattcagcaacacggccatccggatcttggatcagttgaatgtagggtcaacagggggagaggggtggcgcgaatgcacatgggaaagcacgacgaaggataccagggccgtttgggatgcttttttccaaatcctttatcttggggaatgggagatatttgtctggactgatcttccatttcacccatg

SEQ ID NO: 6447 - DNA, 700 bp, Nannochloropsis_gaditana
ccgcacctgcggtcgaggggacagctgcgaataggcaatgtggaaggaagtacgtgaaagggggggggatgggtggcgagaaagttggatactgaccatgcgagaggagaggctcaggaagtatcctcgtgttctgtccctccctcatcggcgtccgatagacgcaggcacgtacctatgaaagccatggagggcccccgtggtgggcaaactgatgaacgcggcagtgttggtggccgtgagggcatgaagcaggacgggtaggaggaggaggaggaggaaaagggtggaggtagatgtgggagtcatgtgtgttgctcaggggaggttggaccgcagtggggtacgaaacacgaaaaagcagtcctgctgtcattgggtgggaaaggatgcgataaaagacgtgtgagggtcgctgtcagcatgcgcaacgttgtctaaccaaaaaatgggcggcttagtcgcttccatacacgggtggggctgcttctagtaagcaagatccatgaccagaatgcgagaagcttccgctctcctgtatcatctcttatcagcgctttggacctatacacatgcgttgaaggccactaagcagacagaaaccatgttattctcgtaattctgacttccaatgatgggctttgcgttcactttagcctactcattctcgatctcgacctcctcctctcacttgtttagt

SEQ ID NO: 6448 - DNA, 700 bp, Nannochloropsis_gaditana
tttgtcttgtcgccattcccctgcagccttattctcgtcctggatgactctgtcgaggcgctagccggtgtctacgcactatcattcctctgcgtcatggctttatttaccatcggcaacatgcttctcaaggtccttcagtgtcctctcccatatttctccttttctctgtgtttcctcgatccctcctccagaacgcaagttttcgaaacaattggcttttcttcctccccttcgcacgcgataccccttccgcttccctatagttcaaacgaccaaatttttgtcgtccctttctttgcccttggtggaagctcttctcgggcttttttgtgtaggagtcgggttcgtcgggaacatgatggaaaaagcccgcgtacttccgtacttcgtggcctaatatgctgtgatcgtcacactggtatggatgcgaaaagattggatcgacattttagggacagaatgaaaaaaatgcgtttccaaattgcttttgacaataagtaagatgaaagattggtacgggaatgatcatagacgattgttcgcgcctcccgcatttcctgtcgtatttacgctattcaccttttctatttctctcctcctctttttcagtgcctcgtgatgttccaacgcgaaagctcttttgtacgtgcgggacaatgagcagaccttccgggttttgattgtgcatttctcaatg

SEQ ID NO: 6449 - DNA, 700 bp, Nannochloropsis_gaditana
agaacaatttatcgtgattttagcagatacgagcgaagcaatggtcattttaagcattctccaccactgcttaaacaattcgtgcacgcgaaatcttagaggaaagaacttgttcttgcctgttgagaagcagatattgataggtgacatctgcctgtgctttctttcacacccccaaaaaatccaaggccattccgcttgcgcgtacatgaaaagggatttcatggtaataaatgtcaattcctaagcatttccagaaaaccccttacctttggctgttctctgtctgcaacccactgcgatgaccgcgaaaaaaatcttcgaccttttccagcgcgtcaaagttgcttttgccggggattataaatttagaagtaacggtttgtgacagaacgaacgtacaccagctcctgcgcccgagtcccatacctttattgtttcggttgcttgcccgcgggccaaactgtccgtacgcatgatggaaatacgctttttccttggaaaggatgcgtatttgtcgcgctgcgatggctttgcgcgaggcactgcctttttaaaggaagatgtaacggaccaagcgaaggcaactgtgcttattctactttcccctcaatcattgccagcttaccgtgtaaatcttgaatctgattctataccatatatctaggttttgtcgtattcactgactgcagcagccatg

SEQ ID NO: 6450 - DNA, 700 bp, Nannochloropsis_gaditana
atcggtcttcagaggagaagccttattgctacgtgaagttaagaatgttctcgcgatcttctcctcatctcccctcctcgcatctccctttctctcccctttcttctcctctctctccaccgccctttccttttctttcttgtcgtcagacatgaatgataacatggagctactttgcctcgcagccgagatgaggaagcagagcatgaagtaaagtgacttaccacggaggttaattctttccgcatgaatggcactaacaacacaattgagcccaagacgtctaggcgtccgtctgtaagcgatataaacagcagaagatgaggtaggggacataaaatgtcatgcctgtggccaagcaacgcaagcccttactggggtaggggcatgaaggcggatatcaatgacgtcatctcttataaaagcaatgacgtcattcctaccgcgaacgttccacttgcctgccgcaggaattttaacaaccgacatgtgagcggtcgaaccattttcgcccctttcattccaacatgagcattcctttagctggccttttcgcacaaattgccttttcaaattaaaatagtccacatgctttaaccacgcgctgccagcggtaaacatatttgatacagagccatcgcataaccccggaggaactttgtgcggcctctagccttgacaacctacaggcttaaatatg

SEQ ID NO: 6451 - DNA, 700 bp, Nannochloropsis_gaditana
tttctcagccaccttgcatgcagcactcttttccctgttacgtattctaacctgcctccgcccaagcgcgacgaatggaacacacgtatctgttccacaatccatgcgcttatttcgagtgccttttctttacgtgtgatgtgtactgagggaccttctttgtacgacaacgtgcgccataagtcctaccttgcaccgatttgcatcgcaattactacaggctatctcttgggggtaagttcgaaatgcgtacaatttccgggggagaactagctgaaacaatcagactttcggtctgcaccaccgttggatgataaatacaggatgctactctagtcttctattccactctgcctcgaaccttccagtccaccatctttccctacggccccgtctcctcccccctccctaccctcgcccaccacctgctgggggccctggcctttatttcttcgctgtattttcaggcagggtatgcattgcttcctttcattttcactttgcttttccttttttccctccaaaaacgcctaactcttttgccttcgagcctttgtatgacatcatcatccattcaatgtctgacattggccctgtgcaaagagggcaaagcgcctttccacctcaccacaccccaaatctcgtttcctcccttcccatgccatctggcttcggcccaaggtatatcctgtccatcatg

SEQ ID NO: 6452 - DNA, 700 bp, Nannochloropsis_gaditana
agagatggttgtgccgaaggggaaccgcctagagacgactgcccccccagcttcggatgctgcttcgaacggcgtcccttattttttccgcgctccatcctctcttctgcggacacattgccttggctgcaattatcatcttcgtcgtcgcatagcaaagctttggcgagtagcgcagagggagtgaacatagagtcatttgtcaagggtgaaccggccgcagaaggaggtggcggtgacgcttgagcgggtgacagcggatgcgaaaggggggcctcattatcctccacattgggttctgaaagggagagtggacgtaccatagcacgcttcaagctctagatgggtatttgtagagtgaaagaggagaaaaactgttgaaatacgatacaaccggggcgggcgcatatatttgggcccatggcggagtgctcgcgcatacgtagctgtctcccgcaggtatcaactcgatttattattttgttcttcaaccagccatgctagagactctacgtgcacttgaatcggcttcagcataattgaaacaatttcctgaccctgaagtgggctgaagcggacacaagttgggtggatggattcgtcattctcagttgatttttcttcagcgatgacatgatatcgtgtacagccacaaaggaccaggcacgtttatgagctcttcaagcatacaacttcaatg

SEQ ID NO: 6453 - DNA, 700 bp, Nannochloropsis_gaditana
gacacaagtcacccatgcaacttactttgtcctgttccaaattttggcacacatccagcattgaagttcagcagttgcagagagatgagactagtttttcgaaccctggtctttgcttctccggtttttgtctttaaagtatcctcctcaatagccgtcagcttaagctgagaacttgccatgtctttgagcactctgagaatcacgttgttggcattttctgagttgtgctctcacctagctcgaatgattgtaaacgcttttacttttcgtcttatgttgatgcaacgatatgacgtatgctaaggctttatttccccccctaggattgactctttgtccaaaaagcagttgtactcgtatctgatcgaagagagtcctcgcagtggccgtagcccttctctcccctcgctctgtctcatcccccctctatttcatttgtagacgaccatacagagatgctccgtggagtggcgtaaaggatacacgcatggcaaaggagagaaaagaagggatagttggtctggcacaggcgtcgagcagtcaagcccccatctgctttggttttcacaaaaagaggaacaccccctcgaagcctcctggtgctatttcctgtgtatttacagcggaggaagaggaggaggaaagtagcatcgacaacactacggttggcaagctgaggttgcacgcacttacgatg

SEQ ID NO: 6454 - DNA, 700 bp, Nannochloropsis_gaditana
tcgccatcgccttcttggaaaggtggtgctgtgtgccaaggtcatacgaggccaacgcctcatggtcttgcaaaatcttgcaccgatgcagaaggtactgctcctcaactgccacgcctatcgcggtcgcaacctgggctttgagatcctggacgcgcatgtcgccctgcacgttgagagggtagcactgtcccccaggcccacgcactatcaagttgttcgttaagggtgagcctcctcctggggtctccccccatgccttatcttcctctccgatcaataaagcatggtcgtacaaaggcatctttgtgacgcggcgtctgaattctaatttcaattatgtgggtacaagtagcgtggggatggaatggtcagaacgtccgtaggatggaagtgaagaaaatggcgagcatctgaagggggcgggcgataggcacgaaggggaagcgacgctctcttgagtcttgaatctccctcttacgattagcccttctgtgctgacccgctttcgaaggccactgtcacacgggtcgatggacgagaaagtgtggctacctatgtcttcgagggtcgtctgctcccaacgggacgaactacgcttagatcgagcatatcacacgcccgggcccctcacttgcgattcctccactctctcgatctgcccgacaggcctcaaagggtaatgagccggaaaggtatg

SEQ ID NO: 6455 - DNA, 700 bp, Nannochloropsis_gaditana
ggaggcggcagccactttattgaaaccttgttttgagcgggaaatttcaaggcgctacgaggaggaacgacctctcatcccgcggccacaatggatgatccagcctgtgactgcgcatgcaggctcatgagcatgagtgtttggtagccacgatgtggttacgaaaggagtgaagagtgtcacgtcgttgagccttagaacaaagcacgcgggtctcatccatatggccgagcgagagaattaaacgattctcggccccctcagtgaaaaaatggtgcgccccccccccccgtacatgaccggtcgcaacaccgtgtcgaggagcaacgtcaaagcctcaaaaacaaaggcttcatgacgacacctcgctcgttccgcccggggacacgcctcgaagctgacaggagtatcgtactggtgcatgttaagtcgccgccgcgaggggggaggggtgctgggacggcaatgctgtcctcaactggccagggaaccgtgctttactttacgaaaccacgggacatgatacgagaccatggacacgcactagagcgcccgtaaattttgtcgacaagtcacatagtggtacaattaacatcttgctcgttcttatcacctcctcaccccccctaggaccctggaggagtacacccctccatccacaagccaacacgccagtcctactattgatcgtattgtaatg

SEQ ID NO: 6456 - DNA, 700 bp, Nannochloropsis_gaditana
taccctcagtcttctgtccctcccctccgcgcacgtacattccagacgaggtttcgggggctgtttccaccttgtttagctcatgcttcccatccacgctgcctccagctgggccttcatgcggaggcgggagaggggagagaggagagatcccttttgagggacctttttcttctaggacacggccttcgttcgtcattttgatcttaattctgtgtcccgagcccgaaggagcctcgtcgccggtgaccacctcctcctccgacatggcaggcaagaaatcacctctactgctacgggaacaaactgtagcgcgtaggaaggaacgggtggcaatgatgagcgagggtcaaaagacgccggagggctagtccgatgacgatcccagagccttgatgacgctgggaaactccccccgtcgagaagcacaaaattttacacttggtgcatagggatatgtccacctcggccgcatgatacatagggtagactgtatgagacatcggaggctctatggtcgcatttcgtgcccaaaaaagcgggtaaagcttccgaaggctcaggctgctcatcggccctctcgcgcattcaaccactcctctgttctatccccctatttcttgcctgaactctcgatgtttttcacacattcacgcatacgcatcattcaattacttaattatacagtcaaaatatcatg

SEQ ID NO: 6457 - DNA, 700 bp, Nannochloropsis_gaditana
taatcttagacattccctgccagcagagaaccaaacaatgccggcaaacaaccgcgccttacctggatgttccccaaaatgcttgcgtaaatgtggccacccttaatatatgtacctgcaacagagatcgagagaaagggtttgtgagctttggaacaaagtatctgtgcagactcaaagatgagagcacatttccgcagttttttcctcgcaatgaataaagacgccgttccagtctcgtgcaggtaatcttaaggcgtgtccatgtgtgtaagattgatgtcttttcgtaatttgaacgtgctagcctaatacaaaaattcgacgacagtaccgaaagcttacctacctggccctgattgatgagatgaaatgcggccgattcgatctcctggtgcggctacactgtctgaagggcttattgctgagggtactgtatccatggcctgtgatgttggcatgttgagtatgtaagagtcgtgactttacatccaaaagccccgaaagtgaagattgccaggaggttggcttcccgacggcgaatgggtagttctccgtttctcattattttccaggatacatagagttatgcaagcaatacttatttatttttgagtcgtgctttatcattatcacaggagtcgaaaggagaagtttccgccaagctgcgagagaggaccttccagctacatgagaaatg

SEQ ID NO: 6458 - DNA, 700 bp, Nannochloropsis_gaditana
acagatgtcccagcacacacagggcaactggaggtaaagcgggacagagctggcaacatgaacaggacggagaaacatgcccggattcgaactcggggaactcatgtattctttcacggccgctttttgtgctccagggtggtaggatcatgaggcggatgatttcctcctctccttaccaggtcctgatcagcgttcttggttttgttatcatagttctgggatactccatcagacgaggtttaagactgggaaaccgcccattcaagcgattcattacgcgggttttacaacgagccgtggtaattctctggttggtgggtggcaagagagaggcttgaggaaaaaaagaagggaaaacaaaacaaaacaaaaaacaaaaacaaaagggcggctctttgtgcacaaggctcttgccgcccgctagacgacagctgtcgctcgctacttccgagcgagcgccggagccccagcaccacgtcggcacgcttgacgtgctcattttccttgatgtccttcctgtgtgcagtcgagtaacaatttggggctgtggtgatcaattgactgattaggttttcaatgttgggcgcagcgatctgatcttcctcttgtaaacaggtggattcgagaactgccgcgtcagtcccaagtcttgatcgagtcggaacaatttggtcgtggccttggtccttggatcatg

SEQ ID NO: 6459 - DNA, 700 bp, Nannochloropsis_gaditana
gtctgcgccggattatccctagatttttgtttctgtacgaaaaaagagccgtcgttatctgtagaaatgctatttaatgcttgttttaaaccacctcactcactgtttacataaatgtcccgctcatgtcttctctacaggcttcgagtttgtctgacgaagggccgcttctggaatgaggcggtgcgacgagcggtaacgcaattgcttgcagcgttacacactgaaatacatttaatgctgcccaacggtatcaatggaacgaagtcgccatctaaagtatcggaattttcgcatcctctcgaaggtgaggatgaagccgatatattcgagggagttcgaaagcacctttacgcaccaggagagcaagagaaagcatcatcgatggctaaaaatagtgaaggggtaaagaagcgtctagtagcagtactgagcatgtacaatcaagtgatggagctgctgatattgaagatcatgctggaatcaggacatgcggaaccagcacttacaagagtacggtcggattcatacctggaagacggcgtgcgacaggtacatttggatagcattgatactgtaacgaatgctttatggttgcgtgagtgtgacttggtactgcaatgtgtaattttgatcggtctatccacaggcacttgtagacgcctgccgagccgctatcaaaaggcaacggatcttaatg

SEQ ID NO: 6460 - DNA, 700 bp, Nannochloropsis_gaditana
cattgttcgcttttttgattgatcgtcgagcggactgtcgtccctaacggggatgatgcggttgcccgcatcctgaatgagcttgaatcgatcaaatgactgctgctggccgataccactgtcccctgggagaaggctctgcacatggcatcattggaagcacagctggaaccgattgtagagcgcggtgcaagataagtccaagccatggtcgggtaggaccacaaggctactaggcagcacgatactgctgttgcggctttcggaatccgacgcattatggagcaaaactctaaatctgtcaaaaaatgcacgtaaatgtggaagagttggcaagtcagggaagtcaatcaagcgaagatctccctattatccttggttataacatcaagcgcgtgcgcctcgcagggctttctcgaaacaagctccgctagggaaatatcaacttgacggcgaggcgcgacggatggcagccgccttccgtgtgctctcctgcctccgcccgcgccacgttatgaccattggggcctgtaggccacgtcacgggcgttggattgatatggttgtgatgtgctcgaggatgccggcgcggtgtcgctcgagaccttgcgagggaattgctgtcttcattcataggagcagtatcaggactacctcaccccggcgtgcatccctttgacgagacaggcgggcgaccatg

SEQ ID NO: 6461 - DNA, 14 bp, Nannochloropsis_gaditana
gaggaggaggggac

SEQ ID NO: 6462 - DNA, 700 bp, Nannochloropsis_gaditana
tagaattatagcagggagcttctgtacatgctgagaaaaacattggtaaatctgttgtctcgttggatttgggtaggcacatacttcaagggtgtccccttctcgtacatatctcttcgaaatcgaaataaaacaatccggtcatcgatcggcatttgttcggaggtggtcataatgttattttcaccgtgctgtagtcactcttcgtgacattgttgtgagtccgcgcattttgactttcaagaccaggaaaagagacaggaggcaggcgcctgggcccaggcgatgggtttgggcgatgcatgacgtttccccttacgcgcgaaaggggagcagggagaaaatgacaagctattaatggcacacacggtgcagaatcgtgaagttttgattcgatgtgcctttttgggttgtgagaggttgtctcacgtggccatgttgtttacggggggtaaggaggcctttcgatcatcgtaggaggccgggcagcttcaactctcttcatgtccgcacgctctaggcgaactaattccagcggacttccacaggaaaaattagttgtgagtactgcgtttggctccatatactcttgtgggtcggttgaggtggaagaggggcggaaagcggtcgaggtgaggttcttggtggcgcaaatttcttcgacgacgcatcagcaaagaacgagatcaggtccattatg

SEQ ID NO: 6463 - DNA, 700 bp, Nannochloropsis_gaditana
ctgcgaaataagtgcaatggactttagaatcctcgcattgcttcatcgcaacacatattccttatcccttccaaaaaatgctcgacgggaccatttgtttcagagtgcgagtatctaaaatagtgtttttgagtttattgcgtgccgtgaagggatctttttggttcatcgacaagagaacaaaggacacatccctgcgttctctgcttccagggtgactcgactggcgtatcatcgcaaatgcacagcaaattctctatagaattaaaaaagaagcacaaaatttccgacgcaatcaaaagagcggatgaacgctccaacgaagcccgcggcgcgccccgagggatgacactggtcggctgcttctagatacccggatgttgcatggccgccgtccacagtggctccctgaaacgaatgtgaccacgttcttaggacggagtatcccacggacacttccgcccttgcgacccctggacattctttctttgtcgtacgtggatgcctgaaaagtatttcaaatactgcccatgtcctgaccggggggctatgcctgggtcgcccgccgtgttgttgtgcgaggtgtgatggggggccgtgatgacgttcttcgaatcaacttgttgcatcacaatttaccatttctccaccgtgaacatttcccttgatttgtgatacaggccttggaagcgtcggaatg

SEQ ID NO: 6464 - DNA, 153 bp, Nannochloropsis_gaditana
tcgtccccgccatccttgcccgcacacccgctcccttccttatcccctaccctcaccggagtcctctcgccagcccgccctgcctgcaaacgccccccatctcccttcaacgtcacggactcatgccgggaggaggaagaagaggaaggcatg

SEQ ID NO: 6465 - DNA, 700 bp, Nannochloropsis_gaditana
gtctgcggccgctccgggtccacgtcgccggctgaaacggcttccgcagcccgtggctcgcgtcccgtcgcaatggcgcctgtcattgcccccgtggcagcggcaaggaaccctcggaggaactcgtctcgactgcttcccacgtcatttttgccactgctgctctcttgattcaaggatgcacgcagaggtcttatcaatgccctttcccgtgatgatttgattccaggaacaggtaaaaacgcgacggtgcccttccccaaaactgccgcgctgatcaccagcagcaggaaaacgtgagaagagctaaggcctcgcatctcggaggctctgctcagacaaggggaagggttatgagcgattcagtttgctgacaatgatgccggcagcaaaaaagtagctacgagcatacgagtcggtcgaaggatggggcgacatccacgaggcatcaccacgcacaaagaatagaaggagcatgggtcatgaagcggcaagtgaacgggatggacggccttgtgcctgccatgcctaataccatttggctaatagcgtctccgccttgcgtcgactcccggcggcttgaagcttcggcgaggcaggcacttgtccctgccccgcccgtcacagatgtttatgtcacctctactcatgcgagcaccaccacgtcccggacagacctccgccgtcctctcctactatg

SEQ ID NO: 6466 - DNA, 700 bp, Nannochloropsis_gaditana
atcaatagagtaccttcggagacgatggcgggaagtatgtggacgccgcggacagaaacgtggcatgtacagtcttggagtcggcgccaccgaatcaaactgctggaaagcctccacagcaatcattttgggcctgcgcgtaaacagctaatcagaatcggtgagatagcacgtcatggcgaacagaaatgcacaaaatatatatctacacgctggatgtgcatgccgcagagacgtccaacggtttttgttgctgcattttgcaagcccccaaacgaaacggacttcctgttttaacctcccggcgcaacgtgtgcccccccgtgttctcgaaggagaagggggctgccacgcctgcgcttcgcactgtggtagggtgtatgtggacctgtgttggtttcgggtttgttgtgttgttgttatgaactctccaatatcatttaagaaccacttggtgttgcgagtctacgcgagacggcacaatcgtgttgcttccctttagctatctgccttccctttgcataacagaggtctcttcaactctgacaagcagcgttcctcctctatggagaaaaaatcacgcctgtcattacccctcaccgttttggtacatgtattgtccctcaaaaatacatagcaacatcaaggacactgtaaaaggaaagcactgcaagctgctgcagaaattattggaaacatg

SEQ ID NO: 6467 - DNA, 700 bp, Nannochloropsis_gaditana
gctattgaagggatggcatgtcctgccctcccaccaggtcgcggccgcagccagtcgcttccctttggacagccgggcccgtgaggaattcttcgacgaggccatgggccgtccagattctcggatcgtcctgtactttcacgggaatgcggccacccggggccaattcaatcgggtcgagcttatcaaggcgctcgcggcgaccatgcaggcgcacgttgtgacggtcgactatcgggggttcggggactccacgggctggccctccgaggaaggcttggctctggatgcacgggctctgtgggcatgggtggaggagcgggcaggcaggggcgagggcggcgcgcaagtcttcctgtacggacactcccttggggcatgtgtggccttggagctggccaggcacctccctctggtcgcggcactgacaccggagtgctcggatgccccggacttctcatctttctcgccctcgtcctccaatgccaaggagtcggcgccagctgctcctgcgtctctggtcgccagaagacccgacgccggcgacatacaagcaggtcggcaggccaagtctgtcaccccgagcggcgtgatcctggaagcccccttcaccaacctgagtatggccgcgctttaccacccgagcgcgctgcccttccgtctcctcccttttttcaagcacgcccttatcctttccatg

SEQ ID NO: 6468 - DNA, 700 bp, Nannochloropsis_gaditana
caagcgaaaaatatgccttttcatagccaaggtttcgcgccagaccttcgaagtcggtcttccctcggacagtcctcgacttgaagtcgccgtaatcccttcgaaagtccgaaaggcgtcagccgtaatgctaagtcaggccgcacggaaggcccaagccccccctcgctcataccacgacggaggctcaagatactcacttccagaggccccatgctcggaacgcggacagggccttccccgcgcccacggacgacgaggaaactatcctattgctcgtgggaaggaatggtgttttgttcagtcgaccgatggcttttggcccggtgtggactgagaggaaaggctttgctttctgcgtgggaaggacacgagccaaaccctggtgtcgccctttcattgaggacagggtccaagtggaaatgccctcctattccccttcccggccatctcacggacgtatcctatcccagcgaactattgatggttctgctatctcacccacgcattggtggcgcgcgcatgtgaagcaggcataatcgtggccacttgtctgacggaggggagttgcccatggatccatcgcccctgaagctggtgctgggtgctcagtgtggctttgaatggttgaatacccgcgggtctcacctccaaaaacctcgcaaaacaccaaaattacagtcacacacagataaccatg

SEQ ID NO: 6469 - DNA, 700 bp, Nannochloropsis_gaditana
ccaaaggaatgtcaacaattgcggaaaggcagtagttgagagcggacggatgccaaaggggaaggaccggtataggcgaaaaaaaagaagggtttggattcatatccgatggtgtcataaaaacagtccacaaggaggaaacaatgcaaaggaaacacgggaaaggaattgagcaagcatgagtttcttgtacttcttggtacggctatgtccccgtatccatgctccgagtcttcttgtccttcggtgtctgtcattttctctctttcaaccaacctagatcagcaagctgtgtatgggtggagccttatctatgcagtctacgaacataattagcaaaaagcgtggaagttgatgcaccgatgtgtcatttcctttgaaggtcaagttgatgtcttcagggccatttgtcgaccagaaccatacccggacattcctggccacggcccagatcgatacttctttcgttttgtcgatgtttttgtatcaaacttctcccaaaaaagagctatccaagttttattcaaggcttggaaaccctattcctccggattttatcaccgctggcacgattggatgaaccagctgttgtgacatccccctccgtgttctaacagcgtgtgctattcttgagcgattcgcatatgacctcataaagtatacaaatgtttacctgtgcctctgacgaacaacagaaatg

SEQ ID NO: 6470 - DNA, 700 bp, Nannochloropsis_gaditana
gtggcagccggcgtgggtcgttgcttttaaaagcgctggaaaacaagcaggaggagatcgagcgggagctggcacgggcagagaaggagaccaaggcggccgaaaaacagcgacgccggtccgaggccatgctggccgaggcccggagccggaaggagcaagtggaggcatgggccgccagggagcgggcggcagttgagaaatggcgcgaagaccaacgggagttggtaggcaaggagaagaaagctttcctccgggagcaggcggcggcaacgcgctgtttggaagtgcaacgcgcgttgccgacgcgggaggaacgggtcgagcgggaggccctgctcgccaccatcgagaagatgaagctggacgccgaagggcaaaggaagagatgggccgccaacagcaagcggcaggcggctctgatccaggagcaacaagcccgtctggaggagcttcaaggccaagtggaatcggcgaagacagggacggcgagccccgggcttcggtcagggattgggcccagaggccagaacgcgtcgtccatgtccgccgcaaggcagccgaggaacttgcccctgccggcctcctccctttccaccggtctccgggagagcaggccttgcgcccgtgtgggcgcaaggcctctgtcccatcctacgtccgcttcccccctcaggcttgagaaaaaagcactcggggc

SEQ ID NO: 6471 - DNA, 700 bp, Nannochloropsis_gaditana
caaaccagaagatcaagaaaaatcgggtggattgatgacgaaggaagagaaatcagcagcagaatgtgcacatgatgtcaaagggcctcgcgcaatagtatcttcggggatcttggccatccaaagtatttactggatatatggggaaaaagcgagaggaagcgagagacaaataagccctttccgaccgcccctttccaaagcaccacacagggtgatggaaaaaccccgcgtgcaccgaagtcgtgcagatgctgaggacatttcgttgttcgtctagtttgcagtgcatcggtggggtttcatggcgccgaagtccaagaaagtcgttttgaggaaaaagggcgaggagtgattcaaactttttcttgacgttttgcggcgagggggggccacacgcccataccaaataaatcccgtcccgcccgcctcaaaaatgatatccatcaagcgtgcatgtgccggttgacgtaaagtgatttgaaagaagatggctgggtgcattgaatgcttgaattctgctgttgtgcgggccgtgagatttcctcgtctccgttagcttgtctttgagagacattaaataaagcccagtctcttcctaggaacacacgcccccccaaaataccacgcgcccgtttcttttacgcttagcagatccttctcatctttccacaaccaaagaatccttgcaaaagccatg

SEQ ID NO: 6472 - DNA, 700 bp, Nannochloropsis_gaditana
gtctcggcttcaattgtcctcctccatatgctccccatttcgtacgctaatatggtggaataggctcccagtcctttcgtctggttagcgggttacttctctaggaggaaaagggaatgaagtgcttgaaagcaaaatcaacaggaaatttgtatagtggtgtatgagccctgcatgtcgataaagaaaataatctcacagttttcatcgcatatctcaacaaaaaaatgatctgaagtggttcctttcaagatatcgtgggaggtaaaagccctgttttgtgtatgttccatcgcagacgactttcacagagaatgtacactgtttggtggagcctgtctatgataagccgactactcatacttcaaataagccatgtcatactcagcatgaagaaacccctttttcaatgcgtagaatgttctcaaaaaatgagggcaaaggactcgcttaacgcaataaggcaatgcacgcatgcgcaagacccgaaaaatggttgtaatcatcgatccactccttttcaccgcatccagcctaaacaaccgctccccatgacattagttcatagcttttatacgaatctcgaccattgggtcgtccctgtgcatgttatcgttcctcaacacagcaggataaacttcggcgacacttggcacgtatttcactcgaaaaggcaaacctcttctcgccgtacagaatg

SEQ ID NO: 6473 - DNA, 700 bp, Nannochloropsis_gaditana
tagaatttactgggagggaggaggggtaagaatggggacaagcccgtcgatacgacgcggagaaagatgagtccatgatgtctcaacgagtcacacgcatggtatgcccacagacataggtaatcctacgacacagcatctccttcccctcagagccctacgcaatggggtggggcatgcggccccacggacagcaggagagggtcgactgcgagaatccgggcccagaatcgtcatgttacgagcgagacaagaaacgtacaaagatagacaagacgtatacagggaggaggaaagggagggcggtatctcaggagtagcagggctaggagttgattcatacctgacaagcgcagcttccacgccgggccgttgctcgtcgcttaaagagccgatcacggtctgctgcagacgatccaggcctaccgaacgttctcgaaggacagaggcgtactcaggcggaaggggaaaagggttgtacaggagcgtgggtggactcccttctggtggcatgggcccctgcccagggagcccgggcgaggaggcgggagggactgggatggagagggtgtagaaatgctcgggtgggaggatccgtgtctccccccccgcccgggacccttcctgtccggcaaggccggcgtttcggccgttgtctctgtcccctttgcccccatgactcccttcccgggtcagcccc

SEQ ID NO: 6474 - DNA, 700 bp, Nannochloropsis_gaditana
gtggttgctttgtatcgggcctttacctgctaccattctcagccagtacgcatatgggcctaggcctctccgctttttttgtttcacccgtacataaaagccttcagtgatcctttcacagtgatagacatgctcaatacttaagttcctcaacagggggcagccagaaggtggcatccacatttgtttttgctttgcggcttgcaattgcttaggaggcatacttagggtcgccataagagggattgctccactccttcttctggtataattagaaggcaagatgagcatcgccgtgctggacgatggggaagccctggcacaaagtatacataccatcagtacatctctggaggtaggtgcttgcaattacgacacaaataccatggtagactgaggcgcggtttcctctcgccgcctcgagacaagctcgacacgtaggacgccctgtatccgcacaaatggcataatgtgtaggaaaaagattccttttgacattcctatcaagccatcagtcccctgtgtctagattgtcacttcgcgactgaggtcacgggtgcaccttaattttcttctgcccgctgtctctcctttcctccatgaccccctcccatctaaggaacatcataaatctactctcgagtccctgtccattctcgacaaaatcgaccatcgcctcagcagcttggaatccaatatg

SEQ ID NO: 6475 - DNA, 700 bp, Nannochloropsis_gaditana
acaagcttagatgtacaccatcgatgtcgagctgatagggccatgacgactgtttccatgcaaaaatataaatttgtgttacaggcctatggaacaaattcagcctcagaagtcattgcgctttgatatgctaaaaaacatgtacgtgacaaatttccctcaactatctaacgtctacaaatgattttataatattactcttcgattttgtagcaaatactcgacaagcactccatgttcttcctcgataaatggagtaagctgaaaaggcgtggggaggctgtccccccccaaaaaccagcaacggacatattcgtccgtctggctccagatgtgtgacagcagcagcaagccacgcccgtgcccggcaaagcttacagccgtgcggaggcatgaaaggacggaaagtgtcggtatagtgctgtttcatttgtcggcacacgcggtgttaagactatgacagtggtgcctgatttttttttaaccagatgcaccgccgagggtgtggagacagaggcgatcctcagagacgatgtgcactgtgcgaaacccaacccgttcacaacttcacacctcgtaaactgtacagtgtaggtgtacggtgtaggcaacaagaccaggtgcactcgttgtggtttttgacaggcgagacggcaacagttgtgcgtggacacaaagcacctccgtagttttgatcatg

SEQ ID NO: 6476 - DNA, 700 bp, Nannochloropsis_gaditana
agctacccaatatttttctcaagccttacacaccagaagtatgggaaaatgatcctaacttacagcacattcgcaccaagcttcatcctaatttcagggccacatggaattatgcaatgagctcatacttggcgggcgagtggagctcagcaaagcaagggtttgagacgacgtttgagctctcgggaggtagagacggaccaagtcgagcgttattaaagatcttgcagcagtacgacaataaggccccatcagggtggtcaggatggcgagaaataggataactagaaaccctattgggcttcgcagtatcattcatcttaatgccatcgcacgagatcgtaaattcttctcagctcgctcgtatatgtccttgtgaccgggctaatagctagcatggacctttggaatctatttttacattgtgacacggctacaagaggcagataagcaagaaaagggttttttttattttttatttttacccggaagagcaatgaccaaggtgggttatgagcctactattgcggggatactatgggccgttaatcagttcaagaagcagcgaagtaccttggaggattcatttcagcccatcagcctgctttatcactgcgattcaaggaatcgtagatcgcaaacacaaagatcaagcttccagcttattctcatcacatttttgattatcttgcgtgacaga

SEQ ID NO: 6477 - DNA, 700 bp, Nannochloropsis_gaditana
agacaagacattgcttgcatccctccgatacttggaacagcttcgatttttcttttcacctgcgcctccctctcatcccacgacccctgcatccggtccacccatcgtggccacgatgattgaggatatcaggcgggattcccgccagtgggccgccgaaagcattttcctctccgtggcgaccgtcctggtgttcgtcagtctctccctctccctccacgcaaatttggcaaacttggttttccgaccactggaacaaatcgtccagcttgttgaccacattcgtgtaaatcctttggctcccatctcggatgcaagcgctgacttccacagccagttccagcgccaaaggccacagcaacatgggtaccagccgcaggaattatattcgctaagccaggaccaacggccgcagtcaccacgtcaacggtcaaagacatcgtctgcatacatatgggatgaggaaagagggccaagtggaaacgaggcaagacgaacgggaggaagctttatgatatgcagtgatcagcagtcagggctggaaccaaccttgttgttgcagacaatttcaaaaatcggtgcccttgtccggatcggtttaggcgacgcgggagcggacatcatttcaaggcatctggaaaacaacctcgacagagggcaagagagcgggtatagcgatgagaatcggcttgatgtgatg

SEQ ID NO: 6478 - DNA, 700 bp, Nannochloropsis_gaditana
atgcaaggcgatttgtaggggtgggaatctcgtcatgcttcaggctgagcacgggcaggcaatggattgcttaccttactggcaatgtggtcggcgacgcggagacaatctcggtacaactattttttgcgaattataatatactagctgtgagctttgtgctgggtcagcggggtggcatttgtgacggcgttacccttctttcctaacctcacctggacactgctttttccagcaacgttcttgagcgttgctgcgtgtgccgacggcaaagccatcctcgacgtactttgttctcagattcgcgcgtacccaaggcctgattgagcaggaatggcacacaaggaatgaaggattttgagcgggactgagagtctgccgtcgcaccaaggctttgacggtaaagactctccgagggcccttcgccgtgaggctgccatagcgagctcgcgtcgaagccgcgacttgcttgaaaccgcgtgaatgaaccggacggtcgcctatccaagcacttcgaagcttacttaccaaatttgttgcgcaggcttaatttctttatgcaaagcatttcttcgcccgtgtgtacaggacgtgcccaccagcaggaagacccgaatgagggttgaaggagcgctttttacttgtacactagctttttatttcgcttctacgggcgcggcagcaggcagttccaggtatg

SEQ ID NO: 6479 - DNA, 700 bp, Nannochloropsis_gaditana
ccggcgctcgacggtcccgtggggctcccatttcgcccccgctgccgcctcctcggttgtcagcgcctcccgatacatagtgcaaaccacccgacccgaggcaggatccctttgcataccggagaaaaattgcggatcgagcatatcgacaaccatgccacgaaaccggaccaagcgatgcttccgcaggggtcccatcggggccgagtccgcggcccaagtcctagggtctactagcggcacacctgatagcgcgttgggttgcctctcgaaataacgacggaaggcgtctgacaccctcagatgaaaagagggtttgacgggagttgggacagtggagctgatcgccgcttgtgaaacaaagcactcctgcacaagggccagggggttttccaggaggtccgggcagctttccatgttggcaaaagctgacgaattggatgttgcagggcctgagtccatgactgtaagcgtggtgtcagaaagatatcttttttttaattgttacgatacgagcccgtgagagggacagagccgggcgtggcgggcggcaaagaaacagggcaggcgggaggaaggaacaaaggaggcgatactagcgagatatcccgaggcaccaagcgcacctctcatcgccctcttttcttcctgcacacagccctgctcgcactctcctcgtcgcgggttccgtggtggcatg

SEQ ID NO: 6480 - DNA, 700 bp, Nannochloropsis_gaditana
atgctttagcgcactttctgagcaacacccaactgagaaacagagtaggacctcggtaaaagaggtgtctgcgacaaagtacctgcccgacgcaagcactcagaatacgctccacaagtgctctaaggtggagcgtgagactgactgacaatagcctgtcttcataggtgagggaatgtgattgagcaaatggttctagattttctttcattcagccaccacgacgcagccaaacaagaccctaacaacttgcacacacttaaatgtacagaggcaacaacttcatgaatttaggaatggtcgaagtcatagcaccctgcgtgtgattgaatgtacaggggcaagtgatgcgcaacactttgcggggaagcggcccgggtgcgcggaatgacgcggcgccgggtcgagggagagcaaggatagcgcgaaaagaatcaaagaccccccagggaaagcatccacgtatcttatgcccaacgcaagcgaagcttcgtctgatttctttaggtgtggcaatggattgtgcttgcacgaaagtgcgactcggctgaggacagggcacgcccacgcaagcaggctcggggagagagcaacgacggggctcgatctggcaacgagaggaaaggcggggagggaaaaacacacgaccggccctttttatacctttttggcttacgctgtgctacacaacctttacata

SEQ ID NO: 6481 - DNA, 700 bp, Nannochloropsis_gaditana
gagaacaaagcgcaaatagtggcggcgctggagggtttggcaagggcaaaaggtggaggcgggaggttgagtccgcggctatagacagaccatgcgaatgactacaggaacggatgaccatgtttgaacatgccgaccaagaacgaaagaaaaatgagctgtggtacagacgcgcctttgaccttgtctgtaattgcttcttcacggtggggcccggggggcattctgcctaaagcgagggctggggcccacgagcgccggcgccgacagagccatgtggtagtctttcaggcgtggtcggaccctgttcaaatttccggcaattgcttttccagccgcgtgacttctaagtaattatcttcatgcgtactcacttactggtaattcgtcagagaagtacaagacgaaaaggtcccgattaccgaagaagtgaagtaaatcgagcgaggctccacctttctcgccttcttttccgtaggagggcccatcatcgccttcgaagaaacatctggcatgtgtatgttgccttggcattatcttcgccgcctcaaacccaaatttaaaggacgaatgtgttattgtcgtgtcctcgcattcttcgtgatgcatgggtctatttattcggtcgaagtcatgaatgtgatttcttcaatgcctcttttgcgacagacttaacagcacattgtaccaagtattcatg

SEQ ID NO: 6482 - DNA, 700 bp, Nannochloropsis_gaditana
tacaaaaaaagggagaaaaaaaatgcagcatgtcgatattcccttcttttgttttcattttatcaaaatcagcgccacgcataagctcgctgtcttatcacatctgcatatggttgtgggagatcaacaagcatataatactgaggaatacaccaggaacctgccggaatccgccccgaccgctttttcaaattttcactcgcattcatcttgaggctttcttcgtcacaagtctaatccatcataaatatccgcatgcataggtatggagactactgatgctgatgcgttggaacgttatctgccacgaatcctgccccgcgatttcctagccccgtcagtctcttcaacctccccacccactgcactgcacattaaggcaacgaagctggagggcgggcagtcgaatcccacgtatttgctcaggcttcaaccctctgatcgtcaattggttctccgtaagaaacctgcgcttgtcaaagtagcttccgctcatgccgtagagagggaatttcgtgttcttgaggccttgcaaaattcagacgtgcccgttcctcccgtctaccatctctgtgaagatgcttcggttttgggcactcccttctacctaatgggtttcgttgaagggcgcatctttcgggatccgactttgccaggcataaagacctctcaagagcgggcacagtattaccgggcgatg

SEQ ID NO: 6483 - DNA, 700 bp, Nannochloropsis_gaditana
ggaagcggatgtcactggggaaagggaagagtaacatgcttccccccagaaacacgtccaccgcctacctacccataattgctccgaggtcacttcgtttaaagcccctccggtgctgcccgccgccgatgacgccgctgccataccttccagcgtggccggatcgagcggactatcgaagggggggagcatggcctgtcgcctcatgacggaggggggggagggggaaaagggcggggacggtgggcccgcttggtgccgccgctcgcagcaggaggggggagagtggccgtgcgcagaatgcaggctctgatgctggggggtaggcaagaaggcattcgagactcggagtgggaccgaggctgcgacggcggaagtggtgagcaagagccctgtggcaaggaggatggaggaggctggccgtgccacggcggcctggcaacacgaacgagacttggcggaggctggcatcatctcccgggtttgtcttcctcgtgtcatcgctgtgtatggtagaggggcgcatggagggaatgaggaggcagttaaggatacgtgaagacgctgaggtggagatgaagaagaatatcagggtgatgcgacatacgtgccccccgagagggtgggtggggtgactccttcggccttaaattttgtcacgatttcttcacaccccgcaccctacacgcaatgacatgac

SEQ ID NO: 6484 - DNA, 700 bp, Nannochloropsis_gaditana
aggcttggagtgcacgggacagaggcctcgcagggtgggccgagttttggcgagcggcgagaaacgacttctgagggctacccatactcggcaagcgcgaatttcacggcatcagcacgcctccgggagctcgcgggccggacattacaacgttacatgcaggtttcggttgcaatgggagagaaagcatgatagcttgagcccgaacatcacttaggctggaggcggacaccgatgggagcgaaggcgtgcatggttgtttcgaagcagtgtctgagatcaagcctgaggccatggagctccatattggcgcaccattgcatgtttgagtatgagttccttgcaactaatacaagctattttgaaagatatattcgagggtgcggtaggagaccctcttagtcgggtgcgccagaaagggtgggggacgtgcggctggccaccgtgaaagccctcccttgaacacgactgcatcttataccacagaacttcaacaatgttgttatcgaggtttgctatgcgtcagctttgggcccatgtggcaaaatcgaaatcgtgccatcgaagggatgaggtagataaattttatcgccgagagacctgaactttttcactgtgagggagggctaaccgacattcacgaactctatgtatcatattttggaggtgcaggaacttacttgaatcttcgtaaaccatg

SEQ ID NO: 6485 - DNA, 700 bp, Nannochloropsis_gaditana
ttgcacggaccctagaaattcagagtagtaccgactgcacacgcgctctatctcctcctccctccgttcccgaaactccgccaagctacttggcagcgatttctcccatccgcgctgtcaaggcgtcaaatgagatgacgagaagggagccagaggcatttagtcaaacaaggatctcgagcgccccatgccttgttgagaactcacctccagggcgttgcgaacacagagggcaacctgctccatcgggccagtcaccgtctccaaaatcattgattctatcccttctcgccgccgctcctcctccaataccatgactgctcctgtcgaattaccctctgtttcgattgcgttacaattcgacgtgcgaaggaaaacatgggacaaagacacccggactcatcatgctccaccagggactgacagcagtcatcaagtcaaattactgcggttacgcgggcaccgaacatccattcaaaagtcacataaattacaccaatgtgaactgtcatgctcgcctatcgcacaacacctcaagtaggcgatgggcttggggcggcggcacgacaaaagggcgagcccggcagaccgaaggcggggggctcggatccgcccctgcgtgcttaattacggaacaagcactatctgaacccactctgaccttctcgttgcgaatatttacatttaagtgtctcagatg

SEQ ID NO: 6486 - DNA, 700 bp, Nannochloropsis_gaditana
agcgcatttacccatgtaagtatgtgtacatcgacagcaatctgttcaaaattatgtcgcatatgtttgtccttgctagacagagagccccacaggctttgtgtgtgaaaaaaacctaacataacggtagagctggcatcaaccgtacttactcgaggcgtagaggaggcgaagtcgattgcccctagaagacggcacagggaattcaggccagtcaaagaagaggcaatgctgtgttagcgttgtgtacgtgataacgagatgagaaaggacagaatcaggtggcatatgctgagggcgtcgcgaatgggggcccatgcacttgtccgttagcttcctctgggaattttgaatcctagcactaacccatctcaactgggtcttacgcggtaagagtaaacttatcctggctatgatgagatcttacatgcgagacttaaacaaaggcaccttttctaccggcagagtacagcgcaaataaatgaacaaatgacaaatgcacctgcttccgttgggcatgggccacggcggtcacgaagcagaggagagggcgtaacggcttctctctaattaatttctgtccgtgccgggaatgcgtctcatttgtcttaatgatgtgcttttcgtcccgtcattgtcgtttccctcacacaggctgacttagtcatacatcgaaagatagcgctctcaagatccaatg

SEQ ID NO: 6487 - DNA, 700 bp, Nannochloropsis_gaditana
aacttgaacaaagcatcgattttccaaaaaaaagtgttcattcgcccataggtacgacccagtaacgaatgtgatgccttcgcttccgagtctgtgctcggtcctttccacaatctcagtacatgacacccgcctctcactgttctgccggggttcgttctgtacctgagttcaatcacttgtggctttttccttcctatgagtgtctgagtgtctatcggtcttacactccgatgaagatgtgccctgtattagcccgtctctcctcccttctctcctcgcgccatcctgcgcacccgcccgcttgctcaagtccacaaaagtccctctccgccattccggctccaaaaacctcatgttgcccgcacattatctttgtaattgtgccaatttctgtctcatgtcgttttctcctgcccctttcaatttttgggcatatttgtcaacaggagggcctcttttctaaatttctcatcgaagcaattcagggcgtcttccaccgactgcaaaaacgcgtcttgacccgcacacttaatcatcagttgaaggacatttttcattccacctcaaggctgtgcatcgccgccggtctggccttggaatggcataggaagcagaggtgaaagagatctcgacgtcggcatcccatctctccagatcaaggtcctgaacgaccctctcttttagcgttgttcccatg

SEQ ID NO: 6488 - DNA, 700 bp, Nannochloropsis_gaditana
gatcaaatacaatcaacaatgcatttcgatactgaccaactcaccgggggggtaaaagcatcgtcgccaatgaggatacgtatatcctgcggttcccagataaaactggccgggggagtctgcagaggagagtaccacctcaccacttgtcgtcatggctaaaaatgtcttggataatatgttagactcttagccactatcgacacaggaacaagaattcagttcgctttggcgaggggggaggttaacaagccggcttcaagcaatgtgagaacaaagtgcagggcacgcacacgtgatggagcgaaacatacgacaactgtgccatgtacggtatcgacgacagcgtaaagaggccctcctgaatctcgactgtttccgcagactttcatggacgcgaacactttagtaagccaacagatgcttcagggccttggcgttcttcgcgctcttttatagcctgttttctgcatgctttaccatgacatgggaggccgcaaaaagatgtttcccgccttcctccggtgtaccaaacagtgcattgcctaacctttgcatggttggaccgtcactttgtgcttctgatgtcgtgatctgcttgccatgtcttcttcatctatctccctcaacatttacccacgcgccctctgcgcttctacctttcctccttgcagagagtacggccacgctttgaatcatg

SEQ ID NO: 6489 - DNA, 700 bp, Nannochloropsis_gaditana
ggaagggcaaagaggtaaaatataaatccagcatgctcaatgcagaaactttaacctccccacctctaacagtcgctttggggctgggtaagttcagtagaagaagcgggtgcacacaccctcactatgtcgtacacgagacagcatgaaaccgaagttattgaatcttttcgcgagctcaggcgtgcggagcatctttgacttttgatgtttcttacacattgcctacgcaggatcatctctgattcagcgagagaggtcaacttgattctgtctcgtcagtccgggccttgcctgactctattacatcactattgagaaattttcagtcttgtcaagacttttcaccgcgcctttgattctccatttcctcacacagcttctgctatctttgcatcattgcgtgggacaggggcccggctagtagtgtccctgcaggacggggaagattctctctcgccaacatatgccatataccgcaaagcaatttactacaataacatttgaagagtaatcgtaagaagtcttacaaccagtacatttgcttcttttaaggtaagcgaagagagcctgtgctcctctgttatccaattgttggttcgaggaccccatacctgatgtatgtgtgtgctgactcttttgatgtttcgcaaccccactatctgcacagcgtaccttctctcggtctgcttacagcatg

SEQ ID NO: 6490 - DNA, 45 bp, Nannochloropsis_gaditana
gggatgcgcaagcccaggacagggcccaccggatcgggcagacca

SEQ ID NO: 6491 - DNA, 700 bp, Nannochloropsis_gaditana
tgacgtggccttcgaggtcctcgcgatcgtcgatcccgcacgacctccttaccccgtagaccccattccagcccaaggaagtgtatgtatgcctttgctcctggcctatgccagcaaggtgtgcattcgacccctcgtacccaagataggagagaggcaggatacctccgaccgcccatggtcctcaccattcctggtagatcggggtgctgggtccgtggaggaggtggtcttttgtccacccgactcctctgcttcccagtccacacccacgtgcgtcgtggtggatgcggcaatcacggacgcgggggttaaatccattttcctgcgtcccgcttttgtcttcgagaacttgcttccttgccacgcctgggtatcgatctcaccccacgagaattgcgaccacacacgcctcttggcacccggcgacacggcaggcgtacttagcgtaacaccacaggtcacccagaccgtcaagatccgcctcgctccgtacgggggccggcctggtgagaaggggggggggagcatcgttacttgtggtgggtacgagtggagccaagagctggaattaggaggtccccctaacaagttccaaaacttgaagccgttcgtgctagcaaaccacttgcgaggagaagaaattggaatcacggggtgggtagtccgggttccgaggtctcaagtgaggctgcacatg

SEQ ID NO: 6492 - DNA, 700 bp, Nannochloropsis_gaditana
gtagcggaggaggaggaggaggaaacggacgaagaggacgagccacgggacaaggggaggaaggaggacgggctcagggtccagagggcacccctgctagtagccgaggtacgggaagacaagaccttgaaaggctatggcgtggacgtgacactggaggacttcactttgaacgtcttggtcgaggcgctcatggcctccatcgatgtcaccctggaatctgtgaacgggctcctggatgtcctagccgccgggcaagctccttcctctccctcccttccgccctccgctcccgcccatccgactgcgacgacgagtgatgccccttttggtcatctctcccagctcggtagttcctggcacgggtatggagggaaaggacccccaatgggggccatcggggagggcacgcaggaggaagaggaggaagggagtatggagggggacgcggatcacacccgcttgtccgcctcggcgctgcaaggcatgacccaggacggggatggggacaagaaggaggcagagccgatggggttgcgggtgatggtccggttggtgaaccctggattaattttgatagagaatgcccgaaattacgactcccgcgctgtttccttgcggggcacgtaccagatattgtacttggtggagcacgataaacccggggaaacggggggagggggaagcacggtgacgatcc

SEQ ID NO: 6493 - DNA, 700 bp, Nannochloropsis_gaditana
tggtcgggaggagggaaaggcgaacaagggaaagggagggcttcctccgattcatggagttcggacggcgagtttgaggacacgatggaggagatgccagaggaaggggaggaggactggagagatgtgcaggaggtggggacggaatggccggaagaagaggtgcaagagggcgacatatccctgaacgagcttttggcccaggcagaggccaacctgcctcctcctccctccgtccaagcggacacagagctctttgccgtgcgtctccagacggcgagcaccatctccctctacgcgaagcgtcgcaccccgctgttggagctgacgtcctccctggacttgcgcgtgcaccagaaaggcgacacgttctcggcggctgtcatcctcccgaccatatctctcaaggattcgttcacgccccacccgctctttacccacatcgcccaggcgggcgccggggagggggcggaagatgcgaacaaggatggaagggacagaaaccggccgcccattttcaatttgaatttctccacgtccccgcaatccacctccgtggaaatccgcacgcagcccctggacctggtgtatagccggggctggctcgctcaggtgttacacctcctcaggccctcccccgaaatggccgaggccttggccgcccaagcggtggataacattggccgggccaccgcggcgg

SEQ ID NO: 6494 - DNA, 700 bp, Nannochloropsis_gaditana
aggaccttcggcgctcgaatttggccgccaagagggcattgctcgagaaagccacggaaaccgcacaagcctggaacgtagctcggcgcaactcccttgctggcggcaacgagggtgacaaaggcgggggtgggaaagagaaaacgggatattttgccaaattggccacccgcattgccgacaatttgtttgtgttcttaaaaaacgttcacgttcgcttcgaggactcggtctcagacccttccggtgccctgtccgtgggcgttatcatacaagacttccaaatccaatccaccacgaacacttgggaagcgtccttcgtctcgcgagaagaggagaagaagcgggcgctggccaacggacaggtgcccgccatttacaagaagatgatgatgaaaggcttcgcagtgtactggaacacgcgttctctggcctccttggggcccttgcctttggacgccttgttgaaagaaatgagcaagtacgaagaggtgacgaagttgcccggggggagggcggagggggggggggagcctctgacctacatcattcggcctgtcacgctgtccctgaagctcacgcacaacgaggaaggcgaccctcgcctgccccttttctccgcggacgtggagcttccctccctggctgtgggcgtggagacggagcagtacgcgcaggcaatggccgtgaaacacacctt

SEQ ID NO: 6495 - DNA, 700 bp, Nannochloropsis_gaditana
tttgctgcgttcggcgctactcccactcatgaaagccggcccatcgatggtgtcaaaaaggtcgtttgcggacagcagcaagcttttcttcttgggtgcattctcaggtggctacatcaagaaaattgtggtgcaaaaaccatatgagagtataatcagagagtgcagtcagagttggagaaaaaaggatcatttaacgacttacctctgatctgtcggctttggattcctcttgcacttttgcctcctgttcctcctcagacgaagagccataatcggccacaagccctgccagagccatcctttccccctgcgatcggtaatttggatgtcggcatgagtgatttcccttaaatcgcacgtaataccgcatcctcgagcacgacatcacatgcacgaaagagatcgctcatcactacgagcgatcaaaagcagggtgggttctgtctcgggggggaaattctgctgattcacgcccttgggggaaagcgcgagtcagcgcggtatcatacatattttatggttatttccgtatatgtgtttatgctgggtagagtgtatgcttgtgaaggactcaagagacgtctgtgggcaggacctcgctgagcatcggcccacgctctactgcaagtaccttaaattggagggttcatgtcttgaataaccctcacgtacgcccaacatccccttgttccgaagg

SEQ ID NO: 6496 - DNA, 700 bp, Nannochloropsis_gaditana
atgtcgatcgacagatccactgacggatagtttacgaagttatgagactttgcactgtgtgacaccgatgtcagcctccccagagcggagtgtagcctcggccgggcaacctgatctcggcattgtccatgccaccatttcaacacaacgccaaaccgtgcattccgctctaggggctaaagacacgtacgacgtaattatgctgcactctgggctgggtttgatgtcacgttgccctttggctggacagtcaagtccctccagaccagacagtgcttctttttctttccgtgggcgaggggaatgcacacgggcgttccatccagcgcggaaaagaaaactctccaagccctcacgacgctcttgtgtatactttataaatcacacagatttcatctagttgtagtatactggtttcgcgacagagcagcgtttttaatcggacgtgacgagctcgaccaaaaccggcagcaccacaagcaagtgtctcgcgcctggacctgagattactcttactccgtagattgcgatatatagcgttgtacaaacgcccagaccttcctcagtaggtcttttcttctcccattctccactcacggcgtgcaaacgtgcggccattacccgggcaatcacggcgaccgcgaacctcaccagtggctcgagcctggagcttgctcagaacaagcttggcgacaagatg

SEQ ID NO: 6497 - DNA, 700 bp, Nannochloropsis_gaditana
tccctctcatgagactttttctgcttatagtgcggacgtacccaactgcgcgtccctctcgacggcctcgtctccttcccgcctcgcccccttcctggtaaccttcctgataccaggtctcatccaaatgtactactgcatcaagatccaaactgcttgtatgcctcgcttcctcagcatttgtcatgcgcgtaatgggcggtggggtcgaaaggaccgttgtctgatgtgacggagaatctactttgcgaccgacgccagacaacggtcgacacacagggcccaaagcaagcctaaaatagcaaagagatattcgttaggagggatacttttgatcatgaaacctaagagtggatttaccacacaaggaggctgtcccggatgagggacggaacaatgggaacatgaaacgaggatgcatcgcagaagtatccatggcccacacttcccaccatgcctatatgcttcgtgaaggaattattaagccaagatgtgcaccagagtttcctcgaaatgcatgagtggaagcttgtaaagacctctgcggctgcacatggaagtttagacaattttcatgcggcttacctcctcaccctctatcgtcgccgtcgccactcaagcacttccgctcgaatacacgcttataacccttccaaaaaaattaaccagtcatttcaagacaggacaaccactaagtatg

SEQ ID NO: 6498 - DNA, 700 bp, Nannochloropsis_gaditana
tcggtttgcagcatccgaagttgctgtgctgtgaaaggatgctcccacatgtgcgtgttcatggcgggagccaatagcacaggcttctgctttaaatcccaagcccgaacaatgctcgtaacgaggttatcgcagaggccgtgagccagtttccccagtgtattggccgataagggggcgatcaggagaaggtcagcccagtcccgaagctggatgtgtaagaccgggtcccccattgcagtccaggcgtcccactcattcttgtcctccagtacttccacccttcctcccagttcctggaaagaggcccatgctgcggggttgtacaccttcgcacactcccagaagtgccgtgctgccttcgtgagagcgaccttcacctcggcgccagcgccaagggataggcgcagcgccaattccggaattttgaccgtcgcgacacttcccgtggcggcaagaaggactcttggtcgcctctgagaacgatgccgtgccgcagacatgccacctgtgctcgtagggcgtgcgcgtgaggaggggggggggaggtttggcggggcacgtccaggaaaagcgacgcaggcgaagggcttaccaccgtcacatatcttgcccctcctcctgtcgaccgtgcgacaggcacgtgttcactcaagaatgctcaaaattccctttaatgtcttcctactggtctaggatg

SEQ ID NO: 6499 - DNA, 700 bp, Nannochloropsis_gaditana
acgctgctggaggtcggcctaggcaatcgaacacaaaaggaaggtgagatctgggtgggaagggtaacattccctggtctcgtctattgaattgaccttcctgagtacaagagtacgcgtagaatcctttcctgtattgaacgactgtgcctttgctcacctgtgtcatggttttcatggtcccgtctgctgccttgtattcaatgaggggcccatctccgtccgtcacagggtgttgctttacccggtcaaaagccctcttagcatccaaatgttccttccgagagagagtgggctcagccgcagccattactgaaggcgcgcatgtgtataaatgtgttgcaaatgaagctcgcacgattgaagtcaagctcacacatgttatgatccgtacctgaagtgaggctgatgcttacaagaagcacgagcaacaaaacaaagactgacgcgctagggcatgttcccatgggttcctgatgtacgattgtgcgtcaaagagctgtgtagtccttattggctttggtcacgctggcaaatattagaaaaggtggccggtaagtcaagtcttcaggggacgcaggagaaggagcgaggtgagcaagaaaaagcgacgacccctcggaactttcagcccattgccgcatcccccacacccaattcccacgcccattcgcacagtgggagacgagccccagttatg

SEQ ID NO: 6500 - DNA, 700 bp, Nannochloropsis_gaditana
agtaaggagccgagaagcacactgatgcagagacgccgtggagtcctcggccgtttgcaagtttgcatggtaccttttcgaggcacaaagcctgtgcgcatcaatgacacataaaaatggcctttgaacttcaaaaacagtaaattgtatcagagaaaatgtcgtggtggctgcggtcttgcccgacacaccacccgaggacgcgggcccttcggtcacgcaggacttcagcattgaaacccagcatctcctaataacacgccagttcgacacacatcatgccttgatgtacaatacaaaccaaaatctcacctcacagtagtccaacacgtcttcacaaatctgtgccccgttcccgcgtcctcattaaggttatttttaggtcaggcagagcctggagcactgcggtgttgagcaacgtacgcgtcgcttgctctcgctgacgggccgcggggctgccatgggtccttcccacagcgtccacgtcccgccctcacgcgcgcgtcaagcgctgtgcacggcatttgacgtgtctatacacgtggagacaggcttagccatgtcttgacgccctttttccctatcttttccggacagcttgtggtcattttggacagcgaggctcggttcatttgaagcaccaattagcgaggacgggtcagagggttgctcaccagcaagcgtacacaacgttcacatg

SEQ ID NO: 6501 - DNA, 700 bp, Nannochloropsis_gaditana
ttacagccctcgaagggtggtttccatcacaaaccttcgtgtatcgacggtgcgcatgtcgacggatagaaaaagtccttgtcagaggtgcttggtcgaaaaagtgcttattgccttgaggtctgtttgacaagccggagcgtactttttacgtttttctggcatttcttttgcctctttgttgcccgtttttttcaaatattgtcgttgcgacacaaaacaccactgcatcattaccttcataataatgcatgttcgcacataggcggtaatggtgcgtcgaaaactatccggaccgacgggcgtgcttccatcggtgatcgctacgatcccgtccctgcttttgttcaccagcactgtcacgaccaatgccctgccgaatggactgggactgacccctgctatgggttttaatacttggaaccggtttcactgcgacattgacgaggccatggtgaaagaaacggcccgacttttgatcgacacaggcttacgggacctgggctacgtcttcgtgaacttggatgactgctggatggcaagaaatcgaagcgcagaaggtggcttggtggaggaccccgtcaagtttccgtcgggtatcaaagggttgggggactacttgcacgcgttggggttcaaatttggcatctacagcagcgccggctccgcgacctgtgaggggtttccggcgtccttgggg

SEQ ID NO: 6502 - DNA, 700 bp, Nannochloropsis_gaditana
cataaactgatatgaaatgcgcaaggctcccaaggcgtgtgtgcatattgcgctaccgcttgctgagactccgctcaaaaggggggaccatgctcgggcctcgaaccagaaagcgagcttcttcggaattccgtcgagggaacacatgctcatggacttaacatatatggacggccttaccgtgcccttacgagcgacttgagagggtttacagccctcgaagggtggtttccatcacaaaccttcgtgtatcgacggtgcgcatgtcgacggatagaaaaagtccttgtcagaggtgcttggtcgaaaaagtgcttattgccttgaggtctgtttgacaagccggagcgtactttttacgtttttctggcatttcttttgcctctttgttgcccgtttttttcaaatattgtcgttgcgacacaaaacaccactgcatcattaccttcataataatgcatgttcgcacataggcggtaatggtgcgtcgaaaactatccggaccgacgggcgtgcttccatcggtgatcgctacgatcccgtccctgcttttgttcaccagcactgtcacgaccaatgccctgccgaatggactgggactgacccctgctatgggttttaatacttggaaccggtttcactgcgacattgacgaggccatggtgaaagaaacggcccgacttttgatcgacacaggctt

SEQ ID NO: 6503 - DNA, 700 bp, Nannochloropsis_gaditana
actccagaatgagggctcgggtgtcagaccgcgagccacacgtagctacgtcgtctcttcctgttccaaggcccctcatcctctcggctcttttcttgcaatctaggcattccatacacatgcacaccgacatatagcttcatggattcgcatttcttctaaggtgcttgaagttatgttagcgggggaggccgtcgacgtccaggttgtggctaagcagcgtgggaggaggcaagcgtgctactcatgcagaccggtctccgtaatgccgtcctttgccttggggcttatttcgttccttttttttcagctaggaaatatcaacgcttttgtactaccgtgttgggtctcgagtttcatggatcgcggccattttcgtcctcatgccgtggttcaagaagaagatcgccgagctatcagcagagtcaagccaacttcctccaatcttgcatcaagatttcgcaacgcctcgccacccaatgaaatacatgattcaatattggacgctgatatggatttttatgctgtggtttctgcgaaatctacgggccgttttcctgaaaatggaacgacgccgacgccctcggtccccctcaacctggtcactgagacggtctcctggctctctgacaaatggtacggcatagtgtcgaaaaagacgcgagaagcctcttgtttgcggatagtcggtgaggggatg

SEQ ID NO: 6504 - DNA, 700 bp, Nannochloropsis_gaditana
tgatgagctaaaatattgatcatgtaaatttaaatagatagaagaattgtttcgctcgcaatcccccctcaaggatgcagacagcgaatgtatctctctcttgaaataaatcacttctgaacttccccactattctagagacgtacccttttcctcatccgagtcgagacccgctggcggcaaatcgtacttcgcatcctcctctcgaggcgcttgcccccgcgcgcatgggtcacaagccttcaatttcttgtatcttctcacccgacccatatataccttgaaagttggcaagaagaggaagtgagtgtgaccgtggtatccagtttacgcagtttgcaacgcgggtggaaggtgcgtggttctctcgtgagtcgtttcacccccaacgagaagagatgccccgggctaactcttggtcaagaacgtcgcacggagcagttaataagatcgggccgatgccctctcgtccttcgacccatagattttgaccgcaatgaatttggccaagtagtggcgcacttctacttgactgcaactgttggaccgcgctttgctggacgctgggcaacccctaaacccgagacgttacgactgctcccagcacgtttcacgctgtatctttcttccgggactcattgctttcacgcacagacagccttcgcacacatttatcctcctttgctgctacagaaatatg

SEQ ID NO: 6505 - DNA, 700 bp, Nannochloropsis_gaditana
cacagccactacctctcctgcgctctcgtggcctattaccatgggctcctttacaataaagtcggcaatacgacctcttcgaaggtagtgaacgtctgaggcacaaatgccgacggcctttattgcaatacgtacgtcgtactctcccagaggggatggtaattcgtaatttttgactgcaattttgttgatagagagtaaatatgcggccggattctgtgattgtagactgctttgcatgttgtcgctgtctgttgacgccatctcccgcaccacttttgacgttaaatccgagctcttgcaagaaaagttagagccaaatggagcaacctgcacatattgtgccgatgacatgtcaattttcacacttactgatgtctatgggcattctacatgtatggaattcacagttactagacatctctcttctcaattatgtcgcgctttccaatcgccctccgcatgtccgacacaggcacagtctgaccatggccatggtatggtatcaatggcgcagtctgtccatagcaacgcatgcgggccttcaagggggcgggtctggcagtcaggccgtggccgcggtctggtcccagtggggaggttagaaggagggcgagcgcgaggcgaggaggctccggcaccaggaatctttgccccgcctccaaaccctacgccgccccgcctcaggccaaggagaatg

SEQ ID NO: 6506 - DNA, 700 bp, Nannochloropsis_gaditana
attaaacgccatcacgcatggccctgccccagtgtcccactctgctgtatgtatgcgcctttttaagtgagtcaagtaatcgggaattagcgatgttggggctcggcgcgagccgccggggggagggaggcgtggtcagaggctggataccagcccgtccagagagacgtgccatgtggtggtagtgcggactggcaccttgcttgaggaaacacgaatttctgtcaaaggtatgtgcgtgcccgacgacgtgtttcgggggacgatcgatgtccttgaggcgtgtgttgtggcaaagattttccctggaagccttccgcttcttgttctcgagcctggggctccgtgctccccgtcatcattctgccctgtcctctacctatgaagagctctctcctatcagccgtgtaccacggggagacgttgccgagaaacgcttcttttgtacgaatgtggcggctgtgggccatacccttacaggcaagagtgcggcgacgcaggcaggatgcgacctttgaaagaacgagggggtccagcccttgcttggtcacctccgcggtctggccttttgagggtttttgtgtcaaattcacggatgccctcttcccctttccaagacgtacctcatgcgattaagaaaaatgatgcggataacggagcacgcgtaactttgatattccggcgcggaatcgcgaccatg

SEQ ID NO: 6507 - DNA, 700 bp, Nannochloropsis_gaditana
tggctctccccgcagagggaactacttcttatgatgacaagaacacgaagtataccgcgaacagcaaattatgggacaaaccattgagagaggtagtaggagaggaacgccgacaaagtcacacgcgccagtatgctaaattctaaaagcatctgatctgggactctagggcgagcacatagatgaccgttcacagagtatcgaggggaagcggcgcacgatgcacgacacttaccatcacttgactggtcgaagatgttcgtggatttttctagactgatgaaggcgcgtcgtccgcgtgcccggactaaattgcgtctgcggtgagaagcgagaacgctgataccaatgagcgtgagcggaaggggggcgagagagaagccggtgcctgccccgtgtgacgcgcttgtgcggcgcgagaacaacgttcaggacaaaccatcaacgccatcattctcagactctttttaaaccctatctcttccgcgtcaagcatctctgcatggctcggcctcgccttcccctgccgcatttccttatcctgctcctccgcctgctatctccacgcaatctgtgtacgcattcctaccctagcacccggactacaccatgtcattcctagccagatacaacggaggcagaagctacaagaccattcaaacgaaccattcacgattttcttctcctttttcgatcacag

SEQ ID NO: 6508 - DNA, 700 bp, Nannochloropsis_gaditana
cttatgtggatagcgagccagactgtgcgttcaaacagaaacatagacacccacgtgggacaatgtattaactacctttctttttgcgagctgctgaaccgaaagtccatttcctggcggtagagtaggcgatcgaggaggacgatactattttgtgcagaagtaacatttcaatgtgcgtgaaagaaagtgaattatttgatgtggtaatcacagtcgagtcctcatcgtcctttttgcgtttctatctcgggcccgtaccggccatcgtgtgagagtggctctctctctaccatgggccagttccgatcgaaactcttgtagggaattatggatgattcgacagagagacttatcccaaaatgggcttccttttaccctcgttgttttcaattagtgattttgtgccctgctgctcttttttcacgcaggacacgcgggggtcagagggggaggagcctgtgacgatcacggttgaagtttggtaatcctgtcgagtgaacctatggttgaatagaaagacgggtttccacgttccaatgtacactgagccctggtatctttttacttgtcctgtgtttgtattggatgctcatactgtggaggtttaaagccagtgggctgggctttattagaaagctggtaatggtgaacaaacctcccactcttatctatacacgttagcgctaggaagcggatg

SEQ ID NO: 6509 - DNA, 700 bp, Nannochloropsis_gaditana
acgggagaaagcgaagttgtcacatgtctgtctttagggtgcgagagcatcgtacctggaggagggtggcagcgaggagaaaaataggggcagcaaaagacttcatcgtggctttggtttctgtggtatgagggaggcatcgtaatgagttgagtttcggcaaaatacaaggtgccacggcaaaatacgactccttgtatgtaagtcgtacaaatacacgaaaagtcagcaacgcgtggattaatttggcggacgaaattgtccctctgaattttgaattacgtcgatttgatcgccttctatggaggcgcgtcgctttatagatcctccgaacacaactagaccgtccgaaaaccagccggagtcgtgtaccagaccctttgaacacaaatagaccctctgagcacgagaaacctccaaaaactatccgtcggtttgaaatttccagggtcgagtgaactaaagctgtatttgggttccatgcctgttttccttgctttgcacccttttccttcgaatagtgccagatgaccgagccgtgaaatgctggcccatatactatattctagtaaagggtaagcggtcctacgtcccctttctgccaccactttaaatgtcaaatcatggtccatcaattgcaaaaattgcaaaaattgacgaacgtacatcctttggacatactctcaccccagcagccatg

SEQ ID NO: 6510 - DNA, 700 bp, Nannochloropsis_gaditana
aagagtgtagctgcctcctccagggtgagtccttgaacaaattcattctggggcgggtctgcggtagggtgccctgggggcatggcctgaagccgggccctttcttgagcagccaccagaatagctttgacgcatgcggcatcttttgcctggtatttgtcgggcgtttgcacgcacaatgttagtgggcatgtgcgtcgtgaatttgttggggcatatacatgtggagcatctgcccgcagtcgtcctccgtcttcaacccaccttgtcttttgtctcctccaacaagcgattgatcagaccttcgtcgatgattttggcagggtcctcatatttatggtggtgttcagtctcgattgaccattgagccagccagcgttgctggtggtgtctggatggcaacttacctccccgggacgcagccgtcggggtcgtaaagagacttcgaggacaaagccggccagacgcccgccacagcatcatagcagggaccggcacacgctcaactatcctgaatgagaggccgtaggaaagatgagagggaaaacgcgtggctgtctcgcttgaaagcggaacaaacgcttcttgaattgcgtctctccttctgcttcaactttgtcaggaagaactgaaccaggtcttcaaagtcactttcgcattctcacacatgcaacaatcactcacgccaggcaacggcatg

SEQ ID NO: 6511 - DNA, 700 bp, Nannochloropsis_gaditana
atatccagtccgattcctgcgtgcgcaggcgcctacgcaacgcactcaaacggcaaacgtgccgaggaccactccattttatcgagtacatagtcctatgttatatcagcataggatatgtcaagcttgagagtaatattattctttcatggatccccatttcaagaagcatcttacaaagcgagctctctaccccaacactacccggggactcctaacttgaggccctcgtcggcgcaaatattttgtccacgatgagaatcgcacatcaccaaaaaagcgcatacaatccttcacacaacaaatgacccgatgatatatgtggaaaaaaaacaccctttccgttcttcaagggtccccgcggattctgatctgagtctgtccgttgtcagggatccttacgacggaataagaccgaatattttcctgaggcggggtaattaactgctggcctcgaagacgaacgttccctaagatgtggtcccgacgcgagctcccagatttttcttgaggtagttcctgctttctttggtaacatcatgagatatgacagacttgaaacttgtttttgattgcgcagctcatgcatggtgagatggtctgagatgacacgtaaagggcgacctaattactgtcgctctgattttaagggccatatagtcatagcttatatatacccgactacagggggccttatatg

SEQ ID NO: 6512 - DNA, 700 bp, Nannochloropsis_gaditana
gtgctcttgcccgcgttcatttcccccaccaagccgatgaggaggcggtgcagccccgtcgagggaggcgccttggcggtagccgacgaaaaaaaagaagcaagaagcgagagacatggagtacgtaaacgtctgaaaaaggatgacgggatggagaggggggaaggagggcagcacatgggtgagaggggttacttgtaatgttgagtgcccgagagctctaaacgttcaagccacccttctcgaaggtcaaaatatatgcctgtctacctgactgccacaaggcacactgtaggaatgcatgccagttgtgacacgaaacgcacctgaacgctgcactgggcggcattctttctttcgtgacgttctgagcttcaactcagcgccaaagggcttgttctgaccgcgatgcctgtattaacaaatgtctttcaaagcctttgcgctgcgttggcatggcccgtggccgtgcgggcattgcctgtattgccggcgggggtggcacgggtcgtgggaaaggaagggtcgtgggaaaggaagtttaaacgaagccagcaggttcaaaaggatgtcgtgcatcgctcgtttccaggaccctcgcttgaatgttctactttcttcttttttcaaggctatattctgacaaatattccgtcaccaacacatcctacggacacaaatgcagatttagggggctatg

SEQ ID NO: 6513 - DNA, 700 bp, Nannochloropsis_gaditana
gccgtccgacatgacctcgtcgtcctcccggccacccacatcctcgtcgaagctttccatacccgcgtccgactcatctccttcctgccccacaccactgctgctgctagcgtcgcttccaccgtctatgtcttccttttcatcgtcacttttgtcgtcgtggtactccgttgaatcaagagcacgcgtagggcctgcagctcgcgcagtatcttgcaaagacgactttttcgaagcctgcctttgttgcgctttttcctgaccatcctcgtcttcactcgataattcttcctctaaccgcttcagctttttctgtagccttttttccttccggctaggcttccgttttaccaccattgtggagcttgacattgtggttgtatggaggggaggtctgaggcatgagggtaggatcatagcaaataacaatacaaggcatcgcacgacaagttcaattgtcatgtcctttagagaattttggttaaatgacagacatcctgataaccaaactaatgaaatcgtggatgattccaccgcagagctgccgtctagagcactcaatgtaccccttgctctcccctccgcccctcgttgcgcccccttcccctcgctttcgcctcccacgcccaaggtcgccgtttttgtgcccccctcccccgtattcacctggcttcggactcattcgtttcacaggttgatg

SEQ ID NO: 6514 - DNA, 700 bp, Nannochloropsis_gaditana
  misc_feature (446)..(455): n is a, c, g, or t
acacctgcgaagcctcaaatgcatgtgattggttaagccctgatatcaattttagcaaattcgaaagcaactagcgaacgcattatattcttaggtcatccagggaagttgccgtaacaatgttttttaagagggcaaagatacgataatcctacatttcaatgtcagatttcttttctatctttctgtaacttttttttaaaagagatacgccttattccatttcgagaataaaaagctacaaaacttaaacattaaaggaaccaagccctggaatataggtggtgtccacgtcagtctatcgattccggggcgttaataataggtgcctccaatattttgctcttttagccttcttgacaacttgcaagtcatcttgatttcagtgagtacataggatgcatgtatagacgaattgataaacagaaggctatacgggtgtagtnnnnnnnnnngggggggggggggggttgcacttgcaccatttttacgtcgattttctgggttatattgtcgatttcacagctagtattcatccatgtactgatttgctcgcgttaaactacatttcgatacaactgtgctgtccagtggcaggtgcattaaaattcgcaagatacttgaagcttttccacctgaaagccttcctgacactcgcataaaccaacaaaaagacgtatctcctccactgggaaatatg

SEQ ID NO: 6515 - DNA, 700 bp, Nannochloropsis_gaditana
ctgtgatggtcggctacaatagtacaatcacaggaaaaaggccgcgaaaagtcgcgttgacgctttgcgcgtggatacgcacgagagagagtggttcggtctctatgagcactaaacgaaggtgcgggttaagccgaggcaaactaagattatcaatagattgcttgatgatggatgcttggtttgagaagtaagcgggataatggagatcctctgtaatgagtaacgttttgacacagcgcggtatgagacgcggcaagtccgataaaactggcgcgaaacaaaaaaaatgaagcacgcatataagcacccgggcggttctaggatgcggaggacaaatgtaagggtaaagaagtcaaatttccatttttttaaaacatgaaggtcctgcgaaaataaagaagccaaaaggggctgcgaaagcatcctggaatgggccgacaacgataacctcctgccaagccgctccggcatgatccatcctcttccgtccatccgcacaacgcagacactaaacgacttgtctattatcccatattgtctcttataatataaaatgaacttagatgtcttgggtcaggtgtgtcttctggatcgctgctgtacaacacgcctcctcggtagcctctgcatttctaggaccgtcatccacctgctcggcctcactcgcccgctcgagcacgcggtttgtagtgatggc

SEQ ID NO: 6516 - DNA, 700 bp, Nannochloropsis_gaditana
gatcccacgccgccatgagacggccgtgcgtcgcgcttatcgcttcctgtggggctccggcgctcacagtgcgggtagccgggcgtctggttcattctttgaggctttttgtgctttatctcacgttgttcttgtcgccgcagcggcggcttctgcgcggtaagggactttccgtgtctgaacatatcgcgccccccggcaccacagacatccacgcgtcgtatgtacgccgacagtagcaacaaggccatcacgcactgataacttctttattgtcaagcgatacttgtcgtatttaccccgtcttgtttgcctttttccatcacgaggcatgaacatggtcagcatcggtagacatacgccaccatcaggagcttgtctgtgtacatgaccgtaagccctttaacgctgtcgctgtcgacacgcaagccaaaagacgtgtcactcttgggaggggaaccatgggtctttgacatccctcctccccacctgtcacaggtggatgtttccctcctcatcctccatcaaacgcagtctcagcaacctctccccggcaaagatcttgcggaaaggcagcaacagcagcctgagcactcagggttcgcccgctagaagtctttccgtcactgaggacgcgagcaataacatggaggccaccacaaccgccagcacacccactcccagcactagcaacacaatg

SEQ ID NO: 6517 - DNA, 700 bp, Nannochloropsis_gaditana
tgtagaacgaatgattaacgaatgattactctaccaagtacgtgtaacttgtatgatgcttgtagtcgttataggcgacgagaggagacaactcatccccttgacaagcagatggctggtacgcgtgtatcaagaaagaaaagatcgattaaggcttgccctcgtcctttaatatactttgattattgcggaattagtacataaattcaaggtaaagcagggcttccaggcgaggctaagctcaacttgtcaccacggttcgagatgcaccaaaatcagcgactcgaccacgtaccactagtagtttgaggcccgcacagctcttcgaagaggacagatatctgaatgcccgtcttttggaggaaaagagacgaactaccagaccatatttcattttttataatgtacagcgatgcgcaggacatcctggaacggcgttacgaccatttgggtgttcctggtcgcaggcacaggtgcgcaagccttcttcactgtctcttcaacacggcctcattcactcctgtcgagagccgcatgtgatctaaatcagaataaggactcccttaagcaagcttcatttccgtctcttcaatctcttcccggtctgggcctcttagcacttaatgtactggccccttctttgattcccccgtccgcccaggccctgcctcagaaggcgcctgaaaccaatgcacaaatg

SEQ ID NO: 6518 - DNA, 700 bp, Nannochloropsis_gaditana
acgtccgtcatgtcgggctcttttgcctggtcgcggcctggatccaaaagccttagctgcaaacaagagacctcaacgtcaaaaaaacagcagcgatatcagcttctgggggtgctattacctctctttttgaccttatcgaggccactacaaatacacggcttccacgctagcctgttcggacagcggcattggcggtcctcccagaaacatatgttgttcctgctctcaaagtcaagttcgattacgcttcttcatgatatctcacaacaccgatcaagaaaatcaatgtctacatttccattttcgagccttccttccggcacaccactcttttccattaatgacgaaaaagattttcatgctgcttcaagcaactttgagaaggctttagtagacgacatcaacaagacgaaagagaatcccatcgagctgttgtactcaactcacatgttagaagatttttgggatgaattgccggatgaaaagctctatctgctgctggacaaactaagaatactagaaaaggagacaagtggaatcgggagcgatgtggggcaggacgcgactttgaaacgaatttctgactactgtcagaatcgacagaggcacattgacatccaaagtactttgatttcacctgatccaaacggtttattcgcgcagctccgagcttcttggaggaactcagagtcgcatg

SEQ ID NO: 6519 - DNA, 700 bp, Nannochloropsis_gaditana
gaccctgccttctggtcggttggttccatggaagtgccacacgtggggtatcgaggccgtgaaaggcaactcgaccttctgtgccgtgcttcgaagggtcgtgaacgccgttttttccacgatgggtggactttgtggatgtgagctggccttgaaggcttgcgctcggcgcgggggtcctgctgagtgccacctcactcactggactatgacataaaggtgggccctcgtcaccacccagggcggttgctccaggatccaacgcggtcgaaacccattttctccgtgagcataagttctttgttgcgtggtttcccatgcgtgcgcctttcatgggtgtaaatgtctagttttgtgtgaagtattttttttgcagtcggaatgatgaggagaatgcaagcacagaatcctctcactcgagaccacctgaacattcaaccccgtgttcaatccagtagtgtgcgaccctctcacgccatcttctttcccttcttgtcctccatatacatacacacatgtttcaaaatacatctgtctgctttttggttcttagtggccagcaccagaatcggtaaacactacctttgagtatcgtcgtcgctgtcgtcgaccataagcgtacctttctcgcgggccccaaccaagcgacacataaaaaacaatcaccaccaactggaacagtgcggtcttgccttgtatg

SEQ ID NO: 6520 - DNA, 700 bp, Nannochloropsis_gaditana
ttccccaaccagttgtgaagctccagcaaggtagtccccgcctgcgcagtcaccgtttgtccttcatcgtcgttgcccactgcaatgatttgattgagtttgcgcatgagcacaacagtgcctccttcatttaccacggcctcagttacagtatgaatattgcccagtgctcgcacaggggtgggatacttttctgtatcctggacagcttcaatcacatcctcaaatgtggcggcctccacgacaacggcaggagtaaattgataggagcggccccaattctttaatggacgattactggtgaccttggaatattctgcttccggatccgggcctggacctcggcatggaatgcaagccatctggggtgaggaaaaaggggtgttttcagaagactcctgaagaagttggttgggcagacgttcagcgtacaacacagtgcttaataataaaatcacacatatcatcagtggaagtgactacagtgcagcatccatgcccatctatgagaggcctttcactctttgcgccaatctcctccaacggcaacggcagcaagcgtctcgttaaattttcaacggttactcgaatttcttttccggacttgtcggaacccagtccgcaaacggtaatacggaaaaagcctcgacggtgtgcagtatgctgctttgtcaatccatttattcaaatgagatgccca

SEQ ID NO: 6521 - DNA, 700 bp, Nannochloropsis_gaditana
cctcagatagagccaacgcgttgaggaatatgaaatccaaggagaaggccagaccgtcctagccgcggtcatgtgcacatggcacgagtcgcgggcgagatcatgagcccaagactgtggctccttgaatatcattgaagtcaccgttattggacaatctgggggatcgctgtcgatggttgccgcgtgtatctcgcaccgccctctgtcggcacgctcccacaccgtccctgtcattcgacgacttttagcggctcgcttcttccttttcgggaaattgaatggaccccacacgcattggatggtctgtgtgtgtgtcgtgaggtgggtagcaatacatattgctgctgttttgctggatgaaaagcttgcggcttgcgttgtcatcatgacacacgccacgaatcgttgaggaaactaaactataatccaccagcttcttacgcccgacaccgcacaaatggagaagccaatcgatcttcttaatcgggaaggagagaaaatagacgatgaatcatctttactatgttgggggtgcttcatatttacggcaagatccctctgttgagggacactgatcagcagccagatcgccccctcatttctgcacgcttttccacattcctatacgcgttcacaaacagacgttctctctagccatacgccaaagaaaagaccttcgctacccgcttctgagatg

SEQ ID NO: 6522 - DNA, 700 bp, Nannochloropsis_gaditana
cggccgtgcgttgccgtgtctattagttggcttcctattccttttattttaacatcggagttgtagcgcatagccctacaaagtaagaaaaaatccaaagaaacgtaaacgtaaacaaaaaatctcgaacgtaatgtacattctctctcaaaaaacaggtaactgtcaaagttctggcgctcttgagactctctttggagtgacttgccgtgaagatttcaagggaggcttatgtatgataaagatggggaggagaccatcgcatatccggagagcggcagcgaggacaagatacagtcaggctggatgtttccattatttgaatgcacagaaacgtcttttgcgggactatgctagaacgacgttgggtttgggagtccgatggaggtcaagcttgcaaggactcaaaagtgctcgtggcattcgactcgctaccacaccgtccagtcaatggacacaggatgaactcgattgtctttacagaaaatgggatttatatcgtccgaattctgaagagctgcgcgtgaacgcttgcattcgaagattaactcaacatgataaagtgaaacaggaaagtagccttgacacgcggcccggattcccgtggaactcgaggtctcagattccgagcttggcttctccatctcttcgtagcatcaacttggacgaaaagaagaattcatgctctctacttgacatg

SEQ ID NO: 6523 - DNA, 700 bp, Nannochloropsis_gaditana
aattgagcgtaatgttacgcggatgagcatatcatgggaaaaagtacctgtacagttcatgtgtgcttgagattgaaaggtggtttttatttacaacgtaacactgaagaaggccttttttaacttttttatattttttccaatactgtttcttgtgtaacaaccaatgacataaagccccgtgactcactgtcctcccccttcaaagtagcctgcggactgcaagcttatgtacgtgaaaggaaatgaatcggcgtcacacaacttacgccatgaaatcaagtcgcaaatatgacgacgtggatgttgtggccaaccccgccaatttttggagccttcgtctactttatctttaacatatgcagagaaagacttcatgcgtcggaagctgagcacaaattcgtcctcgaccttttcttgtagcggcccatattcaaacctcccgcgtctgcggaattgaatggtgcccaccatcgctctttctgacccgatcaccctgatgtttcggtgcacactcaacaaataaagaggtgtccacttgacaagcgtggctgagtgtgccctttttgcatcaaaagctaaggtttgcggtcttggcgtggcgaagcgacttcccgtgcttggaagatactgcattgttcgtcaaaattcacatgtcttctccggcgcatacgctcccctatctcttaggtggggaatg

SEQ ID NO: 6524 - DNA, 700 bp, Nannochloropsis_gaditana
cggtcaggagcgtggtgttcgtgctcgggaccgttttgaccaactacgtctgggagcgggtgatccgtcgagaaggctggcaaggagactacgcgcagctcgtccgtcagcggcggcggggcggtagaggcggggacggaggaagggcaagaggtgaaggaggggaagggggcttgtcttcgcctcctgcagctcctcgttcccacccaccgggtcaccctcccacctccgcccccctcctccagcgctgcctccagcgtcttcgtcgcctcctctccctcctcctctcttctcccccctacctttttctggcttccctcctcccctccccccgtgacgccctcttccgaaccctgcatcgcctgcatctgatggtcttcttcctgaccaaccgttacttcacactggccatgcgggtggcgggcgcgcgaaccatattcacccgggagatggggggggaagggccagaaggagaaggaagcagcccgcgccgggcgagctacgttgcgattggtgtcttgatcctgatggagatgggtttgagagcctcgtcgagcgtcatgtcggccctgcgtcggctgtgggaggagcatcgtcggcgggagggcgagcgtcaacaacatctactgggtgatgggttggaccctcccccctctctagtccacgtagtcgacccccccgcgtcgtccccctccactcc

SEQ ID NO: 6525 - DNA, 700 bp, Nannochloropsis_gaditana
ctactgacctctcacaaagcaggcaagctgcatctcttgagtccctggaaaatcgtaggtgaacttttcacaagttgccgcatacaccatgacctggggatagatgctcagtactgagaaagctcccgactgagtgagacgtctcgagctgcggcgttgaggaatgacctttcaattaaccacgcgaggcatttgttcctctgaaatatcaccagggttctctgcggtggcgtatgagttccctttttcttgtaatagatgtatagtgcatcgtagagcgtgcccgtgatgtcacgttgggccgcagagtctgatcgccagcgagcagccctaccgagtagcaagggcgtgtggtaaatgtctgaataaacgtcacttagacgccccattaacacgtcagagggattgatcgacatggttacttttaccagggtgtttacggtctttgcctacgttcttagtgtccctatcgtaatcgccttaccttccctcctctatccctcctccaaagggctcgataactcttctgctcgcttcccatccgaccctgatggagaatgggaatacgagaagtcccgcgccttcgactcaagaaaataaacttaccgctgatgcctccactcactcgagtgctacgagcaacctcgccagctttcggaggaaacttaacttaccgctagcggcaggacctgacatcatg

SEQ ID NO: 6526 - DNA, 700 bp, Nannochloropsis_gaditana
aaatttcacgatgggacatcatatttgccacaatcatgcaaacatatctgtctatccggccaaacgtgtgagatgtgtgcacgttgccatgtgacgatgtatgcagccacatcgttgccacatccttccaccatacttgacatccgccccgcctgaaaatcacgagggggagactcgcctttgaagtttgaagtcgcctacatactgtgacgtgtagtcgtttttacattataagtttcgacgggatttgcgaagggattaatgcctgccaatgatagtgtatgcaaggctagatttcttgaattcagacaaactgagacatgttcccgtccaaccaggccatttcccaaccccgcacagcatgaaccacttggcaataaggcacctcaaggcttggcttgtatgtttcctggtgcccgtctcaatccgtgcctttaagcctctttcttcgcgccccacccttgcccgcccttcccaccacatgccttcccccgggattttccgcaacctccatcctccccgacccttttcctcaagcactgcaccatcatcttccctcctccttcctcgtcatgcatggcctcagacccgggatccgacacctctccctccggactacccacttgcagccgcacgtgtcggcatcacggtgctcgcatgccttcttacatcctattcccacacgtcccaccaagccatg

SEQ ID NO: 6527 - DNA, 700 bp, Nannochloropsis_gaditana
tggcggagacacgggctcgggagcaacgtgctgcccggagtcgggcgggctcggagggcaacagcgtggacggtcggagttggggtggcttgagcacgctgagtgccggagggggtgacaatgggcacaagggagccggtgggggaatcacgggggaagggagcttcgcctcctcgcatggcatgttgtcaggcgatgggggggaatggggggagcagggagagacttggattgagggagggaaggaagggcggggcaccagctcgagtgaaggactgggcgggtcctcgcggcggggaggggaaggaggggagaaagagggggggagggacgggaaagggggccggaaacgcaatttgacggcggaggagaaagtagctcagtctcggcatcggaatcgggagcacgcccgcaacacccggctgcggaaaaaggcttacacgaagaaattgaaggagctggtggacgacttggaacggcagcgggaggaggaagacagggccaaggacgtgctggcctcccgggccttggaggaggttcaccaccgaaacaccgtcgtccactccttcctacactgccgagcccgggacgaacgcgaccgaaggaaatgggcccaggtcctggacgaggactgcgtgctcacgctgccaatcaccccctaccgttttttcccccggggggaggtgcacaagggggtacg

SEQ ID NO: 6528 - DNA, 700 bp, Nannochloropsis_gaditana
accctgtgtttctggaatcttggggggaagaagggaaaggaaagctgaaggggcaagggaatggagcggtggagaaacaggagcggggcaaggcgaagaggaggcggccagagttgaacccgtccgaccccatgcccggggccgggggcgggcagggggaggtggagtcatgggtggggacgacgcaggtgccggtcggggagaggaaagccgtgaaagggcagggaggtgggggcaatctgtttcgcgcgcaggagaaggagttgagggaggcggcggcgctggaagtggcggagacacgggctcgggagcaacgtgctgcccggagtcgggcgggctcggagggcaacagcgtggacggtcggagttggggtggcttgagcacgctgagtgccggagggggtgacaatgggcacaagggagccggtgggggaatcacgggggaagggagcttcgcctcctcgcatggcatgttgtcaggcgatgggggggaatggggggagcagggagagacttggattgagggagggaaggaagggcggggcaccagctcgagtgaaggactgggcgggtcctcgcggcggggaggggaaggaggggagaaagagggggggagggacgggaaagggggccggaaacgcaatttgacggcggaggagaaagtagctcagtctcggcatcggaatcgggagcacgcccg

SEQ ID NO: 6529 - DNA, 700 bp, Nannochloropsis_gaditana
gtgccacctgtcttcttcttctccttttgcaagttattattctcgagacattgtcttgggaagcaccgggagcagctcgcataaacgctgcggcaaccggcggctgcgactgcaacattgcccggggcgtgccctcaggctaccgctgatacgatgctactaacccagccttcagtcagacgtcatcgtcagagcgcctcctggcagagtatgtttgaaatgacggacgatttagaacgtatgttgaaatgaaacaggctctcaatgccgggggacgggaagtcgcgcggcaagcaagtagctgaagggggttaaagcagaaagccgacacagacgcactgtgaacgacccacacaaatccatcgggaccctgcggcgcgtcaaaaacgtcttgaacaagcaaaatgaatgcgaaatgcatgcgggtctccgttctgtcttatgttcgtccccggtccatggcatcctagtatcctccgaagcccttgctcctgtccgtcgccatttcctggacgcctgtgtttccccttcgataatccgccctcgtttgatctttacccttttaaacaactgcaagatttgattgagtggatccagcgaaactcatgcgtactcacatgctgtgatccgggcaaactggaagtccaccctggtacagactatttcttcgccccggaccaacgaggccttcaccaggatg

SEQ ID NO: 6530 - DNA, 700 bp, Nannochloropsis_gaditana
tcgcctcttgagtgggcacatgcacaaggcgacccggagccgaccgcttcccttcccaccagtggcctcgggagggacggagataggacggtcggagggagccaagatggaagagcagtctaccctggcctcgcataccgcccccggaaagtcctctttgcctccctccaaaacgtccgcccaagacattgacgggtcggcccaccgtccccaggcacgaggcccccacggccctaccacccagcctgccacgtcccccacctccctccgcccctccctcccctcctccctccccatggccgacgcgtggaagcgttggggtctcgacacccgcctcctcccaattctggcgtcccgaggcatgtctaccctcctccccgtccaagcacaggtcctcccgcacctcctcccgcccctcctgccgcccgcccgactcctcccttgccgggacgcagtagtctgcgcccccacggggagtgggaagaccttgatctacgtccttgttcttctccaccagctcgccaaccgccgggtggggaggttgagggggcttgtcctggttcctagccgggacctcgccacgcaggtttggcgggaattccagactttggccccacggtaggagttaaggtgggcttggcggtgggccagtcggatttccaggcggagcaacaaagggtgatggggtgggaaggcgggg

SEQ ID NO: 6531 - DNA, 700 bp, Nannochloropsis_gaditana
cacgtatgctatccaacaccaattacgaggttcccacacggggttgttcggtttgggttaaagtttgaagggagggcggaccgcgcttctcaagaattcttctcatttaagcgacgggtagcagcggcacctggtttccacgggcacatgttaccactgccctcccacgtgtgcttgcacgcaccaaacgactcccacaagcgtatgattgtgcagcggttggacacatacgagaaagagacactttcgggaataattgcaccagtcattttttgagcgtgaggcccgggggatgatgggcggcagggctcctctcccttgacctggggactgtctgaagagagttcaattgaagcgtaggccagtgcgtggtgcttcgaggcaagtaagtgcgatgtggagaatgactttggcgcaggaataattacaacagaccaccgatggccaaggttttgggagaaacaggcattggccatatcaacaagaaggactcctcctgctaacctcctcccatttccaaacctttgtggcggtaccctgccttagattttgcctttagcccctcgtatgactcattctctcctcccgcatgcttttaatcctgttttggtttatgtcgacaggattctggacgagcgatgttggtactaacttgctttaaaaaggggtacaacttgtacgcaactcttcactagatatg

SEQ ID NO: 6532 - DNA, 36 bp, Nannochloropsis_gaditana
agggtggggcactacgagggccgggagggggacatg

SEQ ID NO: 6533 - DNA, 700 bp, Nannochloropsis_gaditana
atccccacgtttcgcatccaaaatgacaggtatgtcagacgggactgattgcacaacctccagcaaagcttgccacccctcagttccgagggcctcgaaaaaagctatgtttggcttgtacgcggctgcgtagggcgccgttgcctcaatgagccgcttgcagaatttatatgcagccgcacctgttgcttcctgaagctatatgagtgtgtacgtgtgcacagccttggtgagtgaggactttgtggcggccgtcgggagaggtgtcggcttacctgtgcaccatgagggtcgagtccgacgcaaagcaacgagtccaccgacttcacccttgcctctaagcattcaaaaaaagacatagccatgcctgtgaggataaaattgcgaaagtcgtgggcaaaacaaatgttacgagtcgacgggcagcgcgacctcccaccccagcaagtctcgtagagcctcgccacaggcccttagcgacgggacaagagcggaacaattacttcacgtccgcgtgcctagaccctcactgccatcctctcacgctctacctcggctacagaaagacagactcgatccagtactacagccctactttcaaattgtgcgacttaactttccctcacgtccacgcgaacatttcttctcgcctcggctctcccgtacttcgcagcacgtgccgccacaagagtaaaccatg

SEQ ID NO: 6534 - DNA, 700 bp, Nannochloropsis_gaditana
agacacgaaactgtctcgtcccaaggaccataagcagctatagtatgcgacgacgacatacaccgctagctagatcttgctttcagcaccgcttatcgctcacgtggatttcatgcctaccctgtgatgttccaacaacatcagtccgcccttattattattgttcacatgttgaatccatgtacaataaatttgacgcgagggcgtactaagaattgtgccgtagactcacaggttgcaaggctggcacgtgtgtcgacggcccgcagctgtccgaccccgtcgtagccagaaagtctcattcgtcacacgtggatcgttcactgccttcctctgcctgatgctgatttttgtcaggaaagctgcattcgaaagtggaatgccagcatttcaaacacttcttctatggcttttttgctagctgtactgctctgtcattcgaattgattccgtacttttggcattcgacgtcctcaacgattcctactcaatctcgttgcgcacaggaatgatgtccaagagcctaattatgcttggcttattgagcccaacagcctttgcttttgtccccaagctttcaacaaatgtgctctcccgggctatttcctcacatgcacgcaagaacctggtcaaggcttctgctgtggattacaaaaccgcattcatgttccctggccagggggcccagtatgtgggaatg

SEQ ID NO: 6535 - DNA, 700 bp, Nannochloropsis_gaditana
aacaaaacaatagacaatcctgcttgtatagagtacggccagcaagagcgcatctgaatgacaagacaggctagcatagggagcaatagccgtctgcgagatgtcactcatgataatgtgttttccttgaaaggagcgtcacttgccgcttaagcgtgtagaacgcacaagaaaagcaaggcatgagataaagaggccccaactctttatttaaaaagatgaagaggggaagaaaggtcactcagcagtcatggaagaggttagaggggtctgtgatcctgccacgttgcttttttcctgagaaggaagcaggctgcgggctctgggaaacagacaaaatacccggaaagtccattgctcgctgcagggcttgaaagcccatgcaacacacggccgagactgatttgattatagctttttttccccgtttgagacgagaagaacgtgtttcatatttttattactctggttgctcaattggacttatacttgaataagcggtcttcgtgggcttccttttcatgcacaaagccttcatgcgcgcggaggatactttacaccgtgcatgacgattcgatggcccacgggtaactcagtattttattgtaccactgccttttttcttgagcccccgatccatattttcgtataaaatcttttctcatatttatccatttttccgtcttgtagtttatttatg

SEQ ID NO: 6536 - DNA, 700 bp, Nannochloropsis_gaditana
tcacatattttatgaaggtgcctcacgggttttcttactgcatgctactgtcaagcctcgaacagctagatacaggcaaagctaaagacatgagaacattttcacacggaaaaagtggtgatggtaaatgcggtgtgcatctggaaagtgcaggcagtagtgacgcatttcgtcccatcaagaggtacgatgttccgttctggatcaacggtgcgtagatatcaatttttaaaaaatagatacatcggtggaaaggcgggagtacatcaaaaggatgtgatttaccgtgacttcgaaactttaaggcatttttcttaattggcccacttgggacaggaggttgttcgaaaagcccttaaaggcacttacgatttaccagcggcgatacaccacctggaggtacacgcagactcccaaaattgaggtcgatcactctttctgaggcaatggctcatagagacagaagaaaaatgtgtccacacgtaatggctgcattaactgtcgggagtgtcgaatgcttctcgtcggcgaatcccagcggtcgcctcgcgcggggagttaacgtgagcagcacatgccgcattttggtgcttacatattgtcgggcaccactcctcgtcttttaaatacactgtctttcaacagggcaacttaatccactttttagctcccagtctgtgggataaaactgggcacaatg

SEQ ID NO: 6537 - DNA, 700 bp, Nannochloropsis_gaditana
tttatgctaaaggacgggcgtatgttacaaaaaagaaagaaaaaagatggtgactgtggggtttcggggcagtgtgcatcggagaggaacacgtcccgtctcgaacaccgcacttgaacccacgcggtttcccattggcgcctaaaaccaacgccttaacctctcggccaagtcaccacacaaaggttgctgtcagctcgactagagtctcgccactggagctcgaaaggcggatgtcagcttctattatcttgacgagcaacatgaatgttagacgacagaggtgagaggtgaagtggacgcattatcacaccagtggcattcgtaaattcgtagcgcacattgctgttaaaattaacacatttgaccagcatagattacgcaagtaaatcggtgtgcttctgctgttttgacaacatggtgcatgcctagtaaggcgccgacctcctcccctttctaatggcgatagtgtaaagctccctcgggctcaagaggcaatgcaatagcaccgagaacagtgtggagcgcgtaaaattgagtcccgataatcggagcggtgttggtagcgcacacgtaggtcacatgtattgagctcatcatgtcctaattcgctcttgtcaagggaaaacaagctctggaaggcgtaatcttgcaatttgtcttagccaaagcaactccaagactgcgccctagctccatg

SEQ ID NO: 6538 - DNA, 700 bp, Nannochloropsis_gaditana
cattcaatgttactgcgtcttgagatgggaaaagcaccagcgtctcatctacctcccagggctccgcagccagctcctcgagccctcctgtccacgtgtcccaaacccgaaccgattccgtcgccaccacgccgacttgtattgcggtggattttttacgattgtctgctatgattatgttcacctcgaggggcagacgcaaacgcggtacctgcaccccggctggaacccctacccagcaaacacactttgcacagtaaaagcgtttttctgctgtgcagccgtgcgatggacatgcagccttcacccaatcatcgatagcgtaaggcaaaggtgcagcaagataggcttgcaacgatgcgctggtatcaatatgatcggttgctggagttgatatcgacggcgtataggtcgtggttgcaggcggagggggtgaggaggttaacattgaagggcgcttggagcagtgacctgagggtgattgtaggtggtttatcctcccaatgtgtgctccgccttctctaattcacaataacaaagtgtgtgttcgctgagttgttagcctttggggcagggatcacagttaatctccgcaaaccagtctcctcagcgatgccttgacgtctcgtctctgtagtctttaacctcgccacctcacggacacttatcgcaacgttcttcaggacaggtgattttgatg

SEQ ID NO: 6539 - DNA, 700 bp, Nannochloropsis_gaditana
ggggagggggatggggcgggaggagtggtggcgatccagggggtcggggaggagggaggtcgggtaggggtggtggagggaggcggtggtgaaggtgcaatcctaaagacaggattgcatgcattgtgggaagcgaggagaggagacgcgatttcttcagtgccaaagattgactggtaagggagggaggcgcgctccacacataatgagagatggggccggaggcgggaaagagaacgtgaaactgcactcggggatgcttactgggagcgaccagaaaatctctcccaaattgtacacattttgctcttacagtcatgaagtcaaattcgatgtgcatgtaaaaaaaagaagacactatttgcgttgagcctgcgggctcaaggccgggaggttaaacttctactgggtggctgttgagggctgtgcacggctatactcacattattcaaccttctaattacatagcgacgagtacagaaaatgtggttcttaactacacgcgttttattcacgatggtggccgtcttgagtgcgctggggacgacccaggcttttcgtgcgtcgctcgttaatcgaatcccgccaccccgcgtacgtcatgtcgctctgcaaatgtcaacaaccacagcgtccccgggccaagagacgaatgctgagacagtgctgtggctacgaggcctaagtaacacgtttgatg

SEQ ID NO: 6540 - DNA, 700 bp, Nannochloropsis_gaditana
aagtctcatgagataaatgcgtaaaaagccattccacattggatactagagggtccggctgaagtacagcgagcttgagtcttctgcagaaagtatcttaccaaagacaatcatcgtaatctattcgatttacccaaaaaggccatacattcatgcataatgtgaagagatttacaacaaatcgatcattttctcctgaagttgtgaggtgaagcgcgtccttaccttgtcttctatggtgagtctcactggcgtttccgctgtgtgatttgcgagggcgaaagccaccatgctgctgcttccaccggcagcaccaagccacaaaagtctgccggccttcgacgaaagcattcctgcagcctgtgttattgtggtgggagtacgtaaaaggccattttcggaccgcgtcagtgtactggaacttagcgaattggcgacccctggaagtcctccttcatatgtcatgtcgcgaggtcacttacacacgccatctagaatttgtcagactctcgtctgcgccccacctggactccgctcatgctgcacccctctacgttctgttgacccggattggagcggggagtcggattggttttatgacccatgatgggggcagtcgatttgccgcgccacgctccatgcatactgacaaagcccgtcatccttcccgttgacatacttaggggtctcctataccatg

SEQ ID NO: 6541 - DNA, 700 bp, Nannochloropsis_gaditana
gcaattctttcttttccttccagtcgaccaataacagaccgccttgctgcaccccagtcccaaagacaccagggatgtggatccccttgtcaaaacggagataggaggggatctggcgacggctcgcttatatgtcgccgtctggaagtgagagttgcgttacgggcgctggcggtagcacgggagagatgcctcgcgtgcgtggttcatctttcgtacgccccaaaggctttgcccgccttcatgtagcgtgtgagtaggataaactcgacgctacgtagacggtgagcaggttgcggcccttgtggatgcgtgagaatgagaccatttttttttaggaccggtgtctaaggcatatttttgccccgctccagaagagaatgacctcctgtatccaggcgctgctgggcttttacacgtgagaaaattcatccactggtccgcactgcaaacacttgaagtgaatagatacggaaattcatttttcatggtatccgcgtttttgggttgatagcatatgatacaacatcacttgttcctgctttatcatgctcctccgtgaaacagcctacttatttttcgcttcacactttatttcctccggttagggacagttttgatgcttccattcttgcgaacagcatgtttcaatcgcacagtacgtcgccatcctccactcgccttgctaaaatcactaatg

SEQ ID NO: 6542 - DNA, 700 bp, Nannochloropsis_gaditana
ctttatagcagcgtgaacttccgtaattggctgcataatagaaaagtgaaatttgagtgagggggcacttttagaaacgcactcgcactcgccccactttcgctctctcacaggcgagtgggaccattccctggacgacgggagtcaccccatctaatatttggtctttcatgaaaacggccaatggaccggtggtcagtcatgactcatgtatgagactgtacccgctccgcaggaacgggcctgtccaaactaaggagattcaagggggggcatactgcgaaggggggactgcgggcgctcccccgcgggcttttggggcggtgccctaggcaaaacgcattttagagtgtcaagcccgcattttccgatcacaaatcggaggccttcgtactttaatagctcacctgtctagctcaagcattattcagaaatgaaatctcaccaatgattgatgatgttcgttgatgacccctaggtcgggtgacacccctgcctcatgggagggcaaatagtcgccgaatccattcgcaaacggacgcagcgccgttatgcagaacttcatgggcacgattttcttcggaggcatactgcgaatgatctcatcgaaatcttgcaaaaaacttactttcgggcgaatgtcgttgactacttatcattgctacattctcttcgctccacattgtcgatcacccgcaca

SEQ ID NO: 6543 - DNA, 700 bp, Nannochloropsis_gaditana
gggcgaacagggtacaaaatctctgtttgtgctgatgtgctcgggacgcgcgcagacatatggctccgtaacggtgagtggagggagggagtgagggagcgatggcgtaataggagcagtctgggggagcattcccaccagccccgcggcttcgtgtgcaaaaaagacttacgctttctatctcataccatgcagtcatagacaggagcgagtgggcggaggctgttgaccccttccagcggggccaggcccttatccggcgggcggcagagatagtccgagcgctgggcgtgggggagaacctcaccgtcgtagagaagggcgacattggaacgcttctctatgtcgtgcagtacctgtatccgctggtgagataagacaggactgggattgcgtgcgtcctccccttcgcccctccacagcctgacgattcgaccctctcttcaaaattttcatactccaggtgcccgagacagcccccttcaaggagaacttctatttacaggaagcgctgtggagggtggtggaggcgccgtggatatcgccccttcaaggcaacaatcccaaccacgtcacaccctccccccgcgatggtaggcgcctataacttgtgaagaggggagagttcggcgagaggcgcgacgcaatactaaaaaccatggtctcgctcgcggagttgccggaaccctggcagtagatg

SEQ ID NO: 6544 - DNA, 700 bp, Nannochloropsis_gaditana
cttgatactaatattttcctcactcatcgctcttgtatcttgaaggcgcataaagacgcgaagcctttcccgtgcacgccatcttgaagcgatcttgagcgacggctgtgtgcgtttgagatctgtgggtggccatcacgatggccgatgctggcattaatttgtaactcattatcttgcctttcacgcaacagacgcaatgccatatagcgaaagtgatattgtgactgcatttaacagcagcacgactgcaacgacagcgacgctgcacatccggaccaaggcgggagcgaataagatggcggaagtgcctttgccgccgacacgtatttgccaatacgtgcctgtcccgggcgggcgaacagggtacaaaatctctgtttgtgctgatgtgctcgggacgcgcgcagacatatggctccgtaacggtgagtggagggagggagtgagggagcgatggcgtaataggagcagtctgggggagcattcccaccagccccgcggcttcgtgtgcaaaaaagacttacgctttctatctcataccatgcagtcatagacaggagcgagtgggcggaggctgttgaccccttccagcggggccaggcccttatccggcgggcggcagagatagtccgagcgctgggcgtgggggagaacctcaccgtcgtagagaagggcgacattggaacgcttctctatg

SEQ ID NO: 6545 - DNA, 700 bp, Nannochloropsis_gaditana
gtttccgttgcacatttgaatttgaagattgcccggctaaaccgtcaggagctagtagtcttggtttcggaggccctacacatttctcatcgatgcatttctggtttcatggaatttttgataaataaataattagcatttttctccatctccgagcttgccctatcctgcatggtgtgtttttctgtttgagtctgacgtgctccaaaactattgcattcccgcgtaagaacaaaataacgtttcacccttgttcttgagcttaattcacctcctacttgcgacagaggccactctgagcttttcacttgagcatgagcaaatctattaataagaaaatgtatcgtgatcgcattttctcctacacctttcctcaaaccttaccagctcaaagctcgtcaaacaggaagccgcgagagaggccacatctccaatactctcattaaggctctcaggaggcattggaaaaccgcattataattcgagtgctgaatttagtatggtgactaccaatgtgtcagcttcttgtgggcaatccaaaaggagtcttcaactcaaggtctttcgtcttctgctcgtcttcgcctttgcctcttcttactttttccaaatcgtcgatggacagccggatctagggacctgcgctgtggaaggcagtaatccactcacacctgatcctgtcacaaacgcttgcgcttgt

SEQ ID NO: 6546 - DNA, 700 bp, Nannochloropsis_gaditana
ccgctactactggcaggtaaaaaaaaaggtgcttcgcgccagaatgctttcggtgacacaaggcttgtaaaataagatagcacatgatagtaaatacaaacatatacgatttatgtacagtgcactcaattttacaaaaccaatatagtttgcgttcaatacaagacgcctaggatacctcccattgaatattttggcgcgaagcatttttcatcaagaatcgcccttcgcactcgttcggccctccgtcggccagcatgagatagcatcgcgatgctgtcacatacgattgatgcatcgcaaggctgtggcaaacaccgccacgattcgctttctggacattgagccttgtctggtgatgagattggccattgttgctcttgtcatggcgccatcgttgattggattcaaacctgagtagtatcctaacgttcatttttctgcggttcatagactgctgcagttgcagctcaagcccatgggttttcgtgtttgatagaattgcaatcgacatcaaatgaatgcgaatattatagtgttggtctagtagcgaatttactctcccaatactcatcaagcttttccatctgcaacacgaaacactctgcctcaacttaccttgcgggtagctgcaagacggacgacgtgcagcgtgaacccttgccattgaagcgagaaactggtgaagtcgaatatcatg

SEQ ID NO: 6547 - DNA, 700 bp, Nannochloropsis_gaditana
atataagtcaaagtaagcgagcaaaggtctgaaatacattcttatggattccctcagcgtagagggagattattgcagcagttagagacaaagaaaaaaaacaaaaaaccgttacaccggcgatacagagcgatgcgtcctgttggatgaaatggttggtgattcttgtgtcacacgtccctcgtttcgtaaatagtgtgcactctatcatatatcgaacgagttttcttggattttgtgaaagaatggagggggggggttcagatgccaactctaattcatttccctgccttcatcccctacaagtggttcatgacagagcgccaagactctatcgtggatccaactaaatcgacttgcttcacatgtcgcttgtgccggtcagctctctttagcgacaaagatttggagccccacgctaccggggcacagcgaatcaatcgtcgcaaagtgcgtataacctcctaccttcgcctcttttcactgtgccacgctttcctttcttataaggcgttttacttggtttatgaagcaggttggaagaagcgtggatgactctgcagcacacattcaggcgtgcacgtcctacttcttaaatgaagccgcgatggaatctttggagtgggtgcgcgcggccttacaggcgcatgacgaggcaattgcctctaattcggccgttcaaacaagcagcgaaagtatc

SEQ ID NO: 6548 - DNA, 700 bp, Nannochloropsis_gaditana
ggacttgaggctcaatgaatacgtctgtctcgacggtggactcaggaaaatgcaactttacatcggagcgtcgctgtccagcgtttccagcaggataaaatttccttctctaagaatttccttacttaatccaatcgtcggatcagatataagtcaaagtaagcgagcaaaggtctgaaatacattcttatggattccctcagcgtagagggagattattgcagcagttagagacaaagaaaaaaaacaaaaaaccgttacaccggcgatacagagcgatgcgtcctgttggatgaaatggttggtgattcttgtgtcacacgtccctcgtttcgtaaatagtgtgcactctatcatatatcgaacgagttttcttggattttgtgaaagaatggagggggggggttcagatgccaactctaattcatttccctgccttcatcccctacaagtggttcatgacagagcgccaagactctatcgtggatccaactaaatcgacttgcttcacatgtcgcttgtgccggtcagctctctttagcgacaaagatttggagccccacgctaccggggcacagcgaatcaatcgtcgcaaagtgcgtataacctcctaccttcgcctcttttcactgtgccacgctttcctttcttataaggcgttttacttggtttatgaagcaggttggaagaagcgtggatg

SEQ ID NO: 6549 - DNA, 700 bp, Nannochloropsis_gaditana
cgcgagtgaaaatccaagccgtcaatgccatggagctggcggcaggaacccgcgcctgccgctccatcctgatgctcctgactcccgcgtgacaaagcagtgtcctgcaagctgcaatagtccatgttgttgtagaacaaagcaccgctttcgcgattgttgctaccgctgttgctgtcggtgccgtggctgcgtgaaaagccctgcatacttgtaggacgtgtacacaagttgaggaaggcaaattacgggaagtgcggcattaaacgcacgacgcgaccagtgttccctttcacccgacaggatgactattcagacgggcaagtcaagagcacgtagcggtcaaaagcgaacacaaaggcgcaatgcgtgaggactgaagttacacaagggcgtgcttttcatcgagctgcaggcggcagcctcccttgcagcgatgcatttcggcggggtggggccataatcccttattgcctccccacatgttgtgaaatttccgacttattgcgaggcctaggcatcacaaacatggcatgttgacgtactggccttcgcggcagcctagaagatacaaagcctgcaagctgatagacgactgaccggaaagtgacgccagctaccaccacctcatcgcaacacacattgcattcacttcaggttcttgcaatatcgaaaaagggagcagggcggtagcggaatg

SEQ ID NO: 6550 - DNA, 700 bp, Nannochloropsis_gaditana
atactgaggatagactctttttaatacatttgtctttcctgccactttggatgttgcatttccccctcccacttatgcggagggtcttttggtttggctggagagcattgacttactcgttccgttcgacttactctcaccgtatatctctttttcccggattttcttccccatactttctgccctccggaccgcggtctgtctttcagaatgtcctcataacccatggcgcatccagcacggagccctcttcggtcgtctcgagctcttcatcgaacgcatcgccagtctcattgacataacacgcacactcatatcttttaataaactggctaaggtgagtagcgaaggggaatcgaggggaaaagctcaagctctcgaaatcgtaatagtattcccagccccattggcgtagcatgtacgcgcctttgcaggactcagaatcgtcacacaatagtcggagggccgctacaaatcaatgagatcgggtccttgtcttttctttgctttccgcgcttcccctcacgccccctccacccttcgcggcaactccctttgtccgcattcacaaccccccccccgtttacaggtggaggtaggagggataaagggccgggctgtgacggcaggggtcagacaggtccatgatgatttcctcgcggcagtccagcgggtccgggaagtgccctacgacctgatg

SEQ ID NO: 6551 - DNA, 700 bp, Nannochloropsis_gaditana
tgttggtaaagagagaggaagggaggaagcaaaaggaaaattttgaaaatgtcggggtcgtagcatgaagaagcaagtggaatgaggtgatgaacgaggcttgccgtgttcctccctcctctctaattaaacaaggaatatcgaaggagccgtccaaagaaagtgtgcttgtatagagcgcatgcacatcccaacccttctctcgtttttctcctgtacgtcggctccagcaaatacctccgccccctggaagcctggatcacacggcttcaggacgaaaagaacggcaccgaggcccgctttcccacccttcccaccctctttaaaccaatattacatattgtactcttggtaagtgagggaatggatcaagaccttgaacaagattgggtggtgagaggaatggagggagacaataaacaaagtggaagaatgaagaaaaacgtgcaattaagcgagtcattgcgaagataacgagcaaaacttagaaaaaatagatccaacagtagaaaaaaggcaacgaaaaaggcctcacaaaaattgggcggagcagttgaaagataacactgactcggggtcgggacgacagggttttagtagtggtatcaacgtttcgcgctttcctcccgtccttcatgcttggcagatatggaagaacagcaaacattacaacacacccgcccggttggtcgtactgatg

SEQ ID NO: 6552 - DNA, 700 bp, Nannochloropsis_gaditana
cggaaacgcacagcggtagcatgcatggctgaagcggtaaaatgcaatcatcgcttatgctgccttctacaatctcattttcgggggtaggctatcgagaaagtactctgaagactctcatggaagtctaaacaagcaagtccaaaggaagtcaccttgctgtgcgtggtcgattgcgcatctacgaacgcgccgtgcgtgggttgtgcatttaatttcatcgttttggtcatgtagtgtctgtctgtgcctgatggtggagtttgatgactttcctcacgtcaatctgtaccacattctaggtaatggaacgtacttgtgttcgatggaaagctcggatcgggtgaaggcctttcgtcagtggaggggatatcaacaggacatcgcatatcatgggactcgtgtggcaaaattatgaccggacaaaaccttatctaccgtacctttacatttataatcttgcagaaagttaatgctgacgaagtgatcaatactggtggtccttaatctcgcccgcccccgcttctagcctccccaccccctgatttttaatcctaagcaaatggcggccacacgcatcgaagcttacagagtggaggcggatcaactctatgaatcgtaccgatcactgaccctggctgaggttaagaccgtggtggaacatttgagagaaaaaatgcgcatacatattgtcaagatg

SEQ ID NO: 6553 - DNA, 700 bp, Nannochloropsis_gaditana
gaaataggtacgctcgaaaccattttggaaatgtttgtgctgatcatattgcgaacaggtgcagctcacagatggtatccttaaggggtacttcgttaattccttatcttctaccgaaatcttgtcgtgatgaggcgccaaaattatcccaaggtgatcaggcaactagattttctctacattaatattgcgttggtcctgctattttctgtcaaatatgaagtcatggctcctcggcccataggacaggagggtaagatttcgatacctttcagtggaatgtgcaagcctcgcgacgtggtcatacctggcgcagcttatggggaaaatattttaataacttgcattctggaaaaaaaaaggaaatccgaattaaagacaagctcacgggttcacaaagatttcaccatccaccagccattgcacgggcgaaagagcttcaacagcgagttttgcgacgatatatgcagacgaaaagtttctatccctgggtgagttttgtgttccaggacgtcatggaaagtcgttatgatacgcgcatttgtgacgaaatcaacagtcatgtttttctcttcacgcggagtgagtataggctgtcctggggtaaagcagaggattttatggctgactggattgcgtggcttcagccctttgttttcactcatcggcacccccccataaattttcttccagaatcatg

SEQ ID NO: 6554 - DNA, 700 bp, Nannochloropsis_gaditana
catgtcggcataaaaaggtccaaaaaatgacgcacaaaacagtccacttgttttctcctgtcttcgtatgacatgtatgtgcagattgactttaccactctccgagtgctctgctctcgaaattggaagatgattggacgtatgcacaatacagcccacttttttcctcttgttttcgtatgacagatatttacatgtcgactttgtcgctctccgagtgctgttgtcacttttgacgtcaagctattgccgaaaaagaagttgcgaacccgaggcaagttcaaatgcctcccccggggtcctcgggtttatccttttgagtgcgtgaaccgggtttatcatgaatttcccgatttaacggccacccaaattccgccgtccctccagacactttttctttatctatgattggatgtgccatggtcaccttttcgacttagaagaatgcgaatagagcccaaacgcattttgtggcattcaagaacatagtatgcatcagagaaagcttgtacagttttctaagtgttgggtggacaaatctactcgcggaccctttccgagcgccgtcgggtcgggtccctccgtgcttccttccctttcctgtgctttcgttgacgaaacgagattatgtagcgtcttttattgtataaaaaagtctacaaactattttaagtttgtacgtacctattgaccgccccaa

SEQ ID NO: 6555 - DNA, 700 bp, Nannochloropsis_gaditana
cttgaaactcgcattgagggagcaccgtttgcagcagcattggaatacatagctctctaatttaatcgtgccaatattattgaagagaggtttatattgcgatgtcgatgattgacacttctttgcgccccaaatgcctcggcctggttggcgtacgtaagtttgaattttcgaaaatttgaatttgagccaaggcgtgcgtccagggacttctgcggacgtttacctcctcgtgcgtccacattagagtcgagaagctcagccgctgcgaacacttctcgaattcctatgcccacgcatattgtcaacaatggatcgatgacttaatcttataaatgggttgcgcggcctagcaaatgcaaatgcgtccgtcagggtttggccttgattttacgcaaaaccaggaggaaaagctcatagggctattccctcggtttattcaccgaagtgcgctctctttctcacacttaaaacagtaatactacctcagcaaggcaaaatgctccgaatggggagttttagcggtggtcggcggagcagtcggcgcaaatcagcgtcttcgcgtccgacatccgtagattggtgcgcccctttggccagccttgaagcttgtctgaccgagaaaactgatttaatcgatgagatgaaaaaagtactgcccattactgtccaagctcctggcattgtggcaattggaatg

SEQ ID NO: 6556 - DNA, 700 bp, Nannochloropsis_gaditana
agggccctccccacactgcatgggcagcccttggccactgactgcttgtagattttttcgcaggcaagaatgaaggggagatccaagtgcacgtccctgaggggggagactgtgttcagggatagtgatgacatgtccagcagatctgtgtcctcgcttgcttgctccagggctcgctgcctagggctaagcagcccatttcgagcggtacgagtaacttggagagtagacacaaagcttggtcgatgtggaccgatttccgctcgagatattgaggatgtttcaaccaaaggctccgatgcatcacccatggggctctgatgaaggagaatgggtagaattttaatttcatcagagaattgaaaggaaacgcaggcggcaccaaggggatgcgaagcgtcgcgccgaccccctgtcaattggaccgccaacggggttcgacgagcccaaacatggacatcaaaaaataatcatgcactcattccagtgcacatattgggaatgtggatgcaggcctatgcatgcattgccggatgggcggtgcgctggcgtagtggggaggttgaagggagagggatgtgggcgggtgggagaggtcgagggaggcgcggcgagaacccgcggtacgcatctttctcaaaacgcaacgccaccacacacctgcagggtcaaagaccgctcacgcataaggaagaccatg

SEQ ID NO: 6557 - DNA, 700 bp, Nannochloropsis_gaditana
gcaagaagcgcctttgttcgctgtggaggggggaagggagggggagggttggggcttggggaggacggtgaaagcggggtactacaggggccaggggcacgcctccgtgggggaagcgagggaggggggggggttcagatttgcaagcgtttcgagcctgtccgctactaccatctggaggtggggagggcggatgggaaggggggggtcgggggccccgagggggcgcaggggcggggaacgctaccgcagcagcaagtgctgctgcttgtggacccggaggcggggggggcgagcctgtgcccgatctcggcggtcttgaaggtgaagaagatggaccgggcggtctcggaaaagccggcgcggggcgtgagtctggtgcaccggcccttgagtgaggaggaggaggaggcgaggagggggaagctccggagggtggggtgggagggggaggagggtgcgggcaggggttagaaggagaagagcctgcgggggctcggaaatgcgcggccaggggccagctgaggggaggaaaggagagggagcgaaggtcgggagttgggacggggaaggaaagaaagaagagaggggccaagaggcacggagcacgtggtggtgactgggactgctttcttttccctgcttcggagagtacgaatgggtatttattccgtttatacaaatatatgaaatatatata

SEQ ID NO: 6558 - DNA, 700 bp, Nannochloropsis_gaditana
ctgcatggaaaggttgtgctggccacctacacgagctttaccgcgtcccattgctcgcaggcgtggcaagtttgaagcgtgcaagtcgaacgtaatgtcaagatgcgaagcagattcgtattcttctccgcgccactttaagcggggccgcgacgcagaaggagcgattgaatggttgggtttggtgtttgacaaaggcgcaacgtagactgatggcaaggaggggcgtgcgggagaaaggtatggctgctgctgatcccttgctaccgaatgtttgacactgaattcttgttccgttttcatgcctgtgtcacgagtaaaaacatttcaagtgtgcattttgaggacgatggccatgtcaaaatgccatggggtggcaaaatagccaagatacgactttgttatcatcttcccagccacaagtgtaatcattttatttttttcgcacacttgaggtattttcctcgtcaagacattccttttcgagggatgttgtccattagtggcctaaaaaatacgaaaagcaagccatgaaaattaacccccccagccgttaccgggctcgggcattaccgagcactggattgcgggctctgggagtcaggaggacattgtggcagcgtcagtggcatgcatgctttttctgggcttacttttcactacttccttcgtcgaaacatttgctaggtatacgaccatg

SEQ ID NO: 6559 - DNA, 700 bp, Nannochloropsis_gaditana
tgaggggtgcgaggatctcgcctcgaagacctgcatacgagcgaacggcctcattgaacgatgcaatggcctcagccgggactggggtagagactgggccccaaccatcggcggtctgcaagaaattggagtgcggaagactggtgggagagcacgaaggaagagaagaggaggaggaggaggaggaggtggaggaagaggaggaggaggaggaggaggaggaggttgtagcgagaaagaaaagcgccatcgcacaagaaaacaaggcaaaccgtaaggcattcaacttggaaaagaggaaaagtcgtggtggtcgcgccatttcaccctgtggttcatgattttgcgcttgtgagggggtccatgcaaggcgctggaccatgtcgcgtgaggtcatcttgaagaggaacaagtgccccttctcgctcattgcggtctgggcgaccacactggggactccaaggccatgtccagggacaaaaccgaggtctattggtcactctaagtccgttcaattccctctaactcactcatttgaaacagacatgacccaaccatggtattcacggcgtacacggaaggctatttcgtcgcgagtgataatctgcctggtgctcgccactttgcccctgacaataaatacttttactctgccatgccacacaattcatccaccccgtgtcaatcaaccaaagccatg

SEQ ID NO: 6560 - DNA, 700 bp, Nannochloropsis_gaditana
cctctttccgcttttgaagaaacggcacagagttaaatacgtcgtccacagcgttcgttgccggtgccgcggtgcttttatctgcttcttcgtgctctccttcaggcaattcatgctccagctcctcttccaacttgtctttaccggcgtcgtcatctgcggcggcggccgactgaagaagtggcacatgaaaccgtgcttgggactgaaagggcaaaatccatgccctaacggaaagcgattggctacttctacctttggaaatgtgtgttgccggcacgaaggcatgcaccaatgtgccggtggtcaggaataaacccagcaacacggcagtcgcagccggctttctaccattcaagctaccaacacgtgctcggagctgtatcatcttaaaagtagcttcgtcagcaagccagaagaatgaacaacctgcatagaaatgacaatgatacgactttgagatttctcgtgctgggcatcagggtgtggtgggggtgacccccagctcttcgtctagaaggatgttgctgttgctgttactgagtggcgagggtacgtgttccatcacaagatacgccatcgccgcgagccccgccccctttgcggtcgacctcagctcttcattcccctctaaacaccacgaatttcacaaccagaggaccccaactcttctcacgatgagtagaggacagggtggccg

SEQ ID NO: 6561 - DNA, 700 bp, Nannochloropsis_gaditana
ttccccaaaagctgtgtatatattactcataggttgagaggacgtatagtgaggccatgtccagctctaatgcacacgtgtcgccttagtatggggaacgaaaaagtcttccgtagggcagctttgaatccttcttcggagtcgatgatgcctaccatctgtgtcaacatgcacccttactttttgcatttttccatgtcctctcacttagacaacaacaaaggcatactcccacccaatttcagtgttcggatccagccgtgaactgtttgcgcgcaggtgagatcctgactggagccctggggggtgagccggaacgctctttcgggtgaaattgtctgcggggactagagagaccccgcgtcaatgtttagttttctccgagtcacagaaataagggagaggccgactcattggggcagagtctttttcgagggagagagactggatgcttcaagcttttcgccctctcccctcatgcattacccaagctcatctccgcagaacgagctgagttagtttagtaatcttcacctctttggccagctcatccgctctcttatttttctcttcccctttattcaaaatgagaaggaatctttgagcattacatgtgggattgagggcagcttgcaattaaccacatccgaaaaagacaattatctgtgcgctcggccctgtcgctgcacaagagaccatg

SEQ ID NO: 6562 - DNA, 700 bp, Nannochloropsis_gaditana
actcgtctcgctcaaatgacttcaggtcacgccctggaaatgggccatagacgctgcctccctcgggtgtgcgaggcaggttggaagacaggtggacagacgcatgtgcaagagaggcatcgtgcgctaagtcatgtgaaaccagagggaggggaaggcggtatagaagtggaggtgggagacgtgcgttgcctgcctctcctaggatacggtaccgcgaagaggaaaactaccgaatatttacatagtcctgcgatgtgcccgcagctcattgcatccccctttcagagtacgtcttgaaaaaagtgaggtcgaggaccttcgctgtgatgtctccactggcttgcgaggctccagtgaacggcatgactcccgagtgtggatatataaataaggcgtcttggcgttcgggccgtatataaagctggggactcttcctatcgcacactcacagggtggtttctggctgatttggcttgagttttaaatgattttgatcttttctaagaccagcattaaaagtctgagtccagctctccaggatgttcttctctgtttcgtcatgcgctcgtggccacagcctcttgtttgttggcatgtcagcaaggaataacaacaaacctcacttattcatttatcttccaaatcaattgagcaggtgaacttacaagggtcttgcttggcaatccaaagtcagatg

SEQ ID NO: 6563 - DNA, 700 bp, Nannochloropsis_gaditana
acgtgtggaacagatcgcacacgatacaaattaccccaatgacgctcgataatacagaggcattgagtttcgcatgcaattatcacgtatcgacacaggggcttggttgcgaactggaggacagggcccgccttagcccggagtcctaattttttggcgattgctctactcggcaagaccataacgaattgcttattaatgtgagaattcatgaatgaaaatgaacatagttcttcgttattgtggaaacaaaacggaagctgaatcacttcacgaagccttcgggccatgttttttttggggagcacaaatgagattctcagagaggaatgagatggaaccaaggaggacgagacccccgtatgacatcgaaattgggttcaaaccgcggcccgcacgtcttttaaaacaataaatgaatcgacaaagtcgaggattggcatgaagtatgcattacgagcatcgtgaagctctttatcgtgccatttgcacagatattgtaccaacaataccagatttaagcaagtgattgccgtcattcacaaccctataaaaagtgtacagccccttgtcgtactttaaaacctcagcgtacgttaacatggcccaatttgatttgttatcttaccttttatgtcagtgtcattgtatttgggccaggaaagagcgcggcctcggccggtgagctcaaaacactatg

SEQ ID NO: 6564 - DNA, 700 bp, Nannochloropsis_gaditana
taaacttcactttcgcaacgatactgaggaagtgacagtgctttatggatgttgatttgtttgcatttcctatcttacggatgcatgcctttcaattgcaaaaagcgctgaaagtgcgcaatgatttcattgtacgttccgtgtatgacccccccgcctcctgtcgtcctcacgcgctctcaatgcagaaaggggaaccaaaaaccaagtacaaactacctctgctacatcccactggagggcacatggtacaaaaactcttgagtgcaacgcacactctcatttaacccggcattgcctcgttttgcctctcggtagttgccattggtccgtactctcccgcctcctcatccccgcccccctccccagcccccggcctccgcgacgcttccacgggctcaacctcctctcgcgcctcgcctcctgagcggtgaggggcccaggtggccaaatgcagcaactatgcgtgacagccaagtgagcatttatttctgtccattgttaagggtgctttcaatttcattgcactaatttgccgtacaagacaagtcaggactccatacaggtggtgaaaggtttgtaactaggatcgtggtcaaaaggtacctcgcttggagctataacttccacgctcttttctgaaatgtaatacacgctactctttgtcacaaagtcagtctgtcaagactttccgctgatg

SEQ ID NO: 6565 - DNA, 700 bp, Nannochloropsis_gaditana
caaagcaacaaggccgtattccggcataatttgcatggcatgaaggcttgcgaaagccggtaatgatttgcctgcgtaatcgtctctactcatcataggcaaacaatcaactgtccgctcccaccaagcccccgattgaaatctgtcgttcccctacttccttaccctggccgccggtatgcgccgtacgacttgtgtgttgtcgacatgtcgagtcacaaagctgtaacggatgatatgatgggtgtgaaaggggcgttcaagagagaaaccagcgtggtcggccgcctccgctttgttcttgttcgctggcggccccctagagcgaggggagggccatcgcctgggagctccaggtgaacgtgccgccatttctctctccacacgcgtgaccacaaaaatgctcctcccacaacatcatctcagcttgcctataggattggttctttgcaaatcctcctccttggcccccaatatttttcctgcctccagtccactttttgctatgcgccaggtcgcaggcccatgccggctctgcgaatctcttacggcgtcgttatcctttttatcatggcgccttacacatattcatgcatgaattttgagcaggttcgagcatttctgcggtgatccgtactgtcgtgtttcctaaaactggtgcagcgatccatacttcctctttccattttcaaaagtcatg

SEQ ID NO: 6566 - DNA, 700 bp, Nannochloropsis_gaditana
ccttgaaattcccgtgtgaagcccttgatgctgtcgagagcacccggagttgcttcttgggcggctttcaaagcgtcctgcaactggaggggcaccttagccggcaaattcaattttggcaacgatttgacaatgttgcttcgagtatcggggtctgaaaaactgtccaaaagtgctttagcatcatctatgctgacggaaggcaacgagtcttgcagagcattcaggtccaccgaggtcccatctcctgccacgacaataaagggcaactgttgtcccagctcgtgcaatagagatgctctcaacacctgactgcgactcgggaagtgcgaacttcgcggtagcgatgtctggagaaataagataggctgggagcgaaaaatgaagccagtcgcaggtcctgccatcacagccatgacgaaaatgctgagaagaatttgccaatccttcatgataagcaccataaatgttaaaaaaggatgtccctgtgatttttgagactttcattcataattggcggggcgactggacgtttgttactagcagttcgtaatgaaatggatcccgcgtgcttcaacctcccccggccctcaagactcgagcccggccccagccaacctcctcccccggccccagcgatctcgctcccaccgctcccactcgcagccctctgttgtacaaatacttgttgcaactatga

SEQ ID NO: 6567 - DNA, 700 bp, Nannochloropsis_gaditana
actgcagcccggggcttgggcaggggcatttcagggctggggaatcgctaataaggaggtgccgctccgtttgcccgtacaaacacttgaagacgggctttttactaatgttgaggtcaagttatgtgattcgactgcaaatccccatatagctctagcagcaattctaagtgccggcctggtcggagtagatttggctgcaacgttatccgaggcagatttcgcggagtccttcgcagctctccccgcaccgctggatgtagacccgggacagctgacatatgccgagcggactcgccgtaagataaaagagttgcctcgggaatggtcaacggctaaagcatgtctaatgagtccagagggaaaaggactccgagagttattgggagaggacatggtcagagcttgcgtagcgattcgcgaaagcgagtgggcagctttggggggtatacggcttgaggaagaaatcgatctactctttgaccgatactagttgccttatgttcaaatcgattatgatgtaaaaggaccatgagtgggacaatcagatcgcaagaaagaaattatcacggcctcagcgcgcgtaacctcctgccaggataagcactctgatactccaacggtgacatgagtcgcatccgctcagcatcttttaagccgttctcaacgaatattatgtttccgggatatttgttgtagg

SEQ ID NO: 6568 - DNA, 700 bp, Nannochloropsis_gaditana
ggatgtgctacaggcgaagagcatgttgatgcgaacatcgataacatttttccacgtagcagtccttaggtttccgatttctctaatctggccccttggccgcaatggagaatcgcctccttgctacctgcctctttccctgacggggccgtgttgccgcgttcagtttgtttcgtcgcaaacacacaatcgataagagagaaacttccaaaagcttggcccagccgtgatttacttaatcgcttgagtcacctgtggagagatgatgcgggatgtagcgttcgaaatgctgcataagctccccttttccaacacacgaagtatggcagctcacggtcggggcgtcagctgtcgccccattttccattcttcgacttgctcgtcgaagtcccaagcacttcgaccggagcccgctgtgcgcactgcaattcggaaatcaggcatagagctccccatcttctgtatttacgcttacagcacgtcatgtgacatcctttccggtgcatcttcatcgcaaaatgtaccgctattctgcaggagcaggtcacaaggatatgccgcaagagacaaagcatataaattttctttggtgctctcttgcagggctgcggtgcctccgcgtcgtacccgtacatacaatgtacgacaaaaaaagggtcgaccaatatgctgacatagatgagaacggctatttaaaatg

SEQ ID NO: 6569 - DNA, 700 bp, Nannochloropsis_gaditana
atgttggtccggtgacaaaaatctctgttcacccgcctccaatgccgtcgtcaaggggcagggacgtgcctggcccccctagcgagagcgggctggcgctcaagaaagtaccgccaccaccaccacccgcgccgccaatgtcggccatggcggcttcaacaaatccttcaagtgcaaagctgtctcaggcggtgcgaatccaatcagagggggggggtgagccggaggagggggatggtgagctggaggagggcgagttggaggatggcgaggtcgaggaggggcatagcgccccgctcggcctcgaagcagaccattctgttcctgcacgcaggagagcccctcctcccccaccaccccctcctgccccgcccagcgccgcaccctcctccctaagtcgccctccccggccagcgcggcctccccctccccctcccctccccccccgcgaccctgcgctgggaaatttgatagccgcggatttaaaggcagcagcacaaaagcatccgcagcgggcggtagcttgctgctgcctccggacaaggtggcccctctgccccccttgctggggcccccgccgcagtatggtcggagcgtagccgcgttccgaaggcgggagatgatcggaaagggaacttacggggaagtgtcgcgggcggtggacaaagatactggagagaccgtcgctctgaagaaaatg

SEQ ID NO: 6570 - DNA, 700 bp, Nannochloropsis_gaditana
ttcgggcacccgcgacgagcatgaatctccgcatgtgcccgctttgtgcgtcggtaccggcgaggcagggcgagcacgccatccaagtgacggccccgcaatttccaggcgcgcgtcccgcaaaattataaactcacgctttcgccactaggaaaacttcatgcccaggagtgtttccaggacattttggggtggtctttgcatagctggcactctccggcacatattttttcaggcgagggtttggcaaagaatctgcgttgtacctcaatttcactcatgttcttgaggtcgagggtgtggctcgaaggaattatgcatatgtcaccgcacccaaacctgatcctgacgcgcaaattacacaggaccgtaaaggatcaagcgaaaatgcaagcagtgtagcaaaagagggggaccgtggaaaacattttcggaaggcgtgttcaattttccctggggcggcacgaaccgacctgcacgggtgaagcagctctttggtgtgggtgctaatctcatgtacgtacgggacagcaaacttggattctgccttagcataaagatgcgtgagacaacagcatcgatagatttttaacatgcgacatgtgtacgatcggattgagccttcataatgacatgcagatgtgcttgtgcgttatgcaatttgcctctgatacaagaaacctatctcatgtcacagatg

SEQ ID NO: 6571 - DNA, 700 bp, Nannochloropsis_gaditana
tccgcaaacattcaacgtgtgtgatctatgtatttcgagctgagatgcacaagagctcgggaacgatatgcgtttgcttgttgctctgtccatccacacgaaccccctcgcctcgccatcgctcgaccacccactgccgctcgcgcccgtactctctcctattacggcgcccgcccctcgaaataccgccgctgacctgccaaattgctttccacctttgcacacgtccaaaaaatccacggcagttttcatcacatcacagcttttctgggcgacggcatcacaagtgttatattcgcgtacttgtcctcactcccaccacaagcaatcccccggccttcacatcctgagggataaacgacgagtagtacgtgtccacgcccggcttctcatctcatgtttacccggcaccgaaacccctgtcaagcacgtatacttactcctagccaatgtgtgtgacttttcgctttacttctttgaatgtttcgatgtagtgtattggtttgatttgtgtgtggcttatcggccccgcttcagcgtgcatccctcgtgtgattctcgccaaaaccaagttacgtatgcttatcaagatctttggctgaagaaaagctttttttcgggaggattcagttaatgggtctaacgcggtttccttcacaattgtttcacagcatcatctcatcaggatcttcaaagcatg

SEQ ID NO: 6572 - DNA, 700 bp, Nannochloropsis_gaditana
ttgtgcggtaaggatatatcgagttcattagaggcgtgcgtgtggagttgcgtgatggggcgcacgtgcgcgcattgcgaccgagtcatcgtggttcttctcttcttccaaatatgacagctgtgagcatagatagaattgggtggcacagcctacgaatgcagcacatagataccgcgtacaactctttagacaaagcaaggcaatctctccatgggcgccgacacgaaaagggaagggaacaagcccttcgagccccgcaagacagaaattgcagcaggctcgaggctgacgcactacggaggaggaggagcctgctcctttcccgacccggcgcgcccgcgtcatgcaccgaggtacacacagtccatgacatgaaaagcttcaagctgtggtaatccgacgcaggtgcacaatcacgacgggcggacaacattggcggaggctgggctcagtgagttggcggggacgggctcggatacgcaccggcgtctccctcgcagaatgtgataaaagcgagcagaaaagtagcgcatttaaaatgccaagcaccgccgcccctcgccaagcccccgggccttggcatgtttctcggcgagccagtaagctgggtcacctggacacgaaatacttacgtaactcacgccagacaacccgctggtacacaagatcttgctagctccttgtcgtccccgccatg

SEQ ID NO: 6573 - DNA, 700 bp, Nannochloropsis_gaditana
ctcgcttcaccgatctcgagattttgggagttccgagtccgaacaatgcatttcaagtgtattcacggtaaaatttaaaattatgcgtacacgtgtgcatgctgtgtgcagtgggtagacatgtccgggccacacctaaacagacagtggtggcgcgacaaggatgggcgaggatgatggcgacaggatgggggattctagtcaaccattcgaagtcgtctacacggcacaaatctcagtgaaagcagtcatattttgcgttctaaggccgacagttctagaagcccgatcattcgggcaaagaaaaagacgatgcaaagaaaagcgtgacgatgaaaaccaaggatacgtgggggatggcagccaccgcggcggtcaccgcctagaggggcgtgcagcatgcctcccgatacaggaagcagtgcacaccgacttgaggaggcgcgggaggcataaaagtacactctcaagtttgattaaccgacttacaagcgttgtagcacctctttgaaccaatttgatatgaagatgcatggtagtcattcgaatggtgtggagtcgtgggaatttatgctgatggtatgtgatctcgagaaattattgaattgaatacttcggcaaggttccagacaaggaaatatctcgtgtataggctcaaaacattgttcttatctacgcgtcttcacgtgtcatctgtacc

SEQ ID NO: 6574 - DNA, 700 bp, Nannochloropsis_gaditana
gggaggtcgaaggcggcgcttttggataaagcggcctcacgttgacagccatcaagcttcattctttgtgctttttcgtatgaataatatgattgatatggatgatatggataagatatggatgatatggataatatagacataatagtacagattttgttgtttttgctctcaaatgctccccctctgtggtgctatcgcgcccaggccgtgagggatccgttaatattgataggcaagtcgtccagtgttgaagcaaatattctataaggagtgaataagttcgacagaatgacgctgttaaaaggtctcaatgcttcctcttttatgatacgtttgttctcacttcgtctgacgcagtccctgcacgtgagtgcaagttgcatgtaatgatcacactccatgacccacgcaaatgtcatcgacttcctgccatagttattcacggatcatactgtgcttttttttttagatttattggtagtaaacaatgccatacgaggcgaccactgatttaaatgaaaacagtgcaatcgttcgcatgaaggcctgcctatcgaagttcgagaccgaggaaggaagactgaaaggttttgcattcaagccttccccaaccgatatacttgttgttacgtcgcctaaagccggcacaacttggatgcagcagatttgtcatcaattgcggacatgtggtgacatg

SEQ ID NO: 6575 - DNA, 700 bp, Nannochloropsis_gaditana
gcctgggccctcgtcaaaaatgactctcatgcagacatgaactaagcaaggttcaaattggtacacttatattatattgattgacggcgtggcaagtgttttggataatttactcgtttcgttactgttcccacccctcttgcaaacaacggctcggatcggttggcgactgcccgagccccaggaccacccgtgtccgccccctgcggtcaccattgatccccgccttgcgggggcttcacgccccagcagtgcttgcttttcctcctccacatacccgtgagccctttgatgggttgcttaattgaggtgaggctgtgagcctaccgaagaaagagtacatgccctgattgccaaaagaggaggcccttgctcatctcaaggaatgtcaagggaatccgcctcccatacgcaccttcagaaaggcgatggcgtctcttgccaatgtcgtacgggaatatcaaatctacaagttctcctgatagtttgtttcaataaggaaagctgtttataaatggtgtggcttcaaatgtagtggggtccttttgcgtacatacaattgcctgaagcttcaccctatcagcaccactttcttctgcccaccttacgctcgtattttgtatgaagattacagggagtgcaccggctttccccttcaattgtctcctcctaccattggtgagcagttttaggaaagatg

SEQ ID NO: 6576 - DNA, 700 bp, Nannochloropsis_gaditana
gtgtcgatacccactacaaaaaaataatcgttcaccctcactgcctctcccaaaacagacatatcatctgcggcaagtctgttcgtgtatgaaatatatgagtgattaaggaccagagcatttgtgcgcggcagaaatcagtaaaagtgaagtcccacctatttgtgatggtgcatcactagggaaaggtggtcaaaggtggtctgttgcatccgcgacggtgcggtacaggacaagagtcagtgacattgaccgacccgaaatgtacgtgaaaggttggcacgcttatagacgatggaccagtttccactgggacccaaaaagaccgcaaagcagcctcaatattgctcccgcttggcgagcgtcttccggtccctgccctgccacctcgataacgcagcaggcagcattacctcttgacgaggagcttgtctgccctcggtgcaaatcacgtttcattgtccttcgagtcctggagttcggggtagaggggggtcgtagcttccaagacctcgtgaaagacaggcttcgacggcgggcggcgggcgtaagatccacctggacgaggtctcgaaagacgaagagcgacacggtgatgcccgggctggcggattctcgtggggaatcccacaatgattgtaatctcttcgcatggtcacattttctaaattttttgcacttttcaacagacgcggttatg

SEQ ID NO: 6577 - DNA, 700 bp, Nannochloropsis_gaditana
agagtagtgcatcaagcctcacataagcggacagaagcgtgcgacggtgttcgagtttcagcaaaagaaaagaagtcagacctctcacaggaggacctccaccgggaacataaaatttgaggtccttctttgcaaagtggtgccttccaattttcttgatttctttttaaccggacacatccatgaccgtcctttgtgacaataccttggcatatttgtcttggtccacttttatcgcctgtcagtctttcttccgccatagcctctgttgttgtcctcttgcagcagctgctcgttgaactcgcgcttaccgaatcctcgacgtgcaataagcagttccgcgctttcgcgacgcattgacattaatggacgccaatcctcgcattttaaaactttcaaatgcatcgcttttcactgatgtacccgaatgagtgactatttccggggagtgcccgggaggcgtgatggtgtgggcttggcatggcgcgagtcggttggccggtgggttgctgctgcatgcacttgcctgctccccgccccagcgtgcacttgcctgctccccgccccagcgtcaacattttgtgcccacagcctcacatcgccagtcctccagtctctctcatcgaactctccatgccacacgctcttatgttgattttttacacaggacgcggtgaggactttctggcccacaatcatg

SEQ ID NO: 6578 - DNA, 700 bp, Nannochloropsis_gaditana
aaagggcagaaggtgcgatgacgggcagggagtgtaaaagttatgatcggtacgcatcgatagctccggacaacatccgcttgagaccgggaggagattaaggacggggcacggtggggtttgggagggctgggaagaaagagcgaggcggcgacatgctaaatccggccaccagggagaacgcgcacgcacgcgagactcggacgacctcctggccgccccaaagtcaagtccagcgcaggtcccctgtgccttagagcaacttcgggttttcatggacgtttgtgaagcgggtgtttgtgaagagctcgcgaacttgcaagcacgaccagacgagagtgaagtgcgccgtttcttcctactgccgcctcgctctcaaattgttgccccctgcgcatctccttccttgtttgctgtctgttacaagtactgtgcctacatactctgacatgccactgtccggaaggactgcaatgtgaagtccggcaattattggccgcgttttcactctcatcgggtgttggtatagcgtttcgaaggcgagaaaaatgatgggaccacctggtcaccgaacgcgtctcatggagggtttttgatgtcaccttcacaaccaatttattacgcagtaagggagccagcctgattcaaagggcttgggcggtcctcacgctcaaacttctgcacggtgatagtcattatg

SEQ ID NO: 6579 - DNA, 700 bp, Nannochloropsis_gaditana
atgaacactaaaacacatgagcatacccgtagcttgggtgatgcttttttggtttcgccgaggtacggtagcagttgtcatgatctcagccacagggcattttactttgttgtacatgatacatatggacgtcatttaatacacaagatactatcgttggctttccacggttcaattcaaggaagaggaaagggagaaaagaaaatgacaagaaaaggagcagtgaatgtacatcatgtaatattctacagtgggtcaacgctgcactcatatgttaagtagcaacttttaaaaaccacttgaaagaatagacagttcatcaatttcgcgatgtaatgtgacagcacaatccttttccttttcgtcgccatttccgttttttcgcaaaaaccattaagctacccggaaaaccggttgacgatgtggatcgaggctcctgctactcgctcccacacacgcccaccgcacgtcattaaagcgcaattaaaataacggcaacagcttgcctgctttgcttaaaggttctcacctatattatttcaccatctctgcacgcttagattcataacccggaatcgcaggacttgacggacgcagtctcacggagacaagtgtctctcctcgtgccaggatcaccgaccctcatctccctcgttgccatatcctgccctcaaatttacaaagcttcgttatgacaatg

SEQ ID NO: 6580 - DNA, 700 bp, Nannochloropsis_gaditana
gaaagtctccggaatgcaagacaatctcgcagacgcatgatttcgcttctcgccgagtttccctcatcacaggcttctacggatgaatcactgcccggtgattcaaggcacaatttcaacgtgtggccggaaatcttaggtcattttatctcacaggcttgtctcgccttcacccaacgctcacacttcgagccagcggaagggtaaccaaaagaaagcaaccttgaaggggccgcaagcctccttactgctagtcagcactcaagcgaggcaatccgacatgagaataattatgaacctttattccctaacatgtgtgcatcactttgtctcttctttttgcatggtttaggatggctcacggtagccgttgcctgacttctgccttccgtcattttcgctctccttatgagatgacggtgggagctcggtggtcgcccggcggctgccatagaaagctgtccacagaggcagaatcaacctcgctgacgtcgaacaaaggtgcgctggggatggatttgttgaggtctgcggttagatgcctatcttcatgctctcgtttaaagataagtttcagtaataccacttgtttccttgtagatcttttactacttgtagccgggtgaagaaaggatattgaagcagaggctggcagggtgtttatttgaaaagctacttctcagataccgaaaagtacatg

SEQ ID NO: 6581 - DNA, 700 bp, Nannochloropsis_gaditana
taccccccaaattgaccgaaatttaaaccgcacagagtagattgactcccggtgcaaggatactgggcagaaagaattaagaaggtgaatcagacataaaaatatcactgttcgcaccaaaatatgtctgttcatttctggctccagccgaaattcttcgcagcgtccgtcgtcttgtcccccgatcccctccgctcagcgacactcccttcccccgtccaagtgccctggaacgcctcagtatcgcacctgctgaagatcgtggatggtattagataccaatcataacatcgtatcgtatgaaaacggccacgctagtttaaaaggaagtgcatgctgcgaatgaaagtctccggaatgcaagacaatctcgcagacgcatgatttcgcttctcgccgagtttccctcatcacaggcttctacggatgaatcactgcccggtgattcaaggcacaatttcaacgtgtggccggaaatcttaggtcattttatctcacaggcttgtctcgccttcacccaacgctcacacttcgagccagcggaagggtaaccaaaagaaagcaaccttgaaggggccgcaagcctccttactgctagtcagcactcaagcgaggcaatccgacatgagaataattatgaacctttattccctaacatgtgtgcatcactttgtctcttctttttgcatggtttaggatg

SEQ ID NO: 6582 - DNA, 700 bp, Nannochloropsis_gaditana
acgtctactgtaccgcaaagcttgcagggctcttcatgcctttcaccacttcttgtggaagcgtgcgggaatcatggacgagccgcgtgtgtacgaagattccgtactgggcttcatggagcctaaattgggaactttgacgtcttttatcggcgtcacgtatgttataaatgtggtgctctctttgctgatcgatattggctggcgagtgagagccgactctgcacgacttatggcgtcgcttttgtacattgcgtacggggcatattttgttaacgaggtcaaaaaggaatatttgacgacatgggtaccatctttgcaagaagatcggcgccgctcctacataatcgaccgttcttcatcggtagtactctggatattggcgatcttctcctgtattgagtgcatctcagcttttctcaagattcctctctcgtccacgctagcttttggagggatcgggggtcttgcatttgggttagcatctaaagacgtggtgagcaatttttttgggggagtcatgcttcttttcacggagccgttcacgccaggagatatggtctctttcacaacgcgcggcacgcactacgagggaaaggtagagcgcgtcggtttctaccaaacccggctgaggggtcgtgacacgcgacctacgtacgtccctaattcggttttcgtggatacaatggtcacgaatatg

SEQ ID NO: 6583 - DNA, 700 bp, Nannochloropsis_gaditana
gagacagttttctatctaggcgtatgcaggcacagttacgtttttatgggatgtaagatttcccgggaagccttagctggtcgccggtagggtgtgacgtacgcagcttcgccgaagccctgtcgaccaccgaagtctgtccttctcgaagacaagcgaagaaaaaaaagagaaaatcacttattgcttcatacgccaccaccgccaatttacacaaatattgttcggaaaatgaatgatgttatcttgtcgtaaatgatggatttctcttttttcactcttctaacatttagattcggaagcttggctcattctcgttcgtcatccaaaacttacacgcagaagaaggggtaggatcttttaagctccgtgtgttccttttttttctatggtgattacaaagtctctccgatggcacgttgtttgtggaaactgagtgcgaaataaacttgtgcgtggttacttgccgacagaatggcgtgtccttattcggcctggtgaccgtcccggtcgtagaacgttctgtctcccacccttccttccaaggcctgaagtcgttttgtgaccgtaattttcaatttgcgtgcaaggcctacaagtgagggctttatctatgcgcatttgacatggtgctgcttatcaacgcttatcctgtccggccccatttccacgcaacgtcattttttgacagactaacatg

SEQ ID NO: 6584 - DNA, 700 bp, Nannochloropsis_gaditana
tccgtagcaagtcgcgaagtcctcgcatcgtaacttaccgagcctttcaagtatcttcaccatgattcaaagcagtgcaagtcggtcgagggctgtaaggtgggagatactgctatgcgagtacgcatggggaagaaatgcatcagtttctcgtgagaaaagaaagcttgcgcgggcttggcatctggcgttcgcaaatggcggagttgacggatgggagggcgggttggacggtggaggaatgatagctagttgaagcgcctaggataaggcggcgccgtggggctcgtctccgactgagaattactccctgcaggacctcgattttgttgcctttacttgtgaatggcacacttcttgtccaaaattcgacattttaaagtccctgtgtcacatccaacgaaggtcctttctcacgttcagtccaacacatgtatatgctctagccatgcgccgcctatgcctgggacaaatagctacgcttgtacttcttcaggctacaaagactatcagcgcatgtggcagtggaatgaaagtggaacaagccttcatcggcggcgcaactcgatctcctttcaggccatctactttgcccggtacgaggagcaggcgaggtgcggggactactcgtatggaggtcttcgaggggaaccccttcggcaaggcagtttgggatttcgtttggaagctgccaatcatg

SEQ ID NO: 6585 - DNA, 700 bp, Nannochloropsis_gaditana
actcgctcagtaacccggttaaagccaagtatttgacacttctttcccctgcttcgagaaaagactcaaacttggtgaatgacgcagccgtctcttttcgtcgttgttgtaggttggtaatggtaagaaaggccacgactggggcttactctagctggcagtcctctgagttgcagcatcgctccagcctcagcgccgcacgttgccatttctacggcaatgcgtacccattccgttcgtctgacttccttaacctgagatgaagagatgctgtaaattattctgtcgagttatgggtcactttgcctctcgatgtggtgcacacctcttgttttagatacgcgtacattttttatgacacttacctcctttgttatgtttgttacacgctgattcaaccaaagtatatttctcgtaccatagcagagagcaggtgaagatggagggggtaaaggaacgaaaagaggaaaagtacattttgcggaacgagcatgcggctctcactgtatggcccgctggtatccctcttgatcaccccgatcactgtcatcatcaacatcatcatttgaatcaatatgaacctgcgcccgggccacgcttctcattcataagcaatgagaacacgagtttggggatttttgacaccagcaccattgagtttcgtggaaaacttcgtggaaaggcatggaaaacaacgatg

SEQ ID NO: 6586 - DNA, 700 bp, Nannochloropsis_gaditana
ggaagctgtctctggcattttgcgtgcatgtcctcgcgtatgttccagttctacggagctggaacgaggacctgccccacatcaacaaaacgtttataaacaaacgaccgtcggttcctcgggacaactgcgtggggggctccctgagtcgtgccggggcaggtgtctacacgcgttgtccccttcgtaagcgacaggagcaactcggcttcagcgacgggctcggacacatggcctgccgcaccgactgatcttgcaagatctgagatgcaggacacgtgattgaagccccatttaacgacttcctttcccgcattatttataggcgagatattccacggaaatggaggctgcaccgcatataagaggatctcgaggtcctttcaagtcggctatcatcgcctcatcattcctcttctttgcttgtggagcttccatttggcctccgcgaggcttcaggggctcgagcacacatcgtgcaaacacatgtggtttttttccaccattaagacttttgaaaacgtcgctttccgcgggtactatcgttccctcgtctgcagattgcttcttcagacgtcgcggtggggcaacctctcccacttccttttcaggcaaaactcaaagtcccaccacgaatcccaaaccgactttgtctgcatcaccttctccaacatctgcatcatcgattgccttgaaaatg

SEQ ID NO: 6587 - DNA, 700 bp, Nannochloropsis_gaditana
tcgggtactcccagattctctaacttcttccgacggtgttgtccaggcttgacagcgccctccgccattttcccacgtctccgcacgcgcccaaattgcacttccgacattgacatcaatgacttcctcttgttttctgcagtcgttagcgcttctgatggagtaggctgcacgaacaatggtgggaaggcgctctcgtgtggcagtaggttgagccggttcgggcttgtcatgagaggtcggaggggtaagaatgcagcaaattttatccggcctcttccgcgacaagaacaccatgctctgcttgatctcatccacatcattgttgcaatgctgataacagcctgtaaaaccgaaatcgtccacgtaagggagactcgaaagtttggctgcaaaggtgtgaggttgacgtaccattttcacgcgccgctgcatttatgcactaccagcccagcattcaatcaaaccgggaccgctttaatgttatccattttctatggagaaggtatgcgggaatacggaagaaaagtgtggcgatacaggcgggtgagaaggatgtggcttgctctgaggagctcgaggccccggcgggtcggaaccctctcggagacgctgcagcgcttccatccctcagccggaactttccatcgccccccctcgcacgcgaccctcgctcttcacaacaccctcccgtacgatg

SEQ ID NO: 6588 - DNA, 700 bp, Nannochloropsis_gaditana
gcgtcgtgtcgcgcatgttcgcgcaaagatattttttcccttgttccgtgctttacaacgtagctgcgtgtggtacatggtgcatggttgctccctgtctaccaggcaccatgcgcattttaatatatatttatttcacgtttatatctgcgtctggtcgtagtatcaatgaaaaagagctacctatagactaccattccgggcgttgcgtggtgcggcagaaccctgcattttggggactcatctgatgatattgtttccttgcctctcgttgttttgtacttgagccgagtagagagaattctgactatgctagtcaatgtaatcaagcgttatttacaaagaggtgtatggttttggaaataatatcctctttgattagccgtgaggtcggtcgcacgtcgtggattgaccaacctaacctagtaccttgcgccgcgtctctctgagaagcttggggctaaaatagacaatcccggtaaaagctcgtcagtattgtctccaaggtttgatggaaatcaatccatgaaattcttgattacattttaatttcctcgaaaacatctgtttgctctttcgtcggctgggaatgaaattttgtgttaccagtcccaataaatggtgttattgtttcaagccaactcatacgaattcaatcttgcatactatcaacacaataacagtcagcaattggaccatg

SEQ ID NO: 6589 - DNA, 700 bp, Nannochloropsis_gaditana
agcgccagaagcgagtgctccacgcggaattcgtgctcgcctataatatggagctcgtgccgaaggaggagatcgtaattggcatgtatggagccccctagagagttttcaatcggcacgaccgcataatcagcctcccgagtggcgacagacttaaacgtgtcctcaaaagatggcttgccggtggccaaaacgtgcggtccgaggagctcgcgcaaggctttctccgagtaggcgccgggttcgccctggaaagccacccggatggggtatgccacggccggagcgcgcaatgtaaaagcctgcacaccgacgagcgtaatgagcgcaagcacgatcaatatgaacgacgacctcagtgacagcgtgaaagacttgcgagacggggccttggacacgagcgggagggtgcccatggagcgtaccgatagagcggctctcaacccggccactgcacctgtgcttggatgtgcattacacataagtgtgctcgctctacctcacaaagactttgaacgcttatgcaccgccgctatcgtcacgaacatgtggcattgggagtgccgccaaccctcgcacgcctgtcttcctcgctagaaggctcagcgagcgcaggtacatggcactcaggtactccacacgcacacaggactcgtcgtcccctttccggagcgcgtcaccatctccgcaagtaattatg

SEQ ID NO: 6590 - DNA, 700 bp, Nannochloropsis_gaditana
  misc_feature (290)..(290): n is a, c, g, or t
gcccactgccgcggtggaggacgtgggaacgcacaagacggtcgggaaagtgctgaatgtcgtcacatactttaggtggtacggttaccttgatcttcccacgaattttgatttgataacgactattaaacaggcccacaggtagtggaccggcatttgagaccgtcatcccactcaagcaaaggcccttacagtgtccaccgccggtcgagtaggcatcttgatgcacttgcgtccatcattcctggcaccagcacccttttcgcgaatttgcacggacaacggcgtanattttaacaggagaaggcaccaccgtgggaagtttcccattgcctcggttgtacccaccgctccggctattgcggtcgcttgactagcgtccacaaaattagaaatttccactccaatttcatctgccagtatggcgtcaccagctatgatatcgaccgtgtcatccaatttacaggccttgtgcaaccatcaaggtattggagcttatgctctggccttgggcggcgcagtcttagtccttggcctggcctacgtatttcaacccgccgtggcagcttggcgacgacctcgtgagcgtgagccgtatactttcaccaggtatgcgccaggcagtggcctggcacccggcacagcttcctctccagggagacggactcgagcctccgcgaaagctccgactggagaaatg

SEQ ID NO: 6591 - DNA, 700 bp, Nannochloropsis_gaditana
aaaaagaaaaaatgagagagccagtggcggatgaatgcgacttacttattgaacagatccgagtacatcttaacctccgctttggccatcttcaattgctgattgctcgcagaggacggctgagcgccgcctccacctccaaaaaagctactcatgcttgtacacgtcgaaaattactctagtggtggtttaaaggagaaaataaaatttaaatggtttaaatcagacggtaaatgccatcccgattgggtgacaagatggcagaggggaggaggcagtaaactacatgctcaaagccaggtctggcagccttgctaaaccatagcctttacaaagccagtggccgtccatttgcaaataaaaacattctaacctacgcgcgtcggtcccacgtgagaaaagggtcgacagaacgcaagcatggcgttcgggcgcgctgcagcccatcccatttacctcccctctacagtctctccgagcctggctctaccccaatgttttccccttatttcctcccgtaccatcgtctccggccatgctcctacatgttcatgccaaaccacgtgttaccatctacacgatcacagcgaaagcttttctcatccccgcgatcaccctacacgctgtttgctttcaggtcccgcgggctgtcaggtgcgaggcgggcaggggctttcctccggagcgtccaaaaaccatg

SEQ ID NO: 6592 - DNA, 700 bp, Nannochloropsis_gaditana
gctgccacaaacgaccaaatcgtgcaataaagggcgaaaaagctttgtcgaattgcgctgagcatgtgaagcacaacagcttcagtatggaagttgcatgtatttcatctaccctcctcctgatggccccaggctgagttaagtcattaagaaccgctgaaaagtagaactccgcaaaggcacttcccgtaaaaaaatacatgaaagcatgttgcatggtccaagtctcgacaaaaagagatccggaggaatggccatgcgatgttgaggatcatgggtgcgtcgagcatgtcatggcgggcccactgggtttaaaccctcttccacgactagcgcgagccacgacgccattcggacccaaaatcactcacgaagacactcattcacacccatttcaaaccacgacgactttcaaatacgtgagacggtcgttgccggtgcacaatgcccggacacgggcgcgctgaacagcgggcgcgggggacatggaaagaaacgcagaaagcggcgtaacggttgagggtctgccgggccggtcacccccaggcgcgcaaaagagcgtgcaagcgaggcatgagaatggcgtgcaatggagtcaggacagggaagggcacgtgcgtgaccgttttcatcgggtggtgtgcgcagcatggccttttggctcccctttcgatgttgtatgaagcatatcatccaatac

SEQ ID NO: 6593 - DNA, 700 bp, Nannochloropsis_gaditana
agctttcgttgctgcgataactttccgtgcttctggcgtccgaccaaggttgaggggcagggaatgtttgggcggaaggggcctcgccgtgactcttcgcgcaattttcgttttcggcgcccacagccacccccaccacctcagtagtaaagcctgcgtcttcattaccctgacgcgcccatttggaagggcttcccccatgtcctgcggattcaccaccgcgtttccgcagggaagaatcgagggggtcggccatcgcccctggagcgggttgtacggtgcatgtgagtgaatatatggaaatggagggagcgcgcttttcgcttggtcatgaggcacgcccgagtttcatgtgaaacagacccgctacacaccctgaccaaaatcccaccgttcacacgcaccactgacgcgtctaattgcactatcgacatgatccgacacgcatgggaagcgtggtccggacacgaccccggaaaaagggagtgggcaggatgtgtctatgtgggggctctctcaaacattcggtgacattaaatgccccgacggtcgctgtagaggcgggggggcggggagtgattgcctccctccccggaacaccacattgggtactagaaggttggatccctgcttgtttggcttgtggacatggtgtctcttactcattttcctccgaaaaccgcactcgtggttttcgcag

SEQ ID NO: 6594 - DNA, 700 bp, Nannochloropsis_gaditana
gtctgcatttgttggttgttccggattgaatttccgtagttaaaaaagaatcgatacattgttccatgtttgagtctgtacgactgacaaagaaattttcatgacactgtttccgagttcgcatattacctctgatgcaacgcgcaatccgcttgatagctttgtcacctccgtcgcgggagtattcacctccaagctcctccctttgtatgccgataagaacctttcaccctagatacgagtgtgcgaaaaggaacatatcatttcgtcgtgaaaattacttgatggcctcggtagatagatagatacttcgcataccttgatgccgggtcccggcaagacgagggatgatgacgctgcactccgccgacgcgagagcatctggaggacattcttactgcacttcatttactcagtagcgcaggacgtctccctgtgcgtgggggcgtgtgctgcaggtgagagtgcgacgggacggcatgagatggggcacctaactacgaacttgggggcgcagcgtgtgatggaaagcaacccctcgggtgacggccctctcagaatagttgtattgactcccttcctcgtatgtgcgatcccaccgctgtcaaagccccgtattcgttgcccgagatgtgtgttatttgccaaaatgtagggattgtaggcccttcctaaccaatcgccatgttttatatgaaag

SEQ ID NO: 6595 - DNA, 700 bp, Nannochloropsis_gaditana
ctgtgccgcgtttcttcatttcctggggcagatgtggcttcgctttcctgctttgtcgatgatgtatgtacagtgggcgagctgcaaggaattttgtactcctgatcgaccttgactgccactttcagtttttgcgccgggaggaatggcggggttgttccactcgtcatttctgctgtgtataggtcgcaggtacgcttcctgttaccgagaatcatgtccgctaaagaggtagtcatgatactcaagagcctggaggaggggtgcgagagcatgagagaggacgggtggggtaggaggcttcgccccatctagacatggttcacagacatgccagctcccgcgccctttaagcgcatgctatggttctcaatgtagcccatacatgctttgcccacaatctcttcctgggaacgaggttggaataaaagcattttccctacttgcgagggcatcgggccctgcgccggcggcggcggaagaaggcgattatattgctctatcgcgcttacaggacatgcctgacgcaattgtggtaccacgtccttgacccacgagtggtgacttttccatgaattgtaacgaacaggttgactgcgccggtcttcattcgtattccagtgcagcacggaccaggtctggacgtcgtggatagatccaggagatccagccgcctcgtagcagtttgtctgcacaaatg

SEQ ID NO: 6596 - DNA, 700 bp, Nannochloropsis_gaditana
cagtggtcagccatacaaaggagggaggaaaaaggtgcaaaagtctgttgtgtgcaccaaaagcagcagcaacaacaacggcctcaaggccagataactcttcatcacttttacgagctacggagccagaggggcgtggtcacgcgcagtgccgacaagagacacaagccatcgccgatgacatagtgtcatggagtttttaccggcaatcctatagggctgcagacagtaaggcttcagaactgggagatttatcgaaagatggtaagatacaacccaagcttgaacattttcacaggaaacaatatcccaaagttgtacaggttacagagcacaggatttatgcgaaggtgcatgcatgtaaacagaagaaatataattcagtgtgtgagtctctcgacgggaaggtcctgacatcgtgggcggtatgggccgagaccgggtgatagcaccacgcacgcgtggcccatgctgcgagctgcacctattgttccatcgccccccgtaggcaaattcgtgttcatgcattggtccttcgacgaaacgtttttgaaattcaatcaaaaaagaattctaaatagatcctcatacgactttggaaacgaattctaggttcagcttgcgtctttgctgagattcacaaaaggcatccctttcggccgggcgtgcatccctacataatatgcacttctcaaagatg

SEQ ID NO: 6597 - DNA, 700 bp, Nannochloropsis_gaditana
gcacccttgtcatcctcgactatgaaaagcgagcgtgtcaggtacagtgcaccccaattgtggcacagaagctcgaggcaccgcacacctccctcggcgggctcggcatcatccgcaagacgcctcgaggagctcaagccggaggagcaagtattgcggttgcgcgcatcggaaatatcggcactggcaggcctccatcctttcaaagacgtactggagctattagaccgacacatctatcaggatttgcctcacctgcaagcggaagattgcgcgtcgtgcgggctggtgttgatgacgaaggaggaagaattcgaggagctggttgggctagcgggtccagaggctgctttgctccgccaagtgcactcaaacagtttttcggccgctgtgcagaccacacaagacgtggatagacgcagaagcgatataacggatgtgctggagcgagtggccgcacgagggcgagttggcgcggaggaggtgacgctcttgcgaaatcatatgacttactccctggccacagaatacggcaagcggcacgaagatgcgggcattaagcagtacgaggccacccatggcgtccaagtccacagtcagaacgacactttgctggcatggacgttccctcgagaccccactgccgtctcctgggacaagccccctcctctgcaggtcacgcccctgagacccgaggcga

SEQ ID NO: 6598 - DNA, 700 bp, Nannochloropsis_gaditana
gatgacgaatccaaaaagaacaatccgcggcaccgccggccatggttgccaaaatgtgctggctcactggaaggactttctctgttgcgcgagaaccgatatagctccctgtcgagtagttcagtaataatatggcggtgaaacactgggttttgaaagcaagtaaactaccatatcttacccatgctagctctggagtctacggccaccagaatgccattatcaaagacaaaggcgcatgtcgttgtgccgtgaaaaatgctgtcctccaacagcttggattgagcaatcgcagttcctgaggtcgtgtctttcgcctgctgatcttggtatgaggacagggctgcctgcaaagatgacctgatgtcggctccagcgtcactactccgtagagaacatgctggacttgcagttatgtatattactgtcatgatttgcggcaagagacctactcgtagtctcatggttcgtttgtctcttctggcgctcctcaagaattcagttcttctctttacgagatgcacaattaaatcggactgtagcaatgcaaattgttgtaaagtgagtgtcttccttctgattgggaagttgttttgttttgtttttttacatgccagcaggagctcgccctcttcatgcttggcgatcatatgttaccttcctttgaggcacaagtgacccaagccctaaacctatcaca

SEQ ID NO: 6599 - DNA, 700 bp, Nannochloropsis_gaditana
tccttcggccactctccaggcagaaagtgcagttcacgcacaccacagacaagtatacgtcgcctacatggaaggaatatgcagaaataaaaaaatgaggcagggtggcagcgacatgacatgtgataccactggacgcagcccccggagatgcttgactagggtggagggggggtcaggcgcgggcccgggggcgctttccgggccaacctcccgccctagccacccagccgaaagggtctttccatggattgcggagagaaaaatcgtgactgaacaatcgatttgtaaggtttgaccggcggtatggacgaggtcacctgaaggcgaacgtctccgtcctccgatggcgccacagcattggcggagggagagctgtccttgtccgcccgacaaaactccaataatgccttcattcgccgccttgctcagtgcaacaccccaagcaaacccgtggcaagtcgctttgtttttcccaatttgatgcttgcttatggatggatgtgctgtcctgggggcatggggtatccattcgaatgcttttgtgggaaaaagaatatgaacggctgacacgggatgacaccttcagttttgtccaacgttgtaacatatgggcacttaacagaaaatcaattaaacgaaagctttaattaacttattaaatctatcgctacgttctactctctgaaagattgccatg

SEQ ID NO: 6600 - DNA, 700 bp, Nannochloropsis_gaditana
tgcatgccttttttgtctatatcaaataaaatagatatactccacgcgtcctggcggaaagacaagaaaagcgccatgatgccacggaaacgacaatcagcctcggatctggttggctcaagactctgtataagaaagaaatctttcagacaaaaaatcatggccatgcttatttgtagcctacttttattaggaattgctagtcgtttgctcattccccacgcccaaacgccgccgttctcattcaagagcatgacaattttctcgaatacgccaaccaacgagagtgcaagcaggataaatgaacaatacatgaaatgtaaagcaagagatcttggataccaatccatggattgtcctaggtgggagggatcggcagacaattcgctagtctcaaatgagctcgtggattaccgcgtgcgttatctatggaaaaaacaacacccttcagattgtagtaaggtgaactatcaattgcaaaaggttgtcgacaacggactgggatttggagcaatgatgcacggctattatttaggccctttcatggccgcgatacgatccgaccgtgtattcattcgtgataaagatttttttacatattctggatgtaataacaaaacctggtcctgctattttgagccgatcaccaactgctcctacgaaactgatgtcttacctatcctggagagtcatccaaatg

SEQ ID NO: 6601 - DNA, 700 bp, Nannochloropsis_gaditana
gccatgcgaatgaccttgtcctcgaaagcctttttaaaaacagtggacgaacgcgtgcagaaaacataggaggtatggtccgggggactggaggatactttacagctcaagaggggctgaagaccccattgtgggagaaccccagaaaaaatcatgccgactaccatccaaacctgccattcacagggatgctgacgagcacgagcacacggcgggtgtccgtctgtgataggtgtggtagggtggtggagtggttttctggtcggcatcgccggcagcgacaagcgaggcagagaggacctcctccctgttggcgcttgggtgctcgaacgcataagaaagagcttttcacggacacctttcagtggggggcgagatttcggttctgatacaagcccctctgaatccttgatatggatggcatgcttcacatgtgggtttccagactacttgaagccaggctgtaagtgcagcatttcgacaagcgcaaagcagggaaaagagaagctaccaagcaatttttagtgcttgagcgtggatgaaccaagtattcttgtctgtcaaatggaaagaaaaactttggatcatttcaaagttaacaatgcaggggaaagattctttcggcatccaggtgacgcgtacctatcatctccttgatactttttgtcgcgacaggcacatccataccacgcggactatg

SEQ ID NO: 6602 - DNA, 700 bp, Nannochloropsis_gaditana
agccgcgtcactttcttcgtacggaacataaccgcctgagcccggaaggctcgtcgcgggtttgctaaaccaggaagcccgcagaacctttcgtacgtccttatcccaatacactgcacgcagttgacggtctctgatatcaacctggtaccgtcctccctccaccaacacagggacttccgcgtctgtaccgtggcttgttgtggccaaagccgtcaaggctttttccaaggccgcgttgtcacgtttgcggaacggcgtccaccctctccctgatttgacgctgtcttgcttcagccaataataagacaaaggttctgctgctttagcgcacgattcgttcgcgtgcttctgagcttcggccatctctcggaaaggattgcccaaggaggcagtggccgtgggagtggaagaggatgcctgaggggcagacatgacaaccaggatgatggctaggccgagaaggcgcccagccgtgggaagaggatgtgcgcgaaaagagggcttggagggcgcaatcgtagcacaaccttttgaaatatgaagacgaaacgactaatcgtggggcagtggaacataagtaaatctcggcgcggaacaaagttctcggaggtgtaccctcacgactcccagcgagcccagctgacgactcccagcccaacctgaaatgcctcagacacacacataggtgggacacatg

SEQ ID NO: 6603 - DNA, 700 bp, Nannochloropsis_gaditana
attttgatcgctagtgtcaagctggaccgcgatgaggaggcttaaccttggggtcaagagtgggactaaacccccaaagccatcgcgttcgccatcgtcctctccgactactgcaaatcccgcaactgaaacttctcaaacttcctcaaccgtgggccaaaatttattacttctctcttttgacgaggaaccagtcatgattgagaatagcaaacatggatgcttacagtctttccccgagtcggatcgcgtcccagcgcatgattttttaggagccaacgacgacacaactgagggcggaaaaagtccttcctatgcccgtgtacactcacagaaagaagagtatgcttatcaacaggattcatttagtcaggaaggcccgaatcaggagcaccagcaacagcaagaaggggtgcatcaccatcaagataatgcaaacatggaaaggctctcacaatctttgagagacatgggtggcagagccctcggaagtaacaactcaagtcctcgacttctcaccacacaacgcgttgctcatgcgctgaacagtccctccttatataccacgcgcttcacgccttctagtaaaacgtcatcagcgtcctccaccgggcgctccttctttcaaatctcaggcgggcccatggagctcgctgtctctcaacccaccatccagaatgtcgcacttctacggcgtatg

SEQ ID NO: 6604 - DNA, 700 bp, Nannochloropsis_gaditana
caaagctctaccgggcgcgataggagaggagcttccaccggcatccgactgagaataactggctgcgttatgaatgctagcggccgcgacaccttggccccgcccatcagataatgcagcgccacgtccgctgctaccgcttttacacgacatagaaccaaaaaacgtcgtaaaggctgtaatagcgagaggcaagaatcgaagggaaaccccccgttttgtggaatgagacagcgccggtaaaaaggtaggaggtcgaagaaaaggaggaggtggcatcaaccagggaaccccggtcgctttgcttggtggttccaggtgggtgtcagacgctgtgggatggtggagtcggatagggtgcggaaagatattagaaaagcgtcccaaaaaagagcgcattacagagaggtcgccgggcttcaagtctctcgtcacgtgccgtttccgggctgctcagcgagttgcgatggctgggagcctcgcacctcattctagaccttggcaacaatagtttatctttgtgcaacaaatctccacagggcggtcacagctcaccttacagtgcgtccctgtacgcaaatgatgcaatgatcccgagcgtttaacgcgtccgcaaagagaaccagcaggccagccgaggccccctatctgccgacactgcttctcaggccacacattgtgatcctcacctttcagtatg

SEQ ID NO: 6605 - DNA, 700 bp, Nannochloropsis_gaditana
cgcctccaatgggcatggatatgcaggatctgtcacacctactgctgtgatttgggcttgtcgtttttgcctgtgtttgtttttcaccctcaccctccaccggaaccgcctcacccgtctgctgcgtgctatacttatggctacgaacacggtctgaaaccatctattcagccgtgccattgccatgctttgggcgtgctccgcatctctctgaacagcatccatgtttccgatctgttctcctgttcgtgcccgggatcttgattgactgatacttagcgtcctattcacgaccgtccctttgccccgaactgatacaacattgagtcacactcattacgcacggaactcggtcttcaaatcacactcccaagataggctcatgatagacgaatggatagagacgctacgacgcggagaatgcataaaggaacatgagttgaagaagttgtgtagcttggtacgtggtgacggacagtagtgtacagcagtgttggcgtcgcagccaaacccatcttcccgtacctccctccgggtactggaagctcgcagatgtatcgtgcatcatgtgcatctcatccacgcacactcggtgctgaacatagggggccttcattgcgtggcttacccacggtctctttcctgtatttcccccgtccgcctctcgctttcatcccctacccatctctgggggcaggtc

SEQ ID NO: 6606 - DNA, 700 bp, Nannochloropsis_gaditana
aacgcttggaaacgccggacacaaacacccgccctgcggccgacgaccggaacctcagaggtcacgaaggacgcaaatgttccatgcaaaccatgaaaaacatgcacacaccttgacgtcagggtgtatgggagaaagactgggacagggcgcaagtgtgcacacgatcaatggtgaggcctagcagccatccacgtgcaagaacagaggcttaggggaggcaaagaagcctccctggcccccaacattcacttcaaaaactaccaatacgtctcgattaattttacccgccaactcgaggtctttcacaacaatggttcttttcacgtagcgcatgtggttgggttttttgtggtttcctagacggtgcttgtgcaggcgtgtattttcactcggggaggcctttttcttcggtggcttggagaagggttaggaaagcgggtccacgctcaaattcatggctcttttttgaaggtccgtgacggcgcgacggtgccagctactttcctcctcctgatgtgtgtggagcggagtcaaggcacatttttggcccgttgcgatatggaacacattgtatattgtgtactgattttgtaaccttggctttctggcgcaagctcgtccgcgcatacgcaataaactttgtgtacagcaatgaaatcggacggctcatatcactactgccccatttttttttaac

SEQ ID NO: 6607 - DNA, 700 bp, Nannochloropsis_gaditana
cctccttttccttttctttttcttcttcttcttgtctgatgcctctccagctgtctcctccccgtcctcgtccacggctccgccctcatcctcaccctctttaacctcctcaggcaagtgtttctttacggggaaaccgcttttggagtgcctggatgcagctcttttggttcctttcgcgagttcttggtcagactgtgtgtcgaatgtctccatctcattgttgtccgagggggctggttcaaactagaggcaggaagttcgtgtatatgagcacggggcggtttggatagtcatgggctgcgggcctttcagtgtttccagaaggctttctcacctcgtctccttgcagcccctccgcgtcggcctccatgtcgtaggcttcaatatcgtcgtccaacgcgtcccccatgatgctgtgaggaaggttaaaacgtgtcgaatgtgtgactgcgcgtgaggaggggatcgtgggtggaacccgatgactcgctgctgtgtcgcccactccccctctctggacaagttgacttccggtttccaagttcacttgaacatatgcaccaccgtcactgcagggatgccggccatggatgaacggcgccaacggctgcgttgcggcggtcgcttgcttctcttccactgcgtccttgccgtcataagtcccgcaaaggctcgcgaggtgacctctgatccaatg

SEQ ID NO: 6608 - DNA, 700 bp, Nannochloropsis_gaditana
cctatgggctcaactccttctttgtcgtttgtcaagcgcgcgattatgcggtagaatgggcctagagtagagagtcgaagctggattccaaaggcggccgcacaagcttcaatttcagcctgggtcacaaggggctcctttccagacaagggagcggggtcggtggaaaaaggcagcgccgcgattgatgtcttcaggcctcgttctatccgtgggcgaagagatggagagaacccctgggtgactcccggtgtgaggaagacgaggacgagaaagagcacgctcgtgtggggctggggtcgtgggctcatgataccacgcaatgggcaaatgaagagcgtgtaaaattgcctcctcccaggtgtatagctacgtagtaataatgaggccaactagcgtcaccatggagagaccctgtctccataaaggaaagactaggaaattagatgagataacctcctgccccctggaagtccctcgcagcgagctcgtcgcctcggggcaaagatgggtggcggagccgggtagagaggtagccctcggtcctttgaatcgtgcgttgttttgttttacaagagtgctacgttcttttacgatgcggtgccttgtagcaaagaggctgtcgtggcgacttgcccgctgtggcggttctttttgccaaccactcattgagtatcttgtcaacacgtaaacagacatg

SEQ ID NO: 6609 - DNA, 700 bp, Nannochloropsis_gaditana
cataagggctgtgccacctgcatgcactatgatgtcgccttcacttttggaggtggacaggcactagggcaagctgggggatccgaaaaagactctcagagggcccccacgacgtcccgtcccttgctgtcatgcacatgcacgacgaaggacggcacccacagctgctgttgaccctccctttctcttggtacgcttgactttgcatcggagaaataaaattttgcttacatgcattttgctcttgccctcgcttcacaagcacactataggcaggacagctcctcgccctgcatgactataaaccgcgcgcacctaggaatggcatgaaaatcttgtcagagggctgggttgaatatttccacgacgtgcatgtctgctcgagggaggcaaaaaccagcaagagcacagcggacttggtcatgtcatcgtcgctcgactcgcggagctcgccatttcttgtgacggctccgtgtggaaatacatgacactcccctcgtctattcgccccgctagaaccacgtctactatggcacactacatgtcgatggacctctagcgttcgtgtcttcctaaggaagttataaaacatgacggttcgacgagcgctcatttccgccatgatacttcttttcttccctcccttatcccctttacgattaaaatacagaggggtagcccgcttggacacacaagcatg

SEQ ID NO: 6610 - DNA, 700 bp, Nannochloropsis_gaditana
tgacatcgatccgtagagattcggcgaagcgttgtccgagaatctgctctaatccgttcatggagtgccctaaggactccaccgacagaagatgccccccgctctccggcgcgccctcctctcttcccgcttccggtggtatggccgtgaggcgtacgtcgatggagggttgtagactcaagtgcacgaaggacatgggtttcgtggtgagacgaaatacgtccccggctcggcgatccactagttctgcgtcccaggtggccaggaggacccggtcgggtgattccgtgaggtaccgacggatgagggcaggctcgtcccatagcagaagttccacttcatcgactgtcccaaactccattttcccacgggcgagtcggaaaaattccttcggggaagaagcttcactgttgccgcgactgctccttactcggaggagaagtggactccgccacctgtccatgtctgcggctgtgacggctctggctgctttgactgcgaaagggctggcaagacgaaaggcgtccgccacgctgcttaggagcaaaatcgaaattgtaagggctccgagcatcgctcctggaaaagccgcaagcatcagaggcaagctgaaagggccctgcccacccgtggcctaaatgagagataacatgccaggaaaaccaaaatgaatgccaatctatgcaccatcatggacatg

SEQ ID NO: 6611 - DNA, 700 bp, Nannochloropsis_gaditana
ccgaaggcgagcggtcgagcgagtttgccaaaaatgatggtgacctgaaatgttaagaacaagcaagccaagatacgcagtgcgaccaacccttcgaccaagattcagggcgggggtaaatttgtaattccttcctagatttcttgcaatatatcgactgaaataataatacgacacaaatcgggggacaaggaagaaaatattagcaaaaaggcaaaaacaggaaaggaagaaaacagggcgggtcgagcacgcggtgtcggcaacatcaacccggccatggttgtgccgcaactttaacaggataggtggacaataaccgagttgtgaattcgaaatggaggctttgtgcatctatgcacgtccctttagtcacttgtcagggtttgtctgagtcgtctgttgctgtcagtggcccccgccatccgtccatgctcagacccggcgacggtcgagagggagagtttggaatctctgtagcagggcactgcagtacgttgttctctatgcgcgaatagcccgaaaaatgctaattatgtcttcacattcttattctacagttgcgtctggaaagggcgtctgaaacgctactgctgcagagctcgcgtggtgagggaaaggcgaagcattctggcagcttagctgccacaaggctaggggctaccaggagaaaagacagtgctgtcaagccaccatcatg

SEQ ID NO: 6612 - DNA, 700 bp, Nannochloropsis_gaditana
aataatcgagtgctggaggcccagatgaattgtatattttcctgttaacaacgcagctcgggtcggcgtgcaaacgctttgggtgtagaaggactttagattcacaccctcacggcataagtgatccaaattgggtgttttgatgacattttcgttattgcggttcatccatccgactggaggcaccgagatatgagaatagtgaggggggaaggggaagttgaaggagtgggtgaagtggacatctgcatgccctacggaaggttctttccgggtatagacttaccatcgttccagccgagatcatctgcaagtatatatataatatttggtggtgtatcatggtccacttgttgggcaatgttgagtttggccctcgatgcctctgttgcgctttggagctcatgagaatcgagcaaaacagtcacacatgcaaaggtgaaggcgatgaccgtgaagtcccttctgctcatatacggtcttatgcctattagaaagcttagcattttgctgcgtgaagatttgaaaagaggggcggtcaacacgggcgtggggaacaagcaccttttcccttcagacctcggagcttcgcggaatttccgagttcaaaaactcaagttgtcgttgctctgcttccagccgtttcgtcccccccgcgacgtgtcggttcgttatgcatttatggttgtcttccctcatg

SEQ ID NO: 6613 - DNA, 700 bp, Nannochloropsis_gaditana
cacgacatcgcaaaaggtatccccaagaatcgagatttgataatgtggcgtggcgtgggatttgtcttctgacgcgttctccgcttcttgttttttctttttgagtgcctgacgacgaaggtacagagctcctactagagcaagcacggcaattgctgtaatggacgccgcggagcgatttctcacaggcataccttgaacaatgtagaaacaaaagactatcagactatcatggatgttataatatcaatttgcggtgtgcaagtattcctgtaaaagaattaacaacagcaaagcaggagagggtggggaggttattgcccctgtgaaagaaagaagcacgccacgatggcattatgctttacggtacaacgtcgaagaagaattttttggttcggtacaaaagggaaaagaaaagtgatgtcccgcaagcatcggcattgagcaaaaggatgaaatgatgtgctttaccgtctactagtagttttgccgcaggcaactggaagacctgctctcgccgtacacgcgtccctctcattacctaaaaagcacaagcatcgcaaaaccaaaatgtagttgtcaaacccagctcactagttaccttatcttctaacttcctctgtctatcagctttcaacaggcacaggcttaacaactctcgttggtcgttttcctatgcctctcttcctccgaagaactg

SEQ ID NO: 6614 - DNA, 700 bp, Nannochloropsis_gaditana
gaggacgggaagggagacgtggtgatcggagagctgagcgaaaaagaggccagctcggaggaggagttatggcgcctgatcgaggaagggaaccggaaccggaccacccacgcgaccgaggtgaacgatgtctcctcccgctcccacgccatatgccaagtcctcctccgggaccgagattcggggaagctgtgggggaaactctccctggtcgacttggccggctcggaacggggggcggacacgaagagccactgccggcagcggcgcttggaaagtgcggagatcaacaaatcgctcttggcgctcaaagagtgcattcgggcattggatgcgggcggtggcacccacgttccttaccgcgcgagcaagcttacgttggtcttgaaggattgcttcacgaaggaaaaagcacgcaccgtcatgatcgccaccgtgtcccccaacgcctcctccgccgatcataccctcaacaccctccggtacgcagacagggtcaagcagaaaaaggcggaagactttcataacagcgggagtgggagcagtgtgggcaaaggactacggacagagggctgcggggaagggcgggcggtgcgagggacgggtctggggggtgactttgaagacgaggaaagggaggggcgcgggggcgaggaaggtgcctcgggggaccgggaggacgaattcgaggacgaggggg

SEQ ID NO: 6615 - DNA, 700 bp, Nannochloropsis_gaditana
gagtatggtttggagccacaccctcacatcccaccaggggacctgaagatatgcatttgcgtgcgaaagcggcccataaacgccaaggagcggaagcggaaggactacgacgcggtcacgtgcttcaaccccgtggtgatggtgcacgactgccgtctccgcgtggacggaatcaccaagtacctggacaacacggatttcgccttcgaccacaccttcgacgaggaggactccaccgaggccctctaccgttacacggcgaagcctctcgttcccttcgttttccgacaggggcgggccacctgcttcgcctacggccagacgggctcgggaaagaccttcaccatgtgcggcatccaacagcaggtggtggtggatgtgttcgcccacctgagccaggcgcacgcaacgcagcaggcgccgggggggttgggcgtctatgtgagctacttcgagatctacggcgggcggtgtcaggacctgctcaaccaccggcacaagctgctggtgcgggaggacgggaagggagacgtggtgatcggagagctgagcgaaaaagaggccagctcggaggaggagttatggcgcctgatcgaggaagggaaccggaaccggaccacccacgcgaccgaggtgaacgatgtctcctcccgctcccacgccatatgccaagtcctcctccgggaccgagattcgggga

SEQ ID NO: 6616 - DNA, 700 bp, Nannochloropsis_gaditana
tcacgctcatcaaaacgcgtggcagattctctcctgacaggagcagcatgatggtctgcttcaaggcctgaattttgtacttcacgtccggattctccaaatccctcatgatttcttcctgttgcactgcagatgccttttcggtatggaagagcaccgtgcatgatgtctcgatggatgagacggcgggaaggcccgatggggccatgatgcgcaggagatgctagagactcgaaagcaggaaacgcccacggacgaggcaaggcgatcagcccagtttgtaggtgtgtcccagtaccgtgaaggaaaatcctgtgatatccagaatgcccgacgtagaataaggtaggggtatgagcgaagtgagacaggcttatgcacgatgagcacccccttaccctcatcaagttaaatcatcccgaggaaaaacggccacatgtggtgcataccaaggaaatcgatttcccagacagcctcattttcaacactgtcaggtgcagagaggcatccacagtcctgggagacagcgtgggaattctcgggcgtgggatatgtgtccagacagacgacgaaactcctcgctgagttcctttggagagcgcccatagacccccccccgagaggtcttgcgtggcgatccaggcacattcacacgtccatcgtccactcacccgtgaccagggcattcacaggcaaaatg

SEQ ID NO: 6617 - DNA, 700 bp, Nannochloropsis_gaditana
gtttgagctccgcctgacagaaagagggagggaacgatcgaggtaagcatggcgagtccaggagcaggaaggcacctgagagggacaggtcacagatactagggagctgaaatcatacaaaaattaaaacatcgttcataaggcgctttgttgtttatgtcatgttatacactaggcggcaaaattctatctcagaattgaagtattgcaggaggacaaggtacttaaagagacgcattgcgtccacgaaaaaaggagcaaggagattttcaaccgcaaaaatacatccacttaccttcatcgatgcaggaaacgtgcaaattagcgcggctgaggtgtttgtatcactttttgttgtagttgccatgctcaaggcctcgtcttcggcaggcttgctcgtgggccccgctgacgctgggatgtcctcctcgttcaactcacttgccatggcttcacaggcacccaatgtatctactgtgctcgatctggttgtccatacgaatgtaaaatacaggtgaggcgaagatgctttttccccaaaagtaggggtgaccgcgctaaggtgatttgtgggggaaacctcgacgttggtagagggcgatggcgactgaggaggtcagactgcccgaggccttgacgtcttctttgtgcgcaaaattcaatgcatcttggtgaaaactaaacgacacactatgaaaca

SEQ ID NO: 6618 - DNA, 700 bp, Nannochloropsis_gaditana
tacatcactttcttggactacctggctcagtacgcatcctacaaggtatgggtgaagccgcaaagtgagatggggttcctatacggcaacaacatcatcaagtccggcctggggaggatgacggaagggatcccccagtacgcgggtgtggtggtgtactccatgacggacatccccctggggttcggggttgcggcacagcccacggacgtgtgcaaagacctggatcctggggccaacgtggtgctgcaccaaggggacgttggcgagtacctgcgcgtggaagacgagctctcgtgatcgcgatgaggatggaaggggagtgatgagcgtggaagggaaatatttctgagggtggctaacaagagccgatgggaggtgtattcgggtgacggaggggaagagggaggccagatcggggagggaaaatgtacatatgtgcgaagctgtgctcggcactgtccgaaaggtgccgcctgggggatggcgtcagcggcctacgaagggaggataaagggagacagcgcggagaaaagtaaagagcctgtggatatcttcaacgctttgtttcgcttccagcaatgcgtgtcctccgtgcgtcttcgctggtcctaaacaattgtcgagcaagacggcaccttagcttttgtacatcgtcgtaccaggaaagtgcgggagagcctgtacagggaggaccatg

SEQ ID NO: 6619 - DNA, 700 bp, Nannochloropsis_gaditana
tgatgttgcaagtgactcctgcgtatctcatctcttgtcgcatgcctgattcaaatcgcaacagcatttacgcactcatgaaaccaacgtacctagctaggacgttaatctcgatatcttatatggtggcggcaagttgtcgtgaaagtgggcgtgtgaaggcgtgaaatggagccaactatttagtatccactgcctcttgttgctgtaggggaatccacaaagctgaatggataggaagagggatgcacacagaatgaaaaccacgagcctacagcagaaattaaggacatggtcgatcctttatgcaggtatgattttgatttgagtgatttttggtttttaaagagggccatataaagacatggcgccttcattcttgcctccagccacccatcgcccctttctgaccagacccgctctgctcaggaatatcatccaatgtggcgcctttttgtcgttgcgatggccgatcgcacatttacaggcacccttccatcacattatttcttgaatttgtgagattatagccttgtgatgtcatttatttgcctttcgtccgataaacgttttctagacaggcgcttcggtttagtcgacctcctcatcccctcgccttagccttcaagtcttgcatcagtttatatttggtaacactgtacgaccacgacttttggattgaaaaaaggttgaacacatg

SEQ ID NO: 6620 - DNA, 700 bp, Nannochloropsis_gaditana
taccagcctcgcctccatgccatgtaatctgtggtgttgttattttcatcgtgctggtggtaggtgtaggcaagaaagctggtgtgcgtccttccgatttctgtaccctaggagggggggggaggagagagattaccatccatttccttactcttttggtgacactcgtctacgccacattatcagacgccacacttaagacctcctccgagccttagaacaggacgcacaccttgggggaatgcacacgcaaggcaggagccaagctggaagtgaaattatcgcctagaaagaaggcttggcgaagcaaatgatatacgactttcccgcctcccaccgtcaacctacacgggagcagtgcccgaaactctgcgaggcgtcaaaccatgccacggcaggccctggaggcttggaagggtggtcgcagggtagcatgaacctcctaggacgtgtcatcaatggcgtgtccggcaactttggcagtattggtcatggttatggcctcaaagaagaggcagggacgtagtatccttgaacccgggccgctggtgctgttgctcgagctgcaggcacttgtcaggccactttatgagctgaaacacgacgcccgcgggaagaagttgacgtacgaaagtcttaagtgtcttattcgtgcccttttgttatttgtgccctcttaggcaaataaaaacgcatcatg

SEQ ID NO: 6621 - DNA, 700 bp, Nannochloropsis_gaditana
cccgagacacggctgttcctgctctcataatgtaaaccgatgaaggtttctttctttccccccccaacctcgttattcccttaccaaacgcccctatttaacctcttgtcatatctcgtacctggtattcaaaaaattcatctcggacgaagcggacaaccaagcatgatttgccaactgctgtgtcgcccagaaggacaagcttgaaatggcacacccggttgttgctactgctgccgccgccgctggtcatggttctgaaatcgtctctagtttcttgggggtgcaactgagtggttgtctgagatgcgttggaggggaaaagggtaagtgtcacgcgttgtggtgcataaagaagtcgctcagttcttcgccttgcctgatcatcacactgggcgggagctttgcctcttcctcgcaagaaagcatctgctgcgccattaatggaagctctcgagcagagccagacgtggagtatgtcatcaatttctcaaactgccgttatgaaggtcgtattatcggattaaaggcggctgatgtggacacaaaccacgcggaatttgatggcacaagaagcaaacgctcgccgctgaccgagcccgctgggtgaagcacgtcccattaagacatctactctcacataacacctcactgactcctaggcgacaagagcaatagcaaacaagacagactgtttatg

SEQ ID NO: 6622 - DNA, 700 bp, Nannochloropsis_gaditana
tgagtacagggacagatgcaagatgtcacacatgatctatggttggctttggtagcatataatcaatgggttcttgactattcttcgagattattttgagatagaaagtgcttctcataaagagagtgggcggccgttgagattcgatgacgccagagcgggctgtccacaggcaggacaacccgcactcgttcgtaggcccatataccttcaaaacgagccagtcctacgggaccatagtctaatcagagaaacgggacctgtagtatatttggagagcagcgaggggaatcacgctcttttgcgtgtttgtgcaagggcagaagtatggatgttctgcacttgcagtttcgtctgttggctctctgcaagtgtgtcaaaggcgcgcactcgaatgcttgagagcctgaaaatgaacttcgaggacagttccttttcttatggaacagatactgaatttatcttctaaacgatcgagccatattatattcgattgagatcgtgtcagtatctggtccaaagcctcaatttatggcggagagggggaccatatggatgtaacgacgggatacaatcaaggaaagggaacaaatctactttgatctctcaaagcattacaatgcatatgaaatatacatctgcgtcatctcattgaaatgtccaatagtatagggagcaacctgaccttccagaagcaatg

SEQ ID NO: 6623 - DNA, 700 bp, Nannochloropsis_gaditana
gaaggaggacagaagaacgggtgggcggacccgaattctccctttgcaaaaaaggcggtagcggcgtacgaggctttcgttcaggctcaaaaggggccaggggctgaacagggaggggatgttgcctcggcagtggcggggatgggagatgtggtcatggaggagctgagggagcgaggggccggaggggggggaacgcccgaagatgtgaaagccatgtttgagagcgggctcagaagtgccaaacaggaggcggatcgggtcgcagctaaaggtcagcggcagaagcagatgcttgcggtcgtgaaagaggtggcggaaacgaggcaacgcgaggtgggtgggaaggggggggtgaaggaggggctggcgacattggagatgatgtttgaggggactgggctgaagggtggtgttgacgtgatggctggaccgccgggagaggagagcctggatctgaggtcttgggagaggggtgcagaggaagctcgggtggggagggaaggcgaagcgaggagcgaggaggtggaggacgacgaggacgaggacgagtgggacgaggccctgggaagcatgggggacgcagatcctttgggggatctgggctgggatgtggcggcgcgttttgatgtgctggtgcgggagctggaggctaccgtggactccccggacttgctgcccgccatcgccagccagtacc

SEQ ID NO: 6624 - DNA, 700 bp, Nannochloropsis_gaditana
gaacgaggcagcagggtggtagtgacggccatatttattaaaaatcacaagctgccattaagaggacagaatgctggaatgaagcggcccagcgtgtactgccctgtagccccaataggcgacaaaataatgcgcctaagccatgacggccctcgtctaagccacacggtgcaggaatcgggcatagtagcatgctttcggatcacgcggtgttgtgaggactccgctctgctgagctctgattttccttggcatgctcactctcacgttgtcgcatgatacgcctcttatctattctctctcttcaaaccctcccagagccatgctagtgtcaaggatccttctcccggtgataacactggcgtgcagcgccgcagcgatgtcgtcgaagcggcacgttttgatggttcctccttgctccacgttgaggtccgcttgccggttgccattggccacggcatccaccaccgacttgttcggggctgtgtctcataaacagccttgcagacagggcgttggaagaagaaggatagacacgatttcctccgggcgacaaagaatagaagagccgcgggacgcattcctcgctgccctgcgcgcgcggggcgggggaggcgggggggcggctgcctcggggctaagcaacgctggatgggccactgtagtggaaggactgaagaatggctgtgcgagcggcatg

SEQ ID NO: 6625 - DNA, 700 bp, Nannochloropsis_gaditana
atcacgctctttcacaggtcgagtagttgacttctaggaagagtctgggagacgtctgcggttaagaagttggggtaatgaatggaaagggcgctcctgatgagcccatgaacattgagcagatgcggttccaggtcgtggacaaggacaccggtcaaatctttcggatcgatgagatggagcaacacatcaatatcaatgcgtacacgctatttccttcgcgggatgagctggcacagaaactcgcttcgagcgctgtgcaggccggagactcggacgatgagacgccaacttctcccaaaagtgagttcaagagggtgagagagcatctgggtggacgttgagtcgtgacggatgcagatgttaattgaagtcttttcaatttggcgctgacatacgtgaccatgcaggcggtttgtctttgactggtctgtccgccctctcctccatgctgggcttccccagaaaaaagacgttcaccggcaagatcctgtagagggcctagtgcgtgtgagcacagtgcggaaagagggaccagattttggagacctgaagctctcgcagtgcttgcaggtccgtgtcatccctcgttgattggtccaaaaaacgctgtcaattacgtgtttccttgtagatgttttcttattgttggtcctgatacctcgtttttcaggctcatgatggccccatctggaccatg

SEQ ID NO: 6626 - DNA, 700 bp, Nannochloropsis_gaditana
gtttagcggtctgcttcccggggggcggaaccagtctgacgcccagtctcaccatctctcactcctgcgtgtagagcggtcgtgtctaggccgtccagcgaccaactcaactttcaccgtttgcggactgtattgcgatggacggcggtgtcgtggtgacgcaaaggcgctaagatgagttcttccaagatgagacatgacggaacatttccatgtcctctttttaagggcgatacaacagcgaccgcttctgtaagcaattgagagcctcgacgactgctcaaagatctcttgttgccgaaagcattagtgatcggtgaggccaacgaaagtgtggcgataagctcatgtatgatcccactatgtatttgcaggggctcaatattcttcaaacagcggaaggattctcggacagaaggcggctaagagagtgtccggcggcgttcccgcttccattcagcaactcatgaacgaccgcctaccaaaacacacacggtcggccttgatactcttggctattttgtgtactgtgaagggatccccacaccttgctttacagccatgtggcgccctacaagcttcccttgcgttttcccgcccctctgctcgagacgcctcgacctcctccctgccaagcccctgtgcgcacaggacacgccaaagaagatatggagaacaacctgccttccctgtgtggatg

SEQ ID NO: 6627 - DNA, 700 bp, Nannochloropsis_gaditana
tcaagggttcgtgattggaggcctacgctcatgtccttctttccttccatttcaaagattttcttccggacaagagaacagccaacttaagcgtttgaatcgtccgaaatcgtgcaaatgtgagaaagagatatcgtgtaggtcctagcaggcgtgagcacaagccttgaacacctcagaatgttccgcgaattgttgccagcttgtcattgaaaatccatacgagacttaaaaaaaccctcgagcattattttctcatcccttttggatgttttctttcgtataattgttttcctcaccagagaacgactagagtagcgcgtccgaccgctccgaggcccatccggggcaccaactacccgggttcgacatgttgagcctcgacaaaaaatatacatccgctacgatatcagatacacttgtcgtagctcactcaatcattatcagtgtctcatgctatctacaacacaaggaagatgactgggcggccgtcgtggctaccaagctcctgtctgccatgcgctaacgctagcactgcgcccaggtcatttgagagaggtactacctactgtagtatagtatgatgccagaggacttcgggcgagcaagggtagagaagcgtgcctgacacttcaagctcgaaagagttgtgcattgctgtcggcatattatctgatgtaaactttttcgcaccactcag

SEQ ID NO: 6628 - DNA, 700 bp, Nannochloropsis_gaditana
tgcgggcggcggccgaaacgtgtcctttgacaaagacaggcaagtctgttcgttgtagcgagtctagcacatggtaccgccatttccgaaagcgcaagctagtcgtgtacatggggagcgtcaagggtggaccccccagccctgttttttgtgcttcggtacttttccaatcctctgtaatatggaatgtgcaaagtaattattgcacgatttcagggggacactttctgctttccagaaaataattcggacgattaagtgtcacagaggcacaccagtaaacatctttgtattatttgtgcctgtgtttatgcggggtcgagggaggcggagagccaagaaggctcgagccagtcggtcacctcagcgagcacgacgcagacagtatagttggaagacttcccgcgggcccctgcgcgggactggagagagcgcttggcttcctgtctttgggtttgccagccccttccatggcaccgtgggtgcaggacgctgcagatgacaggcacaaaaaagggtgtcgacgtgaacgtgaccgctgtgggcggtgcaacattggcgatgagctactcgcagtactactagtgcgagtgctagttgctgtgacttaaccccggggagcctttctgaagtcatttttttaaaaaatatcttgtcgcaaataagtatttcacaggtacgcaagacttaacgctggatg

SEQ ID NO: 6629 - DNA, 700 bp, Nannochloropsis_gaditana
cgacagaaggtcacccccgttcccattgtaaaaagtgaggcgtcgtgatatctgccttcctatcccctgtggccacgtaactttccatcgttctcggctatttatctgtcaaatgccatttcctttcctggacatgccctttctccgttctcaacatggccataccgagggtgaagtgcgtgtgtttcctgtgtcgatgccgtttgtaagcgcgatggaccatggaggacaaggggccagccagagctccagccgtcgccgccgtggccgccaccgcaaagaggaccgtgtgattattctcgttctttgacatcgctttgtcttggtcgaaagtaccggtctgattgtgtgataagggcatagaggtgaattcacggaacagggctcaagttgcatcggcgagtgtgatacgagacgagaaaagggacgatattgccttggccattggtgaggggcgtgtttgtgccataatgggcatgaaacaagattcttgcggcttggttagacagtagccgtgtctgcatcgcgagtcttttgaataatggtaaaactgttgcgcacgacttgactagtcaatgcatcctcgtctgagaggtatctgcccccctcccgtcatgcgacacctgccctttcaccgtatataccattcccgcactcgatcctttcgcataaattgaagtaccaccagtgacacatcatg

SEQ ID NO: 6630 - DNA, 700 bp, Nannochloropsis_gaditana
ggatgcgaagttttgagatgtcttgaatgatgcttttttacacgaacaccaagatctataatttgctttggctccagaattacaacgcgtttacttgtaaaattcttcggaagcaaatttcatagaaattgatcgttatcatggataataagcatggaggaaatgtgaagtctatttcggtgctctttcctgctctttcctgaagtgcgtgcaggaagagtacactcttaaaatggcattgcgttggctcgcactccaccaatttccatcccgctgctcatatgcttccccaagacatttagcttcgatctacttgtgcgaaaggtgccgaaggtcgagcgttgcaagccccttgcccaaggcaatccaggtgcgcctcggggccatatcggtgagcgcgttgcatgctgccgagacctgcaacgatggctttgtccccgcttttctgccgtttcgggggctccgcgtctcagaaacattcgcttagtgtggcaggacgtgggcgtgcttcctgcgtggagtgaagagatggatggccttagcgtccaactgtttccctcctctctggtaacgtactactagaagtactcggtgatccaacattcgatcctttgcctgatgccgccgcctcgacattctttttataaaccagcaaaaataccacgcctacggaagtcttaacagccagggggaggggatg

SEQ ID NO: 6631 - DNA, 700 bp, Nannochloropsis_gaditana
cactaaagtacgccttacgtgcactttgtgcatagggagtccttctggcgaccaccatgtgccacacgctccttctctcaaggacggggacagttgttgcacaatcatgtttgcggactgccgataaagtaatttggtatttgcgtgccacatcgtctgccgagatctgtccaagtggtcggaagtcctagcccaaattttagtggcatgacgcgctgctaacgacaagatgacctgagcgcaatagatgccaacggaacctggcaacgtggacatccgtgtcatgttttagtcgaactttagacctacaaaaatatagtacgaccctacaggcagctgtattacccgttactaatgtacactttgaattgattctcgcatttacaggtcgaccaatcattgccttcgattccgttccacaggcaaccctacacgcacaaactcacgtttgagaatgactaatctgtctggtattttacttgtcgccctcctaggcgtcgccagcattttcaccaccgtctcgcaagaatgtccaaggctttccctcaaggccaaagtaaggccgattgcgaagcgtgggatccttgcagggagaaggcagggtacgatcacaattacgctgaagagccagggtcccgtcgacaatctcgagtttcaattgaacgtcccaaatggcttatcggtagagcgaacagcgatg

SEQ ID NO: 6632 - DNA, 700 bp, Nannochloropsis_gaditana
gttcctcctcccaaagaatgcatcaggaaaaaggattgcagtgagtcgcacagctctgccgcctgacgaacagcttccaaaacactctccccatattgcggtccataacagtgatggccgtgtgcaaaattatttcccgcccctgagacgtctgttaatgattgatggctgtcaaaaagtcctcgtaaaggtcctcgaagggtctccgtgaccgggccctcctccatgtctactaatacggcccgcgcttttagagcgccaggtttgacaatacgatcccggactttcctagcagtcccacatatcaaatcatcgttgtcgtgaagatgaaaaaatgaagacatgctgtccgtaaatttcaattcaccgtggtcatcgtcctcgtcgggttggcaatgttcttcaagggcctgctcccaaaagcgtcgacctatctggttccctgcctggcccacttgcagcgtgatgacttcccgaggcattttcccaggaaatctattcatgcaatgacaaaattgtcatgtgagcgaaaaacaacaggaaaagatgcatgaattttggatgaggaaaacctgggcggccaggaggttttagcgatgcaacgtcgtcatgttgcataccaacagcatttaatcagtcacatctcacgccaggtcagggaggagaagcatttgcggcaagcaccgtgaggcctgcgatg

SEQ ID NO: 6633 - DNA, 700 bp, Nannochloropsis_gaditana
catgctggagccgtcgactcctcatttttctgatttttgcggtgcctgctagtggggtctgcgggagtgttttatgcccgctgtctacttgtccttcactttacacgcccacggacattgtaaaacgtatcgaagtgaccgtccctctcgatgccgccatcctacgatttaaaccatgctgtatagaacgcttgcacaagaaataccttaatttccagagagatggtattgttccagctcttataattttctagtgtgacgaagcgagagcgcccatacacataggcaaactcgatgtgatattttcaaaagcctccgtgcaccaaattgcaacgctcttgctcatgcggactaattagaccaatctcttacaaaatatagggccagggtcttgtggacgcgcaaggtgcgtcgaaagccgtgtgcagtccttcctgagcccatcccatctttcctcctgcgccgttttcctctgtagagcgaggccaaagtcgctgtatccctggaaatttctgtgcaagtcatggataatcttccgttagatttgttgtcccgtacgctgtcctttcttgacggggagtccttgctcacgtgcgcgtgcgtgtgcaaggacttttgccaattgacagaccatcgttcatactgggagaatgcagcttggcgacttttcccccatttgaaggaaacctacgacatcatg

SEQ ID NO: 6634 - DNA, 700 bp, Nannochloropsis_gaditana
aattttcgctcaaaaacgattgaacttgattttgctctgtgaagtccgtcgaaaaaatgtcagatgaagagtacagagtcggccccgagcgaagacttggacacaggacattttcttgctcaatggaagcactgcgagcaatcaatacaaagcaaagccatgcgatagatttgattgacaaggagggatgacatcgaaacacatcattatcagatagctctgacatgaaagctacaaggctacgtctaagttgctcgattgaggcggcaagggaggtggtaggccgacttccttggagtgcgaggagctcgatatgggccgaagggcttatcttaacccttgtcaacagggacgctgttaaacaagtccgtgagaaactcgatttccaacctgatcaatgtaagaaataatataattagtttgggtttagcaatggggcgggatttttttccttctcggcggaagggagtttgtcgggcttggaaaggaagatacttcgaacgacgtactcgctcgcgcttggagttgaggagtgtcgccgaagggccgctgatttatgaacgaccttgacgcctcatgtacgttctctgatcaatgctgtatgatatacagatgctttatttgagtcttttgagaaacgagggtggaagagggtaacccagactgccaatctaacttggtccctgaagccttcaagatg

SEQ ID NO: 6635 - DNA, 700 bp, Nannochloropsis_gaditana
agtacgtactctgcttgatcatccaatgaggctgatgtccctgcttccaatgccgctgtttggcgcacgcttgtaatagaggccatcttcgtggacaaggttggctgcaagaaaaatgcgcttgttgaggcatgatagcagcaacacacgaaagcgacggacaggatgcgcggcatcgaaggaagagcagaacagaagacctcaaaagcgtaaaatatccgccaaataaatgacaatcctgtatcaaaatccaaagaataagtcgtgagggacttacgtgaagcattttcttgccctcttaatgcgagtgagccccaaaaccaccggtaaggaacgacttgaagatgacgggcgagggtatcttttccatcataattagcgacggacggagcgacagctgacgctggccgccagccccatccctgcccccccttcccgcccaaaagccctgttcaaaaaatcaaggacacgtgcaccaatactcaagcatcacaatagccttgacatggcatgcgtgcactttacgagagatctcttgcatatgagatccagatgaagacctgacactgacatgacgcactcattgcccctctatcttttcgaaaaagtattgtcactcgttctcgatccccggaatctcatctccccttgcccgtttctatcaaccagtcatactgcgacgcagatgtcatcaatgatg

SEQ ID NO: 6636 - DNA, 700 bp, Nannochloropsis_gaditana
gacgctctggagatcgaaatgcttcagttgcagcgctgcttcaaggccatacgaatgcgcgaaacccccggtgggcaagtttgaatccagtaattgccagattacccacgagacagtggaaggggcataggattccatggggtgctcgcaggcatacaacgcttacacaccataagttctattcccgggggtgcatgttgctgcgacaaatttctcgatgcagtactttctcaaatgcaaacatgcctgtgtacgaaagatttgttgtacaaagtacagtcaaaattagaagcagggtgacgggtttggacgtcagcatcgcacgattgcaacgcctcaaaagcacacaagctgcagaaaatgtggacataaacatgaactctcaaaaatccatgatgccttcgggatgtcaatttttgtgcgccgtgtacggtttcttgatgtacatgcgtgcaaccaactggaccagaattgacatcaacttaatcgcggtttggctgtcgccactctacaggggtagaaaaccccttatgcggcacttcttctctttgagcccagtgcgtggccaaaagaatcatcttgatctcaacaacacctacgcatgtcatctttcctcctcccaccggtcaaagcagcgcaaggtgcatttttctttggagccacacgccgttcttcctgcctcgtcgagggcttctcacgc

SEQ ID NO: 6637 - DNA, 700 bp, Nannochloropsis_gaditana
cagtcgtggtacacccatgcaggaagaactccgtgcttcgccctcgccgtccccgacggttgccgcgtctccccccctaccatccgcgcaaaccatatccataaatccctcctcgagctcggaagagcaggagaaacttttccaacaagcagcacttgagcttggacaggcttggaaacaagcggcaggggtcaaaccaggcatggcacgtttcgaacgcctactccaaggcgaggatctagatgccatggagcggtgctggaggcagacggtgggaaaggaaaggctgaatttctggcatgtgcacacgtttttgggactgctgttggacgatcgattcctgaatgcacgtccccagagcggggctgttccggcagaatttgagggagggcagaagacagggggtaagcgcggggagacccttcgtcggcgcttacgccttgcctcgtccctttttaaagacatggtcatgcaaaagattgcacgggaaaggaaggcgggagggtcgccattggagggcggcgcgttgaatgcagccggggcgacggtgtcttccgacccggatcccacccctcaacattggcagcgtgtctacaatttgatgctgcgggcctgtgcaaacattgcagacggtgtgtgcgctttggaagtatgggatcacatgcaggagaccggtttttcggcgggagaagagacgatg

SEQ ID NO: 6638 - DNA, 700 bp, Nannochloropsis_gaditana
gccccccctcccccctccttccaatgggccatcgcgggacgcaaccaagacaaactcaggaaggtaatccaggaattggagacgcacaaaggcgtgcccgagagcaagtatttggagacattgatcgggtcatccgaggattcggtctttctggacgccttgacgaagcagacgaaggtggtggtcacaacggtgggtccctatgggaagtatggcagcaagctggtcgccgcctgcgcggcgaacgggacgcattacgcggatttgacaggagaggtaggtacatgagtgggggagacgggagcacagagggaggacgggggggaggaagggatacaggggagaggaagggagcaggcgggatgacgcagtgcatacagagccagggtggacaagtaagctgaacgggccgcatagaggggctggcgatggaaggaagggaaaggattggagaagcgaaggtcacgggtggaaagccacggagaactttcggagagacgagaaataacaagactaccttctccttcttaccttcccttggtaccccctgctcctcccactctcctcaggtgccctggatcgccaagatgattgccagccacgaaatcaccgcgcaggcgtcgggcgcacggattttgcactgttgcggcttcgactccgaaccctctgacctggggcccatgtgctatacaacgccatg

SEQ ID NO: 6639 - DNA, 700 bp, Nannochloropsis_gaditana
cgagacagcaccaagcaggttcacaggatcacgatttgcatgagcgtgtgacgcaatcattccttttcttgttctgacgcttgcgctgaaagccagcctcgtttgagctcgaggatgtattcgaggttgtattcatggtcagccggacgatggtggctgttggtacggtctccgtacctcctctttttcccgtttggcgtatgtgacgtttttgccgacaaatcttgtacatgtttcgataaatttacagcacagtaaatacatggcttcattaaagtgtaaagatgcggctttcactgtggaaagtcctgatgtgacttacacgggggatgaaatactggcaaaatatacgtacgagactgttgttatcgagggcacaaaggtaagaagcataggggagatcaaatattggtttcaaacatactcaactgcatgaagcaatagcaatcaaagtagtccggctccgtccgcctccgttatatttgccttcgcagcatgccaatgcgttgcttgcaacaaagctcagtctaaatttccccctcttggcaagaagaccgccccttgaagtgaaatcgctttctggtcatcctgttcaaagtctacttccgacttatggttcctcaaagggctgagtgcggattttttttggggggaggcttggtatttcaaccctttgcctctcagcattatcacgctgatg

SEQ ID NO: 6640 - DNA, 700 bp, Nannochloropsis_gaditana
gcgaagaagaggcgccaatagacatggccgagtcgtgaggatggctgagagagcgcacgctctcggttggggggttggggtctgccggtgaggcgtcgcgcagactgagcttcacatccttgagtccaagttgtttcaggaactcctgattttcacgaatgctctcctggcgtttcttctcgatatcagagaggtgctggcgtgcgttatccttgttgaattgagggaggtcggtggccttcgggtcgctgctagtgctgccagaacttgcgccgtcctccgtcttccccacctcgctcccgaagaaactgcgtgcacttccgcgtgctcttttcctcccatttcccgtgataaacgagaacatgacctagtctatgaatggtagggttggtcagctctattaagtaggaagacgtcaaagtgccaacgcgttcttcgtctcggcgatggacttgccctccggctgccgtccaggaacacggtaacgctaaaacctgaggagcacaagcacctaccgcacaattgaaacgtaacacgctcattccatcctttgttccattgacctcaggccttgattgcctcagtaaggtctgactttcttgaggtaatcaacgtatccgcgcaggcccagcaaccaacctcctccctcccttgggctacccccttggcgtttaccaactccatttccgcctcacgcatg

SEQ ID NO: 6641 - DNA, 700 bp, Nannochloropsis_gaditana
ctcgccgtctcctcaacggcttcaggggaggggggcaagacaacgaacaagtccccgggcccgctaggtgaccgcgctggggcgggcgcaggacagggccgcaacgggacaaagtgtggcgattgtagagtggaatcactgtagtggtacaggagaaggtcggtggtgtgcgcggtactgtgctgtgtgcagtgtgcaggtagacgggcaaaagcaggaggatcacgaggacaatttttgcgcgtcatcgactgcgcgcaacaggacgggccattcaatatcgattttaggatccacaagggacgctcctccgctctatgaggtcaggatggggcgttcctattggtttcctggtgggctctgatagtcagtctgcacggcaaaactgtccctcctgttccgtgcgccccgccccgttgcccgcgttactgcaaggtctcaatccgccgttgcttacctcaactattactatgtatgaagcactattgtgcaataatagcgtaaaggacaggaagtcacaagtccatcgctttttagggcacgctcatcatcttccgacgaaataatatgctaacgtcttcagaacccttatctccccaaatatcgcaacattccttttaatttgtcgtgtgtaggccccctctcgattccgaagctaccaataagctgcacaagagtgtgaaagtcaagggcaaggatg

SEQ ID NO: 6642 - DNA, 700 bp, Nannochloropsis_gaditana
catcatacgaaccgcgtcatcggtctcgagggagcacgcacagaggcccaagaaatcgaccctgctgcttttccccccgaatggtaggggccagggcgaccgtatctcattgaatagatagcgactttttttttccaaattataatggtatcgtgggagcagtaatgccggttctgcaggcgatcaaaggtatgtcttattcggggagccgtgcccgccggcctcgcgttgctggtggttttctagactcggtcactgggcgggaaaaacagctcctgagcgacatattttcatgatagagagagagcacttcagcccatcgcatggtctgtttcattcgaatagggtcccgggaaaaatgaaggaattgacagtggctgccttgttgaacacatgtaaagactacgaaaagttccctacgttccatctcttcacgtttgttatgctgtcacgtagacaattaattcttaaagctagcatggtcagcagacagtgctatatatgcgagtccatattgtcaagtcatgatattacagagtagtacgcgcgaaattgcatcctacagcattgctattatacttagcccctattaatatgaatgatcccactggcgatacactcacctccaccctcgcctccctcttcggattttggtagctaggcataagtgagcgcgtctgaaagccactcgacggctatg

SEQ ID NO: 6643 - DNA, 700 bp, Nannochloropsis_gaditana
aggagcgagagcgggcaagagagatagagttgctcaacgcgagggaagacgtggccaatgcagcaatgcaacgaccactgaagtgcatctgtttgcatgtatcgaaagacataattagaaggaggtgtgaactacaccgctcgggttgtcgaacatgaccatgacagcgtatttacatgcgtgtaacgcttcacgctaacaattgtttttttcattcagccttgcgttagatttcacgcagggacgagcattactagtgacttttagcagtcactatcacaacacgtccctcaagcaggaaatggacagcgggaaccacaggcactttttcctgacataagtaaaagtcttcctgtcggagcagagcagacgaggcaatacccacctaaatggtgttcacgtgtacagtctggccaacctcctccttggcaacactatcataaaacgtccacttcaaaaccccatactccgcatcattggtcttattgcaagatatggacatacaattcccggggtattgaggtcgtggtgacgcattttgtgatccgactcgctttatcgcgcgtggaagaagcgacaaactggggcttgcccggactcatcctgtgacacctgaagtctattgtgcctgtctgcatgctgtcaccgctattatcatgttaaaatgttgccacttaactcgaaatggctcaaacgtgca

SEQ ID NO: 6644 - DNA, 700 bp, Nannochloropsis_gaditana
caaaggaaggtgagatagagggtggtagtgaggacgagcaggaagacaaggaggaggaagacaaggaggaggaaagaacgaatgatagggcgcgagacagccgggcgatcgaggcgggggcagcgggcgaggagagggaggacggaggggcgcggaaggcctcagtaccctcctctcaggaactttcccgccctgcgcccgacgtaggcgtgacagggcggctgtttctcaggaacttacctttctcggccacgaccgaggacctggaggagctgttgcgacccttcgggccggttgcggacatgcacttgccgctggacgatgcccaccgaccgaagggcttcgccttcgcctctttcctgatccccgaggacgcagtgcgggccatggaagccctggaccggcggactttccaagggcggctactgcacgtgctggcggcccaggaggcgcccagggaccctttggccgacgccgacccggcccgcgcgcggacttacaaggaacggaaggagatcgaacgtcggcagcgggcgggggacgagcgggggtggaacgcaagctacttgcggagtgaaaccgtggtggaggcggtggccgagcgcctgcggctggagaagggccaggtgcttgaccgggaggggggcgacatggctgtgaagctcgccttgggcgagaccttcctgctggcggagaaccg

SEQ ID NO: 6645 - DNA, 700 bp, Nannochloropsis_gaditana
cagcgatcaggcatcgaaacgaaagtatagcacagtacacggagaggacgctggaggtacggctaagcgacttcgcgagcagagcgaagaagctcacttggtggcggacctcgggggccaggagaaggtcggggggacgaaggaagaggacaacgccaagacaaagaagcagcgacgtgtgagcaaggacgagtttctggcaacaatgatgccgcgttctcaaaccaagttttggggaaacgacgacgtgggcctcacatcggaggggcagaagctggatcgaggcgagcggcgtgagggactacggtggaagccgggagaggggagggaggggagtgaacatcggcggccatccggcggcgaaaggagaggcaggggtgttgccacggatgacggcgagggggagagcgaggaggagaatggggaggaggaggaggaggaggaggaggaggaggaggaagagggggaggaggacgaaaaggacaagaagaaatttgcgtcttcatcatgtgatgttggactttctgatctcggctatctacgatcgaaagtgaagaagggtttggacggagagattggcgaccatcgcgggggtcctggcctcgaggggcagcgcctggggggggacgaggagagggaccgagggggcaaggcaaaggaaggtgagatagagggtggtagtgaggacgagcaggaagac

SEQ ID NO: 6646 - DNA, 700 bp, Nannochloropsis_gaditana
gctttggtagaagtcaagcactgagcgtgaaccattgggaggaaatgcctgcaagtacgtgaaaaagaacgcatgtctaggtaacaagtgaaatacgtcgcatgcggattaaagaaaggaaaaaggcaacagcagcctcgaccgctcgatgatatcattcctgagattgaaggcacatggcccactcagggggcccggcattattttatctctaccgatcatttaactcactttaacgcacgaacagataaaccactgcgtattaaatcagacctgtgccaattacagaggttgaaacgtggcagcaagcttccaaatgagggcactacgtagcatctgtgtctccctcatcctccacttgcaccttgcgaaggtcgggaggggcttcatgatggcattatgggacacgtccacccctaaaatagatccaaattaccattcacgctcattgcgtgcaatgacaatgagctcgaccgaccgaagcgtccgtcagcccaagaaaacgatagcttacgaggcggctttaaaagacagaggagcccccgcggtcattctcgtccggccctacctcgacgagaatgtaggttcgtgcgcgcgggccatgctgaactttgggttgacagacctacgaattattgaccctttttgcgatcatctcaccccgatggctcgtgctcgtgcctcgggagccgacaacgtc

SEQ ID NO: 6647 - DNA, 700 bp, Nannochloropsis_gaditana
caggccaatagggcataggcagcttccttacaagacttgggcttgaacgtaataatcgtcatcccgatttacgtgatcatacccccaaaaaggaacaatttgggaggataaagtaagtaattgctgctcggtaaactctacaacctgtaggtctccctatagccaaagaaggaaatttaactttgactcaccatgtgggtaatgatgtgtattcaacaatcctcaaccaacaaagctgctaccagagcgaatgatgcctgctttcttgtgcgccgcaatatatatctgaacccgcaagccctgcgtgtgggaacccctcccgccgcgtcgggtttcagccaaaatttgtcaccgaagggttcacctccaaagcgctggtgaacgaggctgttgtgatgcctgtaatgaggactgcgcttgaaataagatttgttgacgctggttctgggggcaggcagacgaggcgggggggtacagggagagtagtgcccgtctggcagtggaggtggctgaaaccctagaaacgcctcctttttgctacggtcgccctcagtgaaggcgtgggactcaatgcacatattgccatgcaatgcatatctcaccaacaactcaaatatttcgggggcttcgtcatgtgctgctcataattcagccttaatgctcacagcaacctctccgcatctctcagacatacgtcatg

SEQ ID NO: 6648 - DNA, 700 bp, Nannochloropsis_gaditana
atccgtcattgactgtccttgcccgtctcgtacttgcatctctagcaccaaggccagccggagcagtagcagccgctaccggtcaaataatttctgtgcattagtcctttttgtttgcataaacgtcatcggcgcgacccctgtggctccccccccctcgttctggccagtccgaggtggcgctacgacctctctgacctccgccaagacggttgccagcagtcccaccccaggcacggggagcagcaacataaatacatcgaacaagagtaggcgaccgccagcgtccgccatctccaccaccagcatgcttgagactgacgaaagcccctccttgctctccgcgcctccaaagccgggcccttcaccctccacggcggccaacagcaccactgccgcctcctcggggcccatcctcttcggcgaccgcatcctcctatctcccagtcgaaggagagagaccgcatctgcctccggtggggccatgcctgcctcgttttcgcgcgtccctaccggcaccggccgccccggtcgatccccgaaaccccccagttcgcccctcccgcccccagcctccgccccctctcccccttccagcacagtcgcgtctccttctttctctctgcaccactcgcatcggaagcatgtgcctgttggagaagaggaagagggatccgtcactgccttggacctggcgatg

SEQ ID NO: 6649 - DNA, 700 bp, Nannochloropsis_gaditana
tgatgcgtatgtatcagataacatccgttccgcgattgttgatatttgggagggatggagaattgctggagaacaatgcggtagggtcacaatttttgagagaagaggcatttcattcttggtgggaggggagaccgttcagagcagggggaggtggatgttgtggaggtggaggatgcaagtagaagaagcgggcggtaggggaggtgatttctggaggtagacgcaatgcctcctagacatgttgacccatatgtttgcctctacagaatagggtgttgagttaaagcattcgatgaacaaactagatagatcgtacttgattcgctgcctgttcgtctcaagagaagagtttacatgggcctcggccccaatgcagggaaagtaaaataccagtggtcgcacaaaaatgtgccccaaacacttcccaagaatgttttgcgtcgggacgttaggacattttagctaaatcgcatgcacgtgcggggtgctaccaaccatgctgtctcctcatctgagaaaaaaagggccaggaggttttgttgacggccctcgctttctttcgagtatcttccctcaccaccacattctatcccatgtattgtggacgtgcaggggttcaacgccgttcttgtctctgctcttcattatgacacagctttttttgctcttgctttcttgcctcttcaggatattcatg

SEQ ID NO: 6650 - DNA, 700 bp, Nannochloropsis_gaditana
aacaagcatggaacgtttcaatttctcgacctctcggactcgactcatcatgatatggaggatttctatgtttccgcagccgaaatatagatttttacactgccctgcttctcgttctgtctcgtgctctatctgtcctccagatcaagacccccgcactggcaacccaacagggtacctgtgatgtatgtattcttaaagtgagtggtgtcatggaattgatcatgtcgctgtacagtttggaaggggggttgtcatgcccctgtggcacgacttgggatagttacaactggcaaatgccaactccagccgccctgtctctcgagtaatttgatgcagcgaacagaacgggaaatgaatatatacaagccaacgtcccatgttgaccatctctagctcttgcttaacacatattgagaacagaatgttctggccaatgccggacaaggatacttggagtgacacgcaccccccgcatcggagttgaacccttgactcaaagcagtgggggtaataccgttttcgaatagttttcctgcaggctgcgacgtcttcaaaggtcttgtgtgcaagtcttgagcaaagtaatttcctttattttgttaacctgtgccgggacgtgtcaattcccgattccccttatactcgcagacgcggcgaatcgctttctgtacaagaacacaggaacccgtctcccatg

SEQ ID NO: 6651 - DNA, 700 bp, Nannochloropsis_gaditana
cttgcaaagcacgggcgcaaaaaaaaagcgcgtctttcactgtgtcctagagaagtatgaagataaaagcttagacgtagaacaaacgtaccggtcgcagcgcccgaaaagtctcacgaattgacaggattgtcagttgacttgtctttctgacctgcacattcgcccagtccttatgttggaggaaaccatcgaggtgacgtgtgtacggaaatggcatcaatgaggccgcaggtacggggggggaatgtggtaggtagtcgaatgcaggcttcatttgacgaggcgaaggataatattggtgcgtagaggaatacaaagaaggggctgatgccgtcgaaaaatccatttatccacacctgtcaggatgaggccgtgtgtcagttgaggagagccgagcatgtggggctatcattgttgacgttgtagtgcatctcttgcttcatcggctgagtttcacttatcggtttaagcgatagacaggcgatatacgacgatcgcgagagtgagctgactcctactccccccaaagcgtatataagcgggcacgaccaacgactgtcgtcatgtggcagatctcatggacatacacttgccctattttctcccgcacatgcataggttgtacgactcatcatttttgcaaagtctttggagcggtcttgtcccacggcgctagcctcgccgcggcttcgacatg

SEQ ID NO: 6652 - DNA, 700 bp, Nannochloropsis_gaditana
gttgtgacgcatgagggcggggcgaaggcctaggagggggaagtaacctcacgtgcttggggagaggactgggtggtgcccacaaagaataacgacacagatgaaatgcgtctttcgtttgaggcattgtgagttggtctgggcgcaaacaggtatttaatgtgtgcgagacgagagcaacaggtgatgatggtcagcccgacactggtgatgatatcatctttcatttcaaccgagactaggagcggccattcatatgcgtaactgaactgataatgataaaatactccacaggatactatgcttgtagcatatgctggcctgtactgtcggactcgagtttgctttttattaataaagatgacattgaaatgaagggggaggaggttaacgaaacttgcttttaccgatcgaggtggtggataggtcacatcacacattccaatccctcacacggacattgacgaagtgtttacttcagtccaatcgctctctggttttcaaaagatgatgggccggctacgtcgtgcgtaataatgactgtgttttccgcgatatctctgaaggagcttcggctgcatgttcctgccagcaacagaaacggcgccaggagcgttgtgcaaacgataaaatttctattcgctcattcttatacctctctaaacatagtgacgcaagcacctgcattacatctgctatg

SEQ ID NO: 6653 - DNA, 700 bp, Nannochloropsis_gaditana
tgccgatgcggaggcaggtgtgggtgaaggcccgttgcccgaggggatgtgccgtggggaggaggtgtgggagggtagcagggagggatgaaggagctgccaaaagaagggactgacgcgaacgagccacgtgcatgactcggaaaggaagaagataagtacgtggcaagggacaaaaggccatgcgtgacgtcgaaaccaagggacttggatgacacgcgcggagggcggaaaattccacttggcggaccatgaatgctagcttttacgggtcttgtatgcgaagtgctaggcgctcgtctgctcaattggcctgccgctcgtcgtcgcacatctttgttgaaaactcctcaaaatgcttatcagcttttccaatccttcaaaatatgatccctatctcatgaacagaaaggaaggaaaagcgaagccccatcctcccgctgcggccaggcagaagcgaaggaatcgagcgtgatgatgcgagcccctctgccggaaaacacgccgccaaaacgcctgtattacccctggcgcgtggaatgaaaaaagaaaaacatttgctgcatgaattcatgcgaggcatcgaccataagaaatgctctcagtggctcgacgtatggtatgctcctgggaacaagcgaaaagcgagtcgtcgctgcaggcggtatcttgccttaaaaaataggtcatttttcgaatg

SEQ ID NO: 6654 - DNA, 700 bp, Nannochloropsis_gaditana
atcaccgacgtcaggcctgagcaccctcgcagtccttgtcgtccttacggtaatcaccgacaggatcggctccattgggagagcatggggccccggtctctccggcggccatgtccctaccccctcacaagcgtcctcgtcgccactttcctctagccgacgatatcgccccccgtacacgtgctatctatcggaaacgttccttccctcacttcattctgatgacccgcccttcctcccttccctccctccccctctttcccccttcccgttcagaaatcctgtcctttcccccacttccacggggagagcctccacccctccccccttttcccctccacggatcgccgcgctgccttcctgtgagagccccgccgcggcatgcgtgctgctgaattgaagccgaagcctttcgtaatgggccagctcctctgcggccacggagggggcgactttcgtggcggcctccaagagatcttcctggtagacccgcgccacgcattcttcgggggataaatgcgacaaaaacgtccccaggctcaacttccctccccccgtcccaccctccttcccctcctcccctccctcattcaagaccgccagctcctcctccaattcagccacccgccggcgcaatgcccgcatcaaagcctgggcggccacggcggaaaagtcggccccagtaaaattcgggggaagt

SEQ ID NO: 6655 - DNA, 700 bp, Nannochloropsis_gaditana
tggtggatcgccgaacataaggctcccagggcacctctacagaacagggtaggtctcgtttcctcctcgtcctcgtcgtcgtcctcgtcgacttcgtctcgctgtacgaacgtttcagaaaatagttggcatgagactctgtaggataaagcataatatgaatgtgaagcatgtctactgcactcaccagccaagcgaggcgtgcatcttcgtcttcagcccgggccatggaagtataatgctgcaaagctcgcgccgctgcgctgtcgctatttgcgctcatttcgcctattgaagtaacatatctatataattggtttgtctgtacggatacgcattgtccaaggtgcctgaaaggcggcggtaatctgttaatgaaccgaacccaagagaagatcggagcagccatgctatcaaagaagaaacgtctaacggcctcaagaggatgaacgtagagaaaactggatttactcctcgtcctaattacacacaattttcgaaaaattaaaggaatccctcttttacattgaactctgcgacgtttgacgatgcctgcagaaactttggctagaatgcatggcggcccatgtaaagcaccgaaacttcaaagtgttgcgttcttcaatctagtcacagcctgccccgtcactcaagcacgtttcttgacgtctgatcccactgcgcacacatcaacagcatg

SEQ ID NO: 6656 - DNA, 700 bp, Nannochloropsis_gaditana
  misc_feature (685)..(685): n is a, c, g, or t
gcgtcctctgacccttgctcctcctttaacacctaccttacagttttgtggtggtttcctccgtgactgctggcagggtgatcatgggtaagtgatgcttgctattttttccgaatcaaatgtggatgatttaacctcctctctcctgtcgcccacagctgcccgtgccccttgcggctttctttcacgaattgtagcatttcacaagacctggctttctatactggttttatttttgctatatagcactagtacgagcgcgttctatggcctttctggaccccgacgatcccaatttgtctttgttttgtatgcctccacgccaagcaaactccctgtcgtgggatcctcgttttacgctgaggtccggagacaaggtaatgatgcccatgattggatgtgagatatattacaggaatgttgccaatctcacctttaaccttctttgcccatcaagccaccgaggccgtgcaagctggattgaaagctggatttgagcagatggaaattgagtttcctatcagtccaggacgaatagatgtctcattaggagagttcttggacgactcccgggaatggacccgcgaatttgtccgaccatttacgccaaagggggccaaactttgggtgatatttccagacgggaaggaggcgaccttggcagggaaaagatggggggggggtnaattttcgcatcatg

SEQ ID NO: 6657 - DNA, 700 bp, Nannochloropsis_gaditana
gttgttgggtgttccgttagctgagcttgattagccaatgggatgcgggtgcatacaagagggggtaagactgtacttactttgccggaggtgcatccatgcttgagtgtgcagccaacctgtcaaagcctattctcccttgcaagtctgtgcgtgcgacaagaagggagtgagactattcattcgaagccgactttcacctagccagggcagcgagatcgaggtcctcgcagggcccatgagggcatgccctcgcctcgcactcggcgcccgtcgattctcgtcggcatccgagaccggggtagcgaacgtgtgcttcatgtccttctccgtgagttcgaagtgactaaggaatggtgcgagcgtttgaacatggtggcaagaactgggtttcaggtcgagcctcgccttctccttgtcccgagtccgttgctcgtgggggagcctaacggcgaggtgggaggtagaaactcatccttccttttggtattgacgcgaaatgcaacgcctccatttgccccaaaaacaggctatgatttcgtcgcctcatatttttttggccctgttcttatttttgtccggtcgggtggccatggcttttagctctattcgtcggccctcccgcacaaattctcgcccgtggctctgcatgacaacgacaaacctccaagatgagctaactgtagcaatcaatacggct

SEQ ID NO: 6658 - DNA, 700 bp, Nannochloropsis_gaditana
gagcgccactttataactccattttctaaggcgcacagtacagcatcattaaatacattttaaaagaaacatcgttgcaatctgttagcctatttagattaattgaacaacaagtacgcgcagtggcatggaggtatcccactccttccattccctgactagtctcgtgtttttaaactgtcgtttgaaaaaaccgttggaaaaacggtctgccttgccgtttgtggcgccgtcgtagtcaagcccggaaagatgtctttaaagcggcctggaaagccatcattgcccctatgtgacatgttatgcaatgtttcattttacattctcgatttcaactgaagatgcactgctgcaaagaaagcgggaggaggggaggcaagggatgagaggaagataattgcgtagcattagagcgtacacgccacttttctgtcattcgttctttggcaaaagggggactataatcaaatattatggcacgtcagatttttgaagatagaaaacttatcaatattgaacttcgaagcacgtgccacgaggcgcaactagactgacatgttcagcgtcccaacgtaatctttgggcccccgatcggggtcctccgtgccttacgaatgtatcgtatatgtcctttagcgctaattgtaattctttgatttcttttcttaccaaggacagctacatctctacacgaaggatg

SEQ ID NO: 6659 - DNA, 700 bp, Nannochloropsis_gaditana
aaagactccatttgagcatcctctgtgtggtaagagcgtgattgagtgtgagaggagcaaggccgggggcggggagctcggcgttgaagaacaaagagccgcttcgtctcgctgtaagcgacgccgagtagtttagtttaggatgttagctgcccggcacctcccaaacacttgaaaatggcatgatgcttgtacttgggtaagagtgtggacaaccctatagcaaggaccgagcatagtttgacgttactcctggacgtgataaagccgggtaaaacctcctaaccgcagcctcctccctcaacttggtggtagtagcaattttttggaaatgacttgtaattccggactctgaccatgacagtccctccactcatgttttggaaaatttctcactctttatcagatgtcccgtcccgttgcaaggaagggcattgcgaacggcgaaatcattggcccatcttcccgggcggagcatgccttcgtcaccctccttacgacggattctttcggcccgggagcccaggtcttacttcactcactgagaactagcatatcagccaaagataaagatgttgcaatcagacctgtcgtcgtagttctcgttacacccgaaatatcagagcgaacgcggaagggcttggagggtttctgcgatgaactgctaacagtggagcccattgccaacccgtacgccgaa

SEQ ID NO: 6660 - DNA, 700 bp, Nannochloropsis_gaditana
ttgacctgaccgtttgaggagaaatcatcctcattaaacctttatggaggagacagtatccgcacatgagaccaggtcgattaagcggaactgcgccaaccatatatgaaagtgaaaaaaattctcgcggccccatttcgtaccttttaaacattctcgtggtacaggaatgggtgctttataaaggtaattttactgcaactgataacttaacggacaggtttctgactatccacaacgtaatgaagccctatgctgcgaccaagtgtgtcttttataaggtataatttgagaattaaggctttatcgaaatgattatgtgtctttattgctgagctcttcagtccagtagtcaacttacagccctagccctggcttgcctgctcgctgggcgatgacccgctcactttttaaggacactttggaatggaaactgaaagcccctgcgcaatggcgttttgtgacaccaagacatctaaaaatatgtacttgacatgactttttgagttatctgatcttcccacagaacgccatcatgggtgcttcacggcttctgcacctctgcagcaacctgcttctcctggttatcacgacagcttacgttgtaccctccatgacaacaactcctacgtcttgggccagatatgcaaaagaaaagggtgttgcggtacggcgagaagcagtaggatttacaggcatg

SEQ ID NO: 6661 - DNA, 700 bp, Nannochloropsis_gaditana
caacattgctccataccctcctagagaacctcgaaacgcttaggagcgagtacatcagcgtcgtgtatttctttagaaatcatccatacatgaaaccgcagagaaaggatgatcgctttgcaagagcaagtattgtatctcgcttcattgtaagcgcacgctgtctgggactcgggatgctcgtacccccctggtcagacggcgaggtcgagcacacggcgggcatgggcggcaacattcgtgtcgatgacaccaaaaccgtcacgtcccgcggctcggatattcgccatgttttcaaaacgctaattgatcgagggaataatgcctcgtgtcttttcgcgtgtacagtgaagaaaaaaagggtactgcctgtccatgtctctaagtgcatttaagcagaaatataactgcgatcaggaacgcctcggtccccgaccgatctcctgatctattactactcctatcccccaaaaccctaaccctaaccatgaagcctaccatgcctaaactcagttctcatattcgaaccttttccgaatggaatgttacgagaggcatatgcaacatcctcttctcttgtgtttggaaatgaagaactgagcttagattccgctggcgtttgataaagaatctgaccttcccttgcctcaacactttcctcctttcatacgcgacacagttatcgtacctaagtgacatg

SEQ ID NO: 6662 - DNA, 700 bp, Nannochloropsis_gaditana
cgacgtgtccgtggcagccccggcccatcttccgtgccgtaatcgaagcgagcgagtcgagccaatttcatcgaggcgagagccgggcgtcaggcacatgttctgtttggctcccaggtacggggaaaactggccttttacaccgtttgcgctgtacaatggacatctgtgtacgcgtctgtccgccgaggcatggtctcacgtttttgttacccgtggtgcgttggtctatctgaaagcccaggttgtccttgtcagtacggtgtacactcctcttgttgagatacgcaggaactgcactctttctttatgcgagccaacctgcataaacaagcgaatgcgtcgttacgtgcttaaaatcggagtggctcatgattgcgataaaaacatgagtgtagtgtgcaaataagtttccttgaaaggagcatgaggcgaggggtaaaagtagggaaggagcagccggcactcggcccgactatcttccacagatgattctttgcttgttgattcgtgcgacttattccagcaacgtgcttgaaaatggacaacaccagcttattatgctgtgaagggtacaacatttccccggggcgtctgatttgtctttactgtgcacccttcattctgtaaaatcaaccttacagccaaaagcaagccaacttcaagctctcttgcagccccttcttgccttcaaaacatg

SEQ ID NO: 6663 - DNA, 700 bp, Nannochloropsis_gaditana
gggccaatactatcatttgattcttttattcgtatcgcttcacgcctttctccaagtgaggcccaggaatagaatagttctcatgttaaaaaacagttgcaagtttcatggagacgcttgtgtccccgggtgacggctgaaaaatagtaaagctcgtctcaaacccgagaatgtgtcgaatacaatcgacaacatcaacaataggactaaaaatgtataatgcggaatccatacatgtacatgtttcaagcacaaacagccaagcctttaggcggcaaaaacggagaggcggggtgttgaccaagaatcgggtagcaattggaaaccagtttcctattcatccacaatactgctcaccgttagcagaataaacttattctcatctatgagccgcggtgagcgccgttttcgtccgttacgctctttaagtcgctctgagtggcgcatgggccggggcgaaggacctccctgcttgtacatggggcagggcaggccatgctacttttaaaacaaccgaattggaagccattatcgtcggtcatgccattcgatgtgaagttaacaacatttttgctgtattgacatttctgattctactatcaaacagggcttggtcttaggctggcgcatatatacataagccgttaatcattcctacttcctgcagcagcggcgtacaagccgtcttatcaaagctatg

SEQ ID NO: 6664 - DNA, 700 bp, Nannochloropsis_gaditana
agagacatacatactcatcgctctcatcccttcttgggtcttcgctctccctcctcccgatcaaataattaattgaaattactctcctcccgtaccccccgcgactacacgtaccctttaggacattatgccttacaaacctgggtggggcttcaggccacccatctcgccaaaacattgcaaatctttctcggcagcctctgtctcgttatcttcccaacatccttcgggtttgcctccgccatcttctccttctcctccctcttctctacctcctcatcttctttcctctcctgcatctcttccttctcctcttccacctcctcctccgactgcgcatttcaaattaacgtttgaggatgattatgatgaggacaacgacactgacctctgtatcgaaacgaaagcaactgttggcgctacaatgagtcatattgacaacacaggggaaaagaaagagcagcagctgccccacacaacctcaaaattggaatcttcaatgatttccggacccaacagagagccttactcacaacctttgggttttgctgttgacctggaccgagagcttggagggaaatttcgaaatttatggccttaccgcatccttaacgaggtgcaaagtgcattttggccagtgtgcttcaacactgatcacaacgtggtcattgctgcaccaacaggtgtaggtaagaccatg

SEQ ID NO: 6665 - DNA, 700 bp, Nannochloropsis_gaditana
gctcaaaggggtagcgcggggagacctcgagctcgagcctgaagagtccggcggcgtacggcgttgactctggccctcggatgcctggaatgtgcaaggaagaggtgaaaatgcatagggtacattttccgtaccaattaagagacgacaactcaaatggggaaagtgacgagagcacgctaagtctgcttcacgattggagcgatgacttgcaggatctcctcatcgagtggtgagaaaaccatttccacacccaaacccaaggcaattctaaaatttgtatcccccggcatttaatcacagatcattactcactggcatgaaaacgggacaaatttgcttcatccacgggccaggccgccacgcctgggggagggtcatttcgaagcagctccagctcccgtgcaagccggctaaaacgagccataggcataagcctgccgcttaaaggtactgttcgtgctgtggtcggttgtggtgcctgtttgagcgtgcgtaggaggtaagagatgtgtgtgcggcgccgcagaaaatacgaagaaggcggggcgatgagacagagtgtactacctccagcgacgagcgacgtgcgccgcttcacgtgctcgctctaaaaatgacccactgagacacagaatgaacggaaccaatgggggaaacaaatgaacaaaccatgacaacgctgcaatctttgcacaca

SEQ ID NO: 6666 - DNA, 700 bp, Nannochloropsis_gaditana
catgcactttaaacgtagtgtcctcctctttcgatgctcgtactcacaaatctgagcactgaaaatgcttggaactgtgttgtatgcgtacgggattgtacttatgctatgttcgcgtctgtgcatttaggctggcaggaacatactgagaaaagcggaacatagagtgacgcacccctacgaaagatcttctaaaacattaacccgtttgccgcctagcatagtaaaccaaaaggtgcaaactacgccttgtgctatacaattttttatttcataacttgccacgttggaacaaatcttggaccccactatcctgaaaaagggacccttttttgatgggtttaggaacacacactacacaaccgaaatctcgttcgcatcatttaaagggtttttcgtgacaagtaccgcctgacaatatcagcaaattaacgaaagctacgaaaggggctcgcaattgtcatccgatgtgcggagaaataggctgtatggtcctgcaatgctctatcgcaagcgcggccggggcggcgattctgatctagtcccatgttccacgtcgcctaattcctgtttgttttgtgggttttcgcgacctcgttcacaatgggctccagccctgatatgacttttcggccttgccatacttgtagggattgacgattgatcttttgggtatcctgtcgtgcaaacggtggcgatg

SEQ ID NO: 6667 - DNA, 700 bp, Nannochloropsis_gaditana
gagcctcgtacaggccgctcataaagctgcccaaagaccaaagtttagaaaagggcgtgcaagtaatgcgtcaagccagcatcggaacatgccatccccctgtgcctcctgacgcgcagggagaggctgcctgctgcagtatctttcttgttgaccttcacctaggcatatgcccggcggagtgtaacatacgtggcaatttgaccacatagccagtgccaacctcccggaaaaggcatgcactcaacgccgtgcattgcggtaagtccggcacgatgcagggccggcagaccgcgtgtgcctaaatgccaccgtgtcaatactgccctcagctctgatattcaacatcacagaccgtgagacatcgctctcggcgacctggatacaatttctgcgcagtctcgttgaggtgagaaaaggcatcacagatcgtgacatatatcgctcatagcgacatggatacaacaagtttcaggtcaagcttaatcggagacatcgaagtctggtggatcgaagatgcctttcgggatatcgaatcacctacaaaaggagcaccactgacattctgctttaccgttctctttattaaatggcaatacctagatttttgccatgatggagttcttccgagggtagacgggcacacccagtctgatccgggcaacgagccctttccctacaaaatcccagaagaatcatg

SEQ ID NO: 6668 - DNA, 700 bp, Nannochloropsis_gaditana
agagcgtggcgtagagtgtccacgaacggcatagttgtttgtgatggatgtagatacgctgtacttagtacaataaagacgaaagacagcatgttacgtgcgaaagtgtacgggcgcaacaggcagaacacattgagaaattcttataatgtagagcggaagataaagcagtagccaaatgtttccgagaattagttggcgtgctaccatgtgtcaaaaggaatgctctggaagcagaacacttgaagttgtagggacataaaaatcagcccgcagagcatgcgatacatattaaaaggcagaggtcctcttcaatttagaacattgcatgttgcacatcaaactagatatcttgagggcaggtagtagccatcaggaacaagacccttctactcaggggagggacgtgcctttttttgtctccccctcaggcttgaagcagccggccacgcacccctcaagccgagacggaaaaccataacggcttgcacggaggtggtcggccccgcgcctgtgtgacacacactgaagctcaaaatttttaaaccacacgcagctaaatcacgtgcttgagtggtccacgtgattttatatcctgcacctgggtccacgtggcccttttcgggcctccttggtcgcccctcgccgagccgaagacagcgagcagcaagcgtagagtccaagaggacctgtcgccatg

SEQ ID NO: 6669 - DNA, 700 bp, Nannochloropsis_gaditana
acagaagaagtcgtcaggtgaaacttcaacctgtgttaatcgatgcctgtgcagggataagagccagataatatacggcggaggtttgaagggaatagatcgagagcttagcatggactcgatttgttagcatttctcctgtacatacgcgtggttgcggccgcgctgattttacagtcctcgggggcctggtggttggacgcaatgtcgaaagctgttcaaaaggaaaatgaatatttagactcggtcaagcgggttgaaagtccagacttcaccctctgctggcgaagaatgatagatcgcagcgtatggctcttttaaattttcttgatgttgaatggacgggtgctagcgtgggaacgtacgctgccagcccaacagacggcggtcggcgaggcagcgaggcaagctttagccaccactcagactgccgcaatcacatgccaccctccctctagcctcagttgtgcgataaagattaaacatcgcgaaaggtggtgcgcgtagtatggggagatacggtgatggggtgtgtaattgatagaggaggtggtatgctgcctcggaagaagacgacggctcgtttccctcgtctttgttccacgtccttgactcactcggcgtccattccgccctatatactgcacagtcctctgaaattacatcagataacggtttcagtagataggtcaagaagatg

SEQ ID NO: 6670 - DNA, 700 bp, Nannochloropsis_gaditana
gctgatggccaggaatttcaaatgcccccggttctgtgttcaccgtccgagttgtgcgacctcctcctggttgcgaattgtacgcgggctgctgaaatggggacacatgtggagtgggtcttggtctattaccagggccattagtccctcccgaggagcgacctgcaccaggataggatgaagacggatattgctgattcgaaatgctttgatcttgacccatgccaaatatttggctgatgttgatctcttgagagacccggggtcagactccccacagctaaagccgccttccccttgcctgaaatgagagagcgcaggggaggaaaagaacgacttcataaatacaaggggcccgaaacacaggatgcaagagtgcatcgagcagagcacaggcacacgggtctaggcagcacgtccctcagcaggcggggcgggggctggggcgggcggcagcgaatgagtagggcatgatgccagaggatcgccgcccgggtcggacgccggagatcttcggctgcgttgcccactgtgcgcgctgtgcctgcgacttcattcacggcatgaggggtttgcaggaatattcacctctcttatttttccctggggaatagcaatgcgaatcattcgcaagattgatcggtgtctccacaaaggcctcattctctcactcaaatccatgtgccgacagcgaagcatg

SEQ ID NO: 6671 - DNA, 700 bp, Nannochloropsis_gaditana
catttgcaaaggaggagagtgaggaggaggaggaggaggaggaggaggaagaagaggaagaggaggaggagggcacagatgaagatgaagatgaagatgaggatgagggcaggaacgaggaaaaggagtggctggaaaagaagaaagggggaatgagtggtcgaggtttgacagaagaggagcggaaagccgccaaggcccaacggaaagccgacaagaaggcagtgaaggcggatcagcaggagagacgcaaaaccaagatccccaaacacgtgaagaaaagcaggattaaagcaacgtcgggcgcgcgaaagaagcggtaaattggtggtcgaaaggtcgaattccaatgttagattagaaagtttccagtgggaggtttttcagtggtttgagatgggtgtcgcagaacacagcacggggagtgaatcggtacgctgcccagcttaaatactccaaatgtttaaaattttcgaagaatatggtgaaaataacggaggagtaaaacttgatcaatatgagattatgaaagggcgttttacttcgtgaccgcaaagaaaatgactgggcggtggacggacgtcattcttgcttgcctggctctgcgctgcatctcatcttctcaaacctcaacagacgatacaagtactaagcggagcacgcacgggtcaacctgacatgaacaacgatgaggtattcg

SEQ ID NO: 6672 - DNA, 700 bp, Nannochloropsis_gaditana
tacaacaggcaagtcagacccgggggtgtcgacgtggtaggctatcgtgtgttaacaagccttgcgatcgtcccccgcctgccgttgccagacacgacggctccgccgacagataattaatgtggtgcgatttatggccagcgcagacatcgggtcagaaattatccatgtgacataaggctaacattgcttttcagaagtctgaccctgactatttgccctttttctacttaagatgttttcctagtcacaaaggagtgacacttgaaaaccaggtcgccccgggcaagggcagacggcgagaccctcctgaaaatttttggaggaaaaatcttggcaccaaacaaggttccagggaaagttcattggccagctgtaaaatttctgcaggcccaaggccgccgcttcaaagactcttcaccaggcatcatccgcaatgccagtgtgatacatcgacatttatccccattttgtcccacgagtcccttccctcgcgggcggcaagcacggacacctcgggccgtctctgccaacgcgtcggccgttaggcaacgggcggatcggaacggttggcgatggcgtcatcgcaatcagacccggaggccccggagccgcgcttgcggccgtaggcgtgctcccactgccttgggaaggtggggcatggttgtctgtgtactaggtagcgagatgagggatggag

SEQ ID NO: 6673 - DNA, 700 bp, Nannochloropsis_gaditana
tgccgtacttgcccatgttcgagggcgggaaggtccaggtcgtcttcgatcaggcggtggtgcgggaggggctcgaaatcgacgcgagcgagaagcttggggaggtggagcaggagactgtgctggacgcgctcgagcgccgcgtcaacagctccaacattgcacgcttccgcatcgacttccatggcctggagggctggatctccgagaagattcgaggggagcgggaggatttgattgtgcggcgcgtgccggatacatcgcagggcgaagggagggcggagggaggggcagagggggggggattggaggctcagctgcaggcggcagtgcgggattggaagcggaaagtgacggggatggtggggcaatcacaagcgtcaagcactgatgaggatcctatggagaccgagacgcagaccctcccctccgtcggtgcctccttaccgcccccttctctggccgtgcccgacccggaaatggtctggtgcagcgaggacgtggacgagaggtcagagggggagggcgcgggggagggtgcggacccgacgggcgccttcccggggtactggcgctcggcccgattcatgcgggggggcgaggaaggtagggagggagggaaggagggagaggtgtgcccccccgtgccttggacgctggacgcggacgagcagctcacgcagctcttgaacgaagcagc

SEQ ID NO: 6674 - DNA, 700 bp, Nannochloropsis_gaditana
tgcggcggtaccctcatccgagcactgccgaggccgtcgcggtccgtcacggttttggggagggggggacttcggcctcatcttgtggatccgcccggctgcggggggaagcaagagccccagggcgccgcgtcgctttcaaggcatttgcgagtggcccgatcagggagccatgaccgcagttacgggcaccaagggcccgaatggctccctcaccttcacggaggaccgcttgctcgcgggctccgacctggtctggacccgtcgctttggctccccggcctggcgcccgggcctgacctaccggctgcggctgctcccttccacggagacgggggaggagaaggagctgtggaaaggccagtgcgagtttgagagcacggtcaagctggggggggaccgggtggccgtgcgggaagaggtgcatctccaggcccgggacttgttcgtgctggacaaagatgccaaggccgggggcatttctgtctcggaggacggcctctctgcctcatgctcctccagtgagagcaaggccttggtctacggctccctgggcttcgcccgcggcgtccactattgggaggtcaaggtggagcaggaggagatcgggtctatcttcctgggcgtggcggagaagccggacatgatggctcccggagcggcggcggccttgcggggggccatgcaccgttggcacggc

SEQ ID NO: 6675 - DNA, 700 bp, Nannochloropsis_gaditana
gctcccggggaggaaggtgatccggggcccggactggccgggaggggggcaaggggcgaggacgtcagatacgtctggtgaagcgggggcggaggagcggatgaggaggggaaagggccgggaagaagaagaagaagaagaagaagaagaagaagaagaagaggaggaggaggaggaagagcgcatgaatgaggatatggaagaggaagaggaagaagaggaagaggaagacgaggaggaggagcaagaagaagaggaagacgaggaggaggaggaggaggaggaaaacactgaggaagatgggaatggaagggagaaggtccgagcaggcggggacgtggaccaagaccacaggcaaggcgcgagtgcagggagcgaggccgagaaggaaacgttggcggcgcccgcctcgaagcccgagcccccgatactgggcgtcgtggaggaaatattggcctggaatggggagggaggcctggcgcggcgggtccgatgggccaacggggagacaggggtctaccggtggggcgcgaacggcgccttcgacctgacgcacgtggaggtggctcgggacggaaagacgattctgcggcggtaccctcatccgagcactgccgaggccgtcgcggtccgtcacggttttggggagggggggacttcggcctcatcttgtggatccgcccggctgcggggggaagca

SEQ ID NO: 6676 - DNA, 700 bp, Nannochloropsis_gaditana
ggcctgacgggcgcaggtgggagtagcggtggggctcggacgggggagaactcggccgcggtggcgacgatgatggagatgggctttcccaaggagtggtgccaggcggccttgcgccgatgcgggaacaacgtggaagtggcggtgaacttctgcttcgagcacggcggggacatggaccaggatcttggcggaggagcaggcgctggcggcggtggtggcctcgcggggcgggagtggaggggggggcgcagcgtggagaacgtgcgccggtccctggagaccagcatgctgatgaagcaattgctggagatggggttcccgacccgctggtgccagaaggcgctggcagccaaccacaacaacgtgaacgcggcgctgacctggattctctccaacggcgaggcactgagcgcagaggaggaggaagcagagggggagggggaaggagcggggccgggcgcgcgaaggtggggaggaaaaggaggaggaggaggaggaggaagaggaggatgggaatgcgggcgagtgggaagcaagggagggtgtcaatcctttgcgcgtagtgagcggcgaggcggagatccgtcccgatctggccgtggagggggtggccagcggggggttcgccagcgtgggctgccggggtaccctcgttcgcgcggggaaatggtactatgaagtgttgctgaggacggcg

SEQ ID NO: 6677 - DNA, 127 bp, Nannochloropsis_gaditana
cagacggaggtatgatggcgggaaggaggaagtaggtggccggcatccttcacatctgactcttcttccctccctccctccctccctcccgccctccttccctttttgctcgccttggcaagtcctg

SEQ ID NO: 6678 - DNA, 700 bp, Nannochloropsis_gaditana
tcttcaaaaagcatgaatttagatgaacaagaagctctcttcaggattggcaaccagtcctagcggtcaacttcctccagaacttggcatctgggtattggcttggctcatggcggcacgcctagagactcgtcttacttgagacagagctgatacatgcagagtaaaataagatagaccatacgtgatcagtgatggaatacccacatactattgccactgcacacgtcttgtaaagtggtttcgagccatgtcgggttcattcgtgttgtgagtcaacccgacagcgagtccccacatcgctgccactgttgccccgcaactcccaccacacaggatggaaaacattctttctatcagaacgatgactttgtcatctctttctattgaatgcatgatcgacatggagaaagtcttgcaggcgcgttagcgtccgggggctgatatttttctgattctagcatctttcccttcgtatgaccctctgtcacctacctccccgtcctgacaggttgctccctggcacgcacttcgtttaatcaaataagaggccttttccgacaaaaagtcgctgtttgtctagcgaaagatgcgcctttttttgctcttggttgctttcccggctctcgtctcttcatttgtcggaatgttacccagccggcacaagcagtcgcaagggcggcaatcacagcttcgaatg

SEQ ID NO: 6679 - DNA, 700 bp, Nannochloropsis_gaditana
gtacctcactacgtcttgttacttcgtggggaccgtgaacgatggccagcacctccgtctgtccttgtttcaaggacgccgagccatccgcattggagtaggtgcctaatgtacaatgcacgcgtcgaagctcatttggccgccgtccatcggttcgtaagcctgcaagggacacccattccccagcgcctcggcgcatgacgcttaatggcagcagccgcgtgacccgacgaaggcagaagcgagaggggaggcagtaacaggaatctaagaaatgtccgcaggaaaggagcacggggctcagaacgttgcaattcgacctcaggagacgtgtgacctataccactgtatttgtaaaatggaatgggtctgtgaagtcgagcaggatgctggcaggcacctggggaccgctggttggggtcggcgaggcgaggcagtatcctcgtgacttgttccattccacggacaaccacggtcatgtctcactccccgcgcttggaggcatttctatctatcccttgtgcgattctcttctccatgtgctccacgacatgttcttgcctccgataacaaattttggaaagggagggcatatggaaaaatttccatacctcttactgctcccgtcaggcttagtcacggctttataccattccacaaaagttatacagataggccaaaagagtccccatcatcaatg

SEQ ID NO: 6680 - DNA, 700 bp, Nannochloropsis_gaditana
cccgaagatacgagcgtcagagacatcttgcgctgctgagaagtcggccttcagcttcgtctaacccacacttacccgatgcgcgctttttcggcaacaggaattatggcaactcaagcgcagaagcatgaccgccagctgcaccttttgaagcccgaggaagttcacgtcgagcgtgatggcaagggcgaccaggcaagcacccgggcgagagtcgtagcagcctcgctgcctcgaagctcgatcatccagttcctggacagtacccggaatgcaatggtggaggacgagatcgattgcacgtcgcacgatgaagggtgtaatgtagccggtttgaaccctccaacacatcaggtgcgcatcagtgcctatttttctcatgttgcaattgttcttttttgcgtaagcgtgttgtgtgcggccggtcagtatagggcagcctatggaaagtccaacacaagcgttatgtacttgtcgtcaacatcatacctgagtaattaattacacattccttgatcgatagcagctggaacgcgaaattttgacctccctgattgacttagtgacgagagaggtctgtcacactgtgcaccgcctggtcaagactggtctcctaagtaaagacgaagtgctcgctcgacccgtgacatgcacaaccagcgcccagacttccaccgcaaatggactccacgttcccgca

SEQ ID NO: 6681 - DNA, 700 bp, Nannochloropsis_gaditana
cgtctcctacttctatcgcttgaaggtgaacagtaacctcacacaaggttcgggaagaaattgcatcgtgatcatcattacaaaaatcgtaatgcgcgtctccgcaagctccaaatccattcagacatttaaggcttctagcatgaacacatgattgcgaaagggaggggggaaattgctccacccaaaccctcgaattttttgtaagcgtacgagcctaccatacgatcctcgcgagtcgctcaccgtctccctcaaccccgtcgcaaaagcgcggctgaggaggaaggcaagatacaaaaaagaagtgcaatcagggaaaggaagatcgcagatgaatttttaatcatagaatttgacaaatctactaggcctgcgacatctttttatggcacgggcataagtatcgcagcaactcttaactcctcccccctgcctcggccccgggtgctcgctgtctccgccttcactttcccctcgagtgcttccccccctccttgatcaactagtaccgtgctcccggtccatgtaagctgtgcactttagtacgtatgttgccagtcggatttatgatgacagaagcattcgtacgcccgaagatacgagcgtcagagacatcttgcgctgctgagaagtcggccttcagcttcgtctaacccacacttacccgatgcgcgctttttcggcaacaggaattatg

SEQ ID NO: 6682 - DNA, 700 bp, Nannochloropsis_gaditana
acgttgcatcgccttacgagacgtaacagactctcgcttcgttggaatccaccgattctgtcaaggcgcgatcgaccgataaccaagaaatacgcacacaaatcaactcacgagtccttgtggcatgcatgcatacaccccatttcgccgtccccggtccatgcaccagtcgtgcgagtggcagctgggcgcggcggaggccggccctgagcccgaccaatcaggggccaaagctctcgcttgaaattttctccctcccttccggttccatcggatgtctctcaaatggacgccctgcacatgcacccgcgtcctcccgtccacctggggccggtcctcgttttctttgactggcatatttttgggtggaatgaagtgtcctacagctggatagcgtgtggctcttgagccgggtggtagcacggtcgtaaggtaggatttgaagatgggcaagaccggcgtcgaataaggttggcgagccctccggcccgaccctcatgtacgtggtttgtgtgaacagaataaggtctaataggttctgtgaagtcccattttcatatttgaatgatacgcggttacctctgctgcggacatttattccggaggctaccttgtcaaccttcataacgcgttgcatttcaaacccgacacacgtggttcacaggcgtctgagcagccacagcagctgctcggagaaatg

SEQ ID NO: 6683 - DNA, 700 bp, Nannochloropsis_gaditana
atccatgtcttctggagccaaaatccttctctgcctcgccgtactgtgcttctcattagcgcctgctggccctaggcttcgataaagcaagagcgcacatgagagctatcagcggacgtattcggtcccaacaagttgactcaataggtcctagggaaacgcatggtctaggtcctggaatgagttcatcaggcaagaaaggggccggacagaggagtcggggaagcgagcgatgggagttgaattgaggaggataccgttcctgcggtcgactggtctgcgtggaaataatgccccacaaggaaggataaatcttctccctcgcggcgtagcgccctcctcaagagctgcccaagtttaaatctgcgcaatctttgggccccaatatagctctgagcctcacgaatggcttcatggctgcctcctggttgacgtgcggagccagaaaggatttcctcttcaacgtgagcgttaaatgcttgtcccatgtccgacgcgggggcgaccccgcgtggacgtgcgcttgcagaacgtttactccctcctcctagacaatgaagtatgtggaatagaacacatgtactctcgtgtttggggatgtgcacgattatgagcgaggagaagtttttggtgtcaaaatcacactctcttccacctattaatcctacacgagcagatccactcccccttcttcaaaatg

SEQ ID NO: 6684 - DNA, 700 bp, Nannochloropsis_gaditana
gtacctagaatggctgcatttaaatcggggcgctgctggtttaggccccaagctcttatcacacttgagaatttcaatgagcggaaaaatcctaccaaacaggtgcctcacttgctgcgcatacaagcatcttttattgcgcttctatatcgtgctcgaggcactataaaatggaactcaatgcccctggaaaatggagggaatgaggccagcgcgccaaaactcagcgaggaggaacaatcgtcgaccgtacgaggcagtggcttgacgggccgcctgcagacactatgtgatgtaaacacacgggacacgtccttcaacatcgaactaatttgtcaagtcgatagccagatgacaacccgtttctgacacttagtacgcagaggggaggaattccggccgcccactcgatgggaatgcttcaaccgagggatgctactgaaagctatcgatttacgacaacggtcagaccaaaaatcgagaaataagccgccggggcgttttcttttctttgaaaaggcttgaacgaatatcaacgacggactaagcatggtttattgtgtatcatgtgcgaatattacgagtttggtggcaagaaatgatttcaggtacatgttttgaacaaatttgtcctttatgacacgtacccccgtataataaagggttttgaaagctagatgggatcaaaaatgtggctatg

SEQ ID NO: 6685 - DNA, 700 bp, Nannochloropsis_gaditana
catgggctgtcggttctgcggccagctcgacgtcttcactaagcacatgcgggaccaggaatcctcctcccccacgcagctccggacctgggtcgtgccctgcctctgccccgccctcgtccatcgccgatgcctggaggcccacgtggccgacctccagcaatccgccgaggcttgcgccaagccggccccttctcctcccacagcggccacccgcgcccgcacgcgccggctggtgggcggggacaatcggagccagcgccggtggatctcctacgactccgccctccacgcccctgcccccgccccgctcgcggagaagcagtccctggggccttgcgcccgctgcggctccctttacctccccggcttccggctgcccacggtgcgggagctgatcgctgtgacctgggaggacgagatggcgtggcggcgggcgggggactgccttctaatgtgggtcatgggggtttcgatcgtcgcgctctcggaggccgcctaccggggcgacggggagctcctgttttggcccgaggaaggagggcaggtgctcttttggtggatgttccagtacgtgatctccctcaatatattcctctccccacgcttcgcccgagtcgtggacctcctctggctggggcccatcttccgcttctacgccaagctctacctctacttcctcctcgccaccctcaccatg

SEQ ID NO: 6686 - DNA, 700 bp, Nannochloropsis_gaditana
  misc_feature (511)..(520): n is a, c, g, or t
  misc_feature (572)..(581): n is a, c, g, or t
gtgtcccttaccgggcataaccctctctatcccgccttggctcgggaggaatcgtgtaaagctgcccgcatggcccttcgttccgtgtctcctcccccttccttttcctccctcggaccttagacgcctgtacacgtggggctatggcgacggcggctcgatatccacaaaataggcactatgcgacctgcatccctctgtgcaacaaatagcgaggctcgcgcgcactgacaaaatgcgtcgatttaatctccggcgcatgctgccgctagcggtggcgacgtgtctggacccattattgaaaagtcttccacgcatgactcgtacaatcatgtacggaacaaagcgtggtgtatgatacaccagcacacggataggacattttttgcactgaagaaagcggacacgtatggccaggagaaacgcggcgataagcgaagcgatgacggcaatttaaaacaggcaactttaaggactttttaatggcggaaagtgaggatcaaacgcctcnnnnnnnnnnagctgtttcaacatccatgttatccagctcaagatccactatgcatgctaannnnnnnnnnaccaaccgccacctggacggagcaaaccgccgctggtacccgtggctgggactcgatcgcgtcctcctcggatggcacagtacgtgttcgatgccgaaagttacacacggtgcaccatg

SEQ ID NO: 6687 - DNA, 700 bp, Nannochloropsis_gaditana
gcgaacacgaaatgacgacatttttgaagtcgcgcgcgtgccgtcgtaatatctcgttatacacttgaaaatcagaaagtcacgagattgtttcgcatgtaagcacacctcacggcgaggttctcatgcaagtggttcgaacgcgtgctcgagagtgtgggcagaagtggtctcaggtaaccggatgccggcacgcgccacgcagagatgagaagagagagaagaggggcacgcgcctcaggatcagtagcctctcaccacattctccgtcgcacattcccgcctctcctaccctatccaccctatatttcctgcttgtatgggccatactttgtgagcgtaccttcggacatgcacgcatttcgaatgtttagcgatgtagcgaatgctatgaccactgctatggcagcagtattacaaacacttggggcaacggttttgaagacctatcaatggcgagcaagtacaaactattgtgaactcaaagcaagtacagcgtgcaacctattgggcatttgtgtggttcgatcttcacttacttgcccaactgctttgattgtcggcgccattcgcttttcaactttggccctctcccacaagcatttaccccggtaactccgcgtctaagcgtgcgaatatattttgctcaaaaaattcattcaagacatctcatttttttcgctcatgcattacaggaatg

SEQ ID NO: 6688 - DNA, 67 bp, Nannochloropsis_gaditana
gaagttcctggtcatagacgcgcgccctcagctctctgcacgagccaatcaggctgcgagggggatg

SEQ ID NO: 6689 - DNA, 700 bp, Nannochloropsis_gaditana; identical to SEQ ID NO: 4817

SEQ ID NO: 6690 - DNA, 700 bp, Nannochloropsis_gaditana
catgagatagtcaaaagcatcaataaagtattgtaaatttcattgagatctgtttgctctggcatagccaaaagaggtcgttgaacatctaagatggaactagaaataactacaaaggtctctaagcggtgaacaatgattaacaagagaatagtgggtgatgctgttcgtcgaggaggacaagagaatattttggagagggagctcgtgtgggtgacaaggtaacttcaccacgtggcagaggccctccggaagaggcctcgtgaggtgctgaaaaggcatgtcgtctagagacgtagaaaagtgtgtaggcagtgaagatcgatgtataattacaacccgtacagtatatagtactcatgattgccagaagacttcaagacagccagaccggattcgtccatgacgcgatgtcgatctcacgacttgacgggtactgtccctgccccataccattcgcgcatttttacaaaacaacaaaaaagaattgggaacatgacgcacgcgcatctccgctccatgctttcccaaagacaaaatttgaaaagacctacaacatcctttgatcttacaacgctcaaagtatcgatatgacttaagttgaagaaagactaggcgagtgaattcctcctcgagaaagtctccttatccctggcaggtaaaataatatcccgccaccatcatgtaccgatttctcaca

SEQ ID NO: 6691 - DNA, 700 bp, Nannochloropsis_gaditana
tctgtttgctgaaggtcagagattctcgcaaaatcggcaacttgcgccattttatgatcgtcgactctcccagcactccaaattgaacaaggatgaaggacccattcctcgtttgcagcttgcactgcgcaagcctcactcaatcaccacgccagaggagtgttttgaatattgctcactaaatggagcgcaaagtgtgcctttattattcacttggaacagcgctgctcgccagtgttactgctgtatgggtgtgtgcacccctttagtgtatgatcctgcgttcgacacatacaaagtacttgttcctgccaccgtatcacccacgtctagtccaagcaccccttccaccacaacttcgacggcgacgccaacgatgcagcctattgtcgaggatccatctttcatagatcttccctctaaatggcaggatcctaacctcttttataatgagacgatcgccaagaaaatgggctattatgctgctgcctcctactattgcagatcatccgcgtgcgagatgtgggcttgcgggtaattgtcgtgttttcaaagcttcaccctcaaagttttcgattctcaaaccttacgtgtggcatcttctatttatttgatggccgttctcttatactttctttctcactcagatcctgtgctcagttcccaaacatgactgtgcgtcgtttccataagggatatg

SEQ ID NO: 6692 - DNA, 700 bp, Nannochloropsis_gaditana
tcggataatgtgtaggaagacaagtaggagagtaaatggcagcctcatgaagctcaacttcagcgcaggaacggcagaggcctgtggcgggtgtcaaatgctcctgaacaagacaacaacctgaatgaaggagcagccactgaggccaatgcgtactgtggacggtatataggggcagcgtgaagatacgtgtatgaatcgtccgagctttaagtcgttttgcttggattaggggacggagcctgaggcagtacaggagcgctcgtgtagacctggtcaggcttcgtcaaggccgtttagtatgggacccaaaaattaaaatatgcgtacacccacgcctcagtgtgctctctccacactgcgacgtgcaacgttgccgaacctggccgagtatctaggcttgtagtctcgattctatgcataccatactggcctcggtagcaacctcccaccctggccgtgcttgttctccagtcttttccggttgcctcttgaggcagttccgaacgggacagggtgtgacatccgctgagaaaatgttctggcttgcttgatgcatgacatctttctgttgaagacggcagcggtccggctgacgctctttcatttgcgtggcgttgcttatgcctcgctaccctctccatttcgtcatacttcccctttcaggcagtgggaaaagtcgcagtgcgttgccctgatg

SEQ ID NO: 6693 - DNA, 700 bp, Nannochloropsis_gaditana
caggcgcgagaggtgggggggctggtagaggaggaagtggaagggagggagggctcgggggaggaagaagagggcatgcgactgagtccaccgctgtcggcggaggtggctccaggggaggtaggagtgaaggaagcgggggaggagcaggaggaaggaaggatggaggcggcggtggcggagatgcacgtgaaggaggagacgccggtcgggaccgagggtgctggaagggaggaagcggtggaggaagctagcggagaaggaggggaggaggggatgccggagggggtcggggctagggaagggcagggtggggagggggaggggctgacggaggagcacgaggaggaagagggggaagggaaagagggcgaagaggaggaaaacatggcagtggaggaggaggaggagaagggaggggagacattggccggcgcggacgaggcagggatggaggaagagagggaaggagaacgggaggaagagggtcgaatcgaggtacagcggaagggagggagggggggggggaggcgaagagtgcttctgcatggactctccatctcacctttgttgtccttcctccctcttgtcctccttcgagtagatccagaaggtggccgaggacgtggatgccctcaaggctcagatcagcgacctgaacaagtatgtagcctccctctcctcctccccgccctccctc

SEQ ID NO: 6694 - DNA, 700 bp, Nannochloropsis_gaditana
  misc_feature (1)..(697): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccg

SEQ ID NO: 6695 - DNA, 700 bp, Nannochloropsis_gaditana
gtggtcaaacggcgggggaatgtgggagccctcgccctgtcgaaacgtgtgaatgccgccgccgtgcccacccagaggatccagaccagcaggctacggagccatggacgtggtaaaagcatggtcatggcgcaatgcggagagcgtaattgatttgtgctcttcatcccagcgatatgcctttaataggccatgcctgcctcgcttaatttgtgttgcgcctgtgcaactctcctccagagtcgacgtgagacctagctcgcagacgccctcaagcgcagcagtcttttctcgcttgttcgcaccaagtcgcgtctgtcacgttgaaaataggccaatgacgccgggcgtgagggtgggaaaggggttacgtatgtttgttgacttgagttttcctctcggaggggcagctgctcgctttcacgtccggcgacgcgcaggggcacaacttctagaagaaaaccagcgatttaagtcccatcttggactccacgggggcatgtggtcctgcgtgtgtttttgggccttaaataaggtcgtagagttccccatgtgggctgtcgtgaccgcattaggtcttgaagacacaatgtccggtctgcccctcccgtcatcagcctcagataaagtatctgcttccgtgcgacgtgcccgcctgcctcctctctcatgcgtacattccccacctttcagacacatg

SEQ ID NO: 6696 - DNA, 700 bp, Nannochloropsis_gaditana
tcatgcgtttcgtcgccctgatgcgctgcggggtcgtgggttttgtcgctaatttttatttggagatggtgctggggcggcaactcgaatcgtagaagaacgactaaatcgtaatgctgccgccattggctcaaatgtgccgctcttccaaccacgcgtcccatcccacgctttcgcgcaccctcttttttaagcaagggcgcagagcgaaagagaagcggaagtcaggaccggaatatatggagaatttgagggcgatctcgagcaattttatggaagggccatatgctggcggagggcctagtttgaatgtgctgccccgggcggtgtggctttgacgcgttaagcaatgggttcactgacccattttgctgatatgcggcttgtgttgttagaactcaacagcattgtcacagcctttgactttttggagccagtggccccttgcctttttgccgaaatgctccgcgctttgaatgggagcgagcccgcgtgctttcatcttttcgactgaaaacgatttttataattcaacttacgtcgtctctaccctcacgtttctaccaaataaaattaaaaattgaaacagcaacaccagtgaagtagggtgaagagcaagccagggatgcatgcgcaggtttctagtgtcctagtgcggcgagggagcaggcatgcttgggcaagcacagtgatcaagatg

SEQ ID NO: 6697 - DNA, 700 bp, Nannochloropsis_gaditana
attacataagttgaaataataaaaatcatcttagcggcgaccttgcgcttccggcttcttcatcgtcttcctcgtcttgccagccacgcacaagcacgttgtccatggctgctggggtgagagtatgtccaaaggatgtacgttcgtcaatttttgcaatttttgcaattgatggaccatgatttgacatttaaagtggtggcagaaaggggacgtaggaccgcttaccctttactagaatatagtatatgggccagcatttcacggctcggtcatctggcactattcgaaggaaaagggtgcaaagcaaggaaaacaggcatggaacccaaatacagctttagttcactcgaccctggaaatttcaaaccgacggatagtttttggaggtttctcgtgctcagagggtctatttgtgttcaaagggtctggtacacgactccggctggttttcggacggtctagttgtgttcggaggatctataaagcgacgcgcctccatagaaggcgatcaaatcgacgtaattcaaaattcagagggacaatttcgtccgccaaattaatccacgcgttgctgacttttcgtgtatttgtacgacttacatacaaggagtcgtattttgccgtggcaccttgtattttgccgaaactcaactcattacgatgcctccctcataccacagaaaccaaagccacgatg

SEQ ID NO: 6698 - DNA, 700 bp, Nannochloropsis_gaditana
aggagcgagggacgggacgaggagttgaaagagggcgaggaggcgggggtggtggaggaggaagaaaaggaggaggaatggcaggcgacgccatgtatgtgttggcatggctctcgaccttccttccgactgcctgtgtcggacgcgagcaaggctgaccccctttccccatgtcctccctccactctcctcattcctccctccccgcccaggtaccagggcgaacaagcgcggcgaggggcgaggcgttattgattcccgacgagccacgtccatcataggagggacggaaagtgccactggtgcagcaatacttgaccttctgcttagaaagaagcactttttgtgcaaggagagggtcctatcgacagagcgggcgaaggaccggggcccctgcttcctcatccgcagacaatttccctgttgaaagtatcgcagcagatttcaccagtagcggggcaacatatctaaaagaaaggcaagcctgagaccagcagcaggcatggaaacacgtcaatcgacggcgagctcgtcgtcttcagtgcccgcggcggcagcggcggcgggggcacacgtgctttacagggggattatggtgcagccaatccgagacacgataaaaaagcggggcagtgttaaggttctggagcgagcggcgctgggagtggatggggtgggacggatttgctatttcaaggcg

SEQ ID NO: 6699 - DNA, 700 bp, Nannochloropsis_gaditana
gcatgtcccgcatatttctggatttcgcactcggttatgctttgcgccgtggcgactccgagagaccgcaacttccacctcccaccgtcgtccgtcctcctccctggaccgagtagcgccatcccacgttctaagagtatcaagcaggagcagcagtagtagtaatagtaatgagcaggctaggaaagggccggggagatcgaaagccacatcgaaatctccgcctcgaggcgcgaaacgtggtgggaaaagtagccgctccttgtccagtgcatcttcctccatggcgtccccggaaaacgagagggccgtggccgacatcatcgggaaaaggacggaggccgggaagaaggcgggcggcctggaggggtcgctggtccgggagagggatatgttgatctcagaggacgcgggtagaatggcgccccgggaggaggaaaaggccgagaacgatgacgcaagcgacggcgggaagagccagcatggcagcaatcaatcactacctctccttcttttaccatcttctcccccctcgcctttcaccagtccctcccctcctccctcctcccctttcgatctgcccgacgaccacctcgctggtcaccttcaacgcctctacgccggcagccaaccgccttccccttcctcctctctgggccctgataccttgcatccctactggttgaagcgcttgtcgatg

SEQ ID NO: 6700 - DNA, 700 bp, Nannochloropsis_gaditana
gccagtgcgtggatgtgcgcgcgcatcgtagcagcactttcttgtaaccgggtttcgacgtggtcaaactacctggtatgcatttgcggaacaaagacagggttgtgtattacgtccctcacaactccacagaatcgcatcaaaatttataaaaatgacgacaagctcttattcagcacctgttaaaaccccacacaagcatgcaggtcacatgtgagcgacactatcacgcaactctgttgccattatgcagggatcagcctcggatcggtgggccgaggtcccttttccatcatatcgccgaaagctttccattcccattgcagccccccacttgccctgcctttttccatgtctttaagaacgtgaggggccacgggacaaaaatcataggacacgcacagccgtagagagctcctttgccctctaacatgtcgttttcaatatacctcgggtcgtcatgtgttatttctatgtacatttatctccttcccccgtcccgacctcattcttatcaagacacttgtcatgacatacatcgtttaggctcgagcgcatgggcggatgggacatgaatggcaggaaatgtgaaggagaaagatggagggatgacaatgttgacgacatcttgctgaattcttcttggagcacacccgttcctctaggtgctgcgccttggggtatcgcacacacaggcatg

SEQ ID NO: 6701 - DNA, 700 bp, Nannochloropsis_gaditana
ggatccctgacaacggacagactcagatcagaatccgcggggacccttgaagaacggaaagggtgttttttttccacatatatcatcgggtcatttgttgtgtgaaggattgtatgcgcttttttggtgatgtgcgattctcatcgtggacaaaatatttgcgccgacgagggcctcaagttaggagtccccgggtagtgttggggtagagagctcgctttgtaagatgcttcttgaaatggggatccatgaaagaataatattactctcaagcttgacatatcctatgctgatataacataggactatgtactcgataaaatggagtggtcctcggcacgtttgccgtttgagtgcgttgcgtaggcgcctgcgcacgcaggaatcggactggatatattattacgatggatacctcgactcaatcactattccagccgccgagcatgtggttgtccttctattccctggtcccgagaagacggggaaagctcgaaacgatcttcgagaaaaagttaatatggcaacttccgacgttgtgcgagctatgctcagaattttatacgatgaacacttcgagtgttttcggaagtcggtcacaattatgtatcctttagttgttagactgccagaacttcatccatcatcagacaaataccttcctgcaattatatttggtattctcttcgcaaacaacatg

SEQ ID NO: 6702 - DNA, 700 bp, Nannochloropsis_gaditana
aaggcggcgacactaggggaggttaacggggaaagtgccataaaagaagaaagtactcgacgccgcgtttcatctgtgtccgcgcagcaaatctactcatccatacacacatggtgcagtgcgcttctacgtcaccacgtccatcaaccctgtccgcatttccacaagcacgctttacaagacaccgcgggcagctcgaatgtttggcacggcctccgccagcgccacgatccacacgcatacgtctgaccacctgcgcccttgtccgaccccggtcatccctatcttttaatccttcttttgtaccgtctcgttagcgatggcaggcaagaatgtatgtgtacgctagtgtagtgaaggacgctatcacttgggtggctgaactattttggaaggaggaattttggtagcttgcgctttgatcaccagatcgttcttatgaaaaaacgtccaaatgatctgaagactcattccattagtaatatctttcacatccaggaaattatgcgtctcctacatttcctctctttcgtctctctttcgagtgcctttcttcttccttccctcccctcctcttcctccccgctgtcaaaacggggccgggctctggcgtcttctgcttccgaagaactctctcgaaaggaaaaaagcaaggagcaagtccgttcgcttttgaaaggattgggtgaattagacgatg

SEQ ID NO: 6703 - DNA, 700 bp, Nannochloropsis_gaditana
gctaagtgatttcaaagggtagctcagagtgatacgatatttggaatgcaatgtacacgtatatggccgaattcgaattatagcctacaactctcgcttcagagcatcttggattattttgggtacatttcctttcaaaagcgctgcctgatgaagtattaacagcctccaaaagtctgtgctgcctataagtcaccttccttaaaaattaaatcacattcggatgtatctttccttcgaaagagtatgttctacagctctggagggagaccctgctccgtccatggaatcgtgccgtagaaatactaacgcctagcaagtttgcgaaagccttgcaaaagacgcaatatacatcaatacggagattaatcaataaatgcaagtccacggacgtgcaagagggtacaccgacaagtttcttgtcactggtcctagattagacaccagtgataaggaacaagatggaacgtacgagcgagagtgctgtccgctgccagtccccatcccccgtcctgatttgctggccgtcatcgagcaaatttacacgctctacagtgagttggtcgctggcaaaaggttatattgtcggtgggagggcactgatatacgctagtagctcacgattacgtttgtgtccctttccgcagggcttggtccgtgacaagattacagccacaccgccataccaccgtcaatcatg

SEQ ID NO: 6704 - DNA, 700 bp, Nannochloropsis_gaditana
tcctcttcctccttcccgccctccccatccccctcaggcctgctcactgacgaccccggcctctaccgcccccgctcgttcgcggactcccccatccttcccctcctcccgaccgcggcggaattgcgcgaaaagctgtaccgaacgggcggacaggggggagagggggtggactgtgtgctagccatgacgcaccaggtgaaagtgcggggggcgaggagacagggaataatgagacgaggggaggcgagaaggactcgagcggcagtgaaggcgggccgtgcctctcagccgtgaaatgggccgtatagcttgcgagcttcttgagtgcatcatgaccattttcgtcccccatgccgtcatcctcctcgcccctcctcggcggatccactccacactcacccaggccggcctccctccctccctccctccctccctccctccacgtccactccgccgcggaccgagagcttgcgcagacccgcctcttcccgctcattctaggcgggcacgaccacgaccccttccttgagacctacggcgagggagggagggagggcgggaaggagggcagccctggaggcgggtggagcagccggatcccgtctgcggcgtcgctgcaggagtggggggggaaagggagagggtggagggagaaaaggaggtgtcggagcggtgcacgttggtcaaagtaggcatg

SEQ ID NO: 6705 - DNA, 700 bp, Nannochloropsis_gaditana
gaccacttctcttgtcaaataccactccttttcatcgatttttcgatacatttgcaggcgctcggttactttcaaaaacaaggagccgatggaggtagggttgaggtacggttggcgcttttgggagggcatggaggagaaatccaaaaactgaatcaatgactaagggggaaatccaaaaactgattcgatggccaagaagtcgaaatgaaaggtcaggattagactggtacaacagacgtgaaaggcttaaaaagtacaacttttccaaaagcttacatgtatgttctaattcgctgctttatgtatcgtatcctgctggatggaaatgacgtgctcgaatgtgtgtcatgtcataggatgtttctcttgctgcttatcccccggaccactgaaagttgtcttgcggcgatttgtcgcgcatcaatattttttcaccaccaagaatgcatttcatcaaatatatatacatgtacatgatacgtgtctgcatacatgtgaaacatggcaccaagcaaagctattgaaccctcataccagtccagtcagacacctgtagatagatgttaaagggtccaaaatctttctgccgtaaccactgtctggcgtccgacgggtgggtctcggtgggttttgcctacccggatgtacgacaagaactggaaacattcgcctcggcgttcctaatgcccccaaaatg

SEQ ID NO: 6706 - DNA, 700 bp, Nannochloropsis_gaditana
ttagatgtcaacatactagatgtcaatatatcaggagcatcaggatcctctaaaacaaataagtaatggtgctgaagcaggattacgcaggacgaaatagaatgagtagtaaaaacgaatgatgaagactttttaaatgcgcgcgaggttctttcaagttcatttcttgatacgagctgtgtgtattgaaaacgtaatgggccctacaggggggaaccatgggccgacatggccgcgaacaccgagggcataaaaggttccggaaacacgtgtctaacacccttgccgcacttgtcatggagttctaagccttgtttggcgggatgtaggttttcatgtccgcctttccttcttctcgcaaagcatcatcttttggccaacatcaccaagcaacggcgacacatgacatatcttaatgttaaccctggccactccgcgaaactacttttctgagctttgtcgaattacttcagcatatcagaggtactatggttcccaatgatattaatttcaataccaagtcaatgggatacgacctattgtcgcattaaaaacgaagatgtaggtacataagcatgcggcgccgtcacggcacaggaggaaaggatacgtaccgttcgttgtgctatgtccttagtcttcgtttctaaatcccttgccattataaacaatccactcccacagcttcgaagagacgatg

SEQ ID NO: 6707 - DNA, 700 bp, Nannochloropsis_gaditana; identical to SEQ ID NO: 5269

SEQ ID NO: 6708 - DNA, 700 bp, Nannochloropsis_gaditana; identical to SEQ ID NO: 5272

SEQ ID NO: 6709 - DNA, 700 bp, Nannochloropsis_gaditana; identical to SEQ ID NO: 5264

SEQ ID NO: 6710 - DNA, 700 bp, Nannochloropsis_gaditana
ctcagctgagcgccgtccgcgggtggtgtgagtggtcatcctcctcccggcctatcgctcacatcgcctctcaatggtggtggtggggcctgatatgacctcaatgccgacccatattaaaacccagtaaagcattcaccaacgaacgaggggctcttttgtgtgtgttttgagtatgattttacacctctttgtgcatctctctggtcttccttggttcccgtagtttgggcatcatcactcacgcttccctcgaccttcgttcttcctttacaaccccgacacaggtcagagttggagtaatcaaaaaagggatgcacgaatgagatacgttaggttttgacagatatccttttactggagagggttcaagggatcaaatgaacagcgggcgttggcaatctagggagggatcggaggttggcagcgagcgaaagcgtgtccatccttttggctgtcacacctcacgaaccaactgttagcaggccagcacagatgacatacgagaatctttattatatcgttgaccttatgtggatgacctttggtgctgtgtgtctggcaatgaacctgaaggcttgatagggaggtggctcccgtaaaccctttgtcctttccacgctgagtctcccccgcactgtcctttatacaaattgttacagtcatctgcaggcagttttttctttggcaggcaaagatg

SEQ ID NO: 6711 - DNA, 700 bp, Nannochloropsis_gaditana
gtagacacggttgcgtcgatgtgcggtcatgctcttgcctgtcgtacgcgtcttcagcactgctcccccccgcactttggaaaaatcagctgacctgaccctccaagcctcacatactgctaccatgaggatagaaatgcatagaaagagctgtacacaacgcatggtactagtgtacgccctgtgttcgcagtagatggatagaaaaccggcggatgatgagactccgctatctttttattagcagtcagaaagcgtgaccttatcttacgtacgccgaattcgaagggctgcgaagttgaaagcattggccgtttacggtagaattgacattcttgttcggcggcatgctcctagcacaggtattcgtgcatttagggtcaatcttgtatcaccccaagaggggcgagcagacggcgaggcgagacgattcagggagtcacacgaaagatcttgttgttcctcatcttttcaagccatccccgaagaaaaatcagtgcacattcttaacttttcgacctcattccgctctcttctttgtcaaaaccattaccaggtcaatcttggctgtaaacttgcgtccgatcgccgtgtgtggctgtatcgaaaggtaagagaacgcgcgcacccttgcccgggccccaagatcgtcccattcagcgcggcgtgacggagctgggaattttgaggccgcatcatg

SEQ ID NO: 6712 - DNA, 700 bp, Nannochloropsis_gaditana
atttctgttcactgctcgctttcttttctccccatctccaagttcgtaatcagcgacttcagtgcaaattagggacttcatatcctgggcacaacaaaaagatcgctggcaaagcgatgtaatgtatttgagttgtgtgaaagctggctttaatatgtataaatgagcaggttcaacaagagaggatttgaaggttgtccgatgccgcgttcctggtagtctgtacagggcaactcgaacgacccaaaggaagacaccacaaggcacattttgatggaacaacgtcgcttattattccttttacgtgtatgaaccgaacagaaaatgttgggacttcggatattgttgtcagctatatggtcaaaccgtcctctttcctctctgtgtgctcagatgccgcctgcgagaggtctcgtgcagcacagctccttttttcataccaatttccttcgcaccagctctaattttcatggactctgaccccctgcacgaagccttttcttttatgagctcagttttatttgtcgacttggtttccagctgctgcccgtgtcggcgactccaagaactcgcttaaagagtgctagcacccgccttgcgttccctcttcccctttctttgcggcacacctctttaactcggttttctcttcagtgaattagccgtcactgccatattcaggtctgcgttgcgttagatg

SEQ ID NO: 6713 - DNA, 700 bp, Nannochloropsis_gaditana
cgtcctcctcgatcttggtcagttccgccatgggaaaatcgcgcaaactttgaatggtccgttgcaaatgatctttttcatacatcaaattttgaagctgaaggtgccggtcatcgacttccttcttcttggattgcatctctgtccggcaccccccgacagccatggcgctctctctagccatactcttgtactcgatgagtgttactgccgcttctgtgataagctcttgcatttcatcttttccggggacaggactgttttggtcccccaaggtacctttcaagcggtgcaccagctcgaccaaatcctcgtggacggcccgcagagtcgtcttccccgtcatgcctcgagtcgcggcactgccggatgaacaagctgagccccaggcctccaggcggatgacggtgagatgacggcgaagagcagggacagtatcctgctttattgagtgtgattggaacgaaacagacattggtcatgagttctctctccaggaaagtgtgaaggagtcgctggcgaggggtgctgcgaggggcggaaaagaccttgacgtgggtggcagaagtggcaaaactccgtgacacaccccagacggtccggactctcaaattcgaaggtcactgagtggtgtcagtcactgactgacgatgcatcacagtatttagacaagaaacagggacgagcccgtgataggatg

SEQ ID NO: 6714 - DNA, 700 bp, Nannochloropsis_gaditana
atccactgtgcgtgtcttgtacagtgagcgccgctacgggacgtcctcactcttgggtcagaagatggcggactggcagggcccagcgttgtatttctacaacgatgctattttctcaccacaggattttcaaaacattgcccgcattggtcaagcctcaaagttagataagcagaattcgaccggacgatttggtctaggagttaatgccgtttatcatagcacggacttgccgtcgttcgtctctggggagcatctcgtcatattcgaccctcatgtcaaattcctccctggagcaacgcgtcaacaaccaggaatcaagattcgtttcgtagataccgatcttttgtcacagtttcctcaccaatttgaaccctacacggtgtttggctgtacacttcagcagacattttctggcactcttttccgctttcccctgcgaaccgcagatctggcgcggcaatcggaaataagtaaatctcaatatgattcaacgacaattcgacaccttctagcatctttcaaagaaagcatctctcgtttcctcctctttctgcgcaatgtcgataacatcgaagtgtacgtagctcatgaagtcgacgatctgactttgaagcctggcgccaccgacaacagtctgaaagctgaatccaagcccaggctgctttatcgcgcgagccgatcgatggacactagagaa

SEQ ID NO: 6715 - DNA, 700 bp, Nannochloropsis_gaditana
atgctgccgcggaactgacaatgcggtacagaatatgcagcaggcaatctcttccgtcgtacccgtaatttatcagaaactaagtgcttcactacacaacccaagtgttatggaaagcgaacttcgtcggcatttgacagggccatgggtttttgtgggcgaccgcttcgttgaggcccagcaagtagcttttgcttctcaagtcaacgctacaccgtacctttacagtgtcccacctgatctggtgtgcttcgccccgctcttcaaggagcttggtgtcagggcctcttttgcacccagcgactttgtgaacgtgttgcagatgatggcggcagaaacatatgcaactcgctgcgaatttactcagacttggattgtaccagacaggaatacgaatttaagcaggtccgagaacgtatgtctcaggcctgctcaattagagctcgccatcacgttggtgcagcgcttgagtgacgagatcatccaagtttcggactgggaaatatttgccccggacgagggaggcaagttggccagggcaacagacttggtctacgacgacgctccatggctttccaagaaaattcaacgccgacctgatattcgatatgctcatcctaagatttcttctgtcaccggcgagaagctgggtatccgctcggtgcggaggctgctgatggagacgcacgcagacacgatg

SEQ ID NO: 6716 - DNA, 700 bp, Nannochloropsis_gaditana
gctactttccatggcacatctggctccgctagggtttgagagaaagggtgaaaatctctttttaaatcgcattgatgtatagaattcatttttatatgatgtagaaattatgtcatagctatagttgacacgctccacaaaggaaattgtagatcaaacgacatattcataggaaagtaaaaaacaaataggtggggatggctcagtagacagctcggaacccccgattcaaatttaatttagcgagcttcttgggcgtcagggccacctgaaagccacacaggatggaagaaaggtagtaaacatgcaagtctatgcattgggatgactcgtgtccaaggtggtgccctgtatgcgtgcatttttccagcaaacatggctttgtgtggaaggagacattgtggagggcccaggggcgttacaccgactgctccgttgtcacgcgttatggcacacaggccccgtcaatctgcccggaccgcagcgacgtgttgcctgaaagctcgcacgaagtcgctcatacctgtataacattatcatgaccagagttaaggacttgacggcccctgggctgtcgaccgcgattcttgttggccattgcaagccgaaagggagcttgcaacctcccggcaacaacaaaagacatttccatatcgatacacggtacgcctaaaggtggtccagtgcgtcctgacgcatg

SEQ ID NO: 6717 - DNA, 700 bp, Nannochloropsis_gaditana
ggagaaggaagaggaagaggagatggcacgtcaactggggtgaggaaaggagataggaaaaagagaaatcgtggacggtaagaaacccacagacaacgcaccctctccactcaccctgccacttttgaatttacacaacacatgaaagcactcacgttccatcatcatcgtccagccctcctcccatgaaaagcgccgcaatgcgtgtctccaccccagtggccgcatccagcatcaccacggaggcaggtaatgcttgttgccgaagagccatgccgaattcatactggcgttgtagacgtctatttgctcgggccgaaggaatagttacccctcttcgcgtgagagtaatgcgtggacctgcgaagcctaccacgttatgtgtccttcccccgctaccacttgcttggcttgctctgcgcgcattgcgagcaccacgcataacgacgctacccatcgtcctcattaccaccgccgtctgtgtgaatgtcaacgaatgaataaagagggggttacgcgagcgggaagacggcctgggtaagatactggcgctgcatgctcctgacgtgcatgtgacagctggcatacggcagagacatagcacctcgaacacgactacacatcctcaaaggccattttccattcatgtcagaggttgtagataccgcgaccggagggggaatgaaagcctgatgacatg

SEQ ID NO: 6718 - DNA, 700 bp, Nannochloropsis_gaditana
gcatggcgaggaatggccatgtccgcactgccagcacggaaaacgaaaaagttgaaagccgcgacaaacgtgacgcgatgtgatcactgcgacccgcaaggccgccgacaccgcaagggcctggcatcattgcgactgtgcctgacaaatgaagtgtgttttgcggaagccaagtttagacaggatttcattacgacagagttggggccaaactttgcaggtgtcatggcacgagcaaggaagagaaagagcgagtcgcgacgacacggcgatgatatagatgctcacacaagaaatatgttcgtccgccgatgttttagaatgcttgtggtccgttgtacaacaataatatataacctagaggcgtgtaatccgcttgaggtctttccgggacgaatttttacatctaggagctactcgattctccctcgtatgtcgagatccctgcatgtgtgagccccggcctctgttccagcaactcaccatccaccagagatgattgtcgagataaaaaacttgatgatgctttatcacaatcacatgactgaaaacatgtgtgattgcgcttgattctgcgatattgcctgtcatttctgacacgcgttactcccttcaagcaccctcctaggactttaagaacaaagtgaacaacatagcgacatagtatcattcggtcaaaagcagaatctatcggctaatg

SEQ ID NO: 6719 - DNA, 700 bp, Nannochloropsis_gaditana
aggaagctgcgggtcgctgcgaatgatacgaaaagcgagaagaaaaaaatgcagcaggagccgccccacatacacgtcctaaaatgcgatggaaatcagaaccttggtcatgatttttaattgtcaataattcatgtaattactcatagcgcggcctgcatcgattcacctgggagccttgggctttccttttggcaataaaattcgagcggcgctgccgttgactcgtccgctcgacgtgcttgttcgcgcctccgatccgagggcccatgcacgcaatgccaccgtgagatgccaaaggatatcaattatgaccgagccttactcttttgcatcttcctatctggcaactactccatctttaagacaggtgagcgatttgtacgtttcactgcggtgcatgccccggcgcctgtgaggtactcccgctcaggttctcgcgtcccgaggagctcactcccagagagctcaactactcctttctcgctccccacgatcgtatcgggagcttacctcgtagactacgatgaggaaacttcgactttagtgtcgacaagctacgagtgaccacggatataggttagttagcgcggaggtcggagtcatatgggccaagcggactaatcgagttatacctgtccctgtctcttactctccctaaatgtaggaggcgttgcatttcggggcagccttcataatg

SEQ ID NO: 6720 - DNA, 700 bp, Nannochloropsis_gaditana
gtctgtggtctcggaggaggcagtaggtggacaaggacggtattcatcgggggagcgcggtttaaaccatcgcacaagcgccacgacggaagacagcaggcaccattgttgcctcggagacccgcgtaccatggccagctcattggagtggggcggtgactgtatcgagggctgtgatggtggtttgaaagatggtgtcaccggccccgccacgcccccgtcgccttggctcatatttaaaaagattgatgtgatgctggtggtctaggaaatcatgatatgcgaccgtagcagttgcgcgctcaagttgcccgcctgttgtcgttcgtgtgcgagacatgcgtgaggaaattggatgtttcagtccttctcaggcccccgataagcgcctatgtcacaggtggagggctaagtttgaaaccccgagaagggcgaacaacggcgagcggaagggacacaggaggtcagtggccacggggccccggatggagtccctattgaagcccccccgacccaagaagccctttcaatgtattctcgagcatgcattagaagccttttgccacgggagggcaccatttgttcccgccggtgcgcgatcggcaaataaaaagtctctatcagcatagtatctaatacgtgggcgtacgcccccccccattttaattgcacgtaaatgacccaggaacaggccaccatg

SEQ ID NO: 6721 - DNA, 700 bp, Nannochloropsis_gaditana
tgatttagtaggcctaccactgctgcttttagaggatggatcagtcgtccaagttccttcatcgaaaagtaagaccagtgggtacatcctgggcaatgaggcgcaaaagtctcttcttcctcattgcaagaacatattcatagcaagtcgaacggtggaatgtttggggaaattgaaggacgaacccaactttttagccgctgtgggcttccgtaaattcaaccctcaagctttggcatccaatcttgacacaatactgccaccctcatggaaaaacctggtccgtttacagattgattgggatcgtatcccttatcccttgactccattgtggttctatcgcttttggcgggagatgccattggcgcaggcaactgagttgctggcatcgtggcccttggtgccgatatgcaacagcacagcggctggcacctccccacgtcgaggaagcatcgaactggtctcttgcgtgctgtccttacacgtgcttcgccttttgccagacttttgtgacacacgactacgggctgacttagaggctcaagatgccgaagcgtccagaagtgctatgcggacttgtgaaagtaatcaaattagagctgacgtggccttcctttcgaagaccgtgactgtcggtgaagaagctctggctcgtaataaatcgcttaaatctcacccccgtgacatctgcctagacatg

SEQ ID NO: 6722 - DNA, 700 bp, Nannochloropsis_gaditana
gcttggaaccaataccgtgaaccaagaccatcacatggggcctgctagattcgcctcggtttcaggaggcggggcgggagggactagcccgacgaagcgcggggcccagtttacccctaagccattctcttcatctccctcgggcccggcaggttgtggcggcggggattggttggaaaagggggcaaccaaagcagggcggggggaggtagggagcgagtcggcctcgatcgcccccggtgccttgggcagcagagcttttttccccgagggagaagagtctacctctaggcttgctaccgcccttcggcactcgttctacctcccgcaatgcggtcccagcaacctcagtccctcgcattctgaccaggaagggagcgtgaacagcaccagcagcagtgccagcagttgtgtcagcagcatcaacggcagtgttgtgggtggcgtggggaaggaaggaggattcccgtcccctggagcagtcttgaacgttacgaatccctccccacggacaaattttctgtcgccgtcgtcgcagcttccgtccgccggggaagcaacctcgtgcaccaaaaatccttacggatacccggagacaggcccagggacgggcatgaccacccatccctctccctccaggcctgccccgccccccattccctcgtccctccctgcgtcctcgacgtctcaacacgccatg

SEQ ID NO: 6723 - DNA, 700 bp, Nannochloropsis_gaditana
gtgctattttaaaaatgctcctaaacttgcctcatcttgctcaagacaaaggggctgacggggaggcctttctggaagaattgaaggttatggctttcgttcccaacggtgctttacctgtagcggaattaagacgagcttgtgagttatatgagcctatgcagggaggattggaaaatttgcttgatggagatgcttttcctgcgccagccctctgtacccctgaaataattcctcgccttcgggagcttggcctcaaagcctctctatctttgcatggcattatacttagtgccacttctatcgcatccatggctgggttggacgaaagagaacgggcggtaaagcgtgggagggacctcttgcgattcttagatcatcacattgaagaactggcagaggattatatggaaagacaaaggtctggctttgatgaggaagatgatgcgtttgatgatgtcaacgatgacctaaatgagtcttcaggcggaccagcatcatcgccagggcactgtcactaccgctcttgcgtgactcttcctagaactttcgtggtggcattgcgagctccatcttgggttcctgtgcggcaagcacccctgcacccgtcactcccttggccctgctcgtcatcttcctcgcgtgcggctctgcctgttgtattgccgccctgtcagacgcgaccacagtctgagatgtg

SEQ ID NO: 6724 - DNA, 700 bp, Nannochloropsis_gaditana
ccttccgcaaacatttgaaatgcgatagctaaggttggtactttgccgataatctccatgatagtgaggtgaaatgaaataagacctcaacccgcgagattcatcatttctttgtcgccatgatacactggcatgatacgcgctccggcgtggaagatcgtgtccaggaagtacattccaccgtctccgctggtacagcacctggccatgattgtagcgaggtatctttccaaacatgtacagatctcccggccacgtaactgggcaatcgttgtgttttccctcgtgataatgaggcatgtgcagtctcctgcctctccccgctaacctcccctccccctctcctcgctaccagcaacggttttccacggatcgagctattctcgtactgctaggacaatacctcatctatcatcgcacatcgcgcctcaacagtctcacaggacacaggcaacatgtgcggtccgcgcggttgctgacctaggatcatgagtaggactccatggcttcgtctgctgtctgagagggatgccgctttaaccgcaggccggtcactgaacgccgttctgggagacggtagcatttttcatttccgtactgaaacccaatcatgacgttttcagcgtcctggttctgtcctggtcctcctctagaggagggtggaggcgagaattggtgcctctacaatacatttaagatg

SEQ ID NO: 6725 - DNA, 700 bp, Nannochloropsis_gaditana
agaagttttttggggaaggacgtgaacgaatacgccactttcaagtcaacagttacgtttctattgagtgtccatgtggagtttcggcgacaaggggctggcatgtatttattgtgcctgatgctatcagggaggggtggatggggagtgaagaagtaaatattggcgcatgtacgcaatttttcaggtcaacacacttttcttggccggtcaggatcacttccccacaattatacgatgatatttgcaaggtaccgtgcgaaacgctgttttcgcggatggattacgtcaacgaagtgttcttttgtgcgaggtgtgccgagatggaacatgctgacctgcatcgccgcagcctctccctccaaatccctgggaaaccaagtcctatgcgctttccattctacctgccgccagggcatatgcttcacggtctcagcctcgtactgatgtgcatgaattgcgactgtacactctatggtggctgtgacgtgaatttctgaaggtccatcgcccattcccaccgccctcgtgccgtcacctcggcttcaacgttcgcagcatggtcgagataatgcctgacctttttttcacccattcacgcaaaatatgccactttaacacgccctctatgtaccaattatattcaggtgagagccctgccaagttggttgccgggaaggcaccttcttgagccaaaatg

SEQ ID NO: 6726 - DNA, 700 bp, Nannochloropsis_gaditana
caccggcccgagtacgaggccgcgctcaaggaggagcagcaggagcgcacgcgggagtcggagaccctagacgggtcggggaaagatgccttcacactggggctgccgaacgtcagccccgctcagcggtatgcagccgctgtgctcctggcggcggagacctttcgattcaaacgcagcgtgcctcgggttttgagcccgggatctgaggcggcagggtcgaaggtgggagaagagagcgtgccggggttgttggtggagggggaggggttccggcccatggagcagtcagtagtgcactcgagggaggtgctggccttcgtgcaggcggtgcgtcaccatgaggagaggcgtgccttgctccggtcggacaagctgctggaggatactacggagggaggggaggaggagggaggggggggggaggacggagcgagggggaggaggctgggaggagcagccgggtggccgggcgggctcggcccagtgggacgcctcgcagtggcgactactgcaccatctggaggtgttcagcctgggggcgggggtggaagggctgtcgagcacctcccagcaggtcctgaaggcacttggagagccgaccacgcccgaaggggccaagcgggtgctcctgcgggcggggtattggaccgagaggcggggcgcggagccggggcgggaggacaatgtggcagcgatg

SEQ ID NO: 6727 - DNA, 700 bp, Nannochloropsis_gaditana
ggtctccgaggcctttaagctggcaaggccaagccgctgcaaaacctcttccaaaaaccgttttggcaaacgcgatccacgcgctgtgcactcatttacatcgctgttgcagagcttcaatgatgtggctacaaattttgtatagcctgtcccttggcggcaggagtctagagcttccggccattaaaaagcaagcggaagcttccggtctgccttgaagaaggaaaaaggtcaacttgccggcccagcgtgcactgagagctataaaggggggcagtctgccgcgatgcctcacctcagtcgtccgagtggtacgcagggacgttcgacactcccaaccgtggttcatcttggccatttggcttcaaaacccctccctctgtagtcgcccggcacggccggctcacttgtcccgggcgaggcctctcccgtcggggggaaaagccactagatgggcggtacgagaacacctcgattgactggcctccagggcacggcaccgcattgaatgaatacgtttgtcatttggtgaaccattttttatgtcatgtgacggaagtgtctttgctgtttgcggcaaccctctaacccatgtcttggccgggctctgggagtatccacatgcgcatgaggttggctgggccacattacttcacccgacgtatttctaaccgcacgaccaccgaaacaaatttttagg

SEQ ID NO: 6728 - DNA, 700 bp, Nannochloropsis_gaditana
aaggtagggtaagctagcccttacccgtccggtgaaaaagacaagtatgtaacacctacagacatatagttcgtatgctccccctctgcatatatgctatatattaaaacaaatttcaaagtgtcgagcggcagccctgatgtacaataagcaaggtctcttcagaaagagtgggaagaggatgcggccgcactcggcacgtccgataatccccattgaccatgctttccactccagagccacacactgcatgttagcggattttttttcctctgcatttcccccaaaaaaaaacttattgcggaatgctgtgcggtggcctgaaacaaacgtaaggcgtcccacgaaggtccacggccgagaggaaggcgtcggcgctctcgacggcgtcggttggaaacccaggacagaccatttcccctctcttcattggtaccatgggcacttaccccgtgcctgcaaccatcacaacaacggtgctctcatacgtgggctctccggttgcagggcacctttctgtggtctctggtgttcgtgacgcctgtggcgcgggcgtcgggcattcgcaaggagcaggaaacgttcttctccgcaacttgccttgcactcgtcgaggagaacatatccataaagatttgcaggcgggagcgtaatttcgggaaacaccaacccattcgttgaacacaatcgcaacaggatg

SEQ ID NO: 6729 - DNA, 700 bp, Nannochloropsis_gaditana
gtctcctagaagaacttaagggtttacttttccacgaatgtgtcgttgacaattactcgtttgtttgtcgtaccgagtacacaactaaatcaatcgtccaaacgacaggatcattacagaagtatggaagcggcagaatgggaaattagcaaggagaatgtgatgcctttgaagcatgggcgcaatgtcagcaagctcaatgcaactttgtctgaaaagtaagtacgctgagactcgggttacccaagtctataaatctaggtcaattcgcaaaattagccaagtctcgatcctctccctccgtctattctcgtcttcattcttactacgcggtacacatgcgtttttgatcgtatattttctggataatttttctatttcactattaaaggccgaaaggtatgcgcgagagaagagctgacctggaaacagaaagacaagccttcgaaaaccggttgcaggaagtggaagagcgcttcctgcagaataaggagggggaggatcccttgagggagtgggtgaggtgagtgtgtgtctaacttgaaaatcctacgcatggaaaatatccaatgtgcgtgagcggagctgcttggaggggcatttggcggagggggttcaaaacggaagctgcttggtcacgcttgaagcgcgctgcccctccttttgcgccaggtacatcaattggctacaagaggccatg

SEQ ID NO: 6730 - DNA, 700 bp, Nannochloropsis_gaditana
gttcaacaagcgcgtagggtttagtggactcaagctacggcaagaattcaataaagctaactggggtaggcggagcgacagcgaggagaaaccggggggtaagcagggggtgagaatcgtacagcgttagtgcgaatcccggtggtcgggacgagcaagataccgagggacaaggaccacaagttctcgacacctttttttaaccaaagaatggtcaatggggcagtcgaagcgctcaagcctgcaggagctcgtttcttccttgcacgccgccggcgcctcgccgtctcgctagcaacaagataccaggctctggcgcaagataaggacacgcaacgtctcagacgctcgggggtggtgtctgattggccttgtctcgtccatgtcttactccaggcgtgttgaaacagaaagaaagtaacgcaatagttgcggaggggaacgggcaaggggacacgggctattggctggatcttcgcctcctgaggaggaagggcggatgacaaggagatgatcctctccagcctctctgaccaaaaggtcgccagctgtaggagaggcttttccaatcatgcaaatgccatttgtcaacactctcgacgctctcttccatgcctcccattcccgtcgattaggtgaggggaacgtccaaggtaacacgtcttcgacctcttcgtcagacccgccctctacactcatg

SEQ ID NO: 6731 - DNA, 700 bp, Nannochloropsis_gaditana
ctcacgccctctctccctccctccctccctccctccttcccccctcctggcagggtggacggcggagttctccttggaatggctccggctagtgtccctcccgttcccgcacacgcgtcctctccgcaaccccctgaacgacaatttacccatctcccgctctcggtacgcattccacagcggcaccggcccaccttcctcccccctttccgtgaaggttgaccagctttatttgtgagacgtggtccctccctttgaaacctttcttgccctctttccctccctccctcccttccttccttcctttcagcgattgccaggaattgacgcctgaaatcggtcgtcagctgctctacctcatttactcttcctccgaagtctctctcgccttagggggggctgaggccagcctacctgtaagtttcccttttccgtatttctcttcgccccttcattccatcttcgtcactccgccgcaatttttccgtcggagcctcttttggccttcttgatctttttcgtatcgtgatcgatagacatgtgaacttacattaagcgtcctgacttcccatgtgcttttcttcccagggcggtggcttcggtgggggaggaggaccctatggctcatttggggcctctgggggaggtcggggaggaggagggggtggaggaggggtgttggacgggggaggagggaatg

SEQ ID NO: 6732 - DNA, 700 bp, Nannochloropsis_gaditana
ggtttcctgtttttcttctccttattcggggaccctctttatcgaatgttacactcaacgcttgttcactttgggatttgagaaatatttaatatggtgtaccaagaagtatgaaatgtccttggtcgttgaaggtcaagcatgcatgtcgagctactctgtgtttgaaatcgtctgcccatgggcgcttccgtcccagcgcttgactacaaatggatgtcaataagctgtcttactcgaggccctagaccacagatctactcttccttttgggaagcattggtctgcattgcatatgggccagcgtcgtgctgcatgtttggcctgatttgacatggcctgcgctgtaactaagtgttaagggcggcctgatttgtcagcccagagcgtttgcattacaaagccctcgttttacactgctaagaatgccctctcctcactagagcacagcgctacattgcaattatcgagttcaatgttttgctcttcaaggatggttagactcagtggtcttgtcattcgatctttctggcggacaaattattccccgccgcagtgatcagatatatttcggtcgtctctaaatgcaaagcacttcatttacccacattcaaacaggacagtttcaacttttggcttgtccactccatattccctcgcaaaggagcaaagagacagaactgaaagtctgttagtaatg

SEQ ID NO: 6733 - DNA, 700 bp, Nannochloropsis_gaditana
gctctctacattaaaccctgtgatggcaccacaggactatattaagcgcttatcagtccttcctcgttgcgctccggatcaaatatcaatcttggacgtcaagccgcactcatgttaacagccatgctacatcttctaaaataatttcgaaaagaagaccgccatttaagtaggagcgctcacgtgcactctttgcagcttacgataattttctgtggccaatgggatcgtacgcctattagaaataggatcgtaagccgtgagcgactgctcagtgaggagcgagagtcaacgtgcagtcttgtccccagttgctttctgtggctccatttcagcgtgtgcttttgatttaccgatcttgaaagccctgtttccccttcgacaggcactcacaaggtcgtatgttttatcgaatggccggtttttacacttgtattcaagctctacgacgctgcgcatatctgggatcgaagtaatggagcccctgatttgaaatagggacagcattttgacacagactattgtctttaccttcttaaactttgatttcccgaaatttgctttttcggatgaagctagggtgtcaaaggtgaacttggaaaatctgtcgcgtgatgcagaggaataaataatcatgtcgatctgactctcaaccgttcggttccacaccactaggtgatcctagctggtcggtcatatg

SEQ ID NO: 6734 - DNA, 700 bp, Nannochloropsis_gaditana
ccgtggagggtagcgccgtccctctcacgccctgtgcgtcgcccaggggcccgacggaggggattggcccatatcctgcctacgtcggaggccttcgtgtgggcggcatgggtggggatggggactccgaaccagggcctcgcggccccctttatacacagacgtcaaccataatccctctgtgtgtggataacacgcccccttggtggatgttcatacacaggtatacggcaatggtgctcctggctaacaactcgttcctccccttcctcccttccgccctctctcccttcctcccctcaggtctccgtcccctggggcgaggtcaacgccgacataacctgcgcccacggtggcctcatgtacgcctttgctttcgtccttctcccctgctgccttgccacacacattagagcttcctttcccacctggacttctctctggcctgccctacacgcccgcgcgggatatatgtcctacccttgtgcccccttgtctctcctcgcgctgcccgcatggcctcgaaaatctccctcttcctccctcttctccctcctcttttcatcgtctctgacccttgccctccgccttctttgcctcgtgcaggcccgtacagcgcccttcccccggctccccgtcctctgtgccttcgtctcctgcctcctcgcccctccccctcgccgggagcggactcgtgatg

SEQ ID NO: 6735 - DNA, 700 bp, Nannochloropsis_gaditana
ataaagagacgtttgtgagttctctgtacagggtcaaccgactctagaaccgagcgtgggcgtcgattcacgctgcaattagcaagcacacacctctttaccggcattttttctacccatcactttggtttctgtgtacgttgccaccgattcggtagtgcacgagccattgcgaagcgtagcgagacgggggaaagtccgtgcaagcgcgaaatttgtcattttacagaaagccgcaacgttttggggtgaaactttgtgggaaatcactggattaagaaagggtaaataagctaagaaacaggaatctacgtgaaagagaacaagtggagaaagaaagcatttgtcctagcacgtcagcggaggcaaggcaggacacggacaagaatacccggatttttgacagttgaaagcgtgttacaagatcgacacaaggggaagggtgctgagcgcacacgtgggggtgagaaaagagaaaggacgtccaaagagacgcagcggccacagcggcaccaagaagattggaacaagaagttgtggagtacgaagattagaaccattctttcaccaagaccgagaaggtgtttctcgacaggagtatccagttagagctcgtgaagcgcatcgggcttgcagttgaggttgcaagggggaacccaagattctcaagactgtgggagcgaagggcgttgagcagatg

SEQ ID NO: 6736 - DNA, 700 bp, Nannochloropsis_gaditana
ctgaagctggacgcattgcaaccctctggctcgttcaaagaccggggtatggccaccttgtgttccacgttgcaacgccagggtgcccgacgcctggtctcttcctcgggcggcaacgctggcctctccgccgccctgtgcggccgtatcttgggcatgccagtacaggtcatcgtcccgtccacgacgaaacccttgatgttggagaaaattcgggcccagggggcaaaagtggaggtgtttgggaaaaattggaacgaagccgacgcccgtgcccggtgggtggtggaggagggagggagggagggagggcccgaggcggtggcctatatccctccctacgaccatcccttgttgtgggaggggcacagcacgctggtggatgaattggtggagggaggaagggagggcgggatggaggaagcgccggcggccatcgtggcgagcgtggggggggggggttgttgtgtgggatttacgaagggttgagtcggtacgaaggccgggcgggctgggaggacgtaggggtggtgggcgtggaaaccgagggtgccgcgtcctttgcggctggtctggcggcgggtgaggtagtgagattaacggaaattcaaacggtggccacgtctctgggggcgttggaagtcacgcctcgggcattggagtacgcgagaagcggagggcgggcgggagggcgggacgg

SEQ ID NO: 6737 - DNA, 700 bp, Nannochloropsis_gaditana
gcgagcataaggatggaaaaaagcttcatcgcgccgcaccaagggaatcgaaggacggacgggcagcctgtatgcctgtatcgggattattttccgttcatcatggggttgaacgggtgaatacggtgtgtcgagtccgggacgaaaagaaaagaagggaaggaaagcttcaaagtcaaccacaagaagacgctcaagatactccaaccccatgtccgtccgctttcctttgactctagctccgacgctctccccattcatgcgggggagacacaacaaggcaggtggcgtgaatgcaccgcccgtgttgggacgggtggcgggggttagctggccatggaaagggtgcaattaatttaaagatgactggcgcgaagaacgtcagtggtgggccctaggcatacatggcgtatatttgcgaggccgcatttatacctgatagaatcccgtctgatcatatctgtcttctttcccctacgtcgtccaatttcatgagatgataacacgggcccccgggaatcacttgcatattcccctttctttttgcatgaggtgtatttcccctaagactgtccgaccccctcgtatgtcgccgtcctcgcttcatctccttcacagtttccgcatcagaatgtagcacgtaagttttttacaccgtaaaactttatttgaccgttttcttgaccgtctgtttttgacg

SEQ ID NO: 6738 - DNA, 700 bp, Nannochloropsis_gaditana
atgagtatttgggaatctaaatgataattgtttgccaccagaggtagatttcccccgttccgagccactgatagagtaacttggggaccatgggtccatgggcctcaagacaagtctttacagcgcagaatgtacagggctgcatgtgccaatgatgcacactggaaaccgtatttaattaaatgctctgcttaaccaacaggtggaagctgtcgggattggcgtttcttggcaacgaaccttcaagtcatggaggaccttccaagtggcgttatgccagcagccgccgcggaaacgctacctgtagagatccttgatgcaaatgtgactggtcttccggtgaaaagtgaaattctggatggtggtgaggttcatgcggagagcatgggcacacgagtccgcaaatccagctccaccaccgtggcgagcaacaaaatgggcccaggcattggcaagtcattttcctcatcaagtcccagcgtgtcgacaacggcacctaatgcagtcgcgcctgttgacacatcgtataattcttcctcttccgctactgctcttgaaatcgcctttgaattctggtcgggactggatctatcaggcgcttgccgtgcggagctcgagcggcaagggcgcgagctcaaggaggcaaaggaaagcacaataagaaaccgaaaacgcctgacggaggcgaccagggaatgga

SEQ ID NO: 6739 - DNA, 700 bp, Nannochloropsis_gaditana
cttgtttttctacgtttaagctggagggtacgtaattgtgtttaatacaatctctacgcagggcacgttggaacaaagctttggcctcgctgtaagagtgattgatgctaacggagagatgaaaatgacatcaaaataaatgtcgaccctgctaatactacactgtttcgagtcaatgcttttattttaaaatataccctataagcagtttttagaggacctgatgttttcaaagcttatttggacttgacccattccatgattggcattaatatttgttttgaccacataaaacgtctacataccttgatgtttaacctaaagtatgattgtggagcattgctccacgcgacaatcaccgcgacccctagaaaggtcacagggagccatgcagcgagtcggacttattgagatatctccgagagagcaaagtacttgttcgcggccctgccgagtcttcaactctggaaaggcccacagcgggcacgtgcctgggtgcattcccacgcatttggtctgaatttcttacgctcaagctgacatgaaagtcattgaatgcttgcagaattttgttctctgcttgtctcttcttgtggtcagccggcttgaacgtcgtccgattagtgccttactagtatgagccttagcccacccgtttctcatacattttattgacccacccacagaatatatagacatg

SEQ ID NO: 6740 - DNA, 700 bp, Nannochloropsis_gaditana
gaaatgagttgcatagttgaacatatgcccagatctgtattcatttcgcctacttcctctttcatccatttctatgcttacccattcgagtcgactttgttaatcaactcctcaatatcaatcatcagtccgaagtctttttttattatatgtaccaaattttcccgcttgacatgtcctttcttgtcggcgcggcctccacatgcgacaaacgcgtctaccatgtccccgtcgtcatcaaatgccaatgctcgtactttctgcaattcaataactcgtaaaatctggccaaaatcaattgatccattcattccctcgtctacgtcggcaatcatctggaacaattcctcttccgtcggtttttgccccaaatgctccagcactcctcgcagtgaggccacgtccaatgttccagttttggccgtgtcaaaagttatgaaagctgcacggcaagcatcaatttcctcttgactcagaaccattgctatactaacgaatgagtgtcatatcttcctcgtgagatagttttttgggtcgaaaagttttaaaaaaatgtcgtagggtggggaggtagggcgagtttgtagcagtaacggtagaagcgagagacgtagagtctcgtccaacatgtccctgctctcctttcttacagcctccggaacccggccttatcttccaacattttcgagacattgtagag

SEQ ID NO: 6741 - DNA, 700 bp, Nannochloropsis_gaditana
tccacaatatcaacaagtgatacatgtacgcccgatagcacattttgttcgtgttgttgtccatgacttttgcaaacaaataactaaccctgatagtgatgtacagcgcaaaaattgctaagagaaccatttttcatattattactttattcatcgcaaaaaaagagggaaaatcttggcaggattacctcgatatacgtcgtatacgaaatatttgactgaggatcatgttcacaggcacgtgaaggggcttactgccccattcagacaatgtccactccaaatctctacaaagcttgacttcacgaggacaagcgagaattttgatgaggcgctcggggcattctgtgtgcctccgaggtgattttacgtcgattgcctttgaaaataatggaaagcaggaggacaagccacgtgcgacgtactcgcttaaacgagcatctccaagggcttatcccttctaagacgacctccctggacgacccaaacaaaaaataaactccacgcctacgattcccaattcaattctacaggaggcttttcagcaagctctgtgcgttttcgaggcgtggatcattttcccaaaagcttcgtggtcctctgtggccggtggaaggggaagcaagctctgccataaaatagcacatttcctcctgtagcatttcctggctccgaccttcccaccaatagcggcagaatg

SEQ ID NO: 6742 - DNA, 700 bp, Nannochloropsis_gaditana
gagtcgctttcaataccttacaggcgcgcttaatttgcacatggccgcaattatcgggggatcgtggcgtttggagctccaccagcgcagccggctcctgagtttctttttatttgtttcccttttcttacctgttaccgtcgaagccttcactgcacggatccatggatgtccaacgatgtcctccttaaatcgaccgaaagcttctggaggcagcagtgacagtcggagaggcggtacccgctcctccttctcaaccgccaatgccaagccctcttcttggcaacgtcctcgctcctcttcaagccctccttttacataccccatcccgcaaaaaaacccgtttccatggaaagcagcccagtctccccctccaacaccaacgcgcctcactcccaaatcaagcttgcctcctgctgtagatgttggtgcacgggatcaaatctacgagccgtccctgctccccccaagaaaaaaacctaccacactacttatttcggatcggaagcgtggtctgtgggttttcgaacaaccatttgtccttggtgtcgtggacgtgaaaaatcggatgagcgtccttcgcctttcagacggcggtttcgcactctattctcccctggctgccacaccggaatgcatcgacatgcttaaaagcctggtcaaaagcgaaaaactctctctgtcttcagcgtggttcatg

SEQ ID NO: 6743 - DNA, 700 bp, Nannochloropsis_gaditana
gctgctgagatctgtgtgtatacaaataacaattttgtcaccgaggtagttggcggtgacaaaaagaatgagtctgcggaagcctgacgggtgagggtgacgtgcacacgacagcaaatacagcgttgggaggtccggcagcaagaacagatatagcggagggttggctaggaaaaacataatgttcgttatttccagatggtaataaaaatagacatttaacaataatcagtatttatatggtcactgttgatacgaaaactacggccgcgaaataattctttcctctaattcccatgtctttgtgactccttagcccctctggatagatcatagtagttgaccgtgggatattttatcagtcgtatcgagcaattctaggggttgtgcatgcatatatctctcgtagacacaggccttggggtctaagcaataacctcctccccccttgtcttacgcggaccggtcgtagaccgggcgagaagagtcgcttacaagcccgcaaaaccagcccccccgcgtcgtgtatgtactaatacgtattactttatgatagcccacgatagtattggcaatgtggtggtgtcttcgggctcttcctctgcatgttgaggatttttctgtattatctggcattgaagacaatccccttccttttctgtcagagatttcagctttcactcggaacagacagcgtatg

SEQ ID NO: 6744 - DNA, 700 bp, Nannochloropsis_gaditana
atagaagcttttaccagtgtgttctctgccgcaattgaagagaccatggcacaggtagggagtccagggcgtaaatcaaccgaagtttttggaggcactgatttcatgacgaaagctgtcgtgaaagctgttgaggagctaagcagcacaactgtggacagcagcacgatgtcggcatacctgcgccgatcctgaagcgcacttgctctccttatctcttgagatttcctcgggcctcgcatttgggcaatgttatttatgcctgcgcctggtatatggtgtatgccattatgtgcttgggccgctctcccgtcctcaggggccatggataaccgtatccttcgtcctttgttttgactcttcattgaccaaaagcagtactatgaaggaaagatatgggtgaatgtggtttctggaagtgaaagaaagctcgcggatgatgactgaaaatggtattttgaatgcgatatttgtagcttagaagagggcagggggcttccagaccagctctcaccagctatgcagcagccagacaaataagaactctttgagattataacgcttctagatttcattgaataaatgtaccataacgcaaaaccacacttttaatgtgaacgtgtgcttgtttgtcagtcgcggagtactgaccaaatttccccccctcttcctccccgccctgccatggacaggaaacatg

SEQ ID NO: 6745 - DNA, 700 bp, Nannochloropsis_gaditana
cattcttattacaccactctagtaactgaggcaccacggcggcacggtcctgtgtttccgtgctgcttgtgctcgcagcagccgccatcgcaggttgggatgagcaggcggatgcaatggtgggagctggaaccaagaacgagtcgacattgcaaagcagcgttgcaaagagcactatgagtggagatatacaacttctcattgcttttgtggcgcctgtaaggaagaatacggagggcaggcaagtaagcgacggaagcggtgcaggtgcattcatggggaggtcgaaacccgatgacgatcgctcgcggtagggctctggagggtatcttgctatggcgctcggggctgcctttatgttcatcgtgtaaggttaaaggacccgactctgggaaatgggacgctatgactgcaacaagttacatgtttgagagtttgaaagttttgggatgatttttacgggctttttgaagggagctagtgcacaagctcactggaaagggtcgactatttcaagtgttcaagagtacccacattttacatgacacagccacattctcaacgaatgcttgtttctctcagaccaagaaattactgataaggacattcttgtaaagaattgccggctgctgtacgctttcgtatctcattcgcgttcgttgccttctacgacacctccgacccattctaagcaaccatg

SEQ ID NO: 6746 - DNA, 700 bp, Nannochloropsis_gaditana
cgcttctcggagcaaggaaatgatccttcgcctgcctgtagctgggaggtcacagctcacgatgagaacgaggaaaaggattgagaaggtacaacgccttcattcctcagcaattttccgtgtgatctccgcacatgctgccccaatgagggaaacatagagcttcaaaatctcgtagaactagagtctagtgcatgggggaggaagaaggcaggggcaggaggtcgaggtcccgccctcccatcggccgcaacatacgagaaccctttctttgttgcgcggttccatgcccgacttcttttgctacatcacccccgcataaaccaaaatactccttgctaaacattgacgctcctggaatgctttggcttggcgtcttgtcaaacggctgggtttaagcgacgaccgagtcgctgtcggggcaggaaggccaccttctgcagaaaacgacctggaaaaaggaaggggatcgtcggcaaccttacattaaactacccacatcgtgaccatttccatgaggcatcgatgatatcatgtttcattcgcaccagaggtagggtctcagtgcggtgctgtgcttctcacacgttggcctctcttgctccttctgacaggccggctcagggaacaaagacacttgcgtctccttcctctgcctcaccgccataaccagcaacgttccaccaaaataacgaccatg

SEQ ID NO: 6747 - DNA, 700 bp, Nannochloropsis_gaditana
aaatccatagtgcggagcgaaaaaaaggtcctgtttgcacgaaaattgggcctcgcccgttgcagtaacggccagaaggacccgtccccgcaacgtttccgcaagccggcgctatccctaaaaagcttgaagctacggtcgatcctaagacccagacacttaatcgcattgacttggtttttaattgttcgcgggggaatgtcttgggtttgcgacaaaaaatgcggtcagaccgcgcgcaccattttcttctccttgcgaggcacacgatgtctttcgcttctcatgacctcgctcctcctcctccctttctgttctgagacggtattggatggaacgctgtgataatgaatgaccgcaactaatgcacaatatgtttgtccgaataccataaggcgtcgataccacacgtacggttgtcaattcttttgacgctgtaggcgcatcacaaggtgtgaacaagtctctttgaggaggcccatgcctctctctactgtgatccatgggcatgaaccgtcgcaaaatgtgcgaagttaatcactattttgtgatgacaactgagaaaattttgtggtaaatgacacgatggctctcattattcaggtatctgaaatcgctaaattacaatcatacattcaatttcgtcttcttgctactcgtcgatcaaggtgaggcaagcatcgctttcagttgcatgatg

SEQ ID NO: 6748 - DNA, 700 bp, Nannochloropsis_gaditana
ttgaggctcccagactcgccgcgcctctcgcccttgttcttcaacagcagcctgggccagaggggggaaaaacaccttagaagtccttgacaatactattgccttgcacatactacgtcgttacgcacattttcacgatctgttgtacacagggtagagcagggcgatagccttgctgcatccgcgcagcgggcggtgaccaactatcttcttcactccccgtttcccagcgccaagatacttgtccatgccccccctctcctccacgccgttgatcttaataatgtttttatgctatggctccgcaccacgacgagttttgggttttagaattgtttggaactcccccttgcactatgccacaccacatttgggcgcgcgaacgtcaggttttcctcccagccagacagcgctgtcgacgtggagctgctgccctcggttggttcagtcatcccgccgctcacccttccagtcgtccaccctgcgtttcgccattcctgctgcttcgtttagcgcagggaagggtaatgaacggaaagtgaaggaccacaaaaggaggacaccgaaaaataaacacatcgacgaagacgaaaccaatgacgttcaagaaatgacagagacagagctgctcaaaataatgcagagtggagaggcaatggatgctgtatggcagcgaatgatgagccaaatggaggggatg

SEQ ID NO: 6749 - DNA, 700 bp, Nannochloropsis_gaditana
cgcagacggttctgaaaggtgcttcgggaaaagcctacaagaccttcgtggacagtggagaaaacttgggtgttgaaatctactacagcttgcactacctcaacctcacgaacccgaccgagctgttggagggcacagcgcttgcgcgcctggaggaagtaggccctttcgtgtatcgacaacaccggcacaaattgaacttgacgttcgcttctgacggagagacagtgagctttgtcttgcaaaagacatacgttttcgacgaagacgccaacgcggcgactggcttggtcgacaccgacgtgcgcgtgaccacggtgcatccagtgatccaggtcctccaagggcaactccagaacacccttaacgcgcagctcaaagagatcattcaccccgctatcggttggctggcgcctttgcggcgcgcgattgagcgcgaaatcgatgcctcgggtctctggaaggcggtgtacaagctagtgctctgccaaggcaaccccatgggcgtctctccctttacggtccagagcgcccgagatttgtattggggctaccataatgacagcgtcctgttgactatgcaggcattggtgggggccatagatgagcttgccaagcgtgtaggcaagagggtgtctctgccggtcatccccgaagccttcccgggactccagcccaacctgacttccgaggcggagac

SEQ ID NO: 6750 - DNA, 700 bp, Nannochloropsis_gaditana
gtccatcttctgcgacatgggcgacgacttcaccgtcaacgacacggacggaaaggaggctaagacgggcctgctcaaatccttcgatcccctgcctacgacaggcgagaccctggtgacattgcgggaaggagagcggcacgatctaagcaaaggggacctcgtctatttcgagcgcacggctaccgaggaagacggtcagacaaaggacgcagtccgagccggcagcgcggaccccgacctggagacggacacctttaccgttaaacgcatcgtctcgccctcatgtttcaccgtccctgctagtgccaaccttgtcaaacaagtccaccagtactccaacggccgtttccggcagctcaagcagccactgcagctcggattccagcctttgaccttggcacggcaggcgatgcggtcggtgcccaccgattttggcaaagccagcctagggcgacaattaaccctccatgcctgcttcgagagcttaaaaagattcaagacacatgcagggggaagactacccatccccgggagcgccacggatgctgcggccttcaaaaaactggtcaaaagctgcgatgttctgagcgacgtcatcagcagccactctgccgcaattgccgccaggtctgccgcgaaacggcccacctccaagaccagggcaccaagcccacccgtcttggacgagcagattatg

SEQ ID NO: 6751 - DNA, 700 bp, Nannochloropsis_gaditana
tgtttgacaacgataaaacgtgggggggggggaagttgcccttttccttatcaatgtcctcgagggataagggacagcgagtagggcgtgtcggagcccgttgcgttgctccagtcccggccccacaatgatagccatgccgtccggaataagtcgttgcgcgtccgtgtagcgctttttcttacaaattaccacagttgtttgactgactgattaaataatgcaggacatttggatagtgggcgttggcattttgccatctaagcccgtgccgtcctcatcccaggaacttcagcttgaagcagtaaggacttgccagaacaggctaggaaagacctcagtgcgaagaatgctcttttcacttatttacttctttccccaactggacacattatttgacaaggcgaaaatgttgagatcaagacaaagggacaagcttcgaccgtatttggtgctttacctattcctcatccatgtgctggtcctcctcgaacagcagcgtattcaagcctccatcgtcgtcgatgaagccctttattcgcggcagctttacgtcttgggactgcccgcgcagcaaagactggccgcctcaaacattttggtggtaggattaggtggtgtaggggttgaaatcaccaaaaatgtgatcctggctgggcctcagtctgtgaccctcatagacccaacaccggcaaggatg

SEQ ID NO: 6752 - DNA, 700 bp, Nannochloropsis_gaditana
gatacctttgccgtgcatcctcgataaataggtagtctttgtacatgtatgccgttaagaggtaggaccaggagatttaatgaaaaaagctggttgacagctcggatcgaggttgacgacgacgacgaacaacgtcttgaagttttgttgtcattttgcttgcttatttttgtcagccgcccccttcatacgaagcgtggatattaccaggttgtcattactacggacctaacctgtctaccttctcgtcttgggcttatttttactccggcaggtctccctaggtcagagacctgcgttcccccccagagcctcctcttgacaaggaacaggggctcacgtccttgtatccaagaaccttatgcccggtggtgcacgacgtcgccagcgacgtagggatggcgggagcttttggggtgatttcgcacgggcaggattagactatattttacctgtgatacgagacaatctgtcgcgaccggcccctgcagcatgccaccccggtaagtttcctcaaagtaatccttttcagcgacaaccagggcgagactacaaccgttcaaatggtgggtctgcccacaggaggcctccggaggttggcggagggacaggggatgagtcaatggggaggggaggcagtagggaggatgtcggggctccccatgagtgggaagatggcgaggaggcgcaggaggagatg

SEQ ID NO: 6753 - DNA, 700 bp, Nannochloropsis_gaditana
gacatttttgcccggccgtggctgctctcagccagcacaccatggtggagtttcccgggcatggtatgtactcgaggggcgcacagacgaatgagagccctcaccggaccacttcaagccgaaggcgtccgcgtcaaagaactgtcgctaatgtaatggtgaaatggtgctcggtcaccgcgcttttcggtggcctacagcaattatcgcgaggagacgcatttcagtccacgtgttcgggatcatctccaggtctaccgcgcgtccgctgcaatgccccacgaccagtttttttgcctccgcttttctcttcgtttgcgggcagcagcgacggaagcttcgacatgagttttgatgagtttttcagaagcgagacaagcaatgggaacgcgtgcacacccggcacttcgacgacctggcgggacctggcctcgcatcgcgcccccggccacccccccccccgtttccccgtcaccggcagcagctgggctctcctctttcccctcccgcctccccagctctggctgagacgaccgacgtggccctgccctccgacccgcagaggccgcaagccgcaaggccgcctctcccgggccgcctcggcgcaggcttccagctcggggactggcgggcgagcaaggaggagtctcaacacacgcaaagcctcatcctccaggcccaatccgagcctgcggacatg

SEQ ID NO: 6754 - DNA, 700 bp, Nannochloropsis_gaditana
attacttgccatttcagccaattcctttccatgcatgagatggcctttggtactacacgcttgtgacgacggtgccatagtggatgacacggaagaagcgacagcgaatggtacttcacgaatttaaagccttggaaaggcttgcattcccatccccacccctcatagccccccgttactatcagtggcagcctgcacgtacacatctcactccttcccacggactagcaagggctgcgaccaggatcgcattggatcgctctctggtcagagaggctaatgtacagacggctctcacgactaacctcgtataacttgaatttataacatcccgtttccatagcaggagcagccttacttgaggcagggtaggaattgcagtgcagcccatcctagtgcgattcgagctattcaaggcgagaggtataatcaaaacaccatgcatttatccaatcttcagcctggcctcgcctcctccatggcaatttcatccgcctcctcccatggccgtagaagacagcgcgttgctgtagcttcatctctcctagttctcgccgctgctgctgtgtcgacgagcacaactcaagcattcatcctgccaattcctccctctgcgaaatcttctccttccttctcgtcttctgccccgcgctttgctcgtcctaatgccgtggtatcggggaagagggtccttcgcatg

SEQ ID NO: 6755 - DNA, 700 bp, Nannochloropsis_gaditana
ccacgtccgtcaccatatctttctctggacagctcccgtcgcttcggtgggcaagcgcctccccttcctttgctttggcggccatagacaccgcagagctgatctcagacggaatattctcagccctgctctgtgcgagcgtcaatcttgataaacgccctttggatgcagtacttcaaataacttcttcaatacttggccggctcgaacgtccctccatggcaacaggcagattttgcgtcttactctatttgccttttttgaggagggggaggggtagagtgggctatacgcatggcattcgcttgtcatgacactcgcctccaacttcaaaatgtgccaggtgcaccaccactaatatttcagacaccagaaatacgcaggtacggacgatggagtaagaagcaggccagatcgtgccagccgtgttattcctaagacatgtctttcgccgctccatgcccgccgcctcaaattttcctcatacttcaactggcttgacagaccggaataaagcctggtgaattttcgtgctccggcacgcgagcacggacgttttttcgtgccttttctttatctaccctgaacacttccgatgctatctagctgaaaataattatctggcacgccttctccaccgttagtgcgtcggttgcccacatcgccgccaattccaagctcttctcagagaccggacatg

SEQ ID NO: 6756 - DNA, 700 bp, Nannochloropsis_gaditana
aattgttgcactcccaagcacgttactcaagcatagcttcggcacgactgactggaagaccgtgcccgcggtcattgtccacacacgcacagcctgtacaggtgcccatcgtcccacacgccaagttcacggagccgccgcgcgttgtttccttgcccatggaggaggggtcggtttttgtgtgcaggtgcagcagatatggatcaaaatctagccaagacacaccggggcttagcgacggcttccttctatgggatagcccagatccgctgagtttaaaagccgcttttaaacccccttttcccacgatgcacccatccgaacgctggtgcatgatcatggtgccgttttcaatgccctcgtggtctcagatcgcgccttgcttgtttcctcgggtggatctacactcgtgaccaagtcactggcatggtctaggcttcaaccctcgaatttttccccgacggcggcgacggccgaggtgcggggacatgcgggacgtgtttttcacaaattacgggctttttccacccttgttttggctgccttgaccagtttcttcttttcaatatccacaggggaaaggagaagtgtgcctgactagaaagtactatttttatgggcgacaggattaggaaagcaatctgcggaccaggatactgctttgcatctctcgtctgtgcgaaaacgggaaagaaatatg

SEQ ID NO: 6757 - DNA, 700 bp, Nannochloropsis_gaditana
cgtcactcgctaccttatattttgcacgcttcgacgatttcacaacatttctacaacattccaaccaccgagccaaacaaaaatctcacacaacacggagaaaaatcccaaacagggtgacatactggtgtatgtgtcgctcatagcgtcgtccaggcgagcgtcctgtcacggcatgagatagccacgcactggagatctgaacggggcactgcaacccacttggccatccacataaaaagtcaacaaaccacacttttccccgaacctgaccgaagacatgacgcatgtctttgtcttgcctgaatattagcattgagatgggaagggcgatgggtgcggcacatgttttttttgggtcatagctgcgtcctgtcgatctctttttcttgctcgtcatcacgggaggggacgacgcggtacttatcatgtgcttgctgtggcgcttcttttcatgcctcttttttcaagaaggacaagatctttgacctcattctctgcagtatacgtacgtccaaacacagataagaccatcctttaagtcgctttccaggtattactaatttggcacctgcttgcctgatctacaatcgcttgtcctcccccgtgcgccccccgatctccaccagccgggccaacccctcttcaaacccttcgtgttttacgaatccatcgctgtagaatctccagtctaagcatg

SEQ ID NO: 6758 - DNA, 700 bp, Nannochloropsis_gaditana
gacgacaggactaggaataacaggagaacagtgggaaggacgtatcggggcagaggcattcctgccctacgcagcgcaaagcttgtgctatcctgaacttcttctggttttgtagcataacacaaaatttggatacaaagacggaacaaatgacaaaggatgtaatatttaatacttctgttatgtgcaattgtcgtagttcttcgtcgggggcgatggcgtgttgtcgaggtggggatggccggctacaatccaaggctcctctacaaatagaccacttcacatttaagggcatttagacggacgagaattcctcaaatatttcacctgcttataaatcacatatgctgctgaactgtgcgagggataggccctgatcttgccaaggagaaacactcagtgcaggcgctgggagaccgtttttattctactgcaacacacatttcagcgaccgccatacgacttcctcctgcgtcacatatttgcaatctcaattggaatctgcatgcaaacctgggcgtgtttggttatgcacgtcatctgctcgtcgtgagcgacgtgcgtgtacctcttgtcgtacaggtcgcaaatggaagacattcgtgccatgacagtggtctcgccatcatgtcctaccccgtcatcaccgtcccaccgcgcatccgtccacccaataatcgctttcactccatctccccaa

SEQ ID NO: 6759 - DNA, 700 bp, Nannochloropsis_gaditana
cgtgacgaggataatggggaagaagtgccatatctgctccgactcccgctcctcttccgctgtcgatgtaagctacggctacggcttcggctgcgactacgtggcatgcgacaaggtcggggagacaggaagcaaatggagtgtaatgaggaaggcctcctcgttcgtgactccgccgctcctcctgtgaccatgcgaaggagaggatgaagtcagcaagtaaaggataatgggaacaatattgttggtctcagggataaatttacttcgtatgtgtgtgtgtgtgtgtgtgtgtgtgtgtgccgacagtccagaaaataaaggtcggtactccttgcgtatcatcaggcgatatgaagcaactggggcgacgggcttcagccttttcctctctcacggccactgtcatcccctgaaagaaccccacagtcatcccctgaaagagcctcgtcgaccggtatatatgccaggtgtcgtatttgaaaatactgtggtagtgccgacgcgtgacatgttctatcgtggtgcacgggcaaggatgagcaggacttcatcggcttctcatgactactctcctcctcttctctactttgatctacgtgctacattcctgtgcgctctagggtgcgtgcgcgcgaaggacggaagcgtccaaagcaccctgatcatcaccagcagcaacgctaatcgtacatttatg

SEQ ID NO: 6760 - DNA, 700 bp, Nannochloropsis_gaditana
aaggtggggtaatttgcgactggatcaaaataatacaaacatacatgcatgaatttacaaaataactacttcatgcaggcattttcacgccaatgtcccgcgatcgatttctttgtttgctgtttttccctacccgctaagcgatgcatcgatgggccgtagctgccaatcgcgggtgagcaatgtgacacaagccggataggaagttattttatgcatatcagatcacaatcttatcatgaacgtagtacacattcacgcccccgagctttaccctgatatttcatgcgcaaacaacatcttgtttatcctttttatcgggtcactcaagcgttccaagggtgggaggttgcttctcgccccatcttccttacttggagtgccccttgcgttctacaacaccccaaaaaaacagccacagataccgcgcaggcgggatgctcattgtgtatggtcgagtatcgacaattttttgttcctataggcttggatcacttaaaattcgtaaagcggtcagcatggttcatgtgccaccacccaccaccacttcaggatactgcctggcgttcgtagcccatatactcacagcactttttccctctatcttttctcttttcctactgtccaatgcttaattgcagggagatagggtcgtacaacaggattgatagctcttccttcgacgtgagacgtggtgatg

SEQ ID NO: 6761 - DNA, 700 bp, Nannochloropsis_gaditana
atgacagcttgtccaaaccgtggtccatggatgagacttctcttcatttgtttgatatctttagaaagttggtggagaaaagaaggaatcagataaatcacatggctgctttaaaaacgcagtacacgctgcttcaacctcccctccttctccgtgcttctgacttagtgatagatgaaggatattgttaaaagaaacatccaactctctatgtcgcacagtacaactcccaaattttactgtccggctgccatgcagtagaattcactcctacgggatatttgtcgctctcaaaagaggagagccgtctcgctcagagcaacgggcacccgccgatattttctttgcgtcatttttctgtctgaatcaatgtctccgtgcgtataccatagaaacaggcagtctaccaaaattagtatgaagcggatgctggcacacgtgaggtacatgatttcttgtcgtttcctattgtttgtctgtgacaaaattattttgggaaagtgaggtaaactatccgatgcacacaacaccctgcagaggaatttatcagaggactgtactgtattggtttcaacgatatcgatgagaatggtcagtttttggtcccctttcttgcctggcgtcttgctttaaagcgctacgtatctccatttgaccctgatacacgccacggccttccgccgtaccacatatgcccaga

SEQ ID NO: 6762 - DNA, 700 bp, Nannochloropsis_gaditana
gagatttctgtcttttccgtacactggctcgggcccagcgtctcctcccggacgaccgggaagccttgtgtccgcgtgagatcttgaggctctggtgttttcctttttccacgcgggcatgcatgggatttttgcatgtttttatatatatatgttcgggctggagcaatttgtgacgtggattgtacacgtggttcggcacgaaaatgccccgaaggcgatgacggtgcgcccaaggacaccactccagaaggctcgtttctcgagcctgatccgtggtgtcccttctcttggcaactttgggattgtcacagctttgatatttgtgtgtggttgtcttcagtgtcgtgtttggcaatggtgcttggtcatgactgcttcaggcttgccgcatgtatttcagagcgacctccctgaaaaatggcatccagaaatgttccagatctcccaaacatgtacttttcactgcacctcacacgttgacatgctttggaatcagggtggaagcatgtgaatgggcttaattttgcctcaagtctcagaaacgtgtcgttgtatccccgcatctctacactaccctccaatcggaacacttcctcactttggacccttttcgcatatcctgtctcaaacacagcgtccacgacagcgaagacaaggtgttacgtctgagtgggagagcctgtaataccgcatcatg

SEQ ID NO: 6763 - DNA, 700 bp, Nannochloropsis_gaditana
aaaacaagacaactaacgcgttgtaagggtcccggtaagcaacagatatgatgacagttctaaaaaattgataaatcaccgaccaactttgtaggcttgaggggaaatggaggacggaagaaaagagatgataggaagaagtggaaactatgaaggggcaaggaggtgatgcaaacgttttagaaggagaagtctctcttgagagccacgtgctccaattgccgtgacgtgtgccatataagaatccaaaacgcagtggaactcctttttgtctactgtttcgttgtcaggcttgcaacacaagacaggtcgtgacatcacaatcgatgtccagccactcctcagcgagcctccacaagaaaggcaccccaggagctttcatagcatccaacagccgcagtgtcatttgtgtgcgagatagagtcaaatttctatacattggaaagcggtcaacttctcaagacggccatgactgaaaatatcgtgtagctgccctagtctagtcatcaccttgtctgatctcgcttttcttggtttcgcccgcccatcctcacaccatttatatcatgaatggttatatgggacagaaggtatgggaatgatcaacataactcataacacattgtaactgcacaatcttagtcagctcaggttgtaagcagtgggtaagggtttttagcttgcgagctttgtggtcatg

SEQ ID NO: 6764 - DNA, 700 bp, Nannochloropsis_gaditana
agatgcaaggaaagtagctctaagcacaaaataactcattaattactgtgttcgtggtatcgttcatccatcgcgacgttcaagcaagcctgatcccgttcgttcgagtcggcgtccgtttccaacctcctacttcccgatttaaaccgtaccgccgggcatttgagcggtcacgctggtattaaacaggaccctgaataatgcggcactcacgactgcgattctcctcctccatgcactttcgtggcaattactccaattggagaggatagaacgtactgcgacaacttcatttatgccttattctcaaactagtaggtacccatgtccgcacagtacgtggcggtggcggactgaaaacgtcgttaagtaagcggagataccagatcgatccgctactcgacgaagtggtccgatattccatgtacgcttcacgcatgtctgagaaagatcaagaaaagactcactttacatatgaaggactgcatggtctggtcgcgcttccaatgcgatgaccaaacatgtcgaatctccacagaatatttgggggatcgcgtcgcccatgcgtttctggccgtgacgtgcgagcctctggggcagtacccaagcttacgaacgactgatgaatttgattgacaaatctaaaaaggcacgcactgaatattttttacctccatattgatgattcaacacctaatac

SEQ ID NO: 6765 - DNA, 700 bp, Nannochloropsis_gaditana
caacgagtggtcgtctctgtctgctgccatgggcacgctgtgtgcagaatgggggtcggagagcgcacagcgggtgaggacggggctcgaggttgtggtgggacagaccgggtacattggtttgaaggggatggaattttatcagcgagagggccgacgggggggccggcgttcggataaaaatgaagagtgggacatccgggcacaagaacgcgtctgaatcaaccccgttgtactacttctctgcggacagggggaaattaatgagaatgcgagccgttgcggaggcatgacttgcagctcaacgcgctattttcctggcagaggaaaccacgctctatcccgagggcctgctcagggacgtcatgctacgccggtaggaaccggagaaaaaacttctctgcgatcactcttggtcgtcaagaatatcatgctcgtggcatgttctttttcacctcctcaagatggcagacttgccatgttatcggcgtcatcttttctacctccccccctcccacgcgtcggtacgagccggcccgaccaattacttgtcacgcgaaccaggtcatcgacaagaatttccagctcttttcacaacagctttcgtacgatcgtccctatcgctcctcgccccgatgcttgccgcatccaccccgctgatcaagtatttttcatcggttcctgcttttcggacaccatg

SEQ ID NO: 6766 - DNA, 700 bp, Nannochloropsis_gaditana
tcatagcgctttctccttccgatcgacccataccgtatcgcaacaaaagggccattctgccaattagcaatcaaagaaacaagtaaagtcccaaagagattagatttcggaccggcactgtcttaaaaacgcacctgtcaacaaatagatgcatggctacgggttggagaatccaggggtgcgcgctcgaccgaccaagagaaagaggtctcaaaggtagcgatgcgcgccaatatgtctttcgaataagaaaatccccccgcagaatcgacaagagcatgcagccgtgccacgacgcggataaatcggtgtatgtggtcaaggagcacggtcggctgtagaagaggcagttgaagcgggtgggatggggagctgttccgcagcccgagttcgcgtggctctggcctgtgtcgtgacatgccaaagtcatagaaatcacaaagatcacagaaaatatcgcacatcgcacgctgctgccaaaggaaagctgtacgtgtcgtccaagcgcggcaacatgtgtattcatcccaaggcacatcgcccgtcatcgccgccacctacaactccagtcatcgccctcgatcatgcgagaagccgcaaggttttccagtatgcaccgcctaactgcacatgttcaatacacatattctgagacctaaccttcactcatcatcctatctttggtgattgtcagagtatg

SEQ ID NO: 6767 - DNA, 700 bp, Nannochloropsis_gaditana
gtcgaatcgtcgcttccagtggagggtgagactcaggatcggcaggagctgaacaagaaaggcgtgcatcgcacgccctgagtggggaggtagactcctgagttattacaaaatcgcgatcctttcgaacgcattccgcgacactatccatgtccactcagtgtgtaacgcctgcaagaaaagccgtaagagaagattggtaggtgcaagctggcgaaatcggctgttggcaggaagagaacggggcagtgagtcctgacgggcgttacgaacagagtccttcaagtgcaccgatgcttggacccgggcattgcatctgtgcgattactccctcggcttcgtcgctcgccgtcatcaattgtgtatggtgatactttatgagccaataacagcatgttccgcgcacatttgtttcagttgggcttacgccttcacacaatgctttctccatccaggggagatgccaaattcaggccccactgaagaggaagacttggatgtacccgagccaattccacacgagcgagcggtgactgaggtatacttgcatgccatgaccaggggtgcgcaggcagggtccattttagtgtctgttctggcagtacctgtctgttggaagcggggactgaggggtagacttctgttgggacgcttgggtcaaatttccttggttggaagcgttttaggcggtgcaatcatg

SEQ ID NO: 6768 - DNA, 99 bp, Nannochloropsis_gaditana
ggagggggggggatccgaccagggcccaaaggggtgagcattgggggtatctcccatgtgattcgcgtgcgtggcctgcccttcgactgcacgcggatg

SEQ ID NO: 6769 - DNA, 700 bp, Nannochloropsis_gaditana
gcttataggccccgggattaaacacgttcacgcccggttgcagctgctggtgggccgcgtgagggacttgtacatgtccgccatactgttgctgagtgctgtaatcctgatttgcatgctgaggcgggaactgatgccagtgctgccccccatcctgctgcatgtcgtgcctttcgttcggcgccgacaggccctctgtatgttcgttcgtggatttaggggaggaagaaggctgtgggtacgcttgaactccaaggaaccttttgaatgtggctaggcgctggatcactatacgtggggtgatccaccccacatggccgcgtccggtcacgatgtgaacattgcaaaaacatggcaatgtgagcaaaattgttcggcctagcccactgcaacaagttcagacactggaaaagggcgcggaggggccatcattttctgtcgccatgcccgcacaggggaaggcgggattcgagctctttcttgtgcctgcaacaagtcaaataccacatacaacgcacaatatgcccgctctcacgcaccacgagcaggaatgttgtcatcatggtcacagctatcgctcacgctgttcgctttgcttctgcttgggcatatattttgtaacagacgacttctttcgcttttttctgttgctgctgccttcccggattgatttcagaagtcccagtagacctccgccatg

SEQ ID NO: 6770 - DNA, 700 bp, Nannochloropsis_gaditana
ctcagttaaaaaaatcgtgctcgattaacgaaagaaaagaccacgaggcgagcttgacaccgtggagtgaatccttcgcggaaggcgtgtcgagaaaagactacccggaggctcctccttcatcgcccccccctcaaattcaatcgatgatggcgcgcgacacgtccacgtgcccttgtttgaccactgaaggtatccgctcatcaattataataactcgctggtacaatggcaaggttgaggatggctgaaatgctgacctctctatgcatgcttcactcattcacgttctcaggtcagatcgcctcggatagtgcgttgcttcgtgctgcaggttcaggaacgggctacgtaccatcacaaaactatggatctcagataggagtgccggtacgtgatggtccaattagcctattatgaggttatatgggcttttcgcagagttacgcacctttccccccacccttttcttgctctgtcttgcatacactcgtcatgggcgaagttcctccgatacctcggacaggggccatagtcccactctagtgatatttcttttccttgcgagagatcactttgtatgcctttcgatggcgccgtcttcatttctgacccttcaagacctcatctattcgacagacacgtgaccgtttccgacttcaattttcgagtagcagcatcagtggcgcgctggagtatg

SEQ ID NO: 6771 - DNA, 700 bp, Nannochloropsis_gaditana
tcacaagctcagcgtctgttaaaattacctcttgtcatgcgctgctttcctggagattctgcagaagcggttattggtcatcatgggactatgcgctatatattactgctcatcacacgctttttaccattaatggaataatagaggtgaatacgcaatttatgagtaaaatacaattggtaaggttgtgtcagaaaaaacactataaaaattacaagggtttatgcctttcaacggtctaaccaccaagagtcaagagaacgcaatgcataagtttcctttgaagtcaaacagaataaaagggccattttcctatcagggaaaatggaaagaaggaaaaaaaggaaaaaaatatagtgaaaaggtcgaggagtagacgagcacgtcgtcggtaatcgccgacgtctcgacgacgcgctcagtcctgttctctttcaatgtcaccccttttcatgtggtagactatgcgtatacgtaagggtcatgtgctccgctagaatgtgtaacaacgttttacatgtcggcagtgcgcaggatttttatgtcttcctgtgtaacagcggtaccaggggcagtagcatgatgaagtccggacgaggccatatgactattaattcatgtggggtgaagtcgcatggaatgaccgactgacgctcctcatatcaaaatgtgtttgacagataaaagcacaattatcatg

SEQ ID NO: 6772 - DNA, 700 bp, Nannochloropsis_gaditana
aacatgacttttcagtgactttaccaaactgtttaagatttttttcgtcaacatcgcctttgactgaattataatcgtgctgtgtttttggaatcgaacagctgatgccacaagacatgtgattcaaacagccgacagcgcagccaaaggatctcttccggtacattatactattacatacctactgaacgtgtacctcatgactcataaattgcacgtttatcacatgaagagaattgtttgacacgcctagctttggagtttaaatttttgaagaaaggcgaaacggtcgcgtttcaaaacgttttatggccaaacggcacggccaaagcgatccaacaaactttatggtgaatttaaacatggcaaaagatcggacaactctgaccatggactctcgtcaatacttaatctctcaatgtaaacaaaaacctcaatgtaaacaaaaacctggtaaagtggatccacttttcaatcgtttacatgtactacgacaatcacgccttatctcgtattgatatcccactttctaatcgtcgaagcatggtgttctctccgtttttcttttttcctcatggtcaggaggattttttcctgtaatcaatataatgcgatatgattcattgtgcatttttaaatcttattcgagaaccaatccacacttgaaccctacacgtagaagataaaactcttcagcatg

SEQ ID NO: 6773 - DNA, 700 bp, Nannochloropsis_gaditana
cagcactccactcatgccaagcgggaggccgctcctcgctgatcgaggtggtcacggatcgtgcgcagaacgtacggatccaccgacagctcggtgcccagattcggactactgtccacgccgggctctcccagttgcttcgtctcgactggatccgcacggggccccggaccaagccgactctcttgctcttgcacggctttttggggtgcaaagaggattggacacccctcctttgggaggcagggggttgtgcgagcgccagcaatgctgggctgagttgcagcagcagcagccccaataccatcgttggcgtttcggggggaagtgggggaagaggcctagcgatggattacgattgccttgctgtcgaccttccagggcacggtaccaccgccatgcacggtgcgggagttggctgctccgcggcctactccatgcccgtcgttgccttctcgctaattcagctcttggaccgacttgggattgcccaatgtgcggtcatgggctacagcctgggaggccgcttggccatgtacttggcccagcaatacccgcaacgtatctcggcaatgatcatcgtgtccgcacaccccggcttgagagcggaaggggagcgcttggaccggcgagaggaggaacgacggcttggcaggcggatcgaagaggcggcgcacgaggggggggaagcatggagcgc

SEQ ID NO: 6774 - DNA, 700 bp, Nannochloropsis_gaditana
tttagacccagacgtgatcctgcagatcggctcgcccttggtgagcaagcgcctgcccaagttcatggtggcttcccgggccgctgcactcatccacgtcgtcccctccccggctcggcgggaccccgagctctctgccacccaccacgtctgctcggacatccccaccttcgtccacaacctggacgcgtctttggactgggagcggcgtcgaaagcccgaggccaggcaaagcggcctcctgtccctcctgaagacccttgcggcacggatcgagcacgagattgcggaggagttgggccccgaggccgacaccctaggtccagcagggcccggccctttcccttcctccccgtccgcgctcaacccgtctcttgttccctcctcgtcgccgccgtctcccgctccgacagactccaggctcctcaacgagccgatgactgcgcatctcgtcgctcgcctgttgcccgccggacacgggcttttcctttccaacagcatgcctgttcgtgatatggagacctttgccaccctcgcttccaccgccggcgccccgtccgctccagcccctttggcgagcgtggccatgaatcgcggtgcctctggcattgacggtatcctcagctcggcgatggggtacgcggctgggctgggaaagcccgtcactctcctggtaggggacatggcatgcctgcacgac

SEQ ID NO: 6775 - DNA, 700 bp, Nannochloropsis_gaditana
ttcctcggccaatatttccaccaagcgcacgtttaagacgtgagctttggcatcctccttctccaccacgtctggccgtcgctctgccacacaatttacgacgacccgaggcgcttgagccgccagaaattcgcgtaaagtcgtctcatcggtaacgtcgcagggtatcaggccgcgtgcccgcgaatgtccagtcccagcgaccacgacgccgtgaggtagcgattcgagtagtgtgtgctgtacagcacgaccgagtaagcccgaggcgcccaagacgagaaccacgggggggttgatggctgccggcatctattttgttgacatactgaggtcggggacgtgggagctcgtgtgattcagcgacgaaggagcaggatgctgtgattcggaaggaagacaacgctgtggcgaagtcaggcaatagatgcctctaaccgagacacaaatcgttatcggaatgaatcggtgtccggctcggatatgtgataaatgcgttgtcggccaggtgtggaaataagggcgcgtcgatgatagataaggctgtgaggtatccaaacaacctccctgcgcaacccagtacatcgcatctttacgtcgcgggcttgtaccgcctgggccatgcacactcatccttgcgcacttgcgctgtataaacaggactttcttccttcttaagctttatatcgtcgtcgtcatg

SEQ ID NO: 6776 - DNA, 700 bp, Nannochloropsis_gaditana
ccgctctcttccgacctgctggccgccatccacgacgctcaaagggggcttctggtcatcggccggctgccgcaacgccgagatcgggcgcatatccggtggctggcgcagggattgcggtggcccatattcgcagacatgggctccggcttgcggtgcgatcctgcgctcaaacatctcttggtggccccgtacgagtccctcttggccgacccactgattagctctgctttagacccagacgtgatcctgcagatcggctcgcccttggtgagcaagcgcctgcccaagttcatggtggcttcccgggccgctgcactcatccacgtcgtcccctccccggctcggcgggaccccgagctctctgccacccaccacgtctgctcggacatccccaccttcgtccacaacctggacgcgtctttggactgggagcggcgtcgaaagcccgaggccaggcaaagcggcctcctgtccctcctgaagacccttgcggcacggatcgagcacgagattgcggaggagttgggccccgaggccgacaccctaggtccagcagggcccggccctttcccttcctccccgtccgcgctcaacccgtctcttgttccctcctcgtcgccgccgtctcccgctccgacagactccaggctcctcaacgagccgatgactgcgcatctcgtcgctcgcctgttgcccg

SEQ ID NO: 6777 - DNA, 700 bp, Nannochloropsis_gaditana
cgagggggagtgggcggaaattggcgcgaaaatggcgaattttgtccgcatgttccctcgcccctccccgcctctacgcagcctccctaacctggccaccctgtgggcgacgctggtggtggaggagctggcccggaacggagtcacccatttcgtcatcgcccccgggtcccgctcgacccctctggtcacggccgccgcccgtcaccccgacaccaccttgatggtgcaccacgacgagcggggcgcgggcttctactgcctgggctacgcgcgggcgcgggggcgtccggcggccgtgatcgtgacctcagggacggccgttgccaaccttttgcctgccgccgtggaggcggcgaccgaccgcgtccccctgctattgctcaccgcggacaggcctccagagcagcgagactgcggtgcgaaccagacggtagcccagcccgacatgtcttgcatttcgcgcgatggaccaaggatgtgccctgtccgacgaggtcctggcctcctctctcctctccgacgtcgactacgccgtcagcatggcccgcggggctgacccagggcccgttcatctcaatttcatgctgcgagaaaacttggctcccgaaggcggggctgtcagggacacggccgtgccgggtttgcactcggaatggcctgacgcctgcctgggagggcggcgctttgcgcagtggga

SEQ ID NO: 6778 - DNA, 700 bp, Nannochloropsis_gaditana
gaggtctggtcgtggctggcgttggagccgcccattgtgtagggggggcggaggagctcggtgcctccaaggagaagctcggtctgtgcgggaaggacgtgcctgcggccgtgacatactacggtggcggccgctttgacccacagtaccctcatccatccgcggagtggcagggctttggcacctcttacctggttttgccggccttggagttgatccgccgcacgcgtcatggggacgggcccctggacgggtctttcctcctggccctcaacctccgattcagtaacgtccaagaactgcaggcagggcgcacggccttgctccatctccttcgcgacgtgcaagtggcggccacggacggcgacgacgagggggccggcgacgcgctcttgcccgcccctgtctcgtgcgaggagccgtcccagttcgacgcctggcacgaaggcgtcgggaaggccctggccgccatgcaggcgggggagtatcggaaggtggtgctggcccgcgccgtgcactttacctttccccgaaagccgcgtcccctggatctggtcctgcggcttcgagggcactacggctacctgttctgtctgcagctggacgccgatcgggcctttctggggtgcacgcccgagcagctcttccgcgtcgcgggaggggcgatctctaccgaagccctggcgggcactcgcccccg

SEQ ID NO: 6779 - DNA, 700 bp, Nannochloropsis_gaditana
caacaattgccaaagttggccctgaaaggatggccgtcaaggctggaacggggtgcgagtgccggatctcaagaaggcatcaagcctctgccaagcccgccggcagtatgggaggatgggctgcctccaagtaagtacgcacaatttttagaggaattttggcagcagagacctctgttgattcgtcgggccttcgacccctccgtggcggttgtaggacccggcgagttgttagccctggcctgcgacgggagggcgccctcacgactgatcgagcactgggctctgcgcaataaggttgaggcagaagaagaaggctgccacggcgacgagggagccacgtggagcgttcgacaaggcccctttgatgaagaagactttcagggggagggggacgagggggagggacgcacgtggacagttttagtgcaggaggtggacaggcatgtccccgaggtcggagatctgcttcagtccttccgttttttgcccaactggcgcgtggacgacatgtgagtagcggtcggtggtggggaaagggggggtggccgtggttccgccctgaataggcggctgttgcccaccagggttaagggtgccttggggccgcgggcatctgcagaaaacggtggctcttgcctccccccctcagtcatcatgacgggtattttccctccaccctgcgcaaaccgacagcatg

SEQ ID NO: 6780 - DNA, 700 bp, Nannochloropsis_gaditana
ggcttctcattcagcaccgtgtttctcgaaaaagcacgaaaatcaatcttcaatacatacctgaccggtgctgttgcagttgccccatggaaggagagggcgagagaaaaaatgcctgggaccatgacagctgcagcgccaccaagaccagaatcacgcaccgagaggaagtggactgtcttacagcagccatattgctgtgaaaaacatgtaggatgcgtgtgtgaggctgtgcggcgtggcttgccccgggaggtctcgactgcatgacttgatcgaggctgtgtgcggcccggggctgttcattccacgcccgcgggggctaacccgcacattgacaacgcgcaggcagacaatactggcgccgacggcgtgaattcttaattagacgtcttcgggtcatgttggacgcctcctcggccgcgttttgcgtgctgtcattgtacgtgtccgggcaaacctgcacctcaaaggctctccctctcgcctccgctcgctcaagatgtgccacgaagcactgcccccaagccgcctcggaagcacttccctagccgtaatcgtagtagaatgaggtgatctgcgcaggataatgacactaggactttgacaaaggttatattaacccatgctgtggtcacgattttctccttatcattatacgcgacaggcgtcagtccggacgtccacgaccttcactatg

SEQ ID NO: 6781 - DNA, 700 bp, Nannochloropsis_gaditana
aaaggtggcaacattttccgtatcgtcgatatttgggagagcagcaacgtcaactagcagcgtgtggttaacaggaaaggaaatttcaagctatgttttgtgttgttgatacttataatcaagcatattagacgtcgtcatcgtggtctattagaacagagcagagcaaggccggaggtatcatgggttggcatccgtgaacggcaggtaaagaattgtcgaccgcaattactcgagtcgaccacatatttacacacccttcgcgcaaaatacggtggcatgcctcttctcgtcgagccgcacaagctccttgagcgttttcatccctctcaaaggctagaaagcaatgaatgactagcatcctatttcatgattttaatacaggttttattaggagatcaagtatccaccatgtaggtgcaaacaatagcgactttactcgatttccctgtttccctgatgtaagcgcgtgccccccctaaaaagggaaaaaatatacacagacctcatcgacgaagtagatgaggctcttaggatcaggaaattgccaccatcctccactggaaatgcatcggaggcgacatctcagctttactggattggtgtttgcggggcaccggcgtcgggaaagtcaactttgacccaagaggttgcccggcgactcaatgataaaggaatctcgactgtagtcattcctatg

SEQ ID NO: 6782 - DNA, 700 bp, Nannochloropsis_gaditana
ctcggttttcttcgtcatgtgccaggcgatggatccgtaggcaataggtaagcacacggtgacccctttcatccgtctggggggtttgctttcctccatgtcagaggggggcgagtcaggaagtgtggaggggaggcgatatttagaaggacttggagacgaagaacggactgtaggaaggaaaagaaggagctcaagctcttgagaatgtctcaaacttgtgaaaagattgggcatttataccgacatgcagcgatagacctcacacccggaatttaagtccagaaacgtcgtagtaaatgaggcatggtcaaggggtggagaaatatggcgcgaaaaccggtcctcgttcttatccgtccgaaggcaggctcgttgtagctcgagtgcgtgggagcagagttgtttctgtgggtgcagcaaaggcagaattaaaggcaccctcatgtgtcccttttcaagcggttggggtttgcgtacgccgcacatggacgaccagggcatcggagaaatacccgccaggcggtcgctttcgcatgtcgctcgtgctcactcggtcgcaaacaaagacccgtcttatcggattccaaccccttcaaaccaactatattcacaggacgtagtcgtgcagggggtgtgccaggttgttatccgtgcggtgataatgcagtcgagttcaattgctggtgatgccgcgatg

SEQ ID NO: 6783 - DNA, 700 bp, Nannochloropsis_gaditana
tgcacctcctgctgcacttcatcctcagcaggtgtgtgttcgccgttggtcaccatagtacgcgggtaacgaggcaaatagatactttgccctcgatgatcgcaactggccggagtcagtcttcgtcactcagctctcagactgcgttcgccgtgaaatagagcagcctggacccgtgcccccgtaccaagcaggggtgaaaacctgagagacaggtgcgggaggaggtgggcgatggtacttagcaccaggagaagggcagggatgcacacgaaggcgggaagaggcttggatggatatgagtcgctgattgctcgcttcgactctacctccccaccccctaggaaacctctattattaccaggccaacggcaagtgccgcgtggcgaaggcatagccggggcctacaacaagaaaattagtgccagtagaggtagaaggacgcgtgattgggtacaacactttgtcatcggttcacgggctgcggatacaccgaccttgaaagtgcggatgtttacgttaggacttgaccaagacgtgactgttggacttttttatagacctgtgattcgagaaatatacatagtacgcttgaaaattttgactttctcgttggatgttgggttgatttagcgtcgtaacctcctcaccctccgccttcacttcttctttcttgaacactcgaaggaggtgtaccatg

SEQ ID NO: 6784 - DNA, 700 bp, Nannochloropsis_gaditana
ttgtcatgtttaagctacacattagacctaccttaactcgctcttctccgaggatcggagctttttcaagatcgattattatgatcttcagcactggacgctcatgaagtcagtaagtcggaggtcctgtcatgcactcggcttgctcttccacttcatactctctgttgaggaacgaacatgagatccaaagtaatggcccctcgttgtcctggcgtgacattctgacctgcatccgtgcatgtcaacggaatcgaggaagacagaaacacatgtggttgtaaagccaaacacagaagtaatgctgtacatcgcttctcctgagagtcggaaattatccaattgaaataattctgggctcttgatgcatgaatcttattcttgcttttcacattgcctgtcgaggtgtgccctgcggtcgttaataatggcccgtagtctcttggcaacgatgcactgctaaattctccctgaccggagtagcatgcacttaaatgcaatcgagcgtcataggctttcttgtgatatctctgtcctacgtgggaactaccaagaccaatgtgacaatgcttatagctgtataactcattatctgtgtaatctttcgaatcatattgcccatttataggtcaagccgtcgcatacttcaaaatcaatctacacgtgccaatacaaccgcggtttcaccaattaaattatg

SEQ ID NO: 6785 - DNA, 700 bp, Nannochloropsis_gaditana
catatgttccacctcacagccagtccgagtgacagacattgaaccctcttctcaagttcacaccatgcagcgaggaagcattttcatgcggattatcttgtccaccctcatcgtccttgcctctgtctccgctaccgaggtgagacgcattagatgaagagatgctttactttctttaaatacttgcggggaaaatggggaaggaatactggtttgagtaaattattggtcatcccccccaacgcgagaagagcctccgcaagtatgcatatcattcaagaagtcccatttcttcggatttcgttttccacaacgtcatggcgcaccctcgcgatctacataccactgcgtagcacgcaagcacggtagcagtcgtggagtcgaccttcacacctgttgaaaaggccgacgtcactttccttcgggtgagcatctctcatttaaacaactcacgctatttgaagcgcgtatagggttttttccctgtatatgcacaaaatttagcgctgaacgtcttattgaaccctccgcttccctcctccgcctcttatcatgcacagggcacggaggctgataaagtgatgtgtgacggcgtggagtgtcccaaaggagaaatgtgcatgcgcagcagctcgggcagtcgctactgcatgaaaatgtagagctttaacatcagctgttaaatcaacaacgatccatg

SEQ ID NO: 6786 - DNA, 700 bp, Nannochloropsis_gaditana
tgactggcagggggaggcaacgtgaatcgtctcggaggggtttacctctctggaggatgaaggcaaaggtggagcccgcgggagtaattctaaggagatagcggagcgtgatgagacgtggagtgagaattgtcacggattaaacagaggaccctttctccttgaaaaacgcagcggtgtcagcgtatacgtgttcatgccaggttcgcttacctgggaaaggaaaaggaggggcaggaggtttatggccgaacgggaaaaaagggaatgggggcgtataccaacgagaagcgaagtgtctgtcgcatgaacaagaatgcggtcgccctgcatgcctgaatggcatcgatggagtcgttcgtggctgtgtgcgggcggtgtgttgaaacattctcaaaaaatagaaaatatgccctttatttatcatccatttgtgcagacgaggcagtaggcgaggtagccaggaggttttggctatcccttttccagcccccccaaacgactgcctttgactgcccaatgcatacccacagttactgtcgtgagactgtgcagcatacgttcgtcacaattaatggggcctgtggagtctttgtcattctgaggcgggctaggcttgtcacggggatttggcaggcagagagcacacatgtcgtagccgcgacaaacgccgcggaggcagacgttggaagacagtatg

SEQ ID NO: 6787 - DNA, 700 bp, Nannochloropsis_gaditana
taattatattatgtgagggacgcgtaatggctaaattggtatccctttatgaaaatctaaaataagtcatgcctctcggaaaaaatctgcctacaagcgtacctcgatgaagaaaaaagcagacatggcgcctgaaaagcatcagaaagacgagctagggccatgacagcgatgagaaacctcctctttacctttgacggagtccatacccatcgactcgacattgaaagcttctggtcaaaccgatggaaaagtcctgtctaaggacgatatcgtttcaaccggctgggatcgggaatttcgtcgggagagtgcgagccagccttgaaatgaaacgaaagtagagtgagaggcttgagcacaacaattccagtattcgctagactgcgtggctttcctccgcttgaaaaaagtgtcccagagcataatttatgcctttttcccaaggccgtgatccgcggatatcccagctcaaggacaaaccgttgccggcttcagaggcgatttctccccttctccctggcccttcctacacccacgcctccttgatagttgcctgggcacaaaggactgatgcataccatcgcatacatcttcttcaaagcacagtataaagacgggcggcggtgatgtgtgattgctggggaggttgtcctcactcgccttcgcagcatcgtagctgagggctacggactgcatg

SEQ ID NO: 6788 - DNA, 700 bp, Nannochloropsis_gaditana
tgtcccagaacttcaccttccgaaacaggatctcagctgcattgggcaaagaatctccgcggaagtcctgtgtgtggttccatatttcaatcaaagctgttttgtcgccccaaacttaaacgaggcttcgcgccggctcttacccgactaatgatggtgtccccgcgcggtgataaaataaaaaaggacgacatagccccagacatggtgctgaaatttttcagcactacgatcccagagttgtgctatgcctgaaaatacaatgatgcgatgtatgctgttaaaattgagctgactgcaacggtattgttgcgtcgaaggcaagttcaggaggcgtcttcctcttggcgagaacgtggcggcggccgcctctgcccctcactacccgccccaagacacgaaatcagtcaccacgtatcaatggtccggatatatgtcccgatactaagccaacagtgtgtgttcgcgctgtcggcgtagacgacctattagtgctttttgcgtcgggatacgtgctctattggagccactggagagagtatactgatacccggcatgctcgcacatcgctcaatgaaggtattttaatgttgacgctgtggtcgtgtcacatttgaacacatcaagtgccacaaattattaggcgcatacagcatcggagggcggcttactgccagtggggtgagagttgtcgatcatg

SEQ ID NO: 6789 - DNA, 700 bp, Nannochloropsis_gaditana
cctcggctttcagtagagactccagtcgcttcaagccgagcctaaaaagggtcgagtggcatttatttggatatttggacggtcaaggcataagatatcaagggcaaaatatgatgtccgtgcacgcttcactgatcctatttctgacgtacgatgtcttaattggctgaatgcgcggggtatcagagaccgtcactttgtcctcccttttcgcgatgtggaagtctggccgggccttggttctccaccccggagtgaaggtcaaaaatatcgagttctttcagcgcgactctcccgtgaccatctcgatttacttccgagcccgttgatgccgtagctccctctggtatgcaggcaggcattccacctaccgatatgcaacattgtgcaagtcgcgtgcgaacggcgagggaggggagggtgccgcctcaaggaggaacccaggccccttcaccggtcgacggatgactgattggaacataaattaacaccacacctccacaaacagggtcgttgtgcatttttgggccagtggagttaacactgtgcacctactgcgtccttactctgggtgagacgggctgagtcataggctcccctctactcctccaccctcgtcggtgttgtggaagatttcttgttgttccggcacccaacaggctcgatcgggcaaccggtcatagtagcaaattcagacatg

SEQ ID NO: 6790 - DNA, 700 bp, Nannochloropsis_gaditana
aatgattctgtttgagagttggcagacgggcggctttatcgggtcagcgcactatattatgcgcgaaggcgaaaatccgctcgagttgctggcggggagccctttgcgcttcacatcgtagactacccatatctgatgacacagttatatgaaattgagccatctcttttgacatctaacataggttgcacaatcagtgtcacgaaagcgatgggtcagctagccatcacatatcttttcgcgctgcttgtcgccaaacaaagtgtgcaggcattcgtgcctcgcttcaagggttcagggcctgcaatagtaactcaacccagcgcaaggtttttgggcccgaaggcaatgcctgtcacgagaagcagacgtgaaggactggacctggtgatgtcgctgtcggaagcaagtgccaaaagtaccaaggtgaaatcaggcagggcctgtgttaggggaagtggtttggtaggggaggttcgagattgacctggcagccgtcgcattacgcgtacctgctgaagtcctggccgctggattcctgccactcggctactttggtgcggtcttgtcactgtcgtggtctctgtacgggaactgattatgattttcgccctcgcgcatctaggttggagaggccgaaacagaagtggaatcggctgatcaccgacagtctaatcaaaaagcgattcgggtcatcatg

SEQ ID NO: 6791 - DNA, 700 bp, Nannochloropsis_gaditana
atccgcgacaaacgatacaggtctaacttacgcgggatgatagataaaaccaggccagtgagagaagcccgcactctttgcccaaacgacttgcttcagccgtgctttctggtcctccggcattcccaccacgagagctgctcgcagagctgcctccttctcctcgctatcgatgtcgtcctcaccttccacttcgacgtctttaccaccactgacgtctccgcctgcgctaccctcgtcctccaaagcgtcatcatcgatgtcttcttcctctccttcttcttcagtcttcttgacctccgacgtctcccgactttcggcgttttccttttcctcctttccctttccgcacgtcccctcgtccctcatgacaggaccgccgcttccggatggaggcgcgaggacttccttactggcatccgacatgctgagcttgaaaagcctgtgttgtttgaatgttattagtcgacttatgcgttgtggcggttgttttgcaacccgcggatgctgccgggacctcgcggagagggcgggagtcgcgttttccgcgcatctcgctaacctcctggccccccccacccccccggcctctagcttgcccttcccacccgcttgtctgccccacggtatgcatcatcagctcagccctcacgtcggacttatgtttcgctacccaatttgaagttgtgaggcgggaatg

SEQ ID NO: 6792 - DNA, 700 bp, Nannochloropsis_gaditana
ctcggtccccataccgagacgcttggaagcgtttgcgcaaaacatttcccccggtggtcaaggcgccggtattagaggccgagtgcgaaaatccctcgtaaggcaacaaagaggggctcgaggagcgcttctccgagccccccaggggggtgtcgttggtgccaggcggcatatcggattggccggcattcaaatgatccgcctcagttggcactgtctcaatcttgatgttgcgagcctgcagccgtcgtcgattgcgggcgcggatccctgcctccttgctggtcccaacctcagaaacattagagtcctctgcctcctccttcccacccgatgccaaatcatatgcggcctcgggaggtgcatcgacttcgcttttgtcctgtaggtgttgagaggtatggcatgttaagcgaggctcgaacctgttcagggggttccagctcgccaccctctttaacttgcctggattgaagacccggagacaagcttcatccggtccttgctgccagacaatatcctcgtccggcgacgcgctgcagcatcactcatgatatgaaacgcctgttacttcctaaaagaagaatagaagtcagagttgctgttcaaggcacccacctcttcgctcgctcaattcctgaaacaagaggcgacattcaggtcacactgacagttcgcaccctacacctgataatctagt

SEQ ID NO: 6793 - DNA, 700 bp, Nannochloropsis_gaditana
aaggataaagttgaaaagtcaggaccctgtcgagatcgtcaaagtccgagacacaatagacgatcgcaacaacgacgacgcagaggaagagggaactagacagttgctgaatggcggcgttgagggaaaagagggtgacaagacccctcctcctgacgactgtgagaggcagctactgtcaagcagtaagcaagtcacagaactggtcctgcaaacagagcgagacttattggctaggaattctctcccagaaaagagctttaaagtgctttcatggaatgtcaatggtctcaacggcattctgaatgggaaggctgcccaaattaacggcaacaagggctcaaacgtattgcaacagttggtacaagaagaagggaatgtagacgtaatttttttacaggaaactaaactgcaagatgcaaagtgtgcagcctttgaagacgttttgccaggttacgtcgcccactggtcatgttccaaaaccaagaaaggttacgccggggtggcggcatttgtgcatgagaaatacgtaaaaagatgcatcagctcctattcggatgctaacaaagggtcttcaaggggtaagcaagccacgctggcctcatttttcccgacgaaaggcaaagagacagagccaacaaagggagcagaggggcgaatcgccgcaatgaagactgcggcttgtaaaagtgcctcaatg

SEQ ID NO: 6794 - DNA, 700 bp, Nannochloropsis_gaditana
ggggacttgtccagtcttgttccaccggcttcagggggggggtccagccgagcttgatctcttcgaggacagcaatttcatatgtcaaccgtgctgtggatcacatctactactcccatgcaagcataggcagtacaacaaatattggtgagtttcaaaaacgattgtccacctttgataggcgccctctttcgaccctgagccctcgcgacgcaaatgatgagagattgaatgaggacccggattgaatcatctcaaggatgttgtgcgccttgggcatgacatacgcaattctcgcgtcaatactgtcaaaatcttcatcaccgttccttacttatttgagcagttcatcgaagtattcgatctggctgggcaaagacggctgcagacgcctcaattgacgtaatagtaaatgcggtgactcgaccagaaattgatgagcctaccgtcaaagtcgcagagcctcggcgtgcaattattaaggcggaccaagcaggcgagctcgaggaagatttggccttggacttgcagcggaagccgcggctggaccttctcgctggctgggcgggggcagcacgcggtgtcgatccgttcaaggtaggtgcctgcactcagggcctgccccactatttccgcatgcgttggttacgatttccctcgcgattcgatatcatgcattcagatcgttgaaagcgatatg

SEQ ID NO: 6795 - DNA, 700 bp, Nannochloropsis_gaditana
ttgaatctagggatctggatgatttggcttcattcatccgggctcgcataaaatgccggtcctcgattttcatttctctcaataaagcctccatatcttgtggcattaaaattccactaaggtaaaatgaaacgttgaaaaaaagttgggtgtatttgtggccgagaggaggtcctttattgacaaataaaattgagtcgcaacaaacaattaaccgcgtttcatctgcttgactgtatacctcttgcatgtaaaaccactatacaagacaatgtcggaggctttccagttaacagggtggaagaaaagccgcggcccatcttgggcttctctaattttcgcctcccaactgccctccaagtcgtcgccgttcgcgagaggggatggtgccgagtgggctgacacggaggccgcagagacccgctgggtcaagtttcgcggccatgttcgctgcttctggtttttagctccatgcagttaccacgttcgcccagcccttttttttttttggcctgtctccgcctagcaaagtctcgtttcgagtggtgccctacgattgctcataatcgctgtcggctctcgtcaccacctcacactcgtatgtctcacaactcaggaacactagaacataacgtgcctaggggaaggcacacataaacttccgtcgatcagtttcattgcatagctggcaggattcatg

SEQ ID NO: 6796 - DNA, 700 bp, Nannochloropsis_gaditana
tcacccgtgatgtgtctgatgaggatgattgtcgacttctgcagattcttctcgcttatcaagactgagtagaatcctttcaagcccgatgaattgtatgtggctgatggcagagtgcgcgcctgctttcagtcccaaggcacgcaagatcttcgggtgcgggatagcaagcgcgagatgatcggctcgcgcccggaagccgactcggtctccttgccctccttctcgccttcaagccctagccatcgcattggcaagcgcgtgtcggcatcggtcgcaggcatcgtcatttttgtgtataaaaccttagcgacctcgggtggctgcgcggaaaccctcgctttcaatgcctccccgtcgcagcgtcctgagagctaccgtgctcccgacagggtaacctggagaactgccccctcaatacgtgcatgatagcttttcatcctctgtttcaatctcgtggttaacatatgccgtgtagttactccgttcccggccttcagcccggggcccgaaaaatattatgccggtgcagaagcagcggatgcctggccggtcttatttgctctagcggcaacgctgagctttttaaagaacgaagaacctcgaggattgctgaggcagtaagtttttgttgtggccttctcattgtgatgccgacttttgccaacatcatgcagacagcttaaatcataggggaatg

SEQ ID NO: 6797 - DNA, 700 bp, Nannochloropsis_gaditana
cttggccacctcgttcgacaatcctcaagaattgcacagaaaatacacagagagccacgccactgtgacgcgtttagaggcattgggcgcacgtgttcgtgttatatatggagtggacgccttgaacatcctagaaaccctgaggcgtgtccaaatggaagaaggaaagagggctgactccttccgagagcctccacatgactctgtctccaattgtgcgcgcactgcagacggtcatccgcttgaggtgttcgaccatgtgattttcaaccatccgcacacgggctgggaagatatacaccggcacagggctcttctcgcccacttcttggagagcgcaaaagccgttttggcgtgctcgaccacccaaggcacggagggaggtcaagtccacgtaaccttagcaggggatcaatgcaaacgttggaagcttcttcagacagcagcgcgactgggcttcaagctccgacacatctgtgacttctatcgacaattcgggcctgaccctcccccggtagacatcaagcgacatcagagtggcaagtcttttcgcatccgggggctgccgagttttacgtactcattcaccttagaagaagtcagttattattcagcaactgcgaatgcggcctattcattccccccgtctccctccctctggaggcacgcctacgatccggaggagcacgaagccgccatg

SEQ ID NO: 6798 - DNA, 700 bp, Nannochloropsis_gaditana
cgtgaacatttttcctgaaggccgtcgactccaagcaaggaggttgtatcccgccccgtggcggattacatctctagtcgtgaatttggtgttgggattggggggggggaatatttgtgcgtacatatggccgctacgaaaatgacaaagaaccaaccgatatcgtagacaaatacaagaacggaacaccaagttgttgatatcatgttggcatgctgcggaatttaaaaaagtcggacggtaaatggtccttagggaagacctcacttgtctttataacatagacctcacttgtctttataacattataacatcgtttatcaagtggcgcacaactgcgccctgtattaagtgactatttgacgtactacatcgaaaacagcatccgtcctgcgaaaagtgtgctgctgacggtgctcttgatcgggtaccagacgaagcggtgcgcttttctacttgtcgaccgcaaaattgtatttcagaagcaatcatcgaatgcgaaaagcagaacgaaaagctgagcgggcttaccctcatggccggggcatgacggcaacgtggatgttgttggtttttacgtgcccggccggggttttgcggccgccccccctctcggctcttcgctcgtcgatgcacgccacgggggggggaggttgcgcctctaaatctagctcacgatatcattcgcacgacatgtcag

SEQ ID NO: 6799 - DNA, 700 bp, Nannochloropsis_gaditana
aaatgccacaccagattgagaaaagcacaaccttgacctggttgccatctagtggtgtaaaagtgagacgagacggacaactcctcgcttcgacgaggtcaggcgtgagaaagcggtcaggcagctcgtcctcgcccagtggcgagcgggcggacgctaacgagtccgagcatgcctaagccgcggatacagccagagcccgcagtctggcatcaggggctgcacgcacggctagcacctcactcttctttgcatatcatttatatcacaggagcgatatatccgcagattcctctcttctagcttgggtagacgccagatttctttttggaacagacgtttgtactttcctctaccaagaacaagaacgactacgtcttcaacatcaactaattccgaacctagcactatgacttcccgatcgtttcccattttgcttgtgcttgtgactatatcggtaagctacgcttttatgccgcaattgtcaacaatccggccgcgcttgactcgctgcgagtcctccctgcaaaatcgacggtcctcttcgccctcgcctcggaggtctgcagcaggaacgctactatcgagcccgagggtgcgctttgaagggtttgaggagactcgtggacccgcggtaggagacactttgtcaatcgtatacgatccggctggggagggcgcggattcccccttgacaatg

SEQ ID NO: 6800 - DNA, 700 bp, Nannochloropsis_gaditana
catataagcaaataacaatcgcatgtttcaccataagcatagtcgtggaaaaagtatgacaagaaaggtacgcgtccgtaccccagaaaacaatcacaaaaagaccaagccccgagggcattttttttccggcagatgcgatcgatacgatgcatcttaagcatgctgaagtatgtatctagcgctaagagtccctgaccatgcctggtgcaatcaaaaaccgaggcattgcgttccgtttcgtgttgcctctggtagcctactaatcgtagcaagcttgtacgtcccccgccacgtcaagcaggggctacgcaacagcagacccgccgttcagtggagcaaccgggtatgtatgggccacagaaagggcgacaaacaaagagtgcgcgccccccgcgtccaagacagcgcgcttttgagggggatgtccaggcgccagtagggcgttggagtgaaatgggccggggctagggcgaggcccctctcgaaggccgtcgccaggacgcggagcgcatctccatcattccctccctcttttgtatcttccgtcctcacgttagactccgcgcatgacgcgaatcccataacagattgcgacctacaatcatcaagctgacaatattttaggggtacgggtggaaaggaacacggaggtttcaaggcggacgcggaccttgagaagcctggcaattcactgatg

SEQ ID NO: 6801 - DNA, 700 bp, Nannochloropsis_gaditana
tttctctgaacaagcactattgcaacggacaagcatagtttctgtacttgttgttgctttttttattagcgaagccaatttcagctcgtctgccctggaagtcatcccaactttgccgtccccagccaccaaaattgacgtcctgttctgttggcgtttgcgctgacgtggtttcaaatgtggagcaagggaagacgacatcgagtctatgcatggactggagaagcgtgtaagagtgctgtcgtgagtgtaaatatgcatcaagtggaacaatttctactacgcgagtctcgggaatcgctgtagagcgtgacatgccgtgacacccgagcccccctaaatctgacgagatcacttggcgtctgtgttcaccttgtaactctcttcagtccttgtaaggcatctcaaagcagggtcatgacaccatgtaatctgtacaccgtgtatcacgtatttaatgtcctcacgcttagaacctccccgcccctggctccaacctccccggcctcttttcccctgcggcaacaagtcgtatttgttatatgcgtcggcacgagcttctctacgtgctttgcaccgtggctgtgtctacgatccaggcctttgtgctgactccctctgcgctaagaagttccatcgtgaatactccgtgtcgtactacagctccctcgcgtttcgtaactacttcatcatcgccatg

SEQ ID NO: 6802 - DNA, 700 bp, Nannochloropsis_gaditana
gcgttatcaaatcacgaaggcgcaggcacatgccgacatgttttatgcgtcctaggacccggttcccactgaaaacattttcttgcccagttttatttccctactcaatacacggaaagccgaagtagctttttgggacagcataccagtttgaaacaaatgggcaagaatatatttcatgcgatgtttcccttgttgacacccacacgttccctattaagcagttgcgcactgtcgctgatcccaaataatgcgttccctatataaatttgtcactaacgatctcttgatacatttcactcagacaaattcgagatattcgtcggactgtaaagttttctacggggttgccttcttcctgtcgtcctttccaaaatcttaccttggtcagtgttttttgtggacacgtcgcgtcggcgtaatagctcttcgtaagtactatctaaattagacgtgcgtgacgacttttagatatctctatatggcatgtactgctgtctgtccaatgtaatacgtaaaaaagtgcgtttactatagtttttaaatattatacgaagtcttcctagagcaattaaaaacatctttttggtgaatcataaggaatataagcgatactagctccactacttttaagaatatctctttattcaatcatcacacagactgattaaccaaaaggcgacaagataccgttccgatg

SEQ ID NO: 6803 - DNA, 700 bp, Nannochloropsis_gaditana
acaccacttcaacatctgccttacttcacttccttcgctcgatattcagggagaaaaatagagcatattatcatcgagcgtgtgctacagagtctccttccgaggcacaggttgcacagctcgactcgatgttgctcgtgaatttccattcaccgcgtggtcatggacgtctatgcttgttgaaagaggtgtcaagtcgaacatcccattcaatgccttgcatttcatcttgccttccgatcgtgacctttccgctcattgtgatctactctgctcgtattattttctctgtagtacaatgaagtcttatttgggcctttgcctaatcggtggagtggtgaccgcggccgcttcctccgactccgcatcctatacttctcgcagcagcaagcgcggcctccatctaaaatgcagggctgtcaaagataaaacgcccgcccttcatcgtgcaagtattatacctgcatctcactcatcctgtacacccaagggcgagtgtctggtatttccaagcaccaccaaaggcacgacgctcatgcatcgggtgcgaggcggggggcctggaattttccgacgagaagactactttgaagagactgccgtggatcgagggcgctgcttggcccggatgtataccctgacgacactcctgtacgctgtcgttgcgggtgtgctctccgtgcctcttcccaagtatatg

SEQ ID NO: 6804 - DNA, 700 bp, Nannochloropsis_gaditana
aaggtggtaggggaagcgtatggggaagggaaggagttcgagagggtgggaagcacgagggcgggagagaaaagtgaaagcaatgtaggcggcgaagcctccttccgcacctcgccctgcaccctttgaaagattgtaccatcacaccggacaggaactcctgaaaaccgtcggcgtgctcctctcctccctcccgatgaacctttccccccccatccgtccttccatccccccttcggcgcctgcgagcgccccagcccctaccccgctccctcttggcgcgcccccctcccttcgttgcatccgtgggaagccttgaaagtcaggatgcggtcttgcaccgccgaagccctcttccgtttccaccaactgctgcgcgtggggccggggaggggagggaaggaaggcggggcgggcgtccaccgatcccagaacgtgccgtgagatccttcacgcactggctgctctgctacaagcggtgactcccactcctccttccattccacctgcctatgatcccatcctctccctcctcttgcatgtccaggatggcctgggggaggggaggagggagggagggagggcgggcgggagggaggtcgggagggaggggagcctagtgttcattgaccagttgctgtacgcagccgcagcgagcaggccaccccgggaaaggagcggaaccgcggaggcagcgatg

SEQ ID NO: 6805 - DNA, 700 bp, Nannochloropsis_gaditana
ggtcaggcctggctgttttttttgcgcgaaacctgatgcctccttccacgcattcgcccactgcgtacgcggcgctggagacgccggccgcttcttcggtccaagtgacccgagaggcaatctttctggcgggccggtacctaaaattaagccgagagatgccgcagacgttgtgggtggtagaggggggaaggcgaaaggggaaagcctcggtagaggaggtagtcgcagagcccgtgctcgattggacaagcgcgacctcggccgtgctgataggttcgggcagagaggacatggacgtgaggatgttgggaaccgggcggcctttcctcctccgcgtgaacgacccccggcggatcccggggagagaggaggtggcgggcttggaggcggcaatcaatcagacgacgggcctgaactcggggggggacgtgcgagtgcacgggttgcgactctcggacaagcatgaagtgaaggcaatgcacgcaggggccacggagaaggtgaagatgtacagctgtcgtgtttgggtggggggccgcgtggaccgagcgctcctggctactagtctggaggggagcaaggagctagtggtagcgcagaaaacgccgatccgggtcttacatcgccgcgcgcttttgactcggcctaaggtgatccatgagatgcgttgcacggatgtgaaggtggtggagggcgg

SEQ ID NO: 6806 - DNA, 700 bp, Nannochloropsis_gaditana
tgtccgctttgtttgggcatactacagtcgtcaggtgatagggaacttggctcggctctgttagatgcaattttagcgcaaattaaaacgaaaaagtacgtgttgccgactggcggtgatagccctgacatgacacaacataaaagtaccaccgaccctgtcggtgaaatggttgctgaacactccaaatacctcctggagagaaaagttccattcatcctaggagtctcactgcccggttctgtggctatccgggaccgcgccgcccttgaatgggtagcgtgcgagcagcaaactgggcgtcaccaggacccggggcggcgcctggacgtgaaagaaattctgaaagcagtcttggagtcatgcttaccgaagcattatccatgcttgtacgcggcatctactccttcccctggggccctgagagtggacctctctttctggcacgcgggggccgacgaggcggactaccaccagggtgtgcgcattcttttgccgaacgccacggggaaggcctttaaccgtacccggaagcgccggcgacacgaggagagcaatcaggaaaacctctgtaatgccacagtggtagcgcgcgtcctacaggcggccacgggtgacccgaacgtgcggtcaggcctggctgttttttttgcgcgaaacctgatgcctccttccacgcattcgcccactgcgtacgcgg

SEQ ID NO: 6807 - DNA, 700 bp, Nannochloropsis_gaditana
gtcaggattttagcgactggttgccacagccacaacagcaacagcagttgcagtggccgccagtggtccagcagcaaaccatgcaacaggggcaacgggttgtatcaaccgggttgtcgacgacgcagcaacatgaccgacagcagcaacagcagcaagaaaacccttttgatgcattcatgtaatgatttaaggttgtgatggcatttgtaagaagaaatggacgtgtagaaatagcaacgaaacgttttttggtgttcttttgggctcatgatgctttccattttgaacttttgaatcgcccaaacttcaagcggtcgggacgcgtacacggaatctgctgtagtcgcgcaaatacgcatagtttcctgccttaacagggcctattttaatatgaatttataaatctataccaataacatacctgatatgatgccacttgttgcctttgtccagcattcatgacttttggactgttaaatattgtcacgtgctggggaatgtacgaccgaatccgacttgattcgttaaggcttctagtgaagtgatcgcggtgggaaatggatttttacttcatgtctggcatcttttgtctgagtaacaaggtatacttgaacaatgtcactcgtttttctgtctcgcttgcttcactttgaaggttgtcttgggcgaatacatcatgtttctcgctttccccaca

SEQ ID NO: 6808 - DNA, 700 bp, Nannochloropsis_gaditana
ggacggggccggccccgcatgccgggcacagcctttttctgagggaccacaagaccatactttttgggtcctgactgctgtccgtacatgatgtctgtgcccagagattgaaatagtgtcaagacgaagatcagacaaccatgtggccggtctaggtgtggacgaggccgtcaaaaacctcccctcgcgcagggccctgcgccaacgtgctttgtcctgcatttccttcctggcgtcgttgaaccccaccgtatgtcgatgcaacacactgcgtcgcgcatggtctgttcaaaagctttactgggttgtcgctgccccagggagccacccacgcagtggaatggcggcacgacgtaggcggcttgtgcgaggtccttgacgggacaggggaagttcagagaacccccgacgactttctctttcctactccccttctcaaacgcgcaccgcgccaatcttaccgttgacccaccgcatacacgcatgcacttccaggtggggcacaattattgacgggacgtggccttgtagcaaggtgaacggcggcaaaacctggtgagctcttcttctttcctctcccgactgaactctcgtcatcaagaagaacagcacgttcaacctcgaccttccattggcacgttccgtccacgcaaatcatctattgtcgccgtgaaaatccgtagagaatccgagaaatatg

SEQ ID NO: 6809 - DNA, 700 bp, Nannochloropsis_gaditana
aatttcgctgaagtaaattttcagccacttatctggatgaaaaaggcactttggtatgggatagccctcaggctctcgcgttgtgtacatgattgcgtgcgagaggccctgggagtggggttgctcatgggaaagaatcctgcccgtctgctgcagctttcccgaggcggggaattgatttggaaacggaataaagatggggatttggtatcaagacgtggaatatagcttctccgttccctgataaggtagaggatagacaccaaaagtaatgggatttgatatgaggaaagtaaaggacatgaagagatgggggggaggttgggaattgaaaaaggaaattaattgcatggatggatcttttgaaaaatcgactaccacaaagggtgaaaaatctaaactaattattgctccctcaccatgtttcggcgtaattccgtgttatgacgcgcaatattggataccatttacgctcgcgatagattgtcaccacagctcaaccttttacaactggcttcaacgtgcttcgccttgacgagggaagtcagcacaaaaagcatccacaaagcgccaaaaataatctcataataatctctataaaacatatatcacgtactgtacgacagagacgtattattaatggattcaattccgtttctgtccaccaaaaagagtaattccggggcaatacccgtatatg

SEQ ID NO: 6810 - DNA, 700 bp, Nannochloropsis_gaditana
gaaattcacggcgcaattcatgtgtgtttctgaagacatgcgttcgggtggcgagaaaagcgtaataatcggtggcacctgacgggacaggcccgcacagtcacggggggtatgaccaagaagtcggggttggaggtcaccgccgtgattcacaatccgactccgatatcagacccgctcgttcgcgccatattttcagaaccaaaagaggtatttcgcgccatattttcttttcttgactcacgagtcgtggaatagtgcagggttttcgcgccatattttcgggcggaaaaaggaacggtaacaagtgagcgcggatactacaagcggcatcctcgccgcactctctccaccattaagacggagatgcgcagcgccgtatgatggactcaggcattctgtgaatgctgtgtactcttctaagaatgtaggcgtagccttgatttcttgacattgaaaacttcgtgtcaagcgtactgcattgaagaggcatgacgggagctgcagtcggatggtcagcaaaaagcaagcgaccccctttttttcaactgccatcgcaagttttttcacgtcggtgcagcctccaagattgtcctaactaagccaattacaggaagtttgtcacgtaccactaactagacatcattaattttctgcacatatccgcacagggccgtcttcgttgctcgcctgcaggatg

SEQ ID NO: 6811 - DNA, 700 bp, Nannochloropsis_gaditana
cgccctcaagatacgcgtgctaggaggaaaagaagggctttatgctttctaccaggtgttctggcgtccatcttacttgtcttcagcgtgacaactactcccgctgccggacttatcctcccccccatcgacgcagcaacagggcctgaggttgccctagtcctccttcacggggctaacgtctctcccgaggcatatctgcctttatgtcgcacgctccaaacagtaattcagacagacgtacgtctgtggataggtttgccggatgttaatctgaatgttcctatctatcttgacggcgctatgaatgatctcaaatctaattttacggctcgcgggctaccggtcgatgccccacgcttccttgccggacactcgctcggtggtgtccgtgcgcaatcttacgctcaagagcatgcagaagattgggtgggagggatcttgatggcttctgtgctcctgcgcgagtacgacaacatgacttaccccgtcccaaccctgaccgtggggggagaaaaagacgggaacatgcgtgtgtcccgcgtcgctcaagcctcgcatgtctaccgcatgcaggcggagaagacggaggatttccccgtggtcgtggtcccgggggcgaatcacatgagtttcgcgtcaggccaaccgcctcttcctgtggctttggcggatctgaccgccgaaatttccgaggatg

SEQ ID NO: 6812 - DNA, 700 bp, Nannochloropsis_gaditana
gaaggctcttccttggtcgactggtgaagaactgcagaaccagcaatggcacaaacgagcgatataaatcttataactcctatatagtagaattaatggcgctataattttcaacctaatattgtttttggccttaactggcattgacgccgtagagaaggtggtcggtcggcttcccgcgtccatttttgaaaatatccctgacagggagcggctaagccccatgacatgttggccaaaatgaggtattgcggtacatgcgggcttctgacatttttcgcaattgatcgtgcgtctcacatttcccaagagaggtacgcgcttttgttcaggtcactcgaaagggaaaaggaaaaaaaaactagagcaggcggcgaagacgaaggtctcgcctaagcgaactgtcagcgagaaaaaacgaggtcaccaacccgcgcaacaacgtgcaccaagaaaacaaagggagcatactatgcccgggtcaagagataacgactgccattttaaaattgacaaagggctttgatatttccgtaggattagtttttcgttccagccaccctacctttcgacataggatatcttctttccataccctgataccagctcctctctcaccattgctttctgaatgccctgttttctcgttttccgcgcttcctcgtacagtacgggatctcaatccaataaaaatcccatg

SEQ ID NO: 6813 - DNA, 700 bp, Nannochloropsis_gaditana
aacactcagttaaaggttattccttgatgtccgacaacccacaatggcatcactttaatccagtcttccatatcaacgtgtgcgagttcgtgaaattaaagcacgaaagacgattgcacaaaaaatcgaacggagcttacctcgaagcggtggtggctgtgttgggcaaggcgctggctattccctctccccctgtcgttccttcatgaaacacgcgccgcatcccaagcgccactccacgcacgcagaccaagagagaaagatcaatgaatcagccctgtggcatggtcagacggtgatgagtttgtgtatgctacttcaggtggtgacatacggggccccgacccccacgatccgagctcccgttggcaagctgttactacgggtcggcccacaggcgtactggagagggtgaggtggcaatggaaaattggtcacaaccatggcgacgcgggtttttggggtgacaaggaggggcggaagcaagcgcgacgggtatttaaaacttgccggggccatgatatgttcatctgcccgctttttgcatgagctcagtgcctgtgctgcttggatgggaggcgcaggtacgagggtgtacgtcctgcccgcgttatgtcacctcacacttttcagtctctcatcttttttttttgtaagaaaaaggcagagacgtagctttattacaagagacgcagtcatg

SEQ ID NO: 6814 - DNA, 700 bp, Nannochloropsis_gaditana
tgccctccacatccgcacaggtcgagcaggcaggcagtgggcggggaccacgtcggtgcgcctacagactccaccttacaaaagtagtcccagatcaggcagtcgcgaccatagcgcacccgtgtccatttccagcaaaaaatccgagtgaaccgcaaccagacggtggccttggccccctaagcccgtcaaaggcctctatttcgacatagttgacctcccccctaagctttcatcaatccgagccgttacatcgccctgacgccgccgcccccgctttggtcatcaacactgccagccagacaggaaatgggcgcaaaggagggacaagttatctatgatcgtgaacatctcgatgtttaatttgcggggataacagtgggcatcgcttccatcccgcggagcttgctactgtggttgttccgccttacagccatgggcccgtgtatcggatgaaggggcgggcttcaggttcacgccctactccctgttttcgggacaagaatgatatcgaatgtagtttttcggactgctacacgcatatatttcgacagtttgacctaattatttcttgcattcacctcccacctcttttccgcgcacgcactcaaatcccaactaggcacgcgcgctcctcccatatcacttgcacatctgatacactgcatctcatcaaccgtgcaaaggtttcccagcaatg

SEQ ID NO: 6815 - DNA, 700 bp, Nannochloropsis_gaditana
atgaattcattctgattgtttaaattgcatgcgtttaatagccaaacggacactttgtgagggatggaaatagcctgaattagggttaaattgaaagtctcaaaacagtgaacaactttaaaatttggggcctttctatactactcgagtctttaaaatggattgttcaaagtaactttttttcttctaaagaaaaatcacttcgaaagcgtttttcgtgcaatgtatgatgctcatcacataatacaaacattttttttctgtgatacttaatgcagtcaggttgttcacatccaacaggctgattcggacatttgttaaatgtctggagaggttgcctgctgcaggagccagaagaaaaatgctccacgctagagagaccgatgttgattcggcttgagtgtacccgggacgtaagtaatatagttctggcggtatgtttcaaacaagggatatgaagaagcatcattcactgtcacgggtcgaatcataaatagttttggaaatggtatgttggtgtttaacctccccactgcagcacggaagatacgtgcgttgaagatagagatcggaaattaccaggagcgttgttttcctacgcggcctatgcgatgcgacctgaagcaaggcaaacatcctatgatggtcttattcgcatcattaatacctctctcattcgaaggcaggtcgactagaaatg

SEQ ID NO: 6816 - DNA, 112 bp, Nannochloropsis_gaditana
tgtatgcgtcctcatgtccccttctgcagctcaccttgtatgcgtcctcatgccccaatctgcagctcaccctgtatgcgtcctcatgccccaatctgcagctcaccctgta

SEQ ID NO: 6817 - DNA, 700 bp, Nannochloropsis_gaditana
cgtgtcaacggaaagccgcgaaaggaggcatgtcaaagaggaagacgcacctggccctgccccagcgtgaattcgaaaggttggttgcggtccaagcttgaatcaaacttgctcccatccttgtacagggtccccgtgtaatgcattgacaacatgtcacccttcttagacttaatgtcgcaagagtccgggcggaatttgacacctacgcgctgttggaagaatatcactgtgaggcccctcacacctttgaacaagaccctccttccgcgtctccccttaccaatttctcgttcgggtcgaggtccacgccatccccctgtttagcagaggccgtcaagaccaccacggccgagagagtcaggaagaaaaggcggcgaagcatggtggttttcgggagtcgctgtatcgggattggtttgaatcagcatgtcgctcaaatcagccattatcgggtttcagttgtggggaaaaccacgcccgagaaatatctacctctagttcaccacgcgcaataccataaacgagtaaaatttgccaaatccacgtggatggcagcaaacattaagcgtggcctttcgagggtcgtgggggggcttttattttgaaacgatgttttcttgggcgagtctcatccgtgctggcgatatcccgacattgcggaggctaacatgaatctgttacgcttgcgcccatgcca

SEQ ID NO: 6818 - DNA, 700 bp, Nannochloropsis_gaditana
acatgtgctgcacacatacatgtatgcgaaagttcggattttgaggtcggcatagggcgacagctgacgttcgcggacgccagatccagggtatgtcagcattgcgtgactcaggtttttgttccattaggggtatgacggaggaaagccgaaggttgttgagcgacaaaagctggcaatcactgtattctgacagacacatgctttttggttgactactgctgtcagccatttttggtcgtccatcgtttttgtttacttggcttcataccagatcttcgaatgcgttgccgtcctctcctccaccacttcaccgtatgtgactcttactttatgttctacacactgtacagggagtaatatgaagccctacccgattgtcactattgcgactctagccattggcgcagtagctgtgcacggcttcgttatcccagccccatcgtctcgacgcatctcgcacgatccttggagctccaccaggtttctgcgatatgtcgacgtgttacaatccacaacactgccgtctgacacacctggtatcagtagtaatagcatagtaaccaatggcttgtacccgtccgatccagttgacgacgcaagctgtgtatctacagaaacaaaccttccaatctccttgaggaacgaccgtatcgttgagaagaagtcaaagcggagaggtccaccgccacctgtcatg

SEQ ID NO: 6819 - DNA, 700 bp, Nannochloropsis_gaditana
tccccgtcttttcttgtcctttcccccgtcgaatgaaccacggggatgcccgcttaatgcaagtccaacaaaacagaagagcgtgtatacgtcgtgacagcaccacgccgtcaatcaaattgtgacatgcccattcattcaacatgctcatgagcctggtcgcgattccgggaagcacgcaggcatggtattaaaaactcggttgccctgtggcgggaattttcgaagctcccatgcaaaatattacgccatcgctgtgagctggttttcatccggactcgtcattgtgcccatagtcgtcttttactgtgtctttcctctcacgcgaacacaccatttttatagcaatgctcaccggcacatattttttacccttccgcgtaaattaggtttgcggggccgctgcactctcctctctgcgtgcatcgagacgaaagcacatcataagcagcagtccatgtatgcgccgcaacgattggtgtcggctcaaatcctattccggcatccttctcttctgtttcttccggtgctgatggggctctgtacgcttgttcccgacgtgactcgtgcttttacgccgctgtacatatcaaccccccccgcgtcgtcgccctccgtaagacattccttcgcttcaccttcagcgcgacagtgccagacgagaagaagaagtccatgggatcctacacacgacctcatg

SEQ ID NO: 6820 - DNA, 700 bp, Nannochloropsis_gaditana
taaaagcgctgcctagtaaatgcaatgaaaacggagctgctaccggatcaaatggcgtgcaaacagcatcatgccgcccggtggagcttaagatcggtccggggagaaaaaagcccgtttggagaaaaatgtttataattataagtcccgcgacccccgaatcacccatttcagtgaaaatgcatttccgacggcacgagtaccaaatgtcgacatgtcttgtgcctgtattcgctagtgcctgcccgacaagcatgatggtggcatcttgaaacgaaggacgagggaggaaaggttgctttagtagctagaaggcaggaggttattgctctggtgactaattatgaggacgagactgctgcacgacgcttgagtaggaaagcgataaaccgacaatcacgacatcatttctgatggaaaatgcccggattcgagataagggatgcccacttcaggggtgcgtcgtatattgacccgggggaacggagggtatcagaggagctggcacgtcttgctttcagagatcgctcaacgggcatggtatccgcacgtcccatcgtgaccttactttgcattagttcccgttgattcgcgtcaggacttgcaggacatatgcactcaatatagacctggtaggttaagtatacgtgtggatatttttaaaagttacataactgtccaacaaccgaacatcagcagg

SEQ ID NO: 6821 - DNA, 52 bp, Nannochloropsis_gaditana
atgccatacttgattttccttcacgcatctgtggattaaatagaacaccatg

SEQ ID NO: 6822 - DNA, 700 bp, Nannochloropsis_gaditana
agaacaaagaaggattgagtgcacgggtaccgctataggcaaagtcgctcgtcgatgctctggctctacgacacacggggaggaaaacgacaggcatcaacggtgcagaagcagccaatgagctttccttcctcgctattcggtccacaattggcgtcgacccttagtttcggtccacaagaagctagcctcctcgatctcggtccacaagaagcttgcctcctcgatctcggtccacaagctagatagacccccccggcgataaagaagacctgacgatacgaacacgcaagcgaggtcattcccataggggtttcattctttgtcttttgcttgtaactcgtagctcttctcactgtggtccgtactattgattcgacaggcagtcgattaacagaaaatttacctcgcctcgccttgagacacggacaacgcagaagagaacaggcaactacctcgtcgtcctcatttcctgacctgagcaaccttatacctttgcagcatggcgtgcttcatgtttctgcgtcttcttgtggtcgttggtacaatcgcctcacccatcacagcattttttacgccctcgggtagtccacttttccgatgcgtgttgcctgccaagacatcaccaccccaacctccccacgctgtcggaccttttgccacagtcgcgcaacctgcacccacgcctgtttccccgatg

SEQ ID NO: 6823 - DNA, 700 bp, Nannochloropsis_gaditana
ttgctctttcgatttttttagaagcgggatcttgcactcttctgggaccttttctataatagtaaaaggacttttctccgtttcttcgttttgttttttattcggcgatgttgtactgaagggtcttctgcgggttgaggaggttctctcgacaagccacgcgcgccatacgttatttttactccatgcctgctcctgcttgcaatcgctgaaagacaaacaacagacccaatactgcttccaacaaccttgcgacccccgggcacccgaaccacagccgtccgcgcgcctccgccggtcacgggggcggggaccgttccgatccgttcacgacgctcgcgtgacgcgtggggctacgcggcacccggctgggcgattctatgtctcgtcggcgcaggctgccgggcgccttggtgcttgtgggggcatgtaccggccgtgtctttgggcaacaaatagtcctttatacttgccgatgaacgagtggcctaccgggtttctcaggggttctttcgccctcttctttcccgaacgccaaggatttatcccgtgttgcagccacctcccgcggcacgagggagaggagcatagggcatagcatcctgtcgtgtgaaacgcattttttcagggctcgttgtttaaaagttgggcctgacgaagtaaattgatgacgggcatttttgctatttttttgtgaatc

SEQ ID NO: 6824 - DNA, 700 bp, Nannochloropsis_gaditana
agcgcgtgaacccgtccaaggcaacgtgcaggaagcccggctgtcttttttgagcctgcctcctccaacaccgtttgctgaggctccatgaggccgtcatggtgacttttacggccacgcccaagggagacacctagatacaaaggaatcccaagaggtacactgaacgacatgagtgtgggcttcttttggctgcacgaagcttcattagttgtcccccccaagacccctgagataaccacacagatggcaaacatgtttacgaacactcgaccgtgccatcatttaaatctgcgaactgggttggtgcttttgccgtcgtggggagccagcccgcatgaaagcttggcaagacgataatatcataaagagatagaaaagacacggccgtcaccacgcagcaatcccgacgccggcggtcactgagacctcactcccacgatatacttcaaaacgtgcccatgcgcgtacttgcggcatctccttcgcacttcctcaacgtgcacggacatgggcagggacagcgagcggtctcgtccgacattttttggttgcatccaggcgataaacaagcatggccgcagagagtccctccgctcgccagtcgtgacgtcttcctttgaaggcctgcgggaatggccatacaccgtgacttctccactcaacgccgtattacacccacgtacaggagtaaaccatg

SEQ ID NO: 6825 - DNA, 700 bp, Nannochloropsis_gaditana
cctcctcctcgtccgcatcgggggaggaaggcgatggggaggcggaggagttaagcacgcaagctacctcgtcctcttccccctcgcaggctgcgaaagggaaagccaagaatgccaagaagaaggcacccccggcggagcaatcgacgccgtccgctcgaccgctgcgtgccccgagggagggatcaggaaggaggcagggcgctcagactcgagtcggaacaagggccgttgcgtccatggacacacccactccttccacgtcgaggggctcccaagtccggaggcgcggtcctcaggaagtggttgagaaatccgtggagcaagggagggagaagagcgagagccaaggtgatgcagggactcggggaaaaaggaaagcgaatgggagtaccggacagggtcgtgacagaaaaaggaaaatcaaagtgtaaggattttggggctcatcaattgactgatgtgtgtaaagcatcttttcaaagtaaagtaatgaaaaaagtaccgaaattgtcagccacttgcgtcccaagagaccatatgaacgatccaaatccgcatcctcctccaaatccaggaccaaagcaagtccaaggctctgtatcaggacactcttgcgcgttaccgacccacattgtttgaatatttattatctgtcgatccctcctgttttgacgaggagacacactcgtagtggcgc

SEQ ID NO: 6826 - DNA, 54 bp, Nannochloropsis_gaditana
cggagtacggggggcgggcggacggaggcggagctggatagcttgcacgcgatg

SEQ ID NO: 6827 - DNA, 700 bp, Nannochloropsis_gaditana
atgcatatataccattacacacaagcaagccaaagaaaagcaacctttatctgccattcgcttacgtcatgctaacatgggcaccggacacggttcaaccatccccatctcctcccggtggtagatcaggatcaataaagcgcgaaaattatcatcacgcagtcaaagatccgtcactccatagaatcttgcattcacttacggatgcacataattttcctataaaatgagctgtcttacgcaacaatgcctcgacccctcgccatagccgtagaggagaaaatgatttcgcgtaagtttgaacaaatatctcccgaaaacagcgacattcttcacaaggaaagttcttggaattatatcaacggttaaaaaaggtcattcatgcgctgactcgacaagatatgggctgttgccttccagaaagttcacaacgtccgtatatctaatgcggcaggcaagctcctgagttttcaggacaatgtctcattatttcgtgtgatatactgattagagcgaccattggtcaccatcggtaaagcgagctcgcctatatcggacttttgcttaattgcaaaaacctccgtcttattcaccctttcattgcattttaaagcatttgtatctcacacattcctacacttcttgccatatctgtagagattacgcgggaagagcagtaaatgcatacctctcacatatg

SEQ ID NO: 6828 - DNA, 700 bp, Nannochloropsis_gaditana
tacctcccaatctctctcttcccttttgtagtcctcttgcttcctcttgcctctatttttgcgcctttcttggcatggtagcaaacttagatggtagcctttaccttcgctctttatcctgtcttgttctacccatctctcttcccgtccgtccccttcgactctattgacggacaccaaagcgtcttttccacccacactgtattgataaagcaacttttgatagttcttctctcccttttcttgttttcgttcgattcgcccccccttcctattcccagtggcctctggctggccttggaagggtggtatctacttccgacgagccgtcatgcgctaccgtgaagacaccagccccattctccaaggtttcacagccgccatacgacccaaggttagccactttctccctatgctcgtctcttattccttttccccttttcctttgtgtgggtgccgaaggaatgactcgcttcaggaaggatagaggggagtagaagggaccaggtggcggtggaagcgtagcgttaggaatgaagaaggtcataggaaatgtacgcgacggagagacaagtagagcatgcaaggacaaagttcaagatggagcgtttatgtcatgcgtggcaaaatgttggtcatggcgcaccaaagcctctgccccttccattaatcttccctccctttctcctcaattcaggaa

SEQ ID NO: 6829 - DNA, 700 bp, Nannochloropsis_gaditana
tgtgcaagaagaagaagatagtgcaagcgacgttgaagcaaggggcatagataggcttgccaacgtttgtgggacgtgcggggcgcggcgacgcagaggatcgaacatttactatttaccaccccttccttctgcacgcccggcgctcgtagaggtggaggatcgcacgggaagtgtgctcgcgatgggtcgtcttccatagtaaaaatgaatggcaaatcagtataaagaaaatttccatacagaacgaaattgattgttttcgggtggggaagctacgaaaaatcgacaggatatagaaattaacgagaaagaaaatgtttgaaatcaagctttgcaaagtgtttcggaaacgcttacacgtaatcgagcttcacaaaatttgtccacgcgcacaggctgggagagaggaggttacgaaaagattggtaaagcgctgtcttcagacccagaatttcgttgcttgtagcaactgattctttcaagattcccacagcagtcccgtaattgtccaagctacctatgcagctaagaagtcgaaaatgcccgggaaactttgtgacagacttccctcgctgaagctccttttaaagcgttcgctcctttttgttccacggtggcgagagctcttttgccgcccttgagtcttaccctccgatacacatttctccacacttctcggcaaagacgaagaggaatg

SEQ ID NO: 6830 - DNA, 700 bp, Nannochloropsis_gaditana
tggaatatcaagcgttagggacttctcagtccatgagtaattcccattcaattggcggcaataccttattcttcgctgtcatattgagattttcattctatagatcgctgtatgtatcacgactgatatcccatgtgctattgcgctttatttcgtcacattgcgtcatttcacaacttcgttggcgttgccggcttagcgtcgggagattaatcagtgatgtcctgtctctcacctgaagccgcaaatagcgatttttttcccgatgttagatataactttagcgcacgttgtaagagaaagctcgtatgtaactttattggacaagatacaatcctaacttcacttaaattgttctcgatttcctttccccaacatgcgctgttcgtctttggtccttcctctgggcgagaaggaaagcaacccggagttgaagcccgcgggagcgacagactactttcacatgtgaccgagcaagtgggtcttcgaatcgatgtcaaagaaaaacaatgtgattttggatatgaggactctcttacaggaataaggactctgaaatttgtgggaggtgtccctgttgtttgttcgtttgcgtggcatgtgcatgccagaattatcgacggaggctcttaggctcaggaagctctggtcgacccccgtgaaggctaaatgtccctttatatctctccaaaggatcatg

SEQ ID NO: 6831 - DNA, 700 bp, Nannochloropsis_gaditana
ctgcaccatggcggtgaccggtcgtgaggccctcgacaacgactttgccaccagggaagtgaggggagatccctatcgttatcttgtaaagtgattactgtgcctttctcttcgctaccggtaccgtcgattatggtgaattactatactaataatgggacggatggcaacagagggtgagactttggcgacccgcgagtcaatcagccgacgactgtgcgctacgtgatgaagaaagaagaaaaaatcacgagagagcctcttgcgcagtccttatcattttgtctcgaaatactgtacagaattcacacgggaatgcacaacactttcccggggtcatttcccatgccctccgatagcccactcagagcgttcgcttacaataggtatgcgcgcggattaacagtagctttcccagtcggcgacgtgctcgagtgtgacaaccgctaccagagtcagagtagtagaggcgcagattcttacgctacaagcgcgtacatttttggcaatgtttttaatcctagggatttcgaaaggaagatccgcccggcttgtgagactggaggtagcaaaatcaaaaggcgggcttcgaccccgccagacaggataaagcaagccgcttcaagcgccgcgctgatgcctataaacaatatgaagtaacgtacatcgcccgtcattttcgacaggtacaaaaagaatg

SEQ ID NO: 6832 - DNA, 700 bp, Nannochloropsis_gaditana
agcatgtcgtaccatcctttagtagaagaccccgaatggaaactcttcgcgtcgttcgacagtctggatttcagttttgtggggggagctatcggagtctgtcggccagtaccacaagaggtgagtgagggacgtatttttccggtcttccaaaagagcagctgttgaggcaaagctttaattgattatcaaagaatagagctgaaacagaaacgtgagcacttctcattcccctttgcctgctctgtcgatcttctcttctgctcttcctcagttttccccgatttacaaagccaccctgacgatgctgaagcccacgatcctccgactcactggccttggatctctctttcttggcaaaaaagagcgcgaagtcatgctttgggacacaccaatttcccccacagccgcttccgtcagtcgaccatcctcctcccgccctcccgcagacaatttgcgattagcggatcagatgcttcgtctcgccttggtggggaagccacgccgttactcctactggtatttgcaatatttcacaactacggacgtcggtaaattactggggcgatggcatggagattatagggaggagtcaatggaggaacggaggcagggagagagcgtggagaacaacgtgatcctggctaagatcgaagagatgacagggacgaggatcttggtggcgccccatgatggaatg

SEQ ID NO: 6833 - DNA, 700 bp, Nannochloropsis_gaditana
tcctcttctggcaccacccgcagttcttcaaattgctccgacaggtcctccgccccgatgtcctccactacattcacgtcattttcggcttcaaaaaattcttcctcctccacatcatcacgtccctctacagctggtatctcttttgcggaaaaatgagaggaagaaagggacgcttctgtgtatttggtcctcatcgtgcccgggcccgaggatgtgggcgaggacaccgacacaggctcgtctgccatagcgaaacacccctgtgcaagatagtcagaaaagaagacaagtgccatcgcgtgaaaagatgtggaatacgaagccacgagaacaccacgaggtctccccgcctgtctggaacgcggtttgcggcttcgacgatgaggctcaatgttctgaattccagagcttcgattcgcccctcgccaagagggagaccgcgaggagcacgaggagctcgtgcgtctactcgtttaatcccacaacattgtgaggaaaggcacgataggggtacatggcctgctttttttcagtctcatgatctgtgtgcttcgatttcgacgaaatggaccgcatggtctgactgcatctctctcacaaacccaccctccttcgcttcctcccattgttccttgcaggaggaccaccgtgcccctcgaaagcaatcgcaagcgacatcgtcaccccttcgagcatg

SEQ ID NO: 6834 - DNA, 700 bp, Nannochloropsis_gaditana
cgatatgcaatgccagaccaaatggtgaaagttattacgcacaaaatcatctcgatttccgaaccgatggcaataaacacggcgttggctgtatacgatagggaggcaaagggcgggcggcccaaaaaatgcagcatgccaagatctatagcatgtccctctttgtcatgcactccaaatagtactaccagatagagcatgttgtaactgcacgcgaggtctcgtaagcgtgtccccgaggttctcgattcattgaacgagtagagtagccctcttgtgcgacggctgacatatctctatgggggcgagataagccctccttgtaatgttgcccagacacaggcattcaagacaccatctgcgtcatgccgtttgcgttgtgatgtcgtcgatgcgaccatcagggatgcgtggacagtctctgtctctgttcggcttgtatcaggcaggcgtgccggtgttttttaagtgactctctgtcgccaaatcggcttgaggcttccgtcccttctttttccttgccagttaaaagtcacgcaaacctggacttcgcgatcccttctgaggccctacagtagaagtccatgcagcacatgatcatttgctcacgcgtacggtattgtcttaccttctccgtcgcaggtggagcgacacaatacctcatcgtgagttcgaggaaatactacactaagcagccatg

SEQ ID NO: 6835 - DNA, 700 bp, Nannochloropsis_gaditana
taggtgggtcttttctttttcatcattcgtgcgtgtggggacaccgaggacgacgggagaggtctaatgccgcgcctcagatctctcatactcgaaccagtaccatttagacaccctctcctatctgtcctgcacccataccttcttcttgccgttgttgagccgcgtattgcgtgtaccagtccccaaaggactggctcccgcctcctactgctggatttgtgccaccagaggtcttcatccttatgtgcatccacttccccccgatgcggtgactgtcggaggccagggggtgggaatcgatgcgcacgtgaatgcaatgtctacaacgacaatgctggccgtgcggaggcaatccagagcacaagaatggtgtatagccttcttgtttacgggaggggtttttctttttccctctccctgtgtataaagtgtaagtgcttcggtgtgtctactacacccctcgctcgactcgctgaggaattgaatgcccactcaaatgtctcgctccgtccccgtgaaccgaattatccatgctcatgaccagctttgagtatacagtgtcatcgcaacttgatgtactcgttgctagggactactgtgtgcgcagtgattgacttccccccccacctgtcctcatctgacacaggacggagcttttcgacgccagacgttcctctccccacgttccaccacgatg

SEQ ID NO: 6836 - DNA, 129 bp, Nannochloropsis_gaditana
cctcccttcctcgtcgcccccctttccgcccctcccgccctccctccctcccctccctccctccctccctccctacgatgctccgtgaccaaaaacctgatccgccacctggctgcatgtgagacgatg

SEQ ID NO: 6837 - DNA, 700 bp, Nannochloropsis_gaditana
ataatggagtgcggcggctgcaagagctggtagcattttgatcgcattgagaaaaagaagggaaaggtagtgcggaagccggtggaggtcgctgcgagcagcgagacgacgcagtggtcattgccgccgcgactccaagagcacgacaaagaagtaggtacttcgggttgaaagagccagggaaggaacacggtgaactcatagatgaagaatgtaacagtaatataacgcagtttgaatgtgtttaatccttcatcgcctttcagttcgattttgcttttcttgcccttctcgtccttgtaagctcggcccatcggactcaccacttcctcgacgagaaaaatgtaagcggccgtattatcgcatccacacccgctctaagccgctgaaagagctcctaattctctttttttgacattccaaaaggttcggtgggggaacttttagggacctcgaggaggtgggtgccccgtcaccaaattagatcccagcggccttggttgcactttcttgagcgagtggaaacatattcttatagaaaatatgaacttggtcaacgatttaattatctcgggcctccattgctttcatggttcgtgctctttcaaggcttacatgcaggtgtttttgttcacccttagttcatactccacaggattttggttgtcccgacactagccattttgacctcagcaccatg

SEQ ID NO: 6838 - DNA, 700 bp, Nannochloropsis_gaditana
tcgttatcaatgtggagtcaagggggccaatttgttcgtttgaatcgtgtgccggtgctctagcggtagatcgagcacccatgacggaaggaatacataaaagagcgacaaaatacgaactaacccagctcactgtgtaatcatcattcataccatgcatatggttcattcgacaatatatgcgaaatagatcagcactagggggcacattgtaataggtctgcggtagctgcttcgaaacggctcgtctaacggctcgtctaacggctcaggcccgagcgtcgtcaatgtttcgaaatctgcagctggagcccaactcaaaggtaaggagtcggaaacagcttttagtacgccctttactttcaatctagggtttataaaacgctcaaggggaaagtcatatccatcgtgcatcgagcagattttatttgtatttgatcaaagtggagcttgacgcagcaacgatgagatgatatggaagttggtatgtcgaaaaaatcccgtacgcaacaaaaatgaatacggccatgggaaatgataataatttcaattgtgaaacatcgagtaaagatgtttggttggtggttgatggttgaatgttcatcgtgtgcataaattttggtaaaaatgaaggtgacatctcctttacagaagaggccgcttacagactatatctcggtatttcacctctccgaaaatg

SEQ ID NO: 6839 - DNA, 700 bp, Nannochloropsis_gaditana
gtcctcttccccgccctatcggttcccaggttttcccatgcctcacgaccatgacgttgacgagcgtattgctcgcgtccgccttgctttgagagacgcgtgtcaagaccatgtcctcagttatgtcgacgctggcctcgccactccggaagagacagcgagcctcctcacacaaatcgaagcccttgatcttcctgaattaaatcgcatttttaacggactcggaatcgagccatcggcatccgttgctgcagctgcggggaatgacgaatatgcaccgctgtctgatttggcctcggtagataccacctcccctgccctcttgcgagagtgggaggagatgggcctagacgccattggccgcggaaaggttgcggccttggttttgagcggtgggcagggcacgcggctcggatttgacggacccaaaggaatgtatgacattggcttgccttctggaaagtccatctttcaattgctagcggaaagaatcttgcgagtgtcagcattggcagcggagaggttcctgcgtagtcccgaaggcaaggactgcccgaatgagggatcaacacggaagcacatccctttctacgttatgacgagccctttgaatcatgagaagactcaggacttcttcaaggaaaacaactactttggcttgtgccccgcagacgtctttttttttcggcagagcaccatg

SEQ ID NO: 6840 - DNA, 700 bp, Nannochloropsis_gaditana
cgatggtaaagagcaagcgccacccgcagggcacagctttacggccgcagtaatatcctcgtccggacagataataaatattgagtatacacgctgtttatgtctacgtgtgctttgtgccgggcgggcaaaggggctggttcagctgcaagtcaaggtcaaaaagaaggagaatcgcttggaccgtcattatcgctccggcttctctgttgcctttccgggcgataaggtctttcacgagtcctcttccccgccctatcggttcccaggttttcccatgcctcacgaccatgacgttgacgagcgtattgctcgcgtccgccttgctttgagagacgcgtgtcaagaccatgtcctcagttatgtcgacgctggcctcgccactccggaagagacagcgagcctcctcacacaaatcgaagcccttgatcttcctgaattaaatcgcatttttaacggactcggaatcgagccatcggcatccgttgctgcagctgcggggaatgacgaatatgcaccgctgtctgatttggcctcggtagataccacctcccctgccctcttgcgagagtgggaggagatgggcctagacgccattggccgcggaaaggttgcggccttggttttgagcggtgggcagggcacgcggctcggatttgacggacccaaaggaatgtatgacattggcttgccttctgga

SEQ ID NO: 6841 - DNA, 700 bp, Nannochloropsis_gaditana
tcatcaatgaaaaaaaccagcatccttcacatcacatgcgttcgcaaatgccctaaattgacaagcagactggctcgacgatgtgtcactgcccactaagctctgttctcgtaatgcttcgatggtaaagagcaagcgccacccgcagggcacagctttacggccgcagtaatatcctcgtccggacagataataaatattgagtatacacgctgtttatgtctacgtgtgctttgtgccgggcgggcaaaggggctggttcagctgcaagtcaaggtcaaaaagaaggagaatcgcttggaccgtcattatcgctccggcttctctgttgcctttccgggcgataaggtctttcacgagtcctcttccccgccctatcggttcccaggttttcccatgcctcacgaccatgacgttgacgagcgtattgctcgcgtccgccttgctttgagagacgcgtgtcaagaccatgtcctcagttatgtcgacgctggcctcgccactccggaagagacagcgagcctcctcacacaaatcgaagcccttgatcttcctgaattaaatcgcatttttaacggactcggaatcgagccatcggcatccgttgctgcagctgcggggaatgacgaatatgcaccgctgtctgatttggcctcggtagataccacctcccctgccctcttgcgagagtgggaggaga

SEQ ID NO: 6842 - DNA, 700 bp, Nannochloropsis_gaditana
accggggccaggggatgtcgtcctcccggtgctttttccggaggataaagacgtggagtttttgatctcgcggaccgcccggtatgttgccaaggacggcgggcccctggaggaacgactgaaggtgacagaaagccaaaacccacgcttccgcttcttgtgggaaggggactcgccggaggctctcttttaccggtggcgcgtcttcagctttttgatgggcgacacggagacgaggtggcgggtgcggccctttcaaatgaccgtcgacggtccattctgggcacctcccgccatcccgggggcttggcgcgaccggcgggaggtgaaagaagaggccaaggaggagaaaacgagcgactacggggagcgagggcgggaaaaaggccgggatagaggtcggagtcgaagcccagagaggaaaaaggaggcggggaagaggggccgaagccggagtcgagggagggatcgacggcagagtcggtcgagagagagggagaggggtggacgccatgagagcaggagtagaagcagggagaggagcaggagccgagaaaggggtcgacgtcgccgtagtcgaagccacagcgccagccgaagccgaagccgtagcccgggcgggagtcggagagggggaggtcgggggcgggtaggggcccctggggatgaggggcaagaagctgtcatgcccgcggctgct

SEQ ID NO: 6843 - DNA, 700 bp, Nannochloropsis_gaditana
cttgattttccggaacagtcagaagttcgtgaaactcccgcccttgcatgaggcttgaacagacgcattaatgtcccaaaacgcgtaccacagggcgctatctacccgcaacgcgctcaatacatctcacactccaacatggacaacatctcgtcctcgcatggtgccattactcccacgtggtcgggccctgaatcccttctcacaggcacgagaagcgcttcctctgtcagggagccctctcgccggtgtcgcttaatccctctgtgaaatacgaagccagacgagatgaagtcgcacgagcccgcagggccggggtgcggcgcgtgctctcctccattttttgacggagactttttcggattacgctttcggactcccagactcgaagtttggaatttaagactttgccaagccgcatagccaagcagcagcctccccaccctccccaaagcaacggtgggcaacgacgggtacagggcgtcgggacgttgtgttaagcgcgcaaccagccgtaggaaatgtccataattgtgatttgagcatactctgggaagtgaatttcacttatggtggttttgggtttgtaaaagtttgcgtggggtcgccttctccttggagcctcgttgcgtgcttagaaagacatcaaaagcatcatccctactccgccgattacgcattcaacattccttcctgtagc

SEQ ID NO: 6844 - DNA, 700 bp, Nannochloropsis_gaditana
agaacgcctccggagcccccggtggtagaaagtttgcgtaaattaccagccgtcttctcaagatcttgaacgtcctaatttgtcacagtgagcgaaggaaattgagaaggtttttcgagacatggtgaaaggcgacataacaatatgtatcagacaggggagaacttcgagagggcggaagaaaacgggaaagtaatcatcggcatcgcatcattattttgctcaccacttcatgtattttaagtgttgtcgctaaccctgtcttggcctcgagtatctcctcttcagtgaagactccaggcaataccacgaccccgtctcggcgaaaggcctccagaagttttggcggtacaagatagctgtcttcattcaccattcccggggctgtggaatttcaggattcatgtgaagggaatttattagaatgcgacagaggctacttggggatagcagcgattcgtttcggggggtgaggaggttaaaaacgagaaaggaatacataagccatgattggccgcgtaagggcttccttgtctcttggctcgacgtctttcactctattctatctcatggcagtactagggtgttattaattgcatagttgacgcagaatgcttccgtcggaggagggaggttccagttcgtacatattaggtactcaccgacttactgtagcaagctttgccatctcctcattcag

SEQ ID NO: 6845 - DNA, 700 bp, Nannochloropsis_gaditana
catctgaaatctcctctctagttcctgaagtttctttgtcacattcttcgtaattggattttctttcatcaaaattcatagattggctttccaaaggagggggcttggccggcgataaaatgcctcgctcttgaagcacaaaagccggaatggaaatggagggtgaaaggggtgactgctcctgtgtcatataactacagtgtgaggtagtgtttcgtcgcctgctgctcaagtaagtgagtaaacggtgccaccagcgcattccaatgagatcgctttaacgggtacgttgactgcaagtggggtggggaggttaagcgtaagcaccaaaacattttcaagtcttaccgtgcgaggagaacttatcgcacgtaggatcacaatgtatgctcaataagtttcatgcatacaaattcagggatgaacgcggcagaaacgtgtcacgagcacacggcggctggataattcctcggagaaagagagcatcgaacctatttgatgtctcctgtggttccattcgcttaattcgccttcaaaactatcgcgccattccttgacgtcgacttgtgtcgaaaaaggttttgacagacaattccctttgctgacagcgatgtacataacacagtcgatcacctctctcccacatttgatttttcctcaacttccctgatttattcggtacagctgagtggaagtaatg

SEQ ID NO: 6846 - DNA, 700 bp, Nannochloropsis_gaditana
tcattcatgagttcacgggcaaaacttacgatcttaagcctccaaaccttttttctagtccattattctcatcatacgcgattagcaccactcttctgcatatctttggtatcaaaagcttaacttccagccaaggccaaaaaattatcttcctgtatgtctgacatttacacatgaccgggcttccagctagcttatttgattgcatataaacagaaatggaagtcttaggaaaacaggaaaggttgtcttggtaaagaaatgttgagcggaaatgttcacacataaatacccgctttacgtgagcaaagttccttccgatgttcgtcaatgaataaggattgctagaactgagaacggtaagagaacaggtctataactccgctctcatgaatcattcgacgaagaaacaaggcaacacgcgtgaggcagggcaatcgctgtcacagagccctcttgtctccccttcactttctttcagcacttccaaagcgatcaataaccaacatctgcagcttcaaaggcactctttgttcgtgcaagttcgtcaagattgtgttaacctccagatcattccaccccccagacgaacgcgcaggcgatatcaaccgtgttgtgcacgtcgctacctcagcaacctcccctccgttcgtagtctcagctagtcacatatagacctactatcacttggaggaccatg

SEQ ID NO: 6847 - DNA, 700 bp, Nannochloropsis_gaditana
ttcctcacgtctctatcaaataaaaaaatgcgcgctgccttcctcgctgacagctcgtaagcgccgttacttaaaatctgagagtgaggtaatccaaaagtacctccaggtatccggaaatatacttgacttagatctagcattaaaaagtcacggcaccaataaaagtcaaagttctaatctgttttgaagacagtatcgacttgattgcgtgtttgaacgatgcgatactcagctggtgcaattctggcataaatcctccgtctaagcgagaatcgaagccgctcaacactgcactcctgtcatccacgagatctcatctcagtttttttttattttaaactctcactacgcccaccgttgggaaagaatttagtcctgggtgcgaagtatggttttactttttactgtcttgctgcgagcttatttagtttccagggttacccccgaacggcgaacgttgtcctcgctttcgccgtcggagtttcggaaccacgtctcgtaacacctccacgagtcacaaagtactcaggaagactcccctctcatgttaccttacattcaaagtgttagggatcagggagaaatggattcctttgccgcccatgtggacgaagacattgtcgtcccgtcgctgttcgcgcgagataccccaagggcctgtgtggaaaaagaggaaggggaaagaccagacaggatg

SEQ ID NO: 6848 - DNA, 537 bp, Nannochloropsis_gaditana
gtctcgtgactggtagggagggaacgttaccgccctgcgtccataaccctcccttgccgcctctacgcccacggcccaagccggggagagcgctctgcgcccggtggcctacttccctctctcccgcgtggtcgcctcctccgcccccatccacatttccaactccttggccgtgcacgggcaggtgaggactcccttctttttctttgcctctttttttcgcgccaaaaaagcgtggattgggaagttcgcacccagcggcttgctctgagctgatctgggtacctacgcgttgattgtcctgtgactgacgccatgaaggagtctcattgcggacacgcctatataattcttctggtcgacttgcaatgcttgattgaaaggaagagtatgatgggggttggacattggcccacattttaaagactcgccagcacggcttcttcccgttccgatggccctccctccctcccttcctccctctcttcctccctcccttgttcccagggagtctacatcgtcacacaggaggagatg

SEQ ID NO: 6849 - DNA, 700 bp, Nannochloropsis_gaditana
cggccaccaaagtcctcctttgtcaccattaatgttccagtcccctctagttactgcggagcaggtaggtaaaatttgttagggttatgaagggtaagggagatcaatcgtatactggagacttgcgaatacaatcttgcgcctgtcccctgaggtcaacacggtcaggctgatatgacattctttttgttttcaatgtttttcaggtgaagtcttccctagctgaaagtaataagagtggagactcaaaagggcgcagcattaaattcttagactcctcgtggcatttggacaaatcgcgggacgccaagaaggaatttttaggtaatgagtctttaataacgagtggttaaagagcatcaactcgtttccttgaaaggctttcttggcacctgcttttacgatcatacaggatttgctctaaccttactaatcaccaccctagagcatctttccgaaatccccttcaatccacattgagtgcccatgcacccgaatgttccccctacctgccttctctttcctcttaattcgcaggggagcatctaccgggcgctcaatttttcgacattgatgccatcagcgacacctcctcacccttcccccacatgcttccgtcggccaccgccttctcggaggcagtctccgccctaggcctcgagaataaggatgagatcgttgtatacaccacccagaaatg

SEQ ID NO: 6850 - DNA, 700 bp, Nannochloropsis_gaditana
ccacggcaacattgtttttccgtgctgccacctgcgtttcacaatgtattataacggtgttggtacaggaatgaaacgtctttttctgcaccggacgaacgggttgattgctcgccttccacgcagccctaccttgacgcccccgacctcccctctagctgccatgctgctcaagtgtctcacaatgacaagtgtgatgtggtttggtgtcaccgccagcgcggctcgtccaaacgtgaatatcggatcgtcaaggaattccggccaccaaagtcctcctttgtcaccattaatgttccagtcccctctagttactgcggagcaggtaggtaaaatttgttagggttatgaagggtaagggagatcaatcgtatactggagacttgcgaatacaatcttgcgcctgtcccctgaggtcaacacggtcaggctgatatgacattctttttgttttcaatgtttttcaggtgaagtcttccctagctgaaagtaataagagtggagactcaaaagggcgcagcattaaattcttagactcctcgtggcatttggacaaatcgcgggacgccaagaaggaatttttaggtaatgagtctttaataacgagtggttaaagagcatcaactcgtttccttgaaaggctttcttggcacctgcttttacgatcatacaggatttgctctaaccttactaatcacca
